United States Patent 9,567,581 (SELECTIVE REACTIVATION OF GENES ON THE INACTIVE X CHROMOSOME) - sequence listing, part 51

SEQ ID NO: 5549 - DNA, 1369324 bp, human
agacaccttcccaaacagcaggggttgtgtgctttcacatagcagtactgtacaaggaaaaccccgtcggatctgttattgcgggatacttgtgaaatatacataggattctttcttatggctgcatcccggatctggaaattttacttggggaccaggaggatttgaaaggctgcatgtactcagaagatttgcaagcaacactccaattcttgtcatagagctcgcagacttctcacttatcggcttttttccttccttattttttaagaattattcttattttcccctctctttttctgctctctcctctctcagtctctccttttctatctgcctcttcatttttctcctagtctgtttttttttttcctgctctgcacctggattgtatcttcagcaaacaatcgggcactttgagaactaactggagacagtcttgtagggaagatctgtatggaattatctgcttttatggtgaacttggcatttgtgaatgggaatcttgttcacaatattaattgctagcaaaaacaagaaaaagaacacaggagtaaaacgtggatttttctgaatacgcattgtgatgaccagcaattaccttaccgactaatatccagaggagaataatttggaagactgttgtgggtaaggtcattttatatatgcaaacccatcagtggcatgagcaaacttgggcatttgtaatgggaatgggtgacttgaatgattgctgcatcgcattgatggctgtgatgtggccgttattggcactgaatggaataactgcagttgggtgtgttgatatgtgtgtgtgtgtgtgtgtgtgtgtgtgtgtgtgtgtgtgtatgtgtgtgtgcgtgtgtgtgtatatgtatgtgtgcccgtattctgagtgcaattgaaaatcaaagtatcactctctcccccaattattttgatatggaagagtgtcttgaattaattctgggtagacactctttgtttgaatgtaatatttgtggcccctgcgttctggaaggggtagcagcagtaaaagaaacacttagtgaagagccccatttaaaatgaaacgagctactctctatgcattaaaagaaatatgttttcaactcagtgcagcattctgctgcatttcacagccgcaatgggaccagggacatcccacttgtcaagttcttaaactttaaggtgataatcatcgttaattgttctctaggttgtggttactggagattattaagcgccctgggctacttttttatctactggattatcactcagagtgaaaaaaggaaaagaaaagaaaaagctaaaaatgatggctaacatagagaagaataaggcaacattatcttaaatatcaccacagtgctttctttctcaagttcaattgcccaataatataattatttacccaatatcctaaatagctgaagctgagacccacgtgcaggggagtcgaaggtctgaaagcagagaccgtccttttattgcaatgcagccagcttgggaaatgcaggcaattaattacatacttcccctaaccttaagttgaagatgtgtcctgtctgctacatctattttaccctttcggtaaaaagttagagactagaacactaaggatgtttaagcatattctgcctgggaaatgggataaagaaatcaatattgatgacgtggttcagtgcactgtactgcaatgctaaagttccatattcagtgcctgtgatgagagagtggagcatttacatatgttataaatctcacctggtagattgatccaaaggggaggggagaagatatgtggatatgtaggaagatggatggaagtcgtgcataatcggtgattatgtaacttcattacatcagcgagtttcagtcaacgatagtgagatgagatgattgtatagagagaggctccatcaccctgttaacttttgaaggcttgtaacagctaacagaggaggagggcagagagagattagctccaagggtcctgtaaaccttgatctctatggcaaattttgcatgagttttctcatagtgagtttcggagggacatcagatcatataagctttagggctggacaggaccaattttagccacacccgtggagagtcaaaatgagtctgcgatgtttcagaagtgccccattgagtaactgggactgatgattccagccaaggtcatagttctttaccctaggattgaaatatatgaccccaactgaatggaaagttaaattcattgaaatgatgactgtgaacggaatgaatatttagggtcctttcttgcatttttcctggtagagcttgatgcagatttcagcctggtggttccctcataaaaatgatgattgcttccacagcgtgtcagaaatgactgttttgtccctttatcttaaccatgacaatctctttctgggccattttaaccttctgggaaaagagaagtaaaagcattcaaaggtaacagtaccctgttaaattacaaattaaatggcactggattcattattaacacaaatcccagaaaaaaagagcaatccatgttcaagtttcacttattgaatggcttaaaagacaggttgcagctgccaaagacttttaccatcatatgagataaatgtactgtgctcactgtgcagagaagggaatactgcagaataaaatgtcattttccctcatgttttatctggagttgtgattttttttaaagaagatacacatcaggtccttttggccttctactgttttaggatctgttttctcctcaatagatcacatattcacaaaaaatgaaacttctgaaatcctaaccctgttcagttgaatcaccttattatctagttgtgctatttcctatttctctttacatttattttacaaagagggctaaacgacttttctgtcagggagatgagatgatttttttctgtttttcttttatttctcatattccatttccttccagtcctaaggagtaagatgcagaatctagacaccctctaagtaactttgaaaagatttgctcaccctgagtcagaatggtgggattggggaatgaaattctaaggtctgatatttgaggtgactttcatacttctgcaggacatgcacaaacattgatgtattgtgccagtggattgggaggtttggcgttcatattgtgtaggaaattgaatgtgaatttaactcctgattccttccttcaggggtcagggtagcacaacagctgcttccaggctgttggtttccaactatgtgcacaaatatagtctgtaatgatttttcctactccttctttcaatattttataaatgacttcctcagttgttttctgacgtaagccacacatatgttaccaagcagggcataggttttctaagctcagtaggagatggaaataatagcaggatggaaaaagattctgtacaaaaagacactggttgtgaagcaaatatacatatgtaattgctaactccttacttgaagactgcatatacttctattaggaaagatagtttcaatcatgttaatggcactttataagctgttactttctttaggaagattatgtaactaaggcaggttatggcatttttcttaagtatcctacacattagtaataaaaagctttgtctaataggaaagcatttaaacatgatggcagtgggtaatttgaaatgtaacatctattttctattttatttccattttgtcagccgcagtcatgtagttaggttagaaaatatttgggaaaaaaagaaataccatttatgaatatgaaagctatcaattttgcttcctgaccagttgcttcagcaaagtaaggagatttagcagataagtaatcacggtattcctaaaactagagaaaattttaaattgaattttcattatgtttgcaacatatgtgaacaaatcagtattacttttaaaatggctattagataaaacattttaaagaacagttgaactttgaagatttatatttcagaatttgttagtttgttacacactgaaatgtttgggatgtactttgacttacaacagatatgatgtttggtgtttggcaaatcttgtgtttttataaagcagactactctataatttgtagcaacaaaacaagtgttgattattgagatttaaaagtagcaagttttctggtgatgctcaagttataaagcataattataattgtaccggttgggcagctataggtaaggtcgcgtcagcctttttattactaaattccaaccctatttccattaggtttatcgggaatctcaaagaggagagtccagttctgtgagacatcaaggcattgtagaattccgggctgagtcagagggctcgaaactgtacttccggctctgtcaattactagccttgtgacctctgacaccacatttgatttctcagtgttccagagaatcattttttaaaaaaataaatagttgcacattgctctacagaaaggagataatatgtgtctaagtacttaccaccatcctatgccttagaaatatatggaattattattaaggattcccttaagtcttattaatttagctgtgcatgttttttacacccttattgtaaatctgaataggtgctttctagtagcaattacagttagctgtacataatactgttcagtgattaaccaacaaagacaaattaaaagctttgttggttaactttcactcagtactcagttttttccagaagtactcatatgggaatatagttgtcttaagtaattaaaaaaatagttgcttttgaataacattcaaacagtggtaactaagggttttatgtgtgagagtgttttctgcagattgctttttaaaaaatgcttctgagtacttaggagtttctgtttctgctaccaagagcacacaaacaaatgtacacaaacttgatgctacttcacagactgagtacattgaccagaaagtgactcttgtctttcagtatattaacaaaagcataatgagtttgaataccaagtgtaatagagaaaatgagaatataaagatacccggtctgtttggaattttctagttgtaataattactaactttctttagggggaggcaatcccccatgtgtcactactaaaactgcatctctttaatgttcttgtatcttaacagaatgatatttacatatatgcaaagaggatagtttagtgatatgagcttccatgtatgtttttcagtgactgaataatcaggttacagagtaagtttttgtattttggttaaaatagaattggaaagtgcaaaattaaccctgtaataaattagtagtcctgggcttaaaataaagaattttcatgttgtagagcaacctcctcttcgtaacttcccagtgtcttgcttttcttttcaaggattcccaatatatttttgtttcagatgaatttcattatgcatgtttatctgacttcattgatgcctattaatagcaagcattttcttggtttcctatatttaaaaaatgcatgttctttatgtcttatggcaatactttagatttgctctggcagatttatgaaagaatattgtatgaatgtagacaggcttgtttatttgacaaattcagctaatcaccttacaaatatgcttttaattttcacccagaaaatgccaccctggagtgtcttatactgcatataacattctattacagtccaaccacatggctcagtggacatacttatccattaagtatgcttatcctgaccattggtttactaggaaagatccttaattgacatgctttttggtatccttgtgtagacacaatattcaggtgcccaaactctaaaactcctgtcttttagctacagagaagggatgactaggtggcttgatgttgctttcttatcacatgatctgaaaatcccaggcactgaactgtgaataaagcaaagggagaaagaaaagaaagagaactaaaagaaaattttacttctgaaaattttgctctttcccattttaatatcacaatattaaaagcaatcttttttatcacaagctattcaaatggtttgttatagttactatgctcatatatatcaaatacgataaatggcactaaatgagctgctttgttcttacaggagctacacctctgtgaacataaatttaagagttaaactagattgtacgttgtaacactacgtcaggatattgtgtgtagaatttggacttactgaaaaattgaaatggattgtggattgtaatcatataattatagacttttactctttcgatgtttattaggtatcttatactttatttgaattataattataataaatcagcatatggataatcataaaattattcatagtagtttatcttcttatgacctaatcaaaacgagttaccttatcgatgttttagattaatatgtatgacttggtatagtgatcttcatcattttctggtgcaaagttccctttttaattaaaaaaattcactggaagtccacttagtcatagttatactttcagtatccattaattgagaaaatgcatgataataatagtaaattattatgaatataataactctttaaaaatgaatttatgtatagtcacaacagagtctacttatatctttgaaatgcatggtttattctatctacatagaaagtttggtgtttatatagattctagattccttggagtaactcctgcagctgtagtaaataaaagatccatatgtctagaggcaaaatacttgcattacatatacatattaatcatgttcatcttacagagaaaatgaaaggtaagtgcgtatggtggtggtttgtggatcaaaggagttgaatttcggtatagatggacttaagagtatataattttctgaggatgtacatttagagttccaaaatattcccattcgagttttaggattcaacagttgtaatttaaaattggttgattttggaaaataattgcttttttaaaaaataaacattgtttttattgtagccaaaataaaaatgaattattataaaagccaaaggtgatcaaaatctcataaaaacctaatagaattatatgcattataggagtaagggatgccccattatgtgattttaaacaaggaatttgcaaaccagagaaatgaagtgaagtttccaagatcttacaatttgttggctctctcatgatgcatgatttcagttccttcatataagccctcagctgggtgttctagttatatagcaatatgtcctggcatacagcattattttttattagtacagctaatgttggcatatcgaatcctttggcctctagcttactttaccgatttgtgatcagtcgtctgacttctgcactcagaatctgtggactttatttttcctttacgcacacctgatttttgacctcatttgatccctggagacacaatacaaaggagagttgagaacataggtcactggtgggtcttcttgtcttttccatactgtgcttttcccattagctttgtatctttccacctgcagggaattgctcttctttggagcctctccactttctggactttcctgaacatccctggccatctttgtctcagtgctgcatgctaccttcttgcttccaggggattccactaaggggtcctatcaaaatatcttctagctacactttatcccactttgacgatattgaatttcatatttcatttcttcatcaacagggtcagtctgcttacataaacaatagtgaaccaattttggaataatgaagacagtaatattttatcaagtttgccaagctacaatcatataactactactaaatgaacaagatacagctggtgtgtgtgtgtgtatcctcatatcctaatgactgcattaatatgtgtatccacacacatacatgatttttgttgaaatgtttgacaaatgaatcatcgttaatatgctaaagaggaaagtttggaataacaggctttatccctttgtattataatagtgacatttctagaaaagatgccattaacttctgaccccgaaaaatagcttgaaaggactgcattttagatgataaggtggagacagggctgtggaggacatacttttgttcaggctgaatcccgcagtgccctctagagttactgggtagggagctggtagcatacctgtatgaagaaatgacactggctatgaacactatgatgcttacaacctctctgccaactttatttcagaagagacacagtcaggagagctaaatacagtggtaaaaatggaaaaactgagagagttagaatggtatcaagtattttgtgtaaacaaagcttcatgtggccaagggagaaaatttgaatgtaacaaatggatctggtagctctcagtgtttggtttttggatacccctattaaagctcctaattgttctcaccatgacagaactcctgaatggtactcaagaggcacccagctccacagtgtgcagagtaaatgcattcaagggatctctaggggtttttgactctgctgttttttcttgtcgaggttctcctacagggcccttaataacacagccacagagcaagccgcttatgtcagtgggtgtgctcttctcaatgagtgaatggtttagcttagctctaggaggcaagtgcctgctggtcttgtatttccagggcccaacattgtgcacagcatatagtaggtcatcagtaaatcattacacaagcaaacgcttaaacacttacggataacaggtcagttttagatctgtgttctccaaaactcatgctacattatacgtagagacaaaagcttctgatttaaaaaagtaaaaaaaggaaaattgagtaataaaggagagagaattaatattaggtagtttaaaacctacaaatgaactgaaggagaagaaatcacctgcctgcctgtctccctccctcccttccttccttccctccctccccttcttcttcctttcctcccccttccttccacctctatcataggtatttaagtgccttcactgttcaaggggatgcaagagggactgcaaaggtccctccctacagagatgactgatgtcatgtgtctgggcccaaaaatggtttagttagggatatgactactaaacaaaatcacatataccgacatcccttggtgtccatggggattggttccaggaccccttgtggacaccaaaatccacagatgctcgagtccctaatataaaatggtctcgtatttgcatatgacctatgtacatcctcctgtataaattatctgaagattacttatacctaatacagtgtaaatgctatgtaaatagttgttacattgtatttttatttgtattatttttaattattttgttgttctttttaaattgtttttaaaaaatattcctgatccatggttgcttggatccacagatatggaaggccacctgttattataattcaagatagtctaccatacatacttctaagagagatgccaagtatgctatgggctcaagaaacgttcaggacacatgcacgtagagggattaggtgaggcttgctgaaggaggcagcctttgtattggactttgaaggagttaacatgggtatggagatgtgaccttctaaatagaggggagatcaaaaatatactgtaaggaggaccaaatggagcatggttaaggaagatccaatgttcttgtttccccagagaagggggtatatgatatgaaatgtaagaagataaggctggagccctgagccttcatgtctggcaagcaggagccaatggaatggtattgcatgagcttaaggaaaacagaacatttcatgacccgctcagatttatgctttaggaagaagggggatgaattaagagtgtgtatctccaggttaccattgatttcaagttgtgtgaatttcccagtgactcctgagtttcacgcttattccaattttctcatgtagaaccccaggcctcaaacaggcatcactggctctcttcattttcctctttctttcttcctttcaaagaagaaactgctgggtgcagtggcttcacgcctgtaatcccagcactttgggaggcggaggcaggcggatcaccggaggtcaggagttcgagaccagcctgaccagcatggtgaaaccccgtctctactaaaaatacaaaattagccgggcatggtggcacatgtctgtaatcccagctacttaggaggctgaggcaggagaattgcttgaacctgggaggcagaggctgcaatgagccgagatcacaccattgcacttaagcctgggcaacaagagtgaaactctgttcaaataaataaataaataagcaaacaaaccactgctaccagtgctggataaatacagaagccagagtttaacattagcttttacttttttcaagcagaaggcaagattctgtaatggggctgatccattcaaactatccttgcttggtagtattagaaagttgccacacactgtagcaacaatgctaagatttaagtaactctttaatgagtacactggataatgtttaaagtttatttctttactgtgatggcaacagcaaagtgactctaaagtgacaattcatctggaagaaagaagttgaaggaagcaactgggaaaaaagaaaaaaggaaagtgctttatataatgtaatgccaaggtggaaatatagatttcaaaatggttttatagtaagatcatatggaataagaatattgctttcgagtagaatgtacattcagtaataagataataggatttatttctaacaagtgtgaactcttttgctaactaccaataattataacaattttgaattgtagctggaaattggaaagtgagcctcctagtaataaaaaatccccatgctagtttagtttaaattatttttcttatcaaatactttatctacacttctaataagtggaagaaaagaaaccagtaggtatagttttttttcccatactgtatctgatcattctatattggaagatgtagtaagctggaaaatagccaaacgttgaagacaaaatgagaaaaaatgcaatttacttaggcacaaactaaatgttatgtacatcatccttaggattcaggtgaaagaacaagtctcacagtctagctgttgtcaaaactcactcccctatccctgaggatcctgattcggtgtttggaatgcagtatagaaatttgtaggtttttttttttttttttgagatggagtttcgctcttttttgcccaggctggagtgcaatggtgcaatcttggctcactgcaacctctgcctcccgggttcaagcaaatctcctccctcagcctcccgagtagctgggattacaggtgtgcgccaccacacccggctaattttgtatttttagtagagacggggtttcaccatgtcggccaggctggtctcaaactcctgacttcaggagatccacccaccttggcctcccaaagtgctgggattacaggcatgagccaccgcacccagccgagaaatttgtactttcaaaaacatttgagggccaggcatggtggctcatgcctgtaaccccagcactttgggaggccgaggcaagggaaacagcctgagttcagcagttcaagaccagcctggccaacatggagaaatcccgtctctactaaaaatacaaaaattagctgggcacattggcaggttcttgtgatcccagccggctactcgggaggctgaggcaggagaatcgcttgaacctgggaggtggaggttgcagtgagccgagattgcaccatgcaccattgcactccagcctgggtgacagagcgagactccatctcaaaaaaaaaaaaaaaaaattgaggtcagtaggatcaccaagatgttccttgggagggcttcagcagaaacctctcagtctctgtcagtattactttcctcctggcgtcataagttacaatggatattggatgctttcttgatgttttccaaagtgcccctccaactcagcttcaactttcaagtaataagtcatttccaaccacaatggcacagggtaggcccctactatgctgaaatcctcacactgccactgtctcagttgattatcatgcagcaattgtggctcattgtgggtccctactaaccactgtccttcagtcctattacgtgatcagaattgccccttcccatatgtattttaatgaactccttcatgtgagtgaatgagaaatactacttgagggccctatctgttgtaagaatggtgcttaacacaggctgtagatgctcaagacagttcttgccatctaaagcttatggaccagtgggaaaggcatatgtgttcaattgggctccctggaaacagactccgagatgaagaattgcatacaaaagttttagttgtttctgaggcagagaaactgactgcaatgtggttgcagctggggccccagcagttccaatgagaagttctaaagatttgatggtccttcaaaattgtctcacattgagtcaagggggttggggctttctgttttcacgtcaggcagtgactggcggggggctgccccacaggaaggagcataatgttgggaagacagttacttgcagctgagggtaaatcccgatgagggactcggctgtgagccaccaacggcaggatgggtatacaggccattaagaggggaatgaaagttatttggagtctctgacaagatcgtattttttctctcaccccttgaggcatgatgcaataataccatatgaaattactgaggaaatgctgtgaaatcgtaaacatttgtttaaagagataaagaaactaaatacaatggagtataaggccttgctctatgtagttttgcttcagagaatgtgattttctcaggaatgtagttcaagtcacattatagttactctgttgtaagttaccaggccacaaatatctaatgagcacgttctatgtgtcctggacttccagagagagagaggaaaaagtggaaaattcatgcctggagaatttacataggacctttttttttttcctcggtggttcatgtgcctgattttgagtttaaggaggggatttgggggtgggggtcaaggaaggggcaaggaaatggaacagagtagagtggggccaagttttctgaattccaaggataataagacaattgtttgggttgtacaggaccaggctacagaggaatattgaaagttggcggaaggcacagacttgatgaactgagtggtagtggaataagtcgaatgtagatttactggtacagaacagacagtgaaagcagtgtttcattagcattagccagtctatgatttggactggaggggaactagttttgaatacgatgaatttgaaatcatcgaaataatatatcctagagttcaattttcactgaaaggaagcatttcatataacactattcacttttatattatgtggaaatattaatttccttccttaatgcaagggaagtgacattacttagatttttaaaatgctttcttcaaccctagtgaggtaataggagcaccttctatttttatcctataaagattttcaatcaagttaaatacactgacacttaattttgccagtaagtttttaaagtactggctgtgtctaaatgggcaaccattcattaaatcatagaaaaattgaatagggatgaactaagtacatacctttacagatataaacatctctcggccaggcacggtggctcatgcctgtaatcccagcactttgggaggctgaggtgggcggatcatgaggtaaagagatcgagaccatcctggccaacatggtgaaaccctgtctttactaaaaaaatacaataattagctgggcgtggtggcgcgtgcctgtagtaccagctactctaactagaggctgaggcaggagaattgcttgaacctgggaggcagaggttgcagtgagctgagatcatgccactgcactctagcctgagtgacagagcaagactccatctcaaaacaaaacaaaacaaaacatacaagcaaacaaaaaatctctcaactaccaaaaaattatccattaactgatattcactttaataaataaccactttggcaattttttccctcacttgacctaacattgactagatggtcaactcaattcagttcaacaaatacttccagatgatccacctactccatgcttaattcaagcacaaagctagaatgaggaatttactcattgccacagcaactgaggatgcacattgttaagcattttaaaagatctgtcttaaaaaaaaatagtaatctttgctaccagcacctagcttgctttaaaagcatttgttagattccttctctggctttggcttggtttttttggaataataataataaaaaaaaaagttggccaggtatggtggttcatgcctggaatcccagcactttgggaggccaaggtgagtggatcacctaaggtcagaagttcgagatcagcctggtcaacatggtgaaaccccgtctctactaaaaatataaaaattagccagacgtggtggcgcacgcctgtaatcccagctacttgggaggctgaggcaggagaatcgcttgaacctgggaggcggaggttacagtgagccgaaattgcaccactgcactccagcctgggcaacagaacgagactccatctcaaaaaaaaaaaaaaaaaagaaaggttcatggtatttttaaaagaccaagaattcaatcaaggtgacactccttttccatcacaatactctacttgtgtgtatggacctatatattttattgtttcaaatacaaattgtgaagcttattaaggagagtccaacatttctatatattcactagctgttttttcattaaatataacttcaaggctccaggctcaaaaattgttccatttttactgattgcatcatgctatttgtgcacagcacacttttatttttgtccgcatagatttgaagcaatggtttttttactctgccacacaatgccacatccctgacagtaggtaagttatgttcttttgcattttttactcaagagctatgtaggtggtatgggagatgagtggcggctattggaacagactgtgcatcagacgctatttaaacctcatctatatgtgcaagttaagagttactatttcctgtttccaaagtgaaaattagttttaatttcttaaatttgtaatcagagaagatgtgggttattgttctaagcatcttctttggactcttccaatgttttggtagcaaagattcaaatattagtaagtctaaattcatcttttattaatttgggtactcctgctagcccaatcttattatttttaatattagtgttaatgttactattggctatgattacaaaagtataaaaataatatatttaataaagcctcatcatgtggcttcagtctagttttgggaacctgaaagatattatgaaaattaaaggtttagtattgcttcattgaatcattacttaagtcaaagatgttaagcagacttagttattatgattaaatcctttccactccaagaattacagtaccagaaatgtgcaatttgtatacacacaaatttactttttgagactattgaaaggtaattggaaataatttcatacctgaggacagtctcttagaaaacatatttgtgtgagtccttgtttatttggatcatactggagttgtaggcaacatatttgtgtgactaatatcatcaccattgtctccatcataatcattatcaacaagctggtattaattttaaaagtgttcattatacaatcaaaaaagaactatataggacaggaccctgactattgaatataatgagcttgaaccaaggattatgtggcttgcggaaatactgtgaggtaaatgaattttgcctgtgacatacttctgtgttcagtttcagcaactcccacttcgtttgaatcccaaatgctcacgtgaataactttagtttctgaatgctaagagtattctgtcacagagaagactgttttcttaaaaatatatgctcccaagctaccactagctatgtatttttctcatcaaatttattatttttaaatgtatttctttgtgtcttcctaactttagtataaggctgagaggatatgacctcatttatctggttcaccacatatctttggtgcccaggagagtgcctgtcacattgtgcaatttagttcaataattatcaaaggaaggaaagaaaggaagaagaaagggagaaagaaagaaaagaaagaagaatctcccgaggtgtcctggtctaagcaagataataggagaaaagagagtttgatttaaaaacacactaagcctagcttggtagatatatgacatttgcattgtaaaggtgttgttcatgatgcaatgttactggtatagtaaagttagcgtttattccatccctcatggggatgggtacaggtatatcacatgctctaaattgccaggtctgttgacagaatgccagaatgccaagctgatagcttagaacctatagccaaagattttggttgcatcaataatgcagaaagcgatgtcttaaggaccattattctgacagtatgtttttaaggtgagcaatgccaagatagactgaagcctacagttagatggcactatatattttataaattacaaggtgataaaagttctcattgttttagcttcttagcttttttccctacttttccctatatataagtatccattaagaagaagctttaaaaaaacactaatttcatttttatctctttcatagtatcaatataccttctcccaattgcagaagacatcatgttatactagaattcacatttggatcaaggcaagtgtgagttccaattttggctttgacatttactagctgtgtaaccttggataggttacttatgtttcagagtttcagtttccagatctctggagagaaaagaatacctacctttaggattactggaaaaagtaaaaattgtatttgtaggccaggtgtggtggctcatacctgtaatcccagcactttgggaggccgaggcgggtggatcacgaggtcaagagatcgagaccatcctggccaacatggtgaaaccctgtctctgctaaaaatacaaaaatgtgctgggtgtggtggcacgcacctgtagtcccagctacttgggaggctgaggcaggagaatcacttgaacccgggaggcggaggttgcagtgagccgagattgcaccattgcactccaggttggcgacagagcgagactcaaaaaaaaaaaaaaaaaaaaaggtatttgttaagcatatcgtgcagtgcttgacaaatcatagctacataataaatgctaatccttattttaatattttaacatgttatattaaaatataacaggaatattctttagttttctccctgtacccaatggtcaatattccatctttatcatacttgacctgtgggtaacaattgcacaatggatcagtccttgtccttgtttatttggatcatacttgacttgtgggcaacacttacacaatggatcactcctcctcagtacattttctttacctggctttggggacagcacaatctcttggtttaacttttttgctccttttaattctttgctgggaaaatgctccatggtttaactcttggctgtcttctcagtctacactcaccccttagtgatttcattcactcactctcatggctatcagtatcctttttgtcaccacctcttaaatttatatctaccttggtaacttttctgatttccaaacacatatatctaaccacttatttgacatcatcagctatttgacatttgtcacttactttgtccaaaactaaacttcttttttccctcccaaatctactttgttcgcaattttcccatctcgattgatgtcagtttcatccttgtatttgttcagacccaaaaccttgaaatcactcatcatttctctccctctctcacaaaccacatccagtcatcaagccttgttggtactatctttacccagatctagaatttaaccacttctcatcacctctactgctattatcctgtggaaccctccatcatctcttttctaaattactgcaaaccgccaaactgactctatgcctctgttattgttttctacagtctgctctcaatatagcagctacggttgccttttgaaaatggacaggttgtgtcactctacttttcaaatccctgcaaaggttgctgattttacttggagtaaaagtaaagttcttataatggcctaaggaaattcgcctacattacttccttgatttcatttccccgactcattctctcttttctagctctctcatttctcaccactctcaacttgctgttctttgaaggtgacaggtaagttcttgccataggaccttttcactggctgttctctttgtttggagcattatttacccagaagtctcaaggctaacttcctcacttccatcatttttggcttacctgtcatcttctccatgagacctaccccgaccacaccctctaaaatttcaatacactcacctccacactcctgatctccttatctggttctactttctaattcttttaggtacttcttaccatgtaacttttttataagttatttattattcttattgattattgctagagtttaagctccacaagagcaaagatctttgtccttttagttcactgaagtatcccaagcactgagaatgctatatgtaaatttggtaaaataaatattgttgtaaaataaagataattttcttacctagtgttactattgtgaaggtttaaataagataatgcagttagagcattttttcacagggcctgacataaattaagggcttaataaatggtcgccattatgaagtgtctcatggcgtaaacacacatggtatacaccaaaaatcaaaagtattacagcatgaaccctttttctcacattgaagttttaccaataccacaggcatataatatcttctctaggtatacacaagcatatcttattgtttcatgctcatctagtaaagataaagatatgctagcattcagcagtagctgacagttcacatatgtcagtgaaataaattgacactgttcttttttactttataccaattaaacttcatataatttaaaaagttggtgacaaatattctctaataaggataattttaaaaatatcactataagatgatattctctaataaggataatttttaaaatatcacaataagatgatttataagattcctgagagctccctaagaattaaagagctaacaaaaaaatgatattcccattatgcattttaatgaacaaccaattttcttctttttgtagatttcaatgacaacttggagagttcaacatgtttaacatttttgattcttttccatgttttataaatagaaaaaaataaaaatgattgtaatgaggtattcttatgtgcatcacaaatgtaggttttagtgtgcgggattcaatagaaaataaatactttctttttccatcttcatttgtgaaaatactgaaaaatagttataacggaaagtcttttgtaaatcaaaacaaaaagtattatttctgaatactgaatagatgttctcatcttgtctattgcctgatcatctagttgcttagtctaatcaaatacatttattcttctatgtttcattcgcatagcttagtcttttccagagaatttacgaatgttttactgcatgccaaaccttgggtaattaaagtcgacgacagaatgtgcccatagtttattctgtagatctgactgtagatgcagaggcttacattacatttggggtgaatgataagcttatattattttcttcttctactaaaaatattttaaagatatagattctagaattcactaaacaggtaatttgtgaataaatatattgccattttttaaaattgctcttttgttctctcatatgttcatcatgcagcttaatttcctttctccatgtttgggatggtcaggtagtcaccacttcccactaaagttcgttaatttttcaaccaccagaaaaaaaggtgaggaatgaaagaaggagaggaaaagagaagaatggcaaactccacgtaattgcctgaatgctaccttagatctaaatgttgtaagttttcctctaacattttagaaagaatcactttttttcaagcatttttattgccactcgtgcctactttactttgttactcctctgctgcttgtgggtggatggaatttgactatttcagaatagttactggtgggtgggttcaagaatctctagtgggttgaggaaaaagccatgtttatatagatagtgatccttctattaaaatcctaagagtgagtaatatttaatagctatgttcaccacgcacatagcagagtccatctgtacagaaactgagggtatctgaaaagaattccacgggagttttggcttcctatagagtttgcacgcagaggctctaatctcccaaattaaattttgtgacttgatggatagacaaggtttctttcctgagggcatgacatggacctggatgcctactggtctatacaagtgtaagatgctatgaacctgtcaagacttagctttcccactatagtggatcataacacacagctttagtgccttgtgtacattgctttgactacagatgtaaaacgtttaggttgactggctttaaattgtgggtagctgtggtaagggtaatcacatgatctacttagatgccaagtgagtgaattctcttctttgatttgaaatccagttcttttatatatatatttgagtacagagctggtagcagccagtgatgcaatgtacacattgaaagtgccataaatttagagatactttctgtatggccagaccacgggaaatgacaggcctttcaaactatagactattttagatgattgttcttgaaagaccacttcacttaatgtgatatttggattacaataaattctaaatcattgtgttctcatttctttcttttctatactgaagaaaatgccttaccttaatctttaccacttaccttaatcttcagagattgagtagtcattgatgttcattacccactttattgcagcaatgctactatcaaagcatgagatttgggtagctgcaacatgtgtacagctgaattctaagttttgcaggcagaacaccagtggtcaaattacatatattgtgtcataattattaaaaaatgtaacatatgaggacaattaaaggtctaaataatttgagatagacagcccattttaaaataacattttactttcattttattggcaagttttaagaccaaaatttaaaaggaccaaaaatggacataatttagatgtgcattttaatgaagaaagagaaaatgctaaatgatttggaaaaaaaagatatttagcatgatgcaacttctataaatgttttttttctcctgttctttaaagaatgaaataaagttacatgtaatggacggtattaaattcagactggcattaagatgtgaatgttttaaataagtgacatattttaatttgaaaatttgaatctaatataaaatgcaaattgcaatagcccttaatgtagaaaaagggaaaaatgtagtgattgagtttgggggaattgtaacttgggcagctctagccagctgcaatgatgaacaaggcttcctttattattgcttcaagaaaagctattgagtgtctagcacaaagtagctgcttgaatacgggaatatccaatatccctttgagaggcgtatttgattatacattttccctttaccctcttgtttctttctaactctccaagttccacaaaaagccccaagatcactgttgttattatcattggtgttgttttttgacccagaggttataccactgacaactactgttacctatgtaaaatgatctctatcaatctttgactaaatttatacctgatcctgttgttcttttgtttaaaatcttcccataaatctttggtccttacaggattatctgtaagagggttagcctggcaggcattttttttttttttacaatcagattcaacagagttcttttttggcttcatttctcactttgatcaaaatgacttctcagcatgcatgttcttacacacacacacacacacacacacacacacacacaacatacctacctctctgatatatgcttcctattaatttctgcctagaaaactcttactcatcctctaatacccatctcagatatatctcttgttttaacccttccttaatgtctctggtagaatgtgttatccaataaccctccctgtcccccgaccccactcaaccccaatgatcagagaacatattcctgttaaatcacctattttactgaaattatttcatttgtctctctcactttttagaatggaatcttcataaggcctgagatgctatttatttagctctgaaaaaactagccttgcatacaagtcttgtcataataagtcctaatgaatagttgattgactgaatgaacggatcttcacttgtggattttgcacaacctacagttgtgggtgccaactcaatgtgcagagttggaagctgtttgtagctctgccagtcagttttatgttctgccagcacattcttggttgttgtacattccccactgataggattttacccaacagtacttggcttgattacagtgttcaaaattgtttttcaccatgtctgggtttttttcccctactcgacttcattctctcagtttctgtacagcaggcttctgggacatcctgttgttacccattcccctcctgtacctcgcccatccaagtaactttgtgaggaaaggctgggagactggccaatttccagcatcttgttgctggtgatcctgtattactgtaggcatataagtggtgaacctgggcatgctgccatggctagcagtgaaggtgaatgcattccggtgccaataagggctaaggcatggaagtaaatccatgcagaattgactttgtcagtgctttctagtaaaggaggagtttatacatggaaagtatatcggtagcagttagcatcattttgtcccttatagttctagatgaaagaacaccaatatttttttaccttaattgcctagtaagaatctgatgttcgtagaaagttctgtacccttgttgcatttgctgcctagctcagctccgagacaggaaactgaattaggtatacagtcctagaagtcactgttgctcaaacttgaattgcacatggatcattaagggattttaattcagtaggtctgcggtggagccaagattctgcatttctaataagctctctggtgataccatgatgttgatattgttggtctgaaaaattcacattgagcagcaggatgtagagggcagagtgagctctttgacaagcagtgccagctaatgcgcgtaccctctacatcttgagtgcctcaacaatgccacaggatgacagagcatgccaaaacacaaaataaatcagttccctcatcaccactgcatgttagttcagaatgttactgacggtggtggaagcatccctgagttagtgttctccctcccacagagctcatttagattctttgtggagaagggaagaggttggcttccccaccaaatctttgttgaaaatgatttaacacattaaaagagcaaatcagtatcttaaggtttaaacttcttagctgcagaggaagttaagttcagttcccaaggacttaagggttcagtgaattttcaccaggttcttttttcacctaaacttcaagagcgcggtaggagagccatcatttattgagttcctgctatatgtgggcactgtttgttaggtgctggaggtacaaagaggcatcacacataatctcttgcccgagggagtttacaattgactccattaaaggttcaaattttgaggataaaggtgtgtcttatttgactttatatttcccaaagtgtaaaattaataactgcctattaactaaaatgttgctaaaccacagcataagaagagtgtattttaaggctaaatcatgccacaaattatgacatggttagtatagttacaagtgacaattgcatgccatttccattctgtaaatcagagcttcctaatactgctttaaacacaaaatgtgccgttgggcaaatgctgtattagcaccactagtactctgtttttcaaactgcaaagggcatcccagagttttaattttgtttcttggtgtaaatttatatgttctttggataaccacccaatttgtccatgtagccaagcttctcataggagagatgacagaggggaacagataactgtagaacacaagataaaatatgatgagggccaggacactgaaacacagataacgtaggtatcaataaactactacccatgacccaaatccagccagccacctgtttttttaaataaagttttattggaacacagccatggccattcatttaggtattatctatggctgccttcatgctacaactgcagagttgaggaattgcaccagaaaccatatatggcttgcagaacctaaaagctatgccttagagtctaagaagcaggctttctaatatttgtggggtcagggcaagaaaacaaaaagataccttccaactatgacccgccactctgctgttctcaccctggctctgtcctgcactgcgagaggtctcaaatacaccctacttatatgtaagttccatctactatcctcacactcctgcttcacaaacacctgtatcttgaccttctttcaaagaaaggggtgcacacacaaacattggtgtctgccctcagaaagtaaaccaatggaagaggcccatagaggccctagaagtggtcccagggaccccgggcggggcgttttaaattttggggtggcagatagtgttctgaaagataaaggacaatggctttgggcaggcacacctccttggttcccctagactccttgtcccatggctaaggcatggcaggaatagggccagagtagcaccccctaaagggaggggcaggaaacaggtttctctgcctgagtatgagggtgatattgttaaggagtcctgtttaaattggctaggcaaggacactattattacaaacagcttttagctagtgcttgatgattatgagaacactgttgtgcacaaatggtgaagagaggtattctaaggagaggaaactttatgagcaaagtcatagagatgaaaaagctttaaacactagtagagaatggctataaaagatggatttttacacctgtgaaaatatatactatatcattttatctttgcaacaggctctaatggctagtatggaaacttttctcttcagtggggagaaattgaaccatatattagttaaaattagaacctggaaacctgaatgcttgtttgaatggcaatgctatcaaaaatatcttgggcaaatctcgtaacatttctgcctatcagtttggaagattagggactcttgtcatatagatctatgatgattaactgtgtggagggtatcactgtaaatactaggaatttgttgtgtgctttaaaagtgtttcagtgtgatttgggagagaagagaaagaaaacccagctgtaagttgagaaccagtgctcagctgagataatggctcaggttgcctttattttaagattagacttaaactaaaaatcttctgttaattagtggctgagctggaattagcaaatagtcctggtcctcttgactttgggccctgttgtttgtcctgtgtatcagatttgataatcagcaacatgggactggatacaaaatctattagcctgtgggaaacagggcatgtattagaccagtggttttcaaatcttggtgaaaacagtaatcccctggtgagttttctaaagtgctaatcccttaaccaaaggtgagggactctgattcagaaggacggcctgaggcctgggaagctgcattttaaaaacatcggtagaaatttggataaaggtagtccttgggactcatgttgaaaagcagtggtttagaatgtgctttctttccttttggacagaagctctgtactgaagagcctttagtctgtgaaagacctgagttatttctccagggaaggtgactgtctttggctgaaccatccacattctcttgcccagttcctctgaggtctatggagtgcccatatatgagactaaagttaaggagtcacctccagccacgggacagaaggcagttttctgaccttatcagattttatcattgccatactttaacttgctgagctaaccagccacagttttgttggaactcaccatggagacagattaattttaactctgagagaacatgggcttttcaacacaagttaaatataggctggcacagaacatcacagaagcattaggtcctcagaaattttctttagctcccaaactttgagctgccactaatttatgctactcatactttctcctggtcatttttatgtttttgtcttcctttgatcactgaaacagagaaggcagtacttaacctgctggaaacaggtcatctatgagcatgtttctcctaaacaattacatggaaaattaatggaaagaataggctatatgtcttaggctcttgggcagaccataagctttcgttcttgtttttttatgttttcttgggtgaaaaacttagcttaaagaaatatgaaatgcatttaaaaattaatttccacaaaaccaaagtgctgagatttgaccaaatgaaaaaacttggaggtaaaaacactgcacggttccatgtgtaatagttttttttttcctggaactaaagagagcacacacatattcacacaattcctacctttagcagatatttcattaaaacaccacacaatttaaatgttgataagaccttttcaaatagagaaattaaaatgataccttattaactttcattatagggcattaataatttttgtatttctgattagaatatggatttttgttaatgtggtgattttcagtggcagtcatgttcagtgcaagtgtgttctacaataatattgagaaataggagatgaaagttaaaatactggtgatgatgggccacatatgacctacacgacgatacacagtagtgtttcaaaataccaataatttaataaattactaatactaacaaatctgtgataagataggaatttttagtgcttcgaatattgacctccctaagttacatttcaatgccagttgtacaatactagtattgaactagtgaggataagagtactagaggccattgcttgtgttacagttcacatcccggctttatgacctttggtgacttacataaactgtcgtctgtttttgttttttgttttttttcgggacacagtcttgctctgtcacccaggctggagtgcagttgggagatcgtggctcactgcaagctccgcctcccggcttcactccattcttctgcctcagcctccggagtagctgggactacaggtgcccgccaccacgcccggctacttttttgtatttttagtagagacggggtttcactgtgttagccaggatggtctcgacctcctgacctcgtgatctgcccgccttggcctcctaaagtgctgagattacaggtatgaggcactgcgcctggccaactgttgtctgtttttttttttttttttttttttttttttttttttacctacaaattgaatgaaattactcatagggttgatattaatattaagagagatcacatatgtaaagagcttagtacagtgtagtatagtgcaagtagttaataagagttaggtattagcaatatattatagtttcataatttttcttctaaaaaccaattgccaaaggatgtattcctttagttgaaatactatagctcgattgtgtatataaacatatacattaatttgtaaaagtcagtttaaaaataagtataatggcatttttgaaacatagccctataaataataaacatgcttccaagttctcaatggatgataaaagccatcaacaggcccttgtcctgctgagtttccctgtgaagccaacagctcagccagcccctcaaaggccatggaagcttgaaggtcagacactgcgtgtaggggtcacctgcagatttaactcttaaatgcgagtcgcttagatctgtggctgcatctatttctgtgaggtaccagacgtcttctacatttggaacattgatgatatgataaaggaagtcatgccaataatcatacccaaagctgcttaatgaaaggaagaatggagagtcacacaaacatcacctcttagtaatagaaacttgactgggagacccaagcgaggccccttctaccaccagcattcaagctgcattaaactaaaatgtcaaaaatacttaaataatagtaataataataattgtgtttaaggccatattcactgatcagtggtcctttattgatttagatctttacagaagtggagctcctgagttcattgcttcatccaattcctcgtttttattatttgagaaaggcactcccccaggggatttgacagattcacatatgtagttcaaaatggttgattagcatgtcatatgaaaacatatcagaaggactaagggctcttggacagattacatttgtagttttcctgatgtctttcaggcctatcattttgtcataaaatgaagttgaaagggtctgaatatgtagacttcttacaggctccatggagacttctcaccacttctgttttctggtacgtgcttagaaaacgactatttgttcctggatttatgtacagatcaaagcatcctggctgatttgttattttctagaatttacatttaaaagcgtgaaggtttctatttgtagaaaaggcatttttctttcttttttttttttttagatggcgtttcactcttgtcacccgggctggagtgcaatggcacgatctcggctcactgcaacctccacctcccaggttcaagggagtctcctgcctcagcctcccaagtagcggggactacaggcgtacgccaccatgcctggctaatttttgtatttttagtagagacggggtttcaccatcttggccaggcttgactcaaactcctgacctcatgatccacccaccttggcctcccaaagtgctgggattacaggcgtgagccaccgcgcccggccagaaaaggcatttttctatttgtatttgggtatttttcataatcccttactcattcatcagtttagaacaatatctaactttaattggaatgaatttcagtgtaaattaaacaattgcagcaaaaaaggagatatccataactaaatccacagtggaagacaactaatgagaatgcatagagagctaaagaatacagaactacatcagtcacagggaagtattcaaaaattgtgaaactttacaagtttgtttttcatatcttggcttcaaatttgtgttgctttcctccacaagggatttcaagagatgtttcagagaactttaaaactttcaataatgttttaaatacctggggaataaaaacaaaaccaacagtaataatgttggaggaggaggcagtggaaaggaacagagaataggagcaaaaagaaaaagatgttaacatccttaggtgctacaatggctgattcatctgtagtctcctattataaaatcttatgtggatttgggagtaagccccttactaccccttcccacccccatgccattcctatcactagtctttttggggaagaggctgtcattgacaagtccctactttcgccatactgttctctacagtttctaaattctattaaaatgaaggattgtatgataattctgttaatatttttattcttgaaatatttcagctctgccatgtattatcaatatggccttatctttaaaatgaggatgataataatactggcatcaaggcatgctttgagaattaaaagagtcaacccaaatatgggacctcaaatatagcctttagcaagcagaggctagctcatagagcatgcttgataaatggcaatcctcattgataaagctcattcaatggaatcacttatttttaaactgtagtttaaccagatatgggatcttactatccaattgaacctaggaaatacaaatgattataggcacagcctttccttggctttgtttagaatagttacagaaatagactaatattttggaatttcatatgttgatagattcaagtaatttgaatgggaaagaggcaggagagaaattattattattttttccagtcttgaaatttttcaaagcattttaatattctcaaagtaggaagcctgattagccttatcttcatcagttctttatacacatccctatatcactaacattttttcttatcccattcaaccttccagtccacttgtaaggctacttaaaagatgctagattaaagaatggtttgtgtcatcctcccatgtctttgacatctccatttttcttgaacctacaggggtaagtgagcactgcatgacaatattgagagaatagatatctttttttcacacctgtctcttcaagtgtatgattctgcttatctctttgtgacatttcagtggtatagtttctgcaaacatgattttatcaggactttgctttctgctttagacttgaaagtgaatttcttttgggatagttacatcttacttgttcaaggtgtgaaacataaaacgatatctgatttttcagtgttctactgatacacaataattctaaactgaagcaatatggtactcttgcctcctgcttttatcttagaagaatgaaaattgaatatttgggttaagttaatatacacaatacgtggattactaaagttattacattttcaatatcttatagtgcagtaatacatattttaacaataaagctcttaggagagtcacagtgtagggaagttatcttatctttacaacaataaccattatgtattgctctaacatgactttggtttaattgtactttctgaccatctgggtaacaaaaattattcttattggattggaccaagtgaatatttgatcaagaacaactttaattttcagcatttttttcaaaattactagggaaatgtaattgtaaacatatttttataaattatattttatttcctattctgagattataaagttaacttttcaatttcttattaacagggtgttgagaagccagattccacattaagccacttaaatattctgtgggtggactacagcaggaggtggaggagctcccatgtttctgaagatagtttgagataatattgtgggtggtgaaggggagggtacttacagtgtgtggagtcacggactcagcaagaatgtaatcctgctggctgcaccttcttttcctcacagggaattccaacaaagcaagaaggggtgaagtggctgagaagggccagtgccagtggtatgtgactccaggatctactcaaagaagtttgcaggttcatttgtagactcaatagttattttactcactaagttaaaggatttatgtatccaattttaacagatgcaataaaagttatttacattaatctttaccatatgtccctcttatcctttacattattctatacatttagaaatttataaaaatggtggtggaaaatacagaacatgatgtaaaatgtcaactcttatctcttttaaagaggttagaataggagatggttgattagtgcatctataaaattgtttacctgaaggccaggcatggtggctcacgcctgtaaccccagcactttgggaggccgagacgagtggatcgcttgagtccaggagttcaagaccagcctgggtaacatggtgaaaccccatctctacaaaaacaaacaaacaaacaaacaaaaattagccggcatagtggcacatgcttgcagtcccagctacttgggaggttgagatgggaggattgctggagcccaggaggcagagattgcagtgggctgagatcacgacactgcattccagcctgggcaacagagtgagaccccgtctccaaaaaaaaaaaaaaaaaaagataaaaaaaattgtttaactgagttgtgccgcacaaataccaatggttgagtgtgtcataatacttacagaatgattttgattgtgtacgtttgcttctctttacatgattcatgcataatttacaataagaactaccatggtgagctaaattaagtttaacattttgaagttttcttatgcagtggttatctgagtctccaagttaacttacattgcatttgttcactgtctccatttcctaagtcatattttagtagatgataccatgtagttttgcatttctatccaaatgcattttgcttgggagattagttgtatgaaatattctaaggggggcataaagaaggttctttgatgaaataactttggaacatgctgcttctatgtctcttacatggatattcacaatgataagtataaccaaaggctctgagaagtcctgcagtttaaaaaaaaaaacactaaagtgttttaacccaggattttgtagacacatttgaccataggcactctctttccataatgctttgttatatcctactgaactttgggaaatgccatcttagacatccagtaagatcatatacacttcaaattgcctaagtatttttacagaaataaatctaagaacataaactaaggtttgccagaaatatattacatttctctgttaaataaacgttttccattgcatgtcaatatctcacatgggaatgcctcttgtctccccagtatagtcaccagacagtcttcctctctggagtcctggtttctttccaagaattaggcccccatctctggtcttgccagattttacacccctcaagcccctcatgtcagggtaatctctttctcctctgggcgatggtgaggaagaattgggacgtgatgaggctctgtgagtctcaagcccattggcattcttacttttctaagatattctgcgtcttccttcagacttttcctctatttctttcaccacggattttgatggctcattaaacccagagcctgatttatccccttttggtttgtattcatagagggcttaatccttcaatgctccaagaaggtgagaaagcagattttcattccatctttccaatctagtacagaggaaaagaaaaacaaattcccatatgaaaagagtctgaaaatatttagaccatgatatagttgaaaaggcatcaacttcatttaccttttgctcttacattattttatcttgggcccagtctatctatctcatatcattgtatatcactctcctctttgcctattaatctccatccagaccagtctttaatccactttctgcttttgggccttttccctagctgtcctctctgcatcttccctgctcttcacattggctgtcccttgaaatacaaggcctcattaagtgtttcttccttggagaagtcttctctaactaccagactaaagtatctgactagtccctcacatgacatcttaattctcttaattctctgcagagcacctattgttatttggtattttattatttgtttatctgtttgtttcttccatcaagaatcaaagttccgtaaaagctcggacactatctttctccttctccattgcttccccagtacctaatacagtgccaggaaaataccacaggctacatagataattgctgaatgaatgattgaatatttgacttttcatgtctgttacttccttggttatttcttggcctttttttactgaaaatttcagtcgctctttggaggcattcgttgcattgtttcaatctcctccctctactcctgaccactctatgccacatttgacatggcaatgcaccttcctctttcttacctcaaattctgtggcacttttgaggctctgacttagtcttttatgtctctttgtattatgctaccttggagaccgcattcttttgcaaacttaaaagtacaaattctatggcaaaaacctttctgtaaattcttctttgacacctgtatcttaatcctgtcactcacttctctgctttactgtttcaatgttagcaaaattgccaactaaatctttagtttcttattgttcattgtggattaatattaagtccttaagcagactaggaatgtctttagggaaggaggcataccatgtccattatttatttatttttaatagcacacaacacatttcttgaacttaccatatttcagtggttcaataaatgcatgcatgtccatagatagacaatgtatactgaaaacacagcatcagtattaatttacgatcttagatgagccacttgtattgtttaatatattattggaattaggaaggaagaggcaggtggcagatccctatcccatactcccttacccccttcttgctttaatgtgctttcttttgccagtcttgcttcctattgtgcctttcccttcacatctaaatatacaacgttaagctagaaaagtactataagaatactaaacctagttgagaaaataaagagaaaaaaatataaaccatgggcaaatcgtcttcttgaatattcttctctcaatattttaaaattaagatgtatgattttgatgatctagaataaaaccaatctccctaacatattttgcatatagtatctgttttggccttttttcagatacagtatcatttcaagttattattgcttaagaaatttatgtttgtggtcacaaattcaaacattaccaaattgcaccaaataaaaaaatgaaatgaccttctctggttagattaaacttgtagcacatttattcctctaatatacaaaggttttattagtgaattgtttttttaaaaaaagaagataaatggaatccaacaacagcaatatatattttccagtaaaattttatctatgtgatcataaaattcatttatgctttttattaatcagtgagagaagtaatgctgtcagcaaaagtgggttatagctctatcacaaagttctaaaagcagccatggaacctatgcattttttcatgttttcagttaacattacttggggtataaaatgctattgtgttgtcaagtgaattgattctaatcacagctgttttctgtgaattaaatcaccaagaaaactcaatcaccaaccaaagacttttaaacaataaaatcccatttgtggttgaagatcaaatttaagaacgctactggatattcatttattttgtcacgtttaattttctactctgactctcagtttcttaaagaaacaaatatttaatatctccccaaagccaatatctgctgtgtagtgggttcatatcttagcactgagagttaaataattgtgtgtagaaaaaaataggatatacagtgattgaattttcacttcatggaaaatggcagaaaagctagctatttgcttgctttcattcctttactatttcagaaacaaacacatctctaacttcaagtgaaattaattagttacttagggagatatatatctatatatctctctatatatacctttgctttttgggttgtggcacttatgctaaagttatcctctgggtttccttatatgggtcatgccataaaaatatccatttgagggctgctcaggtgagactctctgagagagccgttatactgtctgtgcatccttcgtccttgtcacatcataatgttttcattcaacctctttgtacagatcaaggagagaattgttatgtatgtataaagttatgaattgttttgtactagcgaccaaactcagggaatttatcgcaacgggtattccataatggcttggcactaggtcagaagccattgtcagcaaatcaatttatgttacttagggtgtctcttgcagcaggacaggcagattcaggctgaaggtgttgagaaggctaaaaccttctcaaacagcagcgatgtttaaagtgtagctttattacctgcatacgtggcactgtgctggtagaaatgagaatggaagaaaaacagaacattggattattggttaaggaatggcattttattctttccttcataagttttatcttaaaccttgaacatctggctttgtgaaattgagccctgtgtctgaatgacacaacagaagagcaattgcaaagtcctgtgttcagacaagtcctgaatatatatctatttcattgtcatggattgtttatcagtggctggaatgattttatatgtcctttaatttaacaagcagtaccaaaagcaaaacagaaaaaaaaaactctttgaggctgcattttagaaattcttcagtgtcatctggcactggggacatttggtatttctttcatttcttgctgctataccctcttacacaaagtcacaggcttaagctgtttcccttcaactgtgggaaggaaaaaaattaatttgaacatttcatatattttaggaagagtttagaaaatagggtcacatttttcaaatgtgcacgtcagttgcttctcctccttgcctttttctatcttcaaatttgttttcctttagtagtttttagttaattgtgaatgtttacagtatggttagagataaaataattctcttacttttcttttccatcgtcacacctgagacaaatgggggaaagcagacttcaaaccacacacgatgtgtttgatttctgctcctttcaaatatccattttatttaccaagaggtaaaaacactctgaaaactggcaacatcttatgtcccacagcattacttttgatgaaatcctgctgtattttagccaaaacttctttagacaaactataactgagtcacgtcgaccctcagatgacatcaatcttcactcctcttctatccaactaccgactagacacacgtacacatgcgtatgcaccccacagatcaaacttatttcattttctctacctgttggtcacggccttttcttcttatagcttactttattcccattattagacctgtttccatgttactgaaccttttccatcaaacctcaagtcctttatctttgtcaacaactccgtgaagcttttatcaatctgcctgtcagtaatctctctcttatctgaactcggaatctataatctgcaacacggcacagagtatcaaactatgtacttgtttttgttatccttttagctgttttgtgtatgttgatttcccctgtaattcctcacacattttttgtagtccccaatgactctgaaccgacagcagttagtttttaaatatgaataccctatttaaggatcaatttctgcacactttcaaagctttctttaggataattatgtcaccataagtgaattaaggttcctcaccttctccatggagctttgcatagtactttagttggatcataaagaaatgccctgaattataggatgggatcactgcaaagtcctacttgcatgtgagcaaggagcagagtctctacaaggtaacctgttacttggatatctctgaggatattaatgataaaaaggagtggccagaggaaagacttttcgcttctcaattgcagcactgtaactaagtgacttctggtagatcaaatagactattttggggattcctgctcacccatctcctctgtgttttcagagctgctgtagagctgttagaacagtgaactgatgctttttgacttgccaaacagtgggagctttctatttaaatagttatcccttagaagagctatattagggagctcaaaggaaaggatttaagggcccacacagagtagagaggcagcagatcagccacctactgggcccttgttccttcgaatgcttcaaactacatatttgtaaggcagaaggcctcctgctcacagaactgtatgctcctcacctgcccttttgtatttagcaaacacatgggaagggcagctcttccctgctgtctaacttgtctcttgttgttcttcggaagcaatccctcacagcccagtgggcagagagccaggtgtgctgaatgcacctaggggatgtggtcatgggaggagatccttcaggggcaaggggatcaaatttgacttagtatgtggtcattttccaagtgacagatgtgtaaaatgccagtagactaagaacccaaaggagctaatcaaaatgcgtgtgtgtgtgtgtgtgtgtgtgtgtgtgtgttttaccaagaatctatataggtgctttcttatgcctttattaatatctgttcaaattctactaagtcatactgccaagcttattttgataagggaatcagtttatttatttcaccaaggttataactatattggatagagaaattgggattattttcttagcttttaagcccataataactttattaagtccacagagaatagtttatgctctattgttgctgtaataatttatttttcttgtacccattccatggggaaacatacaaacaccaggaagatacagaaaatatgagttagagttgggagactcactgtcctgccagataaaggtctctttctaaatctcattgaaacctgacattcagaagtaggccagaaaataggcctagctatctacacagatatctctttttgtattatcattaaacatctcctaggaggcagcaagctctgtggtgggctgacataaattctgccattacatttttgtttcttttttattatatgtgtattattatgaactattttaaacataaagaaaagctagaaaaatatgacaaaatcatttcaacacccagatttagcatatgttaatgtgttgtcaaatcttctccaactttctttttctctctttttttaaagcaaatgaatgttaaagatacagctaaagcctccctctccatcccctctttatgccactgtgtttcttatataattattacatataaggttgctaactcttaggagtgaatttctttcttaagtccaaggaccatctcctgtcttaggtttttcacaaaggggcaaatcagaacagtactactctactgagtgtcaaatttaattgtctcctcctctggtgtcactggtgtgcaaatactttcccccttgggaaggatatctggggttgtctaaagggcagcaatctctatctagcataacagtttcaaagtgcaagagctgtttatgacctacctgaaaccatgcaccactgtcattcagaccttcgccttttgttctgagccgccctgatgtgatcattcattttgctctgtgcctttttctttttagcatcctatcatgaatagcttgattgactcttctcatctcttgggtcctggatctacagaataatttaataaaatgaggtaaggtagattaataactggcttaaaatcagacttttggctatccctattttgtaactgatgctatactctccccactccctgggatacatcatgttctcttagctttgtgtcttcccaaatcaaaatatagaacaaaagtgaagaagtggaagttggcagctatgtggtttgggtattgaattgttcccacatcaaaagatttatgaactgtgcattttaaacagttctcagttcatggctccctttaactaaattgagaaaacaggtaaggaaagtgaggcaaatgctaaagaaaatggccttgactgttcaatctagcattaaagataaagatttaatgaaggtaggtttaggacttataattttgagtcttgaaaacccaacttttaaaggattaaacgggagggtggggagtaaattcaagtttatgtggtggttctcctcctctgtcgctcgctaatgcagctcttctgaaggatagaaatttaaatagaaagctctcactgcttaggaagcaaaaacattaagaaattgctttaacagctttacggaatctgccattttcatcctgactacagtgctacaaagtgagcagtaatctctggggtaggagcacggcccacagtcaacacctatgctcactctgtgctttttacacttttagttttcattttccttaatcaatatttaccaggcgacagtcacagctttagcagcttctgttttctaccaatctttctgttgctgatacttcagacatttaataatttccttgtctataataatttctgtgctagttccttttataaatatctgcagtatgtgtacctaatttctgggatcaggtgcacatctgaaaaattgggattccttaatgaatgttggcattcaaaaatctcctccagtactcttactttattgggtcacatcattttctttctttttttttttgacatcattttctttgttgtttattttaagcaatcctctttcagacaattgtcacttacaaggttagctactgctgtgaagcaaaccatcacaaaatgtagtggataaaacaataaggtcgcccgtctgagcagttcttctgatttgggctgggctaaactggatctcgctggagcatgtccaagtgtctgtagtcagttatagaggggctgcgggctggctcatctggctgtcacctgggtcatgtagctctgataatccagcaggtcagcctgggtttgcttttatctgatggtcacaatgttctgagtgagagaagaagaaacatgaaaggtctcttaaagggtaggctcaggactggcagattgtgatgtctgctgcaatctattaaccaaaagaagtcacaaggccagtacagatgtaagggcaggggaaatggactctgcctctttagtgagaagaatttcaaaatcacattgcaaagtgtgtggacacagggaggggcaaagaattgtggtgtttttgccatctgcctcttgcacttaaccttctcccatgacatagttgtctcaagtaatttcccttctgggagcagctgttttgatatacaggaaatattgatccatcatactctgaagaaaattgcagcacagaaaggattatttaggcatcataggtggtcatgagaataagaaatgctgaagccttaagcagatgagctttaagcagctgagccctttatgttcttaagtgaagcatttttattcttccaagcatcaactgtagtcttgttttcaccagatgaaagcaactccaagtcaaatgcatgaaactgcactaaaattgtgatgcatttggttactctgtatcatgtgtggacaaaataaataccctgatatggagcacagattatacacacatcgtttctctgaattcatagctatgcaaacagttccttacggttgacgggttttattttttatctactgtgattaagttgcagtttagccttgcattatctcatctaaaacattttagcttttctttttaattcttattctctaactcattaaaacttttttagggctttgctagccgattccatttcttcattttatcctaggaagaagaccagcaaaataaatgtggatattaaataatatgtattatcattttgcaaaatcaaaatgttttacatgagactactaaatagcaagttcatagtttgagggacgatgattttgccaatgagacagaattctctcataacacacttagggggcatatcacatgagggtaccttgcatagtacacaattggaaagtaggagaataaatagtgtgagtaggagacatttatgcaaagaaaaggcgcccttgtttcttgactttgctttagtatagaaatataaagtttgtggcttgaagggaccttaattatttcatggtttattcctgctaaaacttctaatgatgggaaactcactatacctaaagaagcaaagtccatttatctaagtggacgattgggtggtcatcactgggggaccttactatgtgtcattgtttttatcttcatgaaagacatgatctattaaagagatggacatggaaagtatcacagcaaaatatgctatgtaccaaaatataatacacacttaccttggggaccaaacggaaagtgaatttattatccagtttactagtcagaacttgataattctctaaataggtaggatagtggagatggaagagctaaagatggtagatgctgtctactgaaattgggactatctaataagcatgattaccgggagcatgtcagaacattctgtgtatccatggtggtcaatgacttaaatctacatccattttcagagatcaaattccattcctggcccattacagaaacactacctgggcctcgagtgagcaaatgccaagaagctatttaacaataggcaagcacggcaaagagaggcttaaaattggcgaaaagtgcttcctttgcagtcatcctattcaacttgtggcagctttgaaacagcatcatgaattattattttaatattacaaataaactttattcttctcagcaacttgcctcctgatatgttaaaaatatacaaaactcagtttgtcaattcctgggaaattattgtcatagcggggagccataccaaggaagtttaaaagaacaatgataacaatataaaaaactgcaggagaaaagccataaagataggtttcaaggcacacttttctatcttccttttcactgttgatttgcagtcagtgatagatcgactttttttttgtttgtttcatttgtcctcttcctttcactaatctgggctttatttttgtttcaattttccctagctttcttcccagataataactatttccttttcccaagccctaattcacactttatcattctctcactgaagtgcctttcacagcaatccaatcaggacacttctgttcagtttgttccaaggggcttatttgatcatcatcaagaagataattgtctatccttagagctgggctaaacaaaagggtgaagcaggttgtgcacaaattcacaagactccattatcattcccctgcagactcccagctgcacttttactcaacccgtctgccttcttccccttcaggccaccttggttgagcttcttcagctgtccctgcttctatttcatccacctgttttcatccttcatgctttcctaattcaggttttctattcgtctactgcaactgatattttctagcaattttaaggaggataaaaataattcttgagtgaaataattcatactaggctgagagtgaatgatttcagatgtataggaggtgtgttataaaatgatttattaaatgtgaagaaattcctagtgaaaatatacatcgatatattatgtggggatcatgggtgcctctatgaattaattcattcagaaatgttcattaaatgcctaactcattgctaacggtgaagaagccaaacatattccctttcccacctcttctcatggagcttacattcaaatgggcaagataggtagtgtcttagcctggatttccctgtaataagcagcgctaagacaaggctttagatgcaggtttatattgggaaaagaaaccaaaggatcaggagtagaagatggataacagtgagagaaacagaaggaaggaagggtatgtcactgagctagactcaatcccatcaggagcctcttgagaagccatacagagtgtacagtgggcttgtctgccacagatacctattggctccatcccccattggtcacaggctgccccacacatggttcactgtcttgtgcctgtgctttttggaatgtgtcagttggttcctgaaattgtcccactaagatatggcagagaaataaatagtataggtgaggagagacattttcagaataatctgcacaaagctgatggttgcaccaacagctggaatataaaggtaaatgaagaagatataagaaagggctcaagaggtgtccgatacaaagagcaataaaataaaataaatatctaattgcacactgtaataagtgctctagggtaaagggtaccaggagagcatatgcacaacacaatccaaaatagtggtatagaccataggggtgaaaaattccttcaaaccgtcatggttccttgacatgaccaaatgtttgtagtgctactaagtaaaatgtgttgaagattaaagcccatttttaattttactatttagctatcctgttcctaggtaaacgtcaaatcccccaaatctttaagcttttctccaaagtagattttcttccaaagattaagaaggtttcaacactattttagacaaaggacttctgactatcctaatacctccccaaactactacattgaaaaccttattgggagacataagtactcctagctttgtttaacgttaagtggaaaaaatgtaatatagttgagaggtcaagagcctgtgctcaaaagactccgatttaatattggcaagactcatgagctatacctctttgtatctgaattccttatttgtgaaaggggaataacattatcacttgctcgcataggttaaaaggtgattaagtaaggaaacacagataaaacttatagaaaaatgccaggcatatggtataatctcacttattagcaaatgtattaatttactagggctgccataataaaataccacagaatgggtagtttaagcatcagaaatttatttctgtacagttttggagtctagaaacccacaatcaaggtgtcgttaatggtggtttctggtgaggcctcacttcctggttagtggatatctatctgccttctcactgtgtctttatatgatctttactgtgtgtgtgcatcctttggtatctcttcctcctcttataaggacatcagtcctattgtattagatcttcacccttacaacctcatttaaccttaattacctctttaaaagccctgtttccaaatacagttacattggtgggtagggcttcaacatgtgattattatgggcccacaatttagtcaataacagcaagtggtgtaatttttacatgaaaatgtcatttcctagaagggggcttttaaaaactttttagtctcaggattcctgttatacttccaaaaattcttgaaaatgccaaaaagcttttgtttatgtgggttatatctatcgatatttaccatgtcaaacattaaaattgagaaatttaaaatatatgtatttatttatttgaaaataccaataagacctcccattacaaattaacattattttagggaaaataactacattttccaaaacaaaataaatttagtgaagagtggcattgttttccagttttgtaaatctctttaatatctatctttatacaagctgctgaatttgcatatctgcaactatagccaacttgttatgatacctcatgaaatgtaacctctagaaaacttcactgtatgcttttttttttttttttttttttgacggagtctcactctgtcaaccaggctggagtgtggtggtgcattgtctgctcactgcagccttcgcctcctgggttcaagtgattctcctgcctcaacctcttgagtagctgggactacaggtgcccgccaccacacctggctaatttttgtatttttagtagagacgggttttcgccatgttggccagaatggtctcgaactcctggcctcaggtgtcgtgcccaccttgacctctcaaagtgctgggattacaggcatgaaccaccacactttgctacactgtactcttttgaaagaatgagagcaaaaaaggcaaatagcattttggtattattatgaaaatagtacagactttgcagagcctccaaaatctcctgaggaccattggtggtccctgtagcacacatttgagaaccactgccttaaagcttaagaacactcccaaatcaatgaggtttgtaattttggcatcctacttttgaaaggctccccaactcctttaagttcaataccacattttagtgttttgtgctaataatagtaaatattgacttttttccacttgcagagaaataccaaaccatggcatacagatggatttcacttgcaagttatatttgatgatatttttcactttatacttcttcattgtccacaatgagaatgagacagaactatttttgtgatatctgttgggcaatccttcagtgaactggttcaaataatgtgttttcttgaaaactgctgctgtaacatatctgttttgctactaaagaaattcagcctatgaatattattacatctttgaagtgaacttcatcctaatggtcaaaaagttgggagccaactgtattgaacatttattttttaccattatgtaaaacagaccattcatttactcttttgaagatgacaatttaatttgttaaagttttattttatttttaatcgaaaaataattgtgtatatttatgggatgcaatgttattttaatgaccacattaggccacatttcaatagctgataaaaaagttcccaacacttaattgcttttactaaaaatactaaatatttaaagattgattatatcatagaatttttttttttaactgagacgcaatctcattctgtctccctggctggagcgcagtggtgctatctatctgggctcattgcaaccttcacctcccaggttcaagagattctcctgcctcagcttccctagtagctgggaccacaggtgtgcaccacaatgcctggctagtttttgtatttttagtagagatcatgttggccaggctggtcttgaactcctgcaacctcaagccatctgcctgcctaggcctcttaacatgccgggattacaggcatgagccaccacgccaggtctggttttggttatttatatatatatgtgtgtgtgtgtgtgtgtgtatatgtatatatgtgtatatatacatatacacgtatgtacacgtatatacgtatacacgtatgtatacatatatacgtatgtatatatacacgtatttatatatgtatatatgtgtatatatgtatatatgtgtgtatatatgtatatatatgtgtatatatatatgagctcctcaagcacagaaataagtcataaatactgtttttattttccccaactcctgccaggttgaatttcagagttgatgcttaataagtaattttgaaattaagtttaatagaatatatgtaattattattttgtgtcacaatgattctaccatattccctgtctttctaattttttagtccttcttttgttttattttcccctcattttatcacgtttttctcttacttttattctttctattttttttaacctcttatcaatcactttggactcaaactttctgaaatcacgttctttactttttaattaatatttgttcctggttttacaattattttaattatatcatttatacctacttttctcagatattttcaaatgatatttggagacaattctccatatggcttagcttttctgtatgtcttgttagaagaggcaccgaatgccttttttatgaactctttgcactatcttgggagatagaaataatatctccctttggagcaagaggaagacatgtttattgtttactgtgaaagatttgagttctctaagatcaaagtttctctcctataatgtacctattgcatgtgcaaatatcatccatctctcttcatgtcaacctgtaggaattagaccttgggaaactggcacaaaatgtgagtactctggctactgtttttgctgtgagtaatgtttaagccattttttgtttctgactcaagagtttcatgtcttctgttggcatccatgaaactgtggcaggctaacccattaccttgcaagtagggtacaatctcagattttgttatagacatcaatgacttacgatgatttgatctttgacttatgatggttcaacttcgatgtttttactttaccatggtgtgaaagtgccacacattcagtagaaactgtacttcaagtacccatacaaccattctatccttcgctttcagtacatgaggtaatcaataagttgcatgagatagtcaacactatttttttatatataaaataggctttgtgtcagattattttgcccaactgtaggctaatgtgttctaagcatgtttaagataggctaggctaagctatgatgtttggtaggttaggtgtattaaatatatttttgacttactatattttcaacttacaatgagtttattgggacacaaccccattgtaagttgagttatacatgagttaaacatggttggagtttgcggctaaagcttttggattacttttaccccatcgtaactttatcatggcgtgtgtgtgtgtgtatgtgtagcccggcaggcatggccatccactgaatactttgtcttgtattataattgctcttatttttcatattacataggcaagtttccttcacaagtacagtgttttcttgtcttcctccaagaactttttactctcctttcattgtcaggtctcattataaggcttagcagattcattttaaaaagcaaacctattattttttgtatatttatctagtctattggtctatccgtatttttccatatctccaaaagcatcagcatagccattcttacccacaaagcactgttgaccaacttatgtttagatgtggcattattttcccacctggaatgtcatctctttcttttatctatgtttcttccatttcttttaaaacttactttctctacagaggcttttgtgagtaatcccaaataagtttactcattaagcatttattttttgataattatattactaatattcattgattgcctactataattccaggcagagtgagcaaaccaccacagaacttgaataccatcttggaagttagtatcttataaatcaacatacattcaatttgatctatgttatttggatttaaagatacataattttttatttttcatgttgcctccctgatttcattggaaattcttccaaggcaggcaactgtgtctttttccttaactaataatagtttaagcccataaaaccttttctctctcttcaagcaataagaaaaaatcaggctgtccagcagtgcagtgcaatgattccatcagggacttgactaccatctggctttctgctccaccatggttagtgtgtggctttcagcttcatgattgtaattgggctgatatacctctggacctcatggccatgttcaagggaggaagaaggaataagggatagagcaaaaggggattgtctggggtcaaaatccttccaacctgagacatcaatttcagaagttttccccaaaatgctatataacattgtctcactgatcacaactgggtcaatcaccacccctagctacaaggaagtttgagaaggtgaatacgcttaactaagcatatggacactttacacaaaatcagaggtttttttaaataagaatgggacaagatatgttggttagagactaacaatgtttgccgtaccaccaaactcaacagtggcataaggatccttaaagctacaggataaataaaaagcatcttcttagagcatcttattagaaaatttgaaggaaaacttctccctaaaacaaacatggggtagaatacagataagatatgaatatttaaggttgaaattgggtgagataaaaaaattctcaccttttgccatgtcccccacctccttcatgtgccacagccacactggtgtctttcatttcttattctaatcatagccctttctaatctctgatttttctgccagaaatgctcttccctccaaattttaaataaatgggcagatctcaactttaaacttaacaacaacaacaaaaaaggttctcagagagatattccctgtccaaccagatataaaatcccagtcactttctgtgatattttcaatttagtatttatcactacatgtttattgtgtgccctccaccccacccccagaataatgtaagcttcatgcaagcaaatgcagttaggtgctgtttatcctagcaaagggcacaggaaaaggtaggctctcagtatgaagcagggcacaagaagtattcaatacactgttagattttcactgagatatttatgcttgaaactaatctggagtctttcttctcctctcttagaacattgcatcaaagaatatcaagtcaataggatattggatattttcagggaaaaaagacaaagactaggctgattgaaaatcactgtaacatttgttgtaaaacattgtgtttgcgtcctactgttgctgtataaatatattttcaagctctttttgtgaatatcaaatgaggaacaatagacaaaccactagcttgtgaaaacattttgatcccattttagtcaatgattaattttgtaagacataaggctttgcctctgtcttctcactgccaggccattattttagtgttcatccccaaaaccatactttttaaaaactggatattaatgccatgtaaatgttaagaaaatatttagctcaggaattcatagacaagattcttgttgtatatatcttggaatttttcttgggacacaactggaagtttctctatttattcaggacataaaataacccacttcttagggggaaggttccaggtcaacaatttaatgatttttaaacaaatatcctacagggaaagggaagatttagaagaattttttacatccctttatacttcattaaagcctttttggtgtatattgtgaaattatatgcctagtccagaattaaggacctggaataggctaaacaagaaaatacaggttagtagagttataattaatcctcataagtcagagaataaaatgggcaagaagagtagtcaagtacattgaatagagtcttccattaacgtaattcagaattgccctggcttcccaagagcattttcatgtttcactggtcaagtgaaatacctaccctgtcttatctcgatcttcccacattacttacttccttattaggttcctctgtaattctattgactgaaaattcactgctgtggaaatatatctactagtggagttaatccaaacaatttgggcaataggaaaaatacatgcttaatgatgtgtttgccttctcacttaattttatttcagacctactagatagtcaataagggatgggaaatgacattcttgtgaaggagagatgaaaatattaatatattaatattatgtatttaagcgtagggatgatctcgatataggcatatcataaagtaccttaatatttcattggctgattcatcagagtgaatctatgtggtcgtaaatgaatgggaagcatgtaaaaatcttgtttatctaacatgcacactaaaaagggtcctccaggaattagaatcactcaaaattgtaagttgtgccgcaatttgttgatgtaattatatcaacatttttcttgacgtcagaccattgtgggtgggaagattatggttttgatgatcacacagacataggcttgaatatattctcttattgctggctgtgtgaccacagacaagttacataaacactctgactctcagattcttttgtaaagtgggactcctttcctttgaagcatgagcacaaagattgaaagatacataaaacactttaacatgttgcctggcatgaaacaagtgctcattatgtattaatcttcttcccattctccctctgggagcaatgagtgatttagagtttgtaattcagttgagaagaaatttcagaattgtataaaaggcagtgtgcttatatattcattcattagtccccttattatcagagtgtgttatttgcattacatagtttagccatggtgtgtataatttgaatttaactggaaacaacattcctttcacaaatgttgtttccaactcaattacctgaccttcagctaggttagaagcattggcatttctagtaattttgaaattccaaaaatgtaacccccatactctatgctaattttcaaatcagcagttgaattggctgctcagtcacatttgttcctaaagacggaaaataaaagtgtctgtgagagggcaggcctggcttaaattctgtcttaacttgaaggatctcagaagcagactctgagccagggattccagcgcaagtaatttattaaggaagtactcacaggaaataccagtgaaggatcaaagaagcagaataaaaaagggaagaagccaagcaagggttcaatttcaggtgaagtctctgactcagtctgatcctgtggtgagccctggaacaaaaattgtacctctgagtttgtcttgtctcaagacataggaactgtcttcttataatccagagctagtcaatcatgaactgtagtctgtcccaaggaacataaactctcaggaacttctggttctaaattagggtgagacaactctagtatccaaggtcaagttttagaagtttctgctgtaagcccttatcatgaattacagaacatatgggataaaacaaagcactggtaaaggaaatgaagggtataggagcagatcactaattgtgtccagtacactcttctaggtcccttgcattttctgaaccaggaacatatagtggccatcatagcattactagttcccagtaaggtaaattgttttagtaagtgaacagtgcccaaatatttaggacttacttgaactgaacgttgcatactatgaataggctatttcattgtaccttaagggtttccaaggataatgtaaatatatgaacaattagtactgttatgatgaccaacatttattaaacacataggatatgccaagccatatattagatggtgtatatagtttcctatggtctgttttttgtttgtttgttttgttttgttttttgagacagagtcttgctctgtcacccaggctggagtgcagtggtgtcatctcggctcattgcaacctctgccccccaggttcatgcgatcttcctgcctcagcctcctgagtagctgggatgacaggtgtgcaccaccacacccggctaatttttgtattttttttttagtagagatgaggtgtcaacatgttggccaggctggtctcaaactcctgacctcaagtgatccacccaccttggcgtcccaaagtgctaggatcataggcatgagccaccccgtccagccatatatactttattatcttatcaaacattagaagcctcattttagtgatgaagaaactgagcctcaggaaattaaaaaaaaaaaactcataactagtaagtggttaaactaaaactatattcctggtgtaatccaaaaccctagatccttccaataagcaaaattttgccctttaattgcagtaatagaatctgtgaaacactaggaagctaccagtattacttatctatgctgcatatcaaatccccaaacttaaaacaacaacaaacatttatcatcctcacagtttctttgggtcagagatttaagaacagcttatctgggtagctctgacttggtgtctctaataagatggccataaagattttggctagggctgcaatcctctgaaggcttgactagaaatgtaggattttttttttttttaattatactttaagtactgggatacatgtgcagaacatgtaggtttcttacataggtatacacatgccgtggtggtttgctgcacccgtcaacctgtcatctacattaggtatttctcctaatgctatccctcccccagcccaccactccccaacaggccccagtgtgtgacgttcccctccctgtgttcatatgttctcattgttcaactcccacttataagtgggaacatgtggtgtttggttttctgttcctgtgttagtttgctgagaatgatgatttccagcttcatccatgtccctgcaaaggacatgacctcattcttttttatggctgcatagtattccatggtgtgtatgtgccacagtttctttatccagtctgtcattgatgggcatttgggttggttccaagtctttgctagtgtgaatagtgcgtgctgcaataaacatatgtgtgtaagtgtctttatagtagaatgatttataatcctttgggtatatactcagtaatgggattgctgggtcaaatggtatttctggttctacatctttgaggaatcgccgcactgtcttcctcattggttgaactaatttacactcccaccaacagtgtaaaagcattcctatttctccatatcctttccagcatctgttgtttcctgactttttaatgatcgccgttctaactggtgtgagatggtacctcattgtggttttgatttgcacttctctaatgaccagtgatgatgagtgttttttttcatatgcttattggccgcgtaaatgtcttcttttgcgaagtgtctgttcatatcgatgtgctgtattcaggagacccatctcatgtgcaaagacacacataggctcaaaataaagggatggaggaatatttaccaagcaaatggaaagcaaaaaagagctggagttgcaaacctagtctctgataaaacagactttaaaccaacaaagataaaaaaagacaaagaagggcattacataatggtaaagagatcaatgcaacaagaagagctaattatcctaaatatatatgcacccgatacaggagcacccagattcataaagcaagttcttagagacctacaaggagacttacactcccacacaatagtagtgggagactttaacaccccactgtcaatattagacagatcatcgagatggaaaattaacaaggatattcaggacttgaattcagctctggaacaagcagacctaatagacatctacagaactctccaacccaaatcaacagaatatacattcttctcagtaccacatcgcagttattctaaaatttaccacataattggaagtaaaacactcctcagcaaatgcaaaagaacagaaattataacagtctctcagaccacagtgcaatcaaattagaactcaggattaagaaactcactcataactgcatagctacatggaagcagaacaatcctctcctgaatgactactgggtaaataatgaaattaaggcagaaataaataagttgtttgaaaccaatgagaacaaagacacaacttactagaatctctgggacacagctaaagcattgtttagagggaaatttatagcactaaatgtccacaggagaaagtgggaaagatctaaaattgacaccctaacatcacaattaaaagaactagagaagcaagagcaaacaaattcgaaagctagcagaagacaagaaataactaagatcagaggagaactgaaggagacagagacacgaaacacgaaaaaccctttaaaaaatcaatgaatccaggagctggttttttgaaaagatttttttttttttagactgagtctcactctgtcatccaggctggagtgcagtggtgtgatcttggctcaatgcaacctccatctcccaggttcaagtgattctcctctctcagcctcccaagtagctgggattacaggcgtgtgccaccatacccacctaatttttgtatttttagtagagatggggtttcaccatgttggccaggctggtctcaaactcctgacctaagatgatccgcccgccttggcctcccaaaatgttggaattacaggtgtgagccaccgcacccggcagtatgtattataggatctcctatcagggtgtcccactcatagcattggcaaattaatgctggctattagcaggaagcctcagtttcttgccacacggacctccccatagtactgcttgagcatgctcaagaaatggaagttgtttgatttttttccccagagtgagtggttaagagaggacttttggaagccaccatgcattctgtgacttagccttggaagtcacataccatcacgtctacaatatcctattagttacaagatgaaacctattcaatgtgtgagaaaactacataagggcatgaatagcaggtggtaaggatcattaggagccatcttgaagaatggttaccacactaccattcctttcttcttaatcctaagtatagaactcctgctgtctcctgaggatttgttaagcactttgttgctcccacatccccctcaaaaaaaaaacttaattaaaagtagctaagtagaaacaaatattcaacacactagtaataaatgtagatgttactgaatatttagaaaggagatcaagaagaggactgacatcacacatcacttgatagaaacaaaattaatttttcttttacatctgcctgctttcccttcccaaatccctctcttcagctgccagctgtctcattcctctttatctctttcccacatagcctcaaaactctcctttgttgtgccaaataattcagctctggtcctgagtttacaaacacattcttggcaaaacaaaatcctgatggccattctcactttctttagaatgcaaacatctttgccctattatggaaaatagggatcaaagtagcttattgatatttactcaacaaaaagtcctatttcctaaggtggagggagagagacaaatatgttctcttgttcagaaaataagtttttttctcctaagtgttatatatatatataatatactcttctagcttccagatccagggaggacagtgatccttctgtttcttgctgattggttgctatacctgtttgaaattatagctcttacatttttgtcattgagttagttgctgatcagttgctatacctgtttgaagttacagatcttatgtttttgccattgagttagttacatcctttcttattttgtcactgagctcttaaccagctagcctacatctcatcttgtttagaaatattcttatgatttctgtttttcagttcacctgattctggaaaagaaaagaaaactttgcccctgaaggacgcaagcaattatgagtggatactacataagggccctagctttgtcatgctcgttgatacacactcccacctagcgccttgcactcagaagattcagttcatatatctgttaattgactctaactgactgaggttccctggatgaggagagcaatgagaacagaggcttgtcagcctgcataatccctactaataagctctactatactttgatgcttatcttcattttcttaaactgaaaaaaaaaatcttttggcaaattccaaaggagatcatcactgaaatcttgctgagttcaacttataagcttgtgggcattaaaaattatatcaatgaggtcgctgccctgtaactgttcacacttttatttagaggggaccagcaagttatgactgtagaatgttgataccagttttgagaggacaggtttaatgaagcacatcttatgcctcttcatccttttcatactcatccataaaatatgagctctattggctatgtagtaattaaaggctgaaaacaagaaggggctattatgagctaagaagaacggtaagacatttatttttgagggtggcataatctctttggggaaaaaaagtatggataaaagggagaggggccaggcgcagtggctcacacctgtaatcccagcactttgggaggccgaggtgggtggatcacctgaggttgggagttcgagaccagcctgacctacatggagtgaccctgtctctactaaaaatacaaaattagtcgggtatggtggcgtgctcctgtaatcccagctactcgggaggctgaggcaggagaattgcttgaacccaggaggtggaggtcgtggtgggctgagattgtgccattgcactccagcctgggcaacaagagtgaaattccgcctcaaaaaaaaaaaaaaaaaaaaaaaaaaggaaaagaaagagagagggaggtagaaatgaaagggtctattcagaggtgattgcaaagataaatctagatgtcatagagggaaaagtagtgagagggaaggctggaaaaggaggtttctctggattctagaggctcttgagttgcagatcaaagcttggattttatgctattggcgatgagcagtcattgatgacctaaagtgacataataatgaaaatactgctttgggaaaggtaacccgggtcaccatgtatatgaaagattaatgtaaggagaaattgaaagcaggaagagtaacaggaaaatttcagaaatttagaaatgagagagaagaattgagcctatgaatattccaatgcaaattaatgttctattttttctttgcagtttctagtttctcaaatttaggcttcatgcaatatgctttgaaaatatgatgattatattaattcatagaatcactgattcctcttctaccccaccaatgtttgtaaggtgcattctgataattttattaaccatacctcttcgtaaaggtggtaaaatattgaagctcttaaagtggccttggcaaatgcatataacctgtgagtgtattgtgcttagaattattataaaatgatttttaaaggatcttcacccaggcacagctaatatgagtaagaatcctaaatgtaagttacttctagaccagtggtccccaaccttttaggcacccgggacaggtttcgtggaagacaatttttccatggacggggtctggggggtgatttaaggattaaaccgttccacctcagaacatcaggcgttagttggattctcgtaaggaggatgcaacatagatcccttgcatgcatgtgcagttcacaatagggttcatacacctatgagaatgtagggcctcccatgatctgacagtaggcggagctcagactgtaatgcttaatactggctggccagccactcatctcctgctatgcagcccagttctgacccaggctgcagcccaggggttgaggacccctgttctagacatattattgcacttgtatcattttactgctaatatattactgtatcattttactacgaatatattgtcacattataataaattccagatgatagcgcaatcacagcacaaatacttatcttttctaaaaaaaattccagttgtagatttgttcaatgcaatgtggtatattttatctttctaaagagcagagcagtgtggcaattctgaatatacacgtgcttgctgaaagcgataaattggtgattttctccttcgtgggacagaaacaagtgagatggatataaagagaaaatcctacaagtaataattttagagcacttcttagtagcaatttcaatttgtcactagcactctatgtattcccaactgttactcctttcattccataatttttattctcagatctttccatttcatatcccaaagataacatttgctcaaacataaaaataacatttagctgcctttgcatggcccttgcaaatttatctctcacttcttgtttcccttagttccccagtagccttgaaaaacacccaagttggctgaattctaagccgaatgactgtgatagctccacagtagcataattccaaatgcttatttgatagctccaattgatggctaattggcccttcaaatttaacatacttaaaaggaaatttctgtttatcctctactctcagaattgattcttcttcaacttctcctcctagtacatggcactaccattagttggctgcccaggttaagaaaatcatgctaattttaaaaattaataataaataaaaatctagataacatttatttttcttctcattccctaaacctctacctacaagtatacaatcttccagaaacttcaaactgcaaaatatattccaaatctaatcacttgtctccttttctgctgcccccaaccttagtttacatctctcttcagctgtccttcaggtgtttcctcatgggtctctgttctcttgtttggcctttgatccacactcttcacacagtagtgttgactgtaggctccccaaatgaacaacagaaaaaccttttgatcatacatatttaagtttttggaccttctgctgtaagaaaaaaacataattctacagagtcttagtaggatctcaaaatgggaaaattagaataggttatttattatattttacagcttggtctgggttatttcaaggtgggtcttgttaggcagggattggttaagtttggacaaatttcattgcatagttttgaattgtcggatacatttgagtgaatggatttggattggtgggtactgtgagacaatggttttgaaatgagttgtgacaaatatgtcactgagtcagttcatagtcatcttttaggagcaggtgtttcttggaccaagcatctaggttattttggcttggagtaaatattctttaatatggagcagaaatgtatgcctggttctagtttcatagagagagaaaattatgcttcataggtatttaaacttaaaacatctcttcatatccctgcttataatccttggaaagcttcatgctatgatcagaataaaatttaaactcaaattagaagatcctaaataggctgtcccttgtctcctcactgacttcagttcttaccactcttccccttactctccacattccagccacactagcctttcctttccttgagtaaaccaggctcgttcctgcacttgcgaattgcctctgcctggaatgggtctttctctttcatcatttgaagtctcccacaaatatcatctcttcagagaagacttcttaaggctacccatctaaatcagctcatgactcccatatctcttcactttagagttcatggcactcatccctacctatacaaaattatggtcttttaagcctgatatcctctattcaaatctttcttctgctacttattagcagtagaaccatgactatgttactttgactatctgtgcctcaatttcctcatacattaaaaaaggacaatgatgatacatatgtcatagggttgtcatgagccataaatgaatttagctttgtaaaatgttgactctctaaatattagcaatacaacttgttggtaaaataactgtgataaggaagaccactacctcaggagaactactttggttttgtctcccaaaggtgaaggcaaggtcgggatttattgagaattggaagtttggtttaaggtggggttttttcaaaaagaggattttattaagattgggtatgaatcaggatataacagtctaggattggtgaaaacaggaaagccaggattttgagacaggatttcaaaaaattgtactttgtaagttctctgttgattctattgaaaagttgggaagagatgggtcttttggaaagtccctgtaacgaacaatcaaaccacttgcttcagccagaaactcagggaaagtaatgacagtgggatacaaagttacattatcgtggaggtatgaggttagggagctttagtcctcaatatccaagctgaatatacaggtagatggttttggtgctcagcatgtaaagcatatagaacagtgcctggcacataataagagcttaagtaaggtgaatttcatcattaacttattattgtcatggaagccacaagggtggtcatttgtctgtatctccatttcctggcacaaacattgcttagcacaaagtaggtactcaataaatcattgtggaatggataaatttatttatttactggttttctgtttgtctccctaattaggatataaactctgcgagagagaaaaacatgcctttattgttcatcaaagtattccaagggcctgcggcggtatttggcccacagtaatcacacaaagtgtatttgttgagtaaattaataagcttttaagtatcacaaaagaatcttgagtgtaaaaccagctcccagtttctttcacctccactgaaaggtgtgagtccagaaaacgagaacaaaatgaagaacagaagaataaaaaacccagttacattctaaaataaattgggggaaatgctggtttaaaaagttaagtaagatcctttcctgtaaggtttctcagatcctttaatctgccaatgtgcattgttgattactaatgggaaatagtgtgtatacttgtttgatcagggaacttgtttttcccctttttgatttgagaacacttatttgcatctctggaaatacaacattagcgttatttgagatgttctttgggaaatgctgtattaagcagttttatccaaagtcagggatgccatcataggaagccgaatgagactccttggcagtgatctggtgttgagtcacttcagggtgatgggagaagcacagatgaaggcagtcccatcctgatagggctagggctcctccagagactgcacataagtgccctgtttgctaccagaaagcactcacatgtgagggagagtctggtttaatgtccccctagttggtgaacactctccaatcttaaccacaagtttcccacgtgtctctgacatggagtgccatgagagaagagttttctactagatactcaggcagcattttgttcttttacttggccctcacgtgtaccttcaacttgggttttacccctaaaaacttatgttgttgtgtttgggggaagtcaaaaccaggacacatgaaggattcatattctggagcttgtctacttaaaatgaccaatgctttcaaacaattatttcatattcgtatgcctcagattcttcaggaagaaactgagtagcttgaatgatagtcatgggttctgaattgtacattgtattagtccattttcacattgctgatgaagacatacctgagactgggcaaattacaaaaggaaaaggtttaatggactcacagttccacatggctggggaggcctcacaatcatggcgggaggcaaggaggaacaagtcacgttttacatggatgacagcaggcaaaaagagagcttgtgcagggaaactccaccttataaagccatcagatttcatgagacttcttcactatcacaagaacagcatgggaaagacctgcccccatgattcaattacctcccaccatgtccctccgacaacgtgggaattcaagatgagatttgggtggggacacagacaaaccatatcatacattgaggaattttagtttgggcaaggcagggaggtgggcctctgggagcagcaaataggcaactcctgttagtgcctctaagtcaatgcaatcttgctcttatttgctctatgcaactttattagaagagaggaagttcctacttaaaaggtagtttttattagccccacctgtgcaatttcacttgaagacatctgctactaaaagtagtttgaaaactactgtactaaaaaatggagtccactgtctttttttgtatggtctccaagctaacaaaggttttgatatttatagatggttaaaaatgtcagaaaagaggaatacaaattaagcattcctaatctgaaaatccaaaaatctaaaatgctccaaaatccaaaactttcctggtgctaacatgacttcataagcggataattccatacttggcctcatgtgactgggtttcagtgaaaatgcagtcaaaatttcattttgtgcacacaattattaaaaatactgtataaaactaccctcatgctatgtgtataagcggtatatgaaacataaaggaatttcttctttagacttgagtcccatttctgagatatctctctatgtaaatgcaaatattcaaaaatcagaataaatcagaaatttgaaacacagtctcaagcatttcagataagggatactcaacctatattccattatgcacataaattatatgagattcggattttagtgtccataaatatagtcttattggaacacagccacacccatttgtttacatattgttaatggctgctttttattgtctatggtgcttcagcagcagagctgactatttaccacaatgactatatgattcacaaagcctacaatttttactacctagtcctttacaaggaaagtttgctaagccctgacctagatgattattaggatccttttctacccccaacatttgatttttgttcatctttgtggaaccatattgactggctatgtaagattcttctcaaagcaaattgaatcaagccaggactctttcactatgttataaaatcgatttaattatgttacaacaatccttctcatttgagaacatacactacctaactaatccatgtctttcaatctgccttcaccttcattctgaatggcgtttggtatattctactttgttatgttgaacatttctttttttatagtattttaacggggcagcataaaattgcatggctcctctgcaatgtaagtactttagcacgacagagttatagggttgtaaggaagcttgagatgccatctaatctctcctactccttctggacagaattatacttaaagtaccctggaaaggttttggtttactgtagtctttaaaaatccctccacaagaacatttccaaatactcactttgtagcacatcagctgtcaaatgatttgtaacttgggtgcctatgtctgaccaaaagtatatttagagttgttccattttaaggctttaaaatggtttattaatagggcagtacttccagctactcaaaccttgatttttattccagccctgagtcttaaatctgggcaagcacggcttctcagacatggtatcttctaagggcagtgattaagaggcaggacctgggagactactctgttgttgcatgctctattctcccctccacactgtaaaatcctcgcggataggagcaggatttcttttttttcctaactcccatagcacacacagagtgtattgaagaatgttcagcccaacctctttgcaagcatctttattacaaaagatgaagggagggtggatgtaatcaaatatgtactttatattggaaagcaaccaagcctctctgtgcatgcactaccctcatacaatcgataataaattagcattttatttatactgtataatgccgttcttttcaggagtctgatttggaagccaactactgtttgtgttctccaaagtggtttttgatggagtgctaattatgtttcacctcaagagcaatgctgacgggggaccacaatcgccttattgtagtagatccagctgatgaatctccaaggatagcctcatgctatattctggggggcaagtaaatataaaaatacatttttgatcaagaaaatgataccatttacacaacagtagcaggattcagcctttgtaaaacagctgcatagctgcataactgtgacgtgattttttttttttttagtagagaaaaaaacatggaggaaaatatatatcaactcaggaccctagctgaatctggggtttagtagttcatggtgggggcaggggactatattttcaaataaatctagcctaagtgaatttttgttccagatagaagaccaacttaataaatgagtcctgcgtagagaagtatgtcacatttagcaaaagaagacacgcgcaggtagagccaatcttttcacttgtgcgaacctcattaatcctgtcacataaagttttgcacttgtattttagctcaactcaaggaagcttgatccagatattttttcagtatatttttcaatacaacataataaagattggagaatattttaactccacctttttttctttaaagctttcttggccaggtgtggtggctcatgcctgtaatcccagcactttgggaggccaaggtgggcagatcatctgaggtcaggagttgatgaccagcctggccaacatggtgaaaccctgtctctactaaaaatacaaaaattagccaggcgtggtggcaggcacctgtaatcccagctacttgggaggctaaggcaggagaattacttgaacccgggaggcggaggttgcagtgagctgatatcatgccactgcactccagcctgggcgacagagagagactgggtctcaaaaaaaaaaaggctttctttgggtcaggctgccctttgcaaacaccatttttaccaccaaagtccctgcagctcatatactaggctgagatatatgtatgtatgtatatagtatataaaaatggacgtgctctcacattgctagaggtacatagactctctgcatgacttgggattcagaaagtgtgtaaaattaagtaagatgacaatagcaatccattaattattctacatctaccagagcacacttccatgtttggtcctgtgcttttaaggaaagacctgccttttagtgtcatgagggctctcaggaatggcatcttgatgatcacaacattaaatccaactcctctgtcaggcagctaaagtgttaatttattttgtaattagatctctcaccaaagctcacaggaacctgcatttggatctcatttgattatgtatagacccttttatatatgccatcatattaaaggttcattctatgtggcctgccttatgtgctcagtaaacatttgttgaatgctgaaacaaatcaccctggggttaaaggaaagcgttgagggtcacagaggttgacttgccaaacgttactaagctactatggggctaaggcaggagtgaatagttgctgctttaggcaactccacccacccccgaccccgtttgtgctctttctttttttctaaattgttctagcagtctatgatttggtgtacttctttggttaaaaaaaaaaacacacacgaacaaacaaacaaaaccttaagggtctttaaaaaataataagttatctgttattgaggacttaattttgtgcactacactgtaccaaatgctttatatttattaacctatttctttttaagcaataaatctaaaagcttggtattcttatccccattgaaaaattactttaaataaaaaaaacctctccaatgacttttattatattcacataaagctaatggggccgattaaatgtttattgttaaatatccatgaatcatttcaaatatatatgtatttttataattgtaactcatagataataatacagttgggctacaaaagctatttggaggaagacaacaattctaaatggaatgtgatttgtgtttgtcaagattatgtcagcaatctatgattttagcaatttatttggtccatacgtggatagaaaatatcaagcacagggaaggaaagtataaacatttgttcagcaactactatgtgtcagacatcattgatgtttgccatatttagatgtcacaaggaccctgtgagatcctttaaacattttctgtaattaaagatgaagcaactgagtctcatggaaattgggaaatttgctcaaatactttactttgacccaaaggaaaatgcaagtaaacccataccactggctgaatattgggttttaagggtttatagggagaaatatttttcaaaatgtatctgacttgggtgggtcttgagtctagatagaataaagcactctatcttctgtgacctgggaaaggggtgccgttgggggtgggaggagtcgggatggaaaatcaggtctgtttaggaccaaatttagttcccatttaaaacactgaactgcttccaaagaaattaaactcatgaccttggtctacatgaaatgaagccagataaattaacctgacatacacacttatataagaaatccttgaaaaggaagagctgatgaaaccagggaatcatatttcctgtaagaaaagttggtaaaaataccagtgaggtactttggtgtatcatattataatactatcagtagtataaatgaaacgaacaaaaatggtaaaaaaaaaaaattgatctagaataatgtcatcaacaaagtatgcaaccatttcttttttcttctttccaacttttattttaggttcaaggcatacatgtgcaggttgttatatgggtaaattgcatgttccaggggtttggtgtacaaatattacatatcctattctaagtgctgaaaaactaaagtttttaatgctcctatcagcaaaaagagcaccaagcaaataaacatgtcctaatcatttgccatggtagtagatcattaaaaaaatacatttatcttaattacagaatacatgctaagcagaggttcagaaataaaatttctaatgggaactgacagatcgacaaaaggctaacataatatttgcttcatttgtaacaagtattggttgaagggtccaggtaactcaactagcctcagaataaaggatgtaaaactgaaaaggagattttaaacattcttttttagtagcaaaattacacacatgttttatattaaaaaggtaatgaaagaaaaggtggaattttaaaattacgtgaatttctttgggatgaaagcttctggaggcctagtgactgctgaacatttctagaaaagaagacaggtgaccaaaaagcaaattggaaacaaaagacagaatgtttgaagatgaaggccagaggtaatcgatttcattattatattacatcatgtaaaaaatttcttatttcattttaaacagatacacggccatgatgtagaattagattttcttaaaactccaaagaaaaagaaatagcaatttagaaaagcaaattgtaggataagatatcaaactagttagtcatccagttgcttctaatgtcaagtgttttctactttctggcacacacccttgctattgcttttccatttctccctggtcattctcctcctttagtgtccaactcagacttcagccacccagacaaagtattttcttctcctactcttctgattgtgctgagccactttgctgcctctagccctgccacagcacctgttgaatttgcatttcaggtggccgttgaaattgcatttcagttctgagctctggtggataggaaccaggtgccattgatgtttttcactttttcatatattctcagtgccttcccagttgtttagccttcacctgtcttgcccttctctgaattccagtcccatcagctttctttctgtccccatccttgtcataaagccccatccttgtcataaagccccatcacagcatttgccctatgcctgggctactcttacttctctttgcctaattatttcctgcgtgtccttcacatcccatctcagagaggccttcggtgacctcttcatttagatcaaattgccttgcgttgatagtgttgtgtacctagcattgggcacatttgcaattataaatttgtttattaagattttacggccgggcgtggtggctcacgcctgtaatcccagcactttgggaggcctaggcgggaggatcacgaggtcaggagatcaagaccatcctggctaacacggtgaaaccccctctctactaaaaatacaaaaaattagccgggcgtggtggcgggcgcctgtagtcccagctactcgggaggctgaggcaggagaatggcatgaaccccgggaggcggagcttgcagtgagctgagatcgcgccattgcattccagcctgggcaacagatcgagactctacctcaaaaaaaaaaaaaaaaaaaagattttacacccctaccagactataaatgtaatgggggcatatactatgtccatatttcacttaaggttatatccgtagctcatttcatagggctgtacgtatagtagatggccaataaacatttgtgaaatacattgataatatggggtgtgtaacatttgtacttttgaatctaataaatactcatggtttaagtcaattatcagtggtttatggttcaagatgtttgctcttaatttttcttcactgtatcaaatagagatattgaaatttcacttttaccattttccacatttttttccagttccagtaaaattcagatttagtaaccctttcctacattatttctttccccagttattttaagagcatttcagtagataagctggtaacaggggagaaggaaaagaaactaaagggaaggaaaagatattcctgataaaaaaggtttaactatcttgccaaaatgaggttctaagggaatttgattaaagaagtattaaatatatggacatttgtatatttgatactcaattttcaaagaccttttccctttaataaagtagtcaagtgcttttacatgtgggctgtctgaccccagtaggggcataaaaaggctaagaattctggcttgttggattatggcagttggacatttgaaacctacaattttgatgtgcatccaaaatgccactggctaaagagacccccctctaaccctgtccttgcttgtgctacagctagaagcacacaggtgagagcagaatgaaacacctaagaaatctaaagaattggagtttaggaccagaaaatgaaggttggtgttcgagaggctaactggagattttataatgtctggcactctggggaagagaacccacagtgtaaagtttaaggaagtaaaatgtatctactcctttatattaggcggtagtgtattttgcctgtgtttttgttataatcaacaacattgtgttatgattgatccattttaggtctctcttttgcaagactctctgggttccttggatgatgaaaaggttgttttgtattttcatatgtccagcactgagcaatgtgcttaacacttaatagatgctccagagatatttgctgaatgaattcccatgtcctccaaatttgtcctatcctctctgattagtttatttaattaatttatttatttttgagacggagtctcactctgttgcccaggctggagtgcagaggtgtgatctcggctcactgcaaccttcgcctcctgggttcaagtgattcttgtgcctcagcctcctgagtagctgggactacaggtgcttgccaccacgcctagctaatttttgtgttttagtagaaacggggtttcaccatggtgatcaggctggtcttaaactcctgacctcaaatgatccgcctgccttggcctcccaaagtgctgggattacaggcatgagccaccatgcctggccctccccaattagtttttgtctttttttttttttagtttaatgtattttaatagcaaacttacaggaacagcacagaagacagacaacattcaaaacatgtacttggatgtaggacaactcagtcagaaaagtatagtgaatggatggaatctactgtatgataaaaatgctacaaacaccatttagttgccgtcaataagaaatgtacttgttttgaaaaaatccaaatgccggcattgtccagaaaaatttaacgggtttatttataattattttaaagttgaaccgctgaaacttgttcactgaaacattttaacttgcattaatgctttatgactccacatttatattaaaaattcacacacaaatgaaaatggaaaaactgccaatacctaattactgtcccctatttttccacttgcaatcacatacttaggtacattttgaccccatggaaaaaaattaacgttcagaactaccagtaacaggaagaagagactttttttttttattgagaatgaaatgtttcccatcatagtggattcttaagcacgttctccacgtatgcagcctgctagcttgatgtcttttggcataattgttacacgtttggcatggatagcacacaggttggtgtcttcaaaaaggccaaccagctaggcctcagttgcctcctgcaaagcaccgatagctgcactctggaagcgcagatctgttttaaagtcctgagcaatttcttgcaccaaacgctggacgggaagtttgtgaatcagaagttcagtggacttctgatgactaatttcacgaagtgccacagtaccaggcctgtaacgatgaggtttctccacccctccagtagagggcgcactcttgcaagcggcttttgtagccagttgcttcccgggtgttttaccaccagtcgatttgcgggaagtcagctttgtaggagccatgatatagagacctccttgcttaaccacccttctccttcggctggagctcggcgagctagaggcggcgctggctagaggcgagctagagactggctagctggcgagctagagagcgacggtggcggtggcgcggcggcggctgcgaacacaattgctccaattagttgtaagcatattttttaaaccatgcttacctatgttatactatagttgtgtaaagataatttaaagcattaacaaaggatttaaccatttagtaatcagagaaggaaaaacgtgttagaaaaaaatgaagagattaatctttgtactttagctcaagaaaacctgggtttcttggtaaaaaaaaaaaaaatgtagattcttgggtctaatcctggatctaatgaacaagaattttttggatgatgcccaggaatctgcctttaaaaagtcagttacttttggggaccagtgttttgagatataaatgttaaggagatgggcaggaaaacaaatattcttactagcattgttttatcttgactttttcatgtctgagtgtgggaaaatcactctataacacttcacttgtgataaaccgctccagattccaaagcagaagcagagtgaggatggtgtgtgtgtgtgtgtgtgtgtgtgtgtgtgtgtgtgtgtgtgtgtgtgtgtgttggagttactgggttgccattaaacttaattgactctagttatttctgttttctcatgtcatgcccaggataaataatgagtctcaaaagcattgaaatacttttgacccctaaaaaacaatctattagtgttttgattttataatacatgtaagagttatttgttacacctgtttcttctcttttttatcctccactcttgtcaaaatgtcagtcattaaataataggtattttagataagaattaaatatgtagatatttattcacaaagaccctgcaattttccccaaaatagaaaaagccaacttttgtcttcagtgaaagacagaaagggtaacatatgatatgaattattagatataggatactcaaattcaaatttgtttattataaatttgttattttagaaatgacagctaggacatggaatgactaaaaatatgtacattcaataacacatttagaaatacaggaaattttagaactaggtactttgagaattaagagattaagaagggattattttctatctgcacagttctcagggaatagatatgatgagtgatcctaactatttgagtaaatgtcaactgccagcagacaccaccagcttatatcgaagaaaagtcacaaaaaatatgaagagattcatcacactgggaatggaaaacatcgaataagtcagcaagtccagcaaaagaagaaagtattacaagtataatttaaaaatagttttggcaagaggaggttggggagaaagcagagtaggctataataataattataactcaaagatgggccagacctaaatgtacaccttggcctctttccatcctaaaatgttctatattagcaaaagaggtgttatgatttatactcagctccaagtctagactggtttaggtttcctgtgtttaattctgcttctttcttaacaaaaaaatctagtcatctagatctcaagtgaaatgtgcaattgaaggtataaaaataaaattcaattgaggaaggcaagtttgtccttaaaataaaatttaaaataccagcatttatttttaaaaaactacctaattacatctagtcccatacatatgttcaagattaatatgcaactgatgcatgaaaataaaattcagctgagggtaactactgtctcattaaaaagaaaatagaaaactagcatttctatgaaaacgtctagctaatcatataaaaactcatatacatgtgcattgacaagtaaatgctggtgatatattatttgattgaggtcaatttttattctaaatatttttgcatagtgggaatttgttatgttaaataattttgggattggatctctgagagggcttagtaatatattttatattaaattaatcacagtgaaaaaatctttgaaataggcttgatgtttataattatagtattctgtgtttaaacgtgaaaacattgtctccttttaaaaatggtattaactctaggagacaggatatataatgatcaattctttctaccatgaaactctattaattactaaaagtgttagtatgcaaaatacaatataagttgataagaaaaaccaattcacatttgatacccagtggacaaattagaataaaatattataatgttcaaagaacactctatattccataatgttctctgttaagcctgtgtccttctgagtatggtgagtggcaattctggccttaccttcaaacatctgcttcatgtttaaattaaattatgctacgtgcttgtccctgcataagagtagcaaatactgaaagtacagtgaaagggatagtaaaagacttctaagtaggagaagtattaaaaatattctccagctggtaaggctggaacactgatgatcaagacagttctgttgaagggtgggaggcgccctcttctttgctccttcaggtgttaaccttttttttttagatggtggttgattgcagggcctggaggagggcttgagtgtggcctgtgtggcctgggtctagagaagctgttatttaccaaccaatttggaaagagtttaactacggtatttaaaactgtggcagctgtatctgaccaaaagttaagcttctgaacttttccccatagatcacagagggcgggcctccagggaaggtttcaagcaggaggctgacttgaggaggtttttgttttagaaagagccttcaggtagcaatgttgaagatgatggattgcatgagtttgagaaaacattcaggaggattggttttaaaacctaagaaaagaattgaggtagtggctagggagcagaagtgaagaaatggatgtgagaactactttggaggaataattttacagagtcagtgacagttttagaattggatagggtgtgagtttgactcccaggattctggcttggaccactgtggaaaatagtaccattacctgggagaggataaagatgtagtggtgtctgttacttgtttgtctggtttgctggctgattggttggctttatttaattaattttctgagaagagccatgtttataagctgcaggcacaactgcaaatacattaatttaaacatataatagtgcggctttctctgtcggacaacaaaaaagaaccagaaaaggaagggggtgaggggctgaataacattccatgatcacctattatactcttttaactaattttggaatcacattcatgccatacagaggatagtactgttgccatttcacagatgagaattctgacttaccaggtttgaatgactggcctactttctcatagtcagaatgtggcagcgtcacaatttaaatccatttctgtccatcttcagggtctcagtctttaactgtatgaaaatacctccaaaatggaaaagagtgaaaaagaatgaaagggaagaaaagaaaagaaaagggaaagaacgaagaaaaaagtatttagagtgaccaaagaagaagaaagcaaattccaattgaaagggaccaagcagagatgctcatccatgagcaggtcttacccccgcctagacaagttcatagtcctccctaaaggtggcaggaagtttacacagaatattagttcctcataggtgtccctagccttcaggtgacctgaacatgcagccagtaagtgaactggtatcagtttatggccaaaccactgctctctagacttctgcttttagagtggtgcttttcaacctgggctgctgcagatcctcacattctttccggtctgtggagtaattgagagtaggctattagaaacttttataggaatctgactgagtactgttgtatctgctggatccagtaattttaaaacgggattgtattttgtatgtctgtttcatttttcaagtcattggcattgcgttttatgaaataatatatctgtgatgaatcagaaacaaaggaacaaaaactggcccttcaccacagataatttgagaagtaagctttagagcatcaaaagaaaaaaagatgatgagaacctgataggtgtttttgtgctcttggtaacagagactttctcttataaatgtgatggtttagtgaactgcctttacatagcgatctattggccccatatacaaatataatcaaatgatttgtgtcatttgaagctacacaatagatgaacctggtttttgtaatttaacaaaaaatccaatttatgtaacatattaaaagaagcattatcaacttgttttctcctcaaaagactgtagctgttaaactccttaattacttcattttcactctcagtgtaacattagcagtttagcacttcaagtacaaaaatgattaatgagcctgagaattcattcgcatacatatcactttgcatcttgacataaccctggagcctgttctctattctagccatagacatacttccctagcaaatatcttattgcatattaaatgcctaatcattgcaaagtatgcataattatagtcatctttcctgtttttttctacgcaaacaaaaaagacaacaaatcaaatgcattcaaatgtaactaacattttaaaccaaagtataaatccatagggagcatcatgatttttgcattgtaactgtccccgaaaattcaattgtgatttgagctgaagtgtcattcatctaaaaatgtatctttaaaatttttttgaacatgaaggaaaagactttcaatttctatatttatatgtatgtgagtactgtgacttgggaaaatatgacgagagtaaagactgcattgtggattcagagaataagattttatttggagttactgtaagaaatatctgcagggggctatttctgtctaaccatccttggcttgcattggtgacatgtgcctacatgtttcttttagctttagtgaatttcttttttgatctcctccaaggtgatcccacagtgctgactttgtccaatcattcccgaggcttaatcttttaagtatgatcaatggttctttgtgtctttgccttcccttgttttttctactgtattctgtggagttcagccacagctctgtgctgtccctacctaataatcctcttttccctacatgctgatcacctctaagctacactctactacattcagtatggaatcaggaagactaaatgaactttttctcagaactcagagaactgcacttgtcaggcttgttgccattacacaacattgtagttactggaaggtgaaccaaacaacttccaggggcctttcatgtgcaagggaagagcagaactgtagactacttgctagactctaaatctggtctccaattgtttttgttcatgtaggtaaagctatatgctctaaatttgtacctgtttccatttgcttttagagggagacatttagttcggggacaaaataaataatgtccattgaactggacatagtcaaatatttccaataaatttttaaaaccatgtgtgtactccggtaaagcacaggtatcattttctcactgcacaagtgtatactacaaatgcagtcttgcggctggacatctctgaccaacaactagaccactgaaattgcaaggcaatgcagtcaactaaggcactgaggcactgttcccaggaaagatcgtttgattatgatacaatcaggactccttatctagacccatacttgataaatagggttggcagataagttacaggacgcccagatataaaaacaaggaatttaaaaaagtgtaagtatgtcccaaatattacatgaaatatatttatattaaaataaaattactccttatctgaaatacaaattacactgggtgtcctgtatttttatttactaaatatggcagttctatttataagtggtactttttttttgtttgtttgtttttgagacagagtcttgccctgtcacccaggctggagtgcagtggtgtgatcttggctcactgcaacctccacctcccaggttcgaacaattctcatgccttagcctcctgtggaactgggattacaggcatgcaccaccatgcctggctaatttttgtattttcagtagagacagggtttcaccatgttggccaggctggtctcgaactcctgacctcaggtgatccacctgcctaagcctcccacagtgctgggattacaagcgtgagccaccatgcccggctataagtggtactttataagcagcaaagatcatttgaaacagtacacttcctgaggttagtgactaatgagattattcctatatccctaaatgtcatagaagtgggaggaaatgtgaaaaaacagagactcaagagtgggtgtcagctatggagcacgcacgcgcactctggtgcttgcccacgctgcactggcctacactggcccacgcaggcccacacagacccacacaggatcactcagaccgacactctccaggttagagcacttatccagtggatggttcagctttctggaggataggtggagcgttcttaatgccagcccttttctggtccccactaggctgtggtaccctcagaagtcggaaggcgatgttacatactaaggattgcttcctttgtgctgctgcaggatgcccggtgaaaaaaatctgtaaaatgacatccaaataacccaacccttacctgtgtggattttgaacttgctaaaagacacagtggaccccacctatttgtggattgagctaataaaaataatttaacaaacaatgtgataaatatgatggatatgggaaagctgatagtgaagatctttgggtcttataagactgtcaaagaggatatccaagaagaaacgggacaaagaagaaagatgaattgcatttctaagaaggtatttaaatccagtacctccaaaatattaatataaagataaatgcattactaggcggtttttgaataaattttttttgtttacaaactaaactattattctgtaagtaggactatattaaagtgaaaaagagtagcaaagtatgaatgaatacacaaacacacataaaactttctaattagaacaaaaaaaccatatttcttttggtccttttgctttgtttgtttaaggtacataattgaaaaatcagctattctgaatgaaagctttctatcaagtagatgatacttagatttatttttgctgtcacctggcttagttggctatataaacataacaaattgctaattgatattagtaaatatacagtatttgtgacttccttcagtcattatacctttcctcgagaaagtagacttaattgcaccacgtattgggggctgaattttactagtactactaatttatccagcagtggctttctatttgctatatattaacaatttgcatcttgaattagacagttttcttgtagtgtggagatatttattacttctaatgacatgtcaattctactttacttttaggcctaattttaaattcacttaagaaaaccattttttattgaagagatgtgtacatattttcaggatggtcatttaaaaaaaattccaagcaagtgaatgaaatcattcttgggctgtgaattaccttaaaaaatacatttgggaaatatacagtgcctactacccaagatagttatggtgactaattagcttcttacctagatttacagcaccgttaccctgtaaaataatctttgtaaaataggtcacaaactgggtctgcctgaatcttaagtataaatttcatgtttcatggttttgtactgcagctctaaagtaaaacaaaacttattgtcaatcgaatcactttggaggttcatgttgcctcgcatgtcttttgcttaaattcttgtctacagctgcctgcctgatttggatcttgtgccctaatcctagtaactggactcctgttttgctactgtgaacacatttttgtctgttcgcctcatgctagtaactccctttctcattcttccacatgtctggttctgaacacccttctgatgactacagctctgatccctcctctcctggtgaatgatgttctgaacctgtcttaggctgttgtataacaaagtgccatagactggatggtttgtaaacaacagaaacttatttctcccagttatgtaggcttgaagttagagaacaggatgctagcatggtggggttctggtgagaaccctcttcttgtctgcagaatgctatcttcttatatcctcacatggtggagagcagagagcaagttctctggggtctcttttgtaagggcactaatcccattcatgagggttctacccttatgtcctaattacctcccaaaggccccaccctctaataccatcacattctggattcagatttcatcatatgaattttagagggacacaaacattcagtccatagcagatcacagccttcagcggtggcagccttagaatttctatgtagcaattaggcggtgcttggagctgagctgtttgggtatgggagaaaagcagcttgttttaaagccatgtgtgcattgcaattaccctttttttagtaaaagttgcatatttagttgtggtggcttgggggtagtaataaaaattcatgaaggagcaggtttctttgtagccaatcataggcaatgccactgaattcaaggctgggaatccaaaagaattgttttttttttcttttttgagacggagtctcaccctgtcgcccaggctggagtgcaatggcgtgatgtcggctctctgcaacctctgcctcctgggttcaagtgattctcctgcctcagcctccagagtagctggtattacaggcacacaccaccatacccggctaattttttgtatctttagtagagacagggttacgccgtgttggccaggcttgtctcgaactcctgacctctgcatccgcccacctcggcctcccgaagtgctcgggctataggcgtgagccaccgcacccggccaagaattgttttcttacttagttttgtgtctgcagctttgtatataaatagcatatagctgtagtaaataaatatctttgatgattgatctaatgtcatgaatttctagtcctggattccaaatagccacatctattcaactgtaactcttgggataccctatttctcctccttgaagttttctgttggaaaacgcttgctttagccactgtctatggcctctcatgatatcctccagttatgaaggtgtttaatgtactgtgagccatggatagcataatatagtcatgagatttatcataaaacagacctggaactgaatttgtgtcataccaatggtctggttacttctctttgcctgttttacatttcaataaaataaggataataataatattcattctttctcacagtggttaagaggattaaattaggaaacttaagtgtttgacacgtatttgataatcaggaaaattgccctcatctgatatgttgaacttataaaaattgccctcatctgatatgttgaacaaagatggactttgttcaacatactttatccgtgttttagataaatatagatattcaaagtgctgagtcattcattcaacaaactgtctcttaggtgctactttatttcaggctctttgctaagatgaactggaccagaaatttatcagaaaaagtaacagggcatatgacatattagagttaaggatggctagaagagaaatggggatggttcaggtagaacaacacaattaaaaatgtagccccaaggccgggcgcagtggctcacacctgtaatctcagcactttgggaagctgaggcgggtggatcacttgatgtcaggagttcaagaccagactggccaacatggtgaaaccgtgtttctactaaaaataaaaaaactagccccttgtggtggcgcatgcctgtaatcccggctactcaggaagctgaggcaggagaatcgcttgaaccaggaggcagaggttgcagtgaacggagattgcactactgcactccagcctgggtgacagagtgagaggctctatctcaaaaaatattatatatatatatataacttatatatataaattatttatataatttataatataatataattttatatataaattatatataattatatcatttataatataatttataattatatcatatcatatataatttatatatataatcatatataaattgtatatatatatatcccctccaaaattgaagagaatggagaaataataacaattcgagttaatttcggtgatcttggagacattgctgaggctggaaaggatagaactttaagagacttgtagttatgtggactttatggataaatacaaaagttttctcaggcaaatgtagagaatctctgctttgtttccactgactttaagtatatcaccatgataaacactttggtgctattctaattgcatataaacatgcacaactcccatcctgaaggtaggatgaccaattatcccatttgcccaagcctgaggactttcccaagaaacaggactttctttgctaaagctgggagtgtcctaggcaaactgggacaagttggtcacccgctttaaagcaaagacaagactgtgtcttaatctttatgcatcccagaactttgtgtaattccttgtatagtgctttggaggggatcaatacatacttttgctgactcatcagttttaaaccagacccttgtgattttgtctggatagttaaccagaatagacgttggttgaggctgataaattagggaaaatagagctgtttggctaaaagtaaaactaagaagaagaaagccagcctcatctgcaatattgaaaaaaatatgtgttctttctctagtctgcacctgtaattttatgtttcaggtttatttggactctcagaattttcacaatatagcagaattgttccttgcactcagttaaggagtaatgcaatcagaacaggggttggaatggtaataaccaaattcctgccacagctctaccaccctctaataatataaacttaagtaagtcacttaaactctcaaagcattattgctttcaaccaaaggcatgtgtataataacaacttccttataagaaacagctccatatgataacttttataaaatagacttaggaacttcaaaggatgagataaattcgaattattctaatgaccagtcatgccataatgatagtgatatgctgatttaaatgattcagattatggttgtcaacatgtgatagtgaaaataactaaactaccaaagttgaatttccatgtacacactgaaaggacaatatctataaatatctatagcacacctcaatggtcacaatttccagtgagtaacattgattaagtaaaattaaattcttctgaagtttaagtctgtagtctcctaaaatgcccacactggctcaattattcatgaattacagttatattctttttctcaagtctttcaaaaggactaatttaaaaaccagaaaaggtattaacaaatcaaaagaacaaagggacatgttcatttcaagttatgccttgaaattgtaatgaaaacttaatctcaagggccccacatattttctaactgctaaatggaatatcctagttgtacttttgtatctagactgaacaaaacttataaaattcattccaacacacttgccagctaatggatctgagtacatttaatagtaaaaataatgctactgattacattcagtaatgcattttgttttttgcatttttttctattccgaagattgactgagttagtagtccaatgctgatgtgttacttatcagctatgatgaaattactagagtttttcccagttagctatgatgtctaccaagaaactatgatgacaaagaagtctggatttctagtccagctgggcagcacaataataagaatcattcaggagcgctgtatggactgaatttattgagcaagaagaaaactgcatgaacaaactgtggaagcttaacacatctggttagcaaagaaatttattttggccggagagattaaaaacctctttttccagtaacttattctgccagaggtactagaccagaatctgggccatcccacagatcttagcatatgggcatttttcagtagaaggagcattgaagttactgaactgttttctctgcctagccaatttaatatgaaatatgattgaaaccagtaggtccgcactggtatttatttatttcccagtgctttcctaaacgagttttatagtattcagagcatagtgttaaattgattcacctttctccatgtgagaattgtaagcaatttgattagcttttctctattttcatcttctgacatatactgttataactaagaaaaattataacccttttttcttactgaaaataatttatattcagtagtgtttttgtgcctgcacagaatataatctctacaggcttaaatatcaacatttgtaactgtatgggtatgatggtattaagaacaattccaaagacaaattacacttttaaatgttcatgatactgaatttatccctcagaccttataattgaacgttgcaaaccagacacattcctgtgtgttttatttagtgaaggaaggaaagaatgttaaaaaaaaaataaaattagggttttttatatgactgctaaacatgataaattaagggagtcttgttaccctgagagatgtaactttattgatctctcagttaaaagctgctaaatgagtgaatgaaaagatagaagctgggggagggggactgctatctttgctcttcaagaaatggtttatgctaaaatttaatgaccacctactaagagcagtgatgcatgcggaggcttgggtcctttttttcttcctttccatgcctttcacagcggagtctaccactgctgctcatccttagtttcacctgccttactttctgtccagttttcttcctggatcagggccctggcaccctatctaacttctattaattctgtttcctggctgtgggtcatgttcctcatatctaccacctgctttctagtggcagtacaacaattacagctacctgccagccccatcaccccacttgaaaggaatccattatttccagggtcctgcttggattgccttatttcaatcctttaaaaaaaatattcattcttgtgggcttttgactttctcatttccaaggtcttctttttttaacctttaaattcaggggtacaagtgcaggtttgttacataggtgaacttgtgtcatagaagtttgttgtacagattatttcctcacccaggtattaagcctagaacccagtaattatttttcctgatcctctccctcctcccaccctccaccttctgaaatgccccagtgtgtgttgttcccttctatgtgttcatgtgttctcatcatttagctcccactaatacgtgagaacatgtggtatttggttttctgttcctgtgttagtttgctaaggataatggcctcctgctccatccatgtccctgcaaagcatggtactggtacaaaaacagacacatagaccaatggaacagaatagaggacccggaaataaggctgcacagctacatctatgtgatctttgacaaacctgacaaaaacaagcaatggaaaaaggattatctattcaatgaatggtgctgggataactggctagccacatgcagaagattgaaactggaccccttccttacaccatatacaaaagttaactcaaaatggattaaagacttaagtgtaaaacccaaaactataaaaaccctggaagacaacctaggcagtaccattcaggacataggcacgggcaaagatttcataatgaagacaccaaaagtaattgcaactaaagcaaaaattgacaaatgggatctaattaaactaaagtcttcccttaaaaggtcactactttccaggtgggtagcacattcagtggctaatatcttagtttgaagggcatttccctggccagtgtcctctggagttagaaagagctgagcagcatggcagcactggtcctctgaaaggggaaaacatggagtgggatgtgattaactgagatataaaatctcggagggtgtgatccatgacccttgttgacccatgtcttcctcacacctaggagtgcctgcaacaatgtagatcctcagtgttgaatatatgaatgtgtaaatgaaggtacctatttcacaaatcgtctaggattgacatcaccctaaggatggatgttgtttatttcaccagcagtttgggattgtgaaagccctgtgtatggtcacaggctttgaaatgtgtgatgaatctgcatctttaattgggtctctatagtcaaatgagagtcttcatttttctaaaggttcatactgagaagcacaggctttctttcagtgtattgaaggtgcattgtattagattaacactgaaccaaaccattgtcctttgaattgcatgttgtaatcaaacaatgcgattgttttgttaaatactttaaaaattgtattgacttctcaaactaaatagaaacttacttagcttaatagtcagcttatatcatattttatctcatcacatttttcttttctaatgactgtatttgctttattattctgtggctaagtaagatttaaaaaaaaaacccaaaacaacattaaaatgctcccttttgaccaaggtacttccttctcattgtggaaaatgtggaaaactctcacatcaattgcaccaccaccccccttccctatgcactcaatgaaacaatttaaattaagtatctattttgtgtcagctatggagatagactttggggaaataccgttccttttttcattcttcattttgtgccaacaaaatattttgagggaggaatatttttatatcaattattttcattatctaagttaaaataggtacaatggccatttaccctagatttgttttaactgtcctaattttcaaatagtctgaattatttacctgcatttaaagctatgagtcctaatgttggttttggaacatatggtcctcttggagatatatttattttcagagaaactacctgagaatttttacgttttttcttgagtcaaagtagacttatgttttaatagcttgaatagaagaaaatttcaaaactcttagcccattgtaaagttaaagagtacataagtttatgtagtattcatgatttacgaataattggatttttagatcaaaattaactaattgaacttgaaaaatatccaactctatttttatgtcatgtattcaatgcatacacattttatatacccaaatctctagacactgtgcctggcaatatgaatttaaaataataagtaaatatttcttgattttagttttaatgcacaataaaacactaagaataaatagcctagttggtgtatatagaaaaatccataagtaatgattcaaaattatttgaagatggacatattatttttagtagtgagtatatatgggatgtggctgaaattactagacatataaccataatattatgtgaccatttggtgtagataatgcctgactgacaatagcagcaatgtatggttgttttttggtgtttctaccttttagacttacacattttaaatgcttaagatgagtaatctcattcatctttcctgttgcttgcactgaatatttgttgctgctaatccttcttatttccatagtattgttcaaaggtacattccagggcatctttgaagcatattttttaacccccgctgtgtctctaacttgtcatgtaatggttgcttgagcatgtcagccattctgtgtgtgtttgccaagccccagtgtgctggtataagtaggcattgcaattaggctgagagacaagctgcattacaagaactatttgctgcttatattgtcccaatattttaacccaagccaatacagatagcattgagcataatactttacatatagtattaaatatagcatacattacataaagcataatacaatatatataacattgcgcataatatattgagcatgtaccatatgtccagcttttgctaactactgtggagaaatatgggggtgggatgaggaaggcagtattggatgggaggctggtaagaagtataaaggagacctgctcttagtaaactgcagttttgttgaggataacagtgatatacaaaaataattagaaatcatataaggaaaatatacaaacagcgatgcttaggttgtgctgatttaactctttatgatgcagaacatgtaactgggcagctccaagtcctaaagtcttgtaggagttcagttgtttggggtaactacatttcattcatgagttgtatgagtgtagctatcttcgtgtcatgtcttactaccttttgaatcattggtaatcattgttaaacacaatactttggtagaagagatcagtgacaattcacctctatgattgttaatgaaaacgtttgactactgaaataccttcagtggtaatagcttcactattcttaatttttttttaccacaacacttaatttttaatctacgatatgatcattttattgctccatcctctaaatttagccactgagatgattttaaagcatccttaaattccttaagaaaatttaaaaatcaggaatagacagaaggaaggattcacatctatatttatcccaatatactttcctggtgttttggaggatgtcagcttcatcacagattaaacaccaagaaaaggagaggtttaaaagttcacatggatgtgctgcactatgcaatatttttttattttctgtgtgcatattagtaacacttattttatggctgggtgtggtggctcacgcctgtaatcccagcactttgggaggctgaggctggtggatcacctgaggtcaggagtttgagaccagcctggccaacgtggcgaaaccccgtctctactaaaaatacaaaagttaactgggcatggtggcgctcgcctatcctctcagctactcgggaggctgaggcaggagaatcgcttgaaccagggaggcagaggttgcagtgagtcaagattgcaccactgcactccagcctgggtgacagcctgagagtctgactgaaaaaaaaaaaaaccaacaaaacaaaacccgctttctttaggattttgccttttcttgaggacttatattgtttttgaggattttactagcattttctaggtctaaggactcaaaaatcctgaccccaattctttttctcttatacgtagtgacagactgatattattgtaccaattatataactcagcttctcatcattttgatgtgcagaggttagttaatttttagaagctacacagctaataaatagtgtatttattttttacaaaggaaagttctaccttataaaagaatagttctgttatgaaatcttatacatcagttatagaggggaggacatataaattatattacttatacaagtcaactaattttattgtatgataatgagacagatatgttattaaaatttcttcattacatcagtttttccaaaatagacagttttattgacttttctttttctaaaggtattatgaatattatctttaatgccagcatttaaagatctttatgttttgtgtgcatattatagttttttctgtgtgtttgtgtgttatataagaaggatcatgtgatatatacagttttgaaactggcttcaactccccctttcacagtatgtcatagacatctatcagtgtagtcattgattacaaatctgcatcatgattataatgactgtgtagcagcatattgaattgattcgtatgtctttgtttatttgcttaaccaatctcttattggtggacacttggttttcacattttctctctgataccaacacaactctgagatgtgtatactttctatgagactgtgtgtgtcatgcatactttcaaagatagccttctgataccttttttttttttgagacggagtctcactgtgtcacccaggctggagtgcagtggggtgattttggctcactgtatcctctgcctcctggattcaagtgattctcctgcctcagcctcctgaatagcggggattacaggcatgtaccacgaagcccaactaatttttgtatttttagtagagatggggtttccctgtattggccaggctggtctcgaactcctgacctcaggtgatctgcctctcttagcctcccaaagtgttgggattatagatgtaagccaccacacccagcctgattacttcttcaggataaatttcaggaagttgcagagcaatgtcatgttgcagcctctaccacctccttcttttcctcctccttccatttttttttgttatctgtaactatctcaagtctgactgctcgccagtcagaggccaaaaacatgagaagtgagatatggtgaaaggaaagcaactttattgattgaatgctagcagatgggagatggccaggcttctgcctcaaataagccatcttagttttttgggccggatgaaggagtttgagagggaaaaggtgtgggaagtatgctagagtggtgcaggaggttgcaagtctatgttttattccgatggctatcaagtaatcgcccgttggaagatccggtttgcatcaccttgactttggctcggtagtggtggactatctgtatctgtaattcctcctaagcaggaggattctgcctctgggtctctctctgcctgatttgtttaaaaattggcccctggaattttaaggcaagcacataattacataagcgagcactgttcactgaaatgcctggtgggaaaggaggaaacagagtttcaaagtatgtttcaaggctgaaagcaagaaaggaaaaaagttttaaaatgcattttgaggctgaaatacttggttacctgcttatttatatttataaattggtattctaaagtcccaatagaccatagagagaaaaatagagagaaggaaagtttcttttttctaatactctgctgtatgttaggtactgtaaatatagtatttaatcttcatgttaaccctgaaagctgagtggagagtttaaataatatgccaaaggctacattatcaatgtcaaggctaaaagggaatttattaatagttctgtctaatcgtagaacattgttttaaaatttaagtgaaattcatataacatacaattgaccatttaaaaatgtgcaattcaatgtgtgtttccttgtcttggctattgtgaataatgctgcaatgaacatgggagtgcaggtatcttttccagaaccaaatttcatttcctttcaatatatgcccagaagtgggatggctggatcatatggtagttttatttgtagtttttttgaggaatctccatactgttttccataatggctgtgctaattcacattcccaacaacagtgtgcaagggtccccttttctccacatcctctccaacacttgatatgttttgtctttttaataatagctattctaacaagtgtgaggtgatatctcattgtgattttgatttgcattttccccataattagcgatgttgagcaacttttcatattatctgttggccagatatgtcttatttgtatgtcttctttagagaaatatctattcagatcctttgcccatttttattcgggttttttttccattatttcgttttcattattgtatgagttcctcatatattttggatattaaccacttattagttatatagtttgcacatattttctcccacttcgtaagttttgtttttgtttttattttttttactttgttaattgtttgctgtgtagaagctttttagcttgatgtaatctcacttgtccttgattttgttgcttgagctcttggtgtcattacaaaaaagtcattggcaggagcaatatcaagaaacttctcctctgttttcttttaatagttataaggtttcaggtcttacatttaaatatttaaccactttgaactgatttttgaatgtggtgtgaaataaaagcacagttttattattctgcacatagatatccagttttcttaactccatttattaaagagactatcttttccccattttattttctgggcatctttgttaagcatcagttgaccataaatgtgtggatttatttctgggctattttgttctattggtttctatgcctgtttttatgccatcgccatactgttttcattgctgtagctttgtaatacattattttgaaaccaggaagtatgatgccttcagttttaatcttcttgctcaagattgcttcagctatttggagtctttgtggttctatatgaattttaagaatttttacatttctgtaaagaatgccattaggatttagatagggattgcattcagtgtatagatcatagatcattttgggtagtgtgaatattttaacaatactaatttttctaatcaatgaacacaggacatcatttctttcatctgtattttcttttattttcctaatcaatgttttaaattttcagtggaaaaatctttcatatttttagctaaatttattccctagtattttattctttttattgctagtgtaaataggatttttttccttgatttcctttctggatagtttgttgtcagtagatagaaatgacagtgatttttgtatgctaattttgtatcttgcaactttactgaatttgttcattattctaacagtttttttgttgccattagtgttttttacacatatgatcatgtcatctacaaacagggatagttttacttcttcctctctgatttcagtgccttttatttcttgtcttattgctctggctaggacttcttatactgtgttgaagagaagtggtaagcatgggtaccctagctttatatcagatcttagcagaaaagctttcagcttttccccattgattatgatattagctgtggagttttcatatgttgtctttattatgttgaagtcagttccttctatacctattttgttgagaggtttttcttaaatcatgaatggatgttaaattttgtcatatgctttttgtttttgcatctattgagatgatcatgtagttttatcttagagtctgttaatgtggtatatcacattgatcgatatgttgaatcatccttgaatctaagggataaatcccccttgatcattgtgtataatccttttaatatgttattaaatttagttttctgatattttgtggaggatttttgcattgtctgtagttttcttgtagtggctttgtctagctttgatattggagtgatattggcctcataaagttatttctgttttttgaaagggtttgagaaggattggtattaatatttctttgaatgtttggtagaattcacctgtgaaggcatctgcttctgggcttttctgttgttgttggaaggtttttgattactgattgaatctccttatttgttattggtcttttcaggctttctttttattctcaattccttcttgttaggttgtaggtattcaagaatttatttatgttctctaggttatctagttttttgacatataattcttcataatagtcctgtatgatccttttatttttgaggttcccattgcaatgtctcattttttcatttctggacaaatggataaagaaattgtggtgtctatatacaattagatattattcagcctttaaaaagaaggaaacccattttcaaaaacataaatgaacctagaggaaattatgctaagggaaataagccagatactcatcattgctgaatgatctcatttatatgtgagatctaaaataggcaaacttctagaacaagagagtagaatgttgtttgtcagggttggggggaaagaggaattggagagatgttgttcaaagggtacaatgttttaattatgcaagattaataatttcttgagatgggatctaatgtacagcaaggtaactacaatgaaagatacttggaatttgttaagagggtagaccttaagtgctctcgccacaaaaaggaaaataaagaaaatggtaactatgtgaggtgatgaatatgttacttaacttgattttggcagtcatttaagaatgtatacatatatcaaaacatcaaggtgaataccttaaatgtatacaatttgtttttgtcgagtatccctcaataaaatggaaaaaaaatcctaaactattcagcggccttgaatacatttgtagtgttgtgcaaccatcacctctgtttagtaccaagacattcttgttacaccaatatcaagccccacatgtattaaatgagtcttcatttccctcttgctagcctctgacagccatgaatctgctttccgtctctatggttttacttattctacatgtgtcatataaatggaatcatacaatacgtgacttttcgtgtctggcttctttcaccaaacaggtttttgagattcatttatgttgtagcatgtatcagtcctttcttatttttatggctgaataatattacatcatatagatataccacatttgtttattcattcatctgttgatatatatattcattgtttccactttttggctattgggaatagtgctgctctgaagattaatgtataagtacctattttcaattctgtttttttttgttattgtttttgtttgtttttttgttttttgtttttgaaatggagtctcattctgtcgcccaggctgaagtgcagtggcatgacctcggctcactgcaacctccacctcccgggttcaagcgattcttctgcctcagccacccaagtagccaggatgacaggcgtgcaccaccacacgcagctaatttttttatatttttggtagagacagggtttcaccatgttgaccaggctggtcctcccaaagtgctgggagtacaggcatgagctaccatgcccggcccctgttcacaattctttaggtatataactaagattggaattgctgggtcatcttatccatagaacttgtgtagccttctttcacaaggctgtgggtattgtctgataatataatattttcttactatttacaaaatagaaaattcaagttattttaaaagatttgaataatcacaaattttattattgatatgaactttgatgtttagaaatctaaaatcttaatcctctagtacgtttcttcctggaatttgagactcctgttaaaactgttacaagttaaagttgaagaaagcacaaatatactttctagctcctggctattgatatatgcgatttagctgacccatttcattcaaggtcaggagtgttagtgatcttatccagagaaaccacagattcttataaattccctagtttacaattggggatgacaaatcacattttttcgaatcttgaagctgaggatgggctttaaaggaatcatcatgatgagaacatttttacatataattgcccaggaaactattctctagggatcttgagttcatattggattcctatataatttcttcctgtgtattttgagacctgcaagatagaactaaggggaaattagagtgggcaagagaagttcccttcttattgccagtgaagtatagcagctgacatggcttgtcagggtaagtgagtctcattatccctcagtagttgctaccaggtgagctagcacaaggaattaccttcttcctgaagcataaaatacaacagagaggaaatatctcttttttttttccaagaaggggaaaggtaggaaagatgggaaaaaagaaagaaagaagatagtgtacttaattataatatttttgaaatggaggagacctgaggaatcactttagttcaacttctttactttaaatagaaagagactggtttaaagttacccagccctgtggttataaccccgcgggctagaagccaactgtgcactctcctgtggcttgtgttactagtttcctatggctgctgtaacaaattattacatacttagtggcttaaacaacacaaatttattattttactcttctggaagtgagaagtctgacataggtctcaccgggctaaaatcaaggtattggtagggttgcattattttctggaggctctagttaagaattattttctttccttttctagcttctagcagctgcctgcattctttggcttctggggcccttctgtcttcaaagccagcagtcacatcagtctgacctctccgttcatcatctttgactctgactcttctgcttctctctttcacttttaaggattcttgtgggcccacccaaagaccacaggatgatttccctaactcaagatccttaacgtaatcacatctgcacattctcttttgccatgtaaggttacatgtccacagtttccagggatttggacatggacatctttggaggacattgttctgtttaccatagcttgaccactcgttctttaaggaaaaacataaagaaagaaacaaattatataccccctcttctgaggactttgtagatttatttattgacaagtattttcactcatttaaagatggcaccttatatttgttatatttacaaactgcttttgcatatgctatttcatttcattgttgcccttttcacagtggcaacaaagactcaaaaacttaagtgaattttcagaacaaatagtggtcttggcatatgaatcccatgtatttgagtctgtctagtgtttacaacattctactcactatctcatgaaagtgattttcagcactttctaacttaattccttgagactttggatgtcatatgtgggttggtttgtggacattcttcatcatgtttaacatcctcgaagcctctcctacaaagaatgcactgctccttctggatttatgttgtaaaatatgttctaaaactaacttgaattcctatactttcttgcctattttctattcagaaaaaaacaagggaactgatatatttgtctacataattgtgagttgttagaagccaaataatcagtgtgaatggtatgccatgctctatgaatggttgttcagcagtccataaatttggtcttcttcttgagggtaggagtagtgttttgtttactttatggttcttagctattaactaagtaccttgcatttcatagggctttagtaaatttgtgatgtttttaattattgaatgctgattatatcttaagcttagaaaagaagtgaaacttgtggttttaatttaatttttaaattaatctcacattgataagtgtaactattaactacgttataaccttaaaatgagtcatttcatgagtctccaaaggctctttccttgtgtctaaaatgagcaacaaaacaaaccaaaataaaaccacagataatggcagagcttttaactttgggagactgaagaattgatgggagtaaagaaatttacaatttaaaatatcaaactagtttaaccttctaccaattaaattatgtactactggaaagcatagcttttaaaatactgtaactagttaacaaaaatcagctacaatgactgaatcaacaatcttctttcccctaattacaacattaactgcttcacttccttggtgaaaccccagctgcctctcagctccacctgaatctggtgaggcccaccatctcaagccatctttatcttttaatattttagtcaaccaaaatcaatctccatgtttcatttagctatttaggctgatacttacatttgtaaatcataacacaattgtgattatacttaacaatactcttttctctgggattttataggtaaagtagtaatttcttaatggttttctaatttatggaaccaggttgagtttaaatacttaaataaattaacttgtaaatttccattgggttgacttttagatgctctctatgaggaaggtgagcaaacaaaaataaactcacatttcatcaattctaagcacatttttaacatctctgaaatcagggtttaatctgatagtataaggtttgtcatcttttagttagcagcattttgttttttctctcttactggtacataggagatgacggtgcatcttttattcattggtttgccccttagatttcatgaaatgtggtcatttaggtgactctaagcaggaatcttttgcattctgatttgcataatacttttttaggaatgattacaaagcaggctttagaacttctcccttctcaagattttcttcattgatgtatttttctgaagtatggctctttaaaataaaattaagctggaaacaaacctgcttatgtgacatagttcaaggactatatttaacagagttgagtagattcagtggcatcttgacactaacagtggtgggaatttctcttctatattctgcattttcttggtgaacttacattatcctaaacaattgattatttgaactgaagtgaccaaattaaatgattctacgtggcctaaattttcttgggatcatgtgttgtgcacatcttgcccactgttttttctatccatatatcaactctgcctgggtcatacatcctcaataagtctataacatattgagttgaattaaacaaaacacatcatcagggattgaagtttttatcccagaagacttctgaaggtatttaaaacataaacaaaattttaaagtgaggataaataattaagggaaccactagaatttgattatcacccacttaattttcatagctttcttctagacccccaaaacagctattttcttctgtctctttcgattttctctagtgatttttctaagcaaggctgaatggaagctaccagtggtcatttgtgattgacacactaaaaatataatgtgaacacttggaaaagaaaatgcccttggacatttggttagctgcatatctcttgtctcagatgacacccatatactctttcactttccagacaacataaaaattaatgctgtttgctatagcagaaaacagtcagaattattttcagcttttaataaacagctcaatagcctcagggaaattgggcatattacttcatttcttggttttcaaatgtatttctatcacttaattatctaatgaaaatggtattatttatttaaaatatttaagaaggtttttgactcagattttctcctcatttttacctctctctattctgccttctgcatcacctgaatggccttgcaaaagacagtaagagatgttgtggacaaatctggagcaattgatgatatacattttgcatttatgtttgtagaatatgaggaagtctgacaaacttaaaacagctattcacaggctgaaatcccactttctcaaaaaataaaatgaatttttggaatggatttttagagcttataaagaaactagtttacttgtatgtttattttaggtaattactgtattaatactcttttaaattttatagtggtgtatttcaaaatgtctctattttgagatgctgagtcaaatatgtttttcattaaaatgaacctctgtgtctgctttccagtataattatttgtctactagctagaataccatattccattttatttttctttcaggattattctcctaatcccccaagaccatccctgttcagcgtatatttagggcaatgataacaataatagtattaaaattttattaggtaagccaatctgctgaattatgaatttaggtcttgttggaaggacactttttctgaatttgtatttctagctttccttatttatttgaatagttgagattttagtatatttttactttatattttgtagaacaacgtgaattttagcatggaccaaaaaattaacgctttattttaccagtgaacaactacttgaagaaaatatggggccgggcgcggtggctcaagcctgtgatcccagcactttgggaggccgaggcgggtggatcacaaggtcaggagatcgaggccatcctggctaacacggtgaaaccccatctcttctaaaaatacaaaaaattagctgggcgtggtggcgggcgcctgtagtcccagctactcggtaggctgaggcaggagaatggcatgaacccgggaggcggagcttgcagtgagcggagattgcaccactgcactccagcctgggcgacagagcgagactccgtctcagaaaaaaaaaaaaaaaataaaataaaatatgggggcagggggtgcgcggtggctcacgcctgtaattccagcactttgggaggctgaggcaggcagatcacctgaggtcaggagttagagaccagcctggccaacatggcgaaacttcgtctctactaaaaatacaaaaattatccaggcgtggtggtacatgctacagtaatcctagctactcaggaggctgaggcacgagaatcacttgaacccaggagttggaggttgcagtgagccgagactgcgtcactgcagtctagcctgggtgacagagagagactctgtctcaaaaaaaaaaaaaaaaaaaagagaaaatataggaaccactctttgttgcagaaactaccctttgtgaagtatctattaggttataatatatcacatttttttttttgagacagggtctcactctgttgtctgggctggagtgcagtgatgtgatcatggctcactgcagccttgacctcccaaggtcctccacttgggaggctcaagtggtcctcctacctcagcctccagagtagctaggactacaggtgtgcaccaccgtgcccagttaattttttagttttgtagaaacaaggtctccctatgttgcccaggctagtagtgttgaactcctggcctcaagtggtcctcccacctctgcctcccaaagcacttggattataggcatgagccactgtgcctgacctacatcatgtatttatttaactagacattaccacttacagagcactttttcattttattctcatcacaattctgtgaattaggcattattatttgaaaacagggaaacagggtttagaggggctctggggcttgtcaaaagcaatcatatttgaactttatcaatactttaatccacattttctgattttatgagtgctgccatttcccttatatcatgctgcttatttggttcgtgcatggaattgttattatcaattaaatataatctctacagaatgaatgataatgaacattatcatgtgacaataacattgtgcagccattcagagggcacttcaaactttggattttcagaggcagtatctccagtaattagctgtctttagaaaaatagcatctataaatgcttcttagtcctgcccataatgagagagttattgacaaagctaggatgtgaaccacgttctagccatgattcatttttaaattaaaatatcattatatatgttagggaagaaaataagggcctttaatcatgaatatgtcctatatagaaccaagataccaattttctcacgtcagttcgctcagtaaatggtaaatttgaatgcatttgccataaagacaagaataagtcctaatatgagaatgaaatttgctgcccccatgttatggtttggctgtgtccccacccaaaatctcaccttgaattgtaataatccccatgggtcatgggtgggaccaggtgaagataattgaatcatgggggtggtttcccccatgctgttctcatgatagtgagttctgatgagatctgatggttttataaggggcttttccctacctttgctctgcatttctctcccctgctgccacatgaagaagtacatgtttgcttccccttctgccatgattgtaagtttcctgaggcctccccagccatgctgaactgtgagtcaattaaacctctttcctttataaattacccagtctcaggtatgtctttattagcagtgtgagaacagactaatataccccattaatttatctcactataaaattatttaaaaatatttttactattgttattttatccacttatgagaactcaaaacgtcctttgaaataaatagggaaatatttccaaaaataaaacattttatttgtagagtttcttttctcaatgctacataatcaagctccacttgaggaccttaataacaatctttatcaaactctaaaaggaatttttatctttcattgctaggcagaatactcacgacttaccctggttgtctgagcagtcattatctagaatgttaccggttactatggcagaaaaaagagagcattagagagtctcccattggtaattaatttttctgtcaaaaaatgccatgttacttccttccacaagtcattatcagaactagtcaatgatgactgtgttccagtcttttgcctgtttactctgaggtcctttcccttcccttttcaaccttgccctggttttcaagaactgcatttcataggcctttttgctctctggattccaggtagttttggccattgggaggtactcatggcagaatgcagagggggtgggggtagtggataaattagattatttcatctccttctttcagccttgggcagtatctctagcagcagtggcttctctgtgatttcacctcccaactgacagcttgatatagttccaacttccacgaatggcttccggggtctgttaatcgtactttctctttgaccttcttcgcctaaagatataaccaactcctaggtggctttccatcctctatttggcctctcagctcttttaacacatgcataaacatttccctgtattaaattctctgtattgaaatgttaatgtggtttatgtttttgaggagctcctaactaataaatccagattaggacattcaatcttatcgtgttcccagaggacacagaactggaaatatttggtgaacagctctcatgattgctgtactgcctatttacatctgacttgcaatctacctctctccagccagacctctactctaaactataggaccgtatatatacatatatccaataaactacctgcttttgaatgtttcagagacacagtaaactcagcatgtcaaggtggcaacacatgctcaatcccccagcaaacctcatcctctcctgctccctccctcatgcattttgttagtcgagacaaacataattaattcttgcaacttcattccctttcagcctgcacaaccataattttaaccataatcataatcataaccataaccataccaataattaaaacccacaacctttacaattatgtaacctgtgataccctgaatatctctcacttctattcacttctctacattccactgctatcaccctattccaagctcctgccttcaactgaatgattgcaataacgtcttaaccttgtactcaatgttatattctcaaaattaaagttaatcatttttaaagacctccaaagattcaaaccttcagtgaacgaaggtcgtgaccttcagtggcttctaattgctcttaggagaaaaacaatactccttaacataatcctagaagacctagcaaaaacttcctcttcagccttatctccctccccacccctgcccctgatatgccatcttactctctgaattctggcctcaccaacttctttaagtcatttataagtgtcagtccttcccaacccccaacataacctcgggcttttaaatatacagttaccattgtctgaaacacttttcttccttactctctatgttaacatcatttagtaaggatttacttcagtgttatagcctcaggaaaaacttgcctgaccaccctgactacataaaataccctgttacacacattcaattgtgtcatgtacctctgccaggaagcattaacagaattgtgattttacatttcttcgtgtgattctttggtgagcagtaatctcctccagtcacaattgtctttaaactctttgaggtgagagacaatggatgattttgctaaccattatatccatagctcctatcagtgtctgggacataactagctcttaataagtatttgataaattaatgaatgagagcactcttcttcttccctcccttcttctatcctgtctttctctctttctttctccctcccttctttccttcctttttcattgtgtatttactattaggaaatgacaggtctggtactgaacagttaatttctacctataatttttaattcctcaccagtactttctttggttgatgtggagagtattcagacagtgtctaagttaattttgtgttgctataaaggcatacctgaggctgggtaatttataaagaaaataggtttatttggctcatgattctgcaggctgtatgagaagcatggcactagtatctgctctgtttctggtgagggcctcaagctgcttcccctcatggctgaaggtgaagaagagctggcatgtgcagagaccacatgatgagagaggaagcaagagacagacagggggaaggagcgaggctctttttaaaaacccccttttttctggaactgacattctcacccaagagccaatccagtctcatgagagctagaacttaccaccatgagaatgacatcaagccatacatgagggatctgcccccatgacggaaacaaacacctcccatcaggctccatctcccaacaacaccacactggagatcaaatttaaatatgagatttagggggacaaacttccaaactatagcagacaaaatatttgtggtcatgggcagcctatcattagcagagagagggtgcagattttcacatcagaaggaataggtttcgagtcctagctttgccacttgcttgttttgcactctgggctattgcaatgatctatctgaactcagtttccttcttggtaacataagaggataatcagtgccagcttgtgggcattacattgtagtaattatatatctaatgaaacaaactcacatgtagaagccactcaataaatagtagtcattttggccgttgtcaaaaaattattaagtaattatagattttaataagaactattaggtagcatagtgtataggaaaacctttactgagtgttcatatgtaatgtttgaatcagacaatgaaacataaataatggataagaaatataacgtacaattttggaggattaaaatgcagttcatttagtaaatactatgtgaaaacaatgtgtgtaggtgcacgactatatatacacacactgcgcctgtttctatttgcctatatattctttttttacctgtatactcttctattaatattatttaaattgacaaatcatacttgtatacctttatggagtacagtgtgatattgtcatgtaggtatacaatgtggaatgatcaaattgaggtaatggataggtccatatatcttaggtgaaagtattgtaatagcacccactgctgtcaatttttttcattaacttttgtgttgtttaaaacactgtgtttcaatacttttttaagtgtttttaattctttagaaagacaattccactggaataccttgatctcttacttcatagaggaaaagtagaggaaagaaaaagcttgtgcctctttactggtacccccaacaatgtctgtctttgtggggtgagaactgatgtcatctttggcagctatatggctgatactgttctgtgagattgcaacatatccagcacatgcctgataggaaacccttttccaaatagtaaacaacccttcacaaggcagctctgccaaagctatgtattgccattcaacagaagatcaacaggacagtccttttctctttactttaaaaagcatatgcctttaatgatgtgttatcgttcaagccatctgcagatgtactgtccatccaaattgccagggttaaattgttgattattagaaattgttgtgattgtctgattatgcttgtgtcataaaatgactattttctgtcacaatttgacgagcccctgctttagaatagcaatacaacacattttacccatttgcaggtatttcaagtattaaattggatgaatctttttaattttcttctactgaattgagttcaagtgaatttgataggattattagagcggctagtgtctggaataacaatgatgacttacagaaggagccagcagggctgatgttattgacgaagagatactttagaccctttatttgtcagcagggagccctgctctgtggttcctctatgagtccttccctgtgtacggtgcccgcctgttttactttgaaggcactaaatgcatcttttcaatcaatattcaattatataagacaaggaatgctggttaagtaaccatgcctatctgtcaaggaaatgcatttctccaaataatttgtcagggcttctgggttagttcatctttcctacctctggttgagtacttgcccagttacacttgtcgaacacgtgctttaccttcctgcacagagtctcctttggtggcgtgtttcttgcttttcttctggaaacacccttctcagctccattccttgcagtatttgactctcgctacccaggaaaccagagaacattcttcctagtttcacttcattttcttgccttctcatataggccactgccaatcagctgcctcatttaaatcctgcagtgtatgtttatattggtcttaccttgtcctttcttcctaaataaacctggggagctttggtcatgttcatttttcaacaaacctgactaggtattctaatttcgtaaattaaccatcattcttgttttattccactggaaattgacttaacatattattcactttggcccaatctgccaggcaggcatgaggatattgctttctaagctaccttctaattgaagaaatatgaagatttcacaggtcaacacataggcagtgtgaactggggagcttttagcatattaattgggctctgaataattcactatagttaatgaaagttgtgcttgttatctaagatatatggagggcactgctgtacctttcgtaggacaattcaaaaaaacaaaataaaacattaatgtaaaatagataagcaatgcataaatgggttgcagctcatattataagagttttgaattcattttatttcattcccatacttctcaaccaatccagctacacccacatcttatttaattgacagatttggactgtcttgctggctaggaggataaaggcaacaaactttctgactgatcctggattttcctcaagagcaagtttccttagttattggtgtgtcctctgggtatcctgcttcctgaattccacctttgatcctcctggttcttaaccatccatgttgtcttcagagtctgcttgtctgctcattcctgttaatttttttttaacttgatcttcaattgtgagtcttctcacttcctgcctgttctaacttgggctcaaccttgaccccagtcttcagctctgcaggtgggagatgtatggaataactgaagtactccacacggtgttcctgcttataacacaaaagccattgtcatttgacaaacagatgataaagaatctattgttattatttttactttttacctcattattactagtattagaaaatgctttactaagcttttgccaaatattagaccgtgtgctgggagttctacgtgtcatatctcttttaagcctcacatcatttacagaggaggcactgagaggctgtgttgcctcccctggccacatacttattaaatgaaggggtaagaatttgaatcctgacagtctgactgcctagcatgtgcctttatatttgatgctgtatcacactaaattaacaccccatagatccattcttaaatacaaaaatctatatcctcagactttcagggtgttaactttgcactgtaagttggagtctttacattttaaacaaatttcttactttctgtttgttttggattgtcattgcttattttttacttaggagtataaaaataagatagtgaaagtttggacaaccttacatacctttatcatcttcagaagtccgatttttaatgatacgttaaaatagtcacatgtaatcattcattctacaaattcagcaactgtttgctgagtatctactgtatactagcaatgatggaaggcactggggatgtaatggtgaacaaaaaggagtctcttcttctatagagtttacacatgtaagctgggcattggcccagccatgaagagtaagaaacaacttatgggaatttgttgagcttcaagttaaactctgttaaaaacaaacaaaccagaaatatatatgtagagtgtttaatgtgttctgtggctctcaataaatgatggcgttgaaaaataaaatgtaggtaatttgatttaatattcaatcagatgcttgcatcaatcagatgcttgcaaacagggtataacaagataatactatgatatttcttggaaggtaatttaaatttcagtttaaatattttattcagcttatttatcgctatgtaattatacataaatatataacttgaatcataatattctagttttacttttcttgcttcctattgggcttctccctctccatccctttccctcttgatgcaaaccagccatcccttgcagtcacccccaacaatatcaaagtgtgtgtactttcatttttcctccctatgttcttatatttctatttaggaattacagccacacacacaaatacagggttttattatgtcttagaaaaatttaattatcaatattggtgtttctgcatcttgcttttattaataacactcaataatgagtcatagataagttgttaattggtataaaaatacagttagaaggaataaattttagcatttgatagagtatggaaattatagttaataatttataatatatttcaaaataggtataagaggaggagcataatgctcccaacacaaagaaaagataaatgtttcaggtgatggatattccaattaacctgatttgatcattacacattgtatacaggtatcaaagtatcacatgtagcccctgacatctgtacaactatgatatgtcaacaaagacatacaaaaatttcacattacttttgtattaaataagtataattttataagtaaaaaaaatagtcattgaatctgtctaactaaacagacatagctctgttttctttttcctaataggtgcctaatattccagctgaagtggcataatttattttgttttaccctatttgccacaggcacattgctcccaggctttggcattacaaatattgctgcagtaaacatccttaaatatatgtccttaaataattgtgtatctgtggaatagattccaaagcatgagcatgattgggtaaagaagatgagtcttaaaattttaaatagatgttgagagattgctttaaaagaagaaaagatgtctcaattttgtttttacaagtatatgcggacatttcacatgttgtagattgatcagttgttgttacttttaatttgcctaatgacttgtacattggacttttttttgataagttgcttggcttttaaattttctcttctgtaaattatccaatttaaatatcctgccagtttttttctattgtactatttattctcttgtcaatttgtaagtatattttatatattgtggatattaaccctatgtgttttctgcatttcaaattatttttcaaatctagcattgccttgaattttttaatgatgttttccataaataaacatttaaagatttttgtatagtaaatttgtctgttttaggcatctaccatcttgtttaagatggattttcttgtctcttagattttatgtcttgttttctagaatttttaaaaacatatgtaatcttttaatatttttaaaaatttgtaagcctttgatagatcaggatttttaaaaacttgatttaaaatagagttactctttaaatttcctccagatggaaggacagttgtgatacaatgatttaaagcataatttatcatgttcccacaaaatttaagattgtttattaaaagtaccccctctttttatagatacaaaaatatcttcatataaatatttgatcaagttgtcattcatacattcaacaaatattaagtacctcctgttttcctggaattctgaaagaagcataggggtgggggaagcacaatcttgaaatggccactgctttttagagatacagcattcaattttgataacagtggtgggtccagaaatctcaaaaggctgaaatctgttgatggctctgtcactaagagtatgacaggtttctgacactcaacagtgctgggttttagtttcatctgaaacaaaatgaggaagttatgtccaatgatctccaaagccttttctagtcctcaaacatgacagcagctgttcaatctcttctactacccagctatttaaagttatcttctgccaaaacaagcaaaagctcatagctgagagagaatgaatgaatacaaataaatgaatatgaatatgtaaattggatagactgaactcagccaatctgaaataaaggtgaaagtgatttggtgatcaagctctatgtcatcttccttctctgaattatggtgatgggacaggggtttgaaaactcactttaatgaaagaggtgaatcactccatggctgaaaacagataacaaattacttgagaaaactggcaccatgacattttgcaggtaattaagcattcaccttccctgagctctcaccttgacccctgaagagatattcaggatttaatcacaatatatacattatgtgtagattaaccaaattttaaaattgccattcttaatttagtagtaatttgttagattattctggttcaaatcacctcaataatatcgactttaattaaaataatcagtataatcacaatgattcattttagtgcttttgttttatataaaaatctgtgaaaactttcttctttttggaagacaatttaaaaaaataggctacctgtcttaatgtatataacaagttaagtgtaaaatcctttacaggtacatattctttgtaatttatgtctagcatagtcatatatttgaaatcgagttagccattgaaatgaaggaagaactttgtcatgcaaagccattgaaacaacatacaaaaataagttgaagtttttataagtgaccattcgtggtcatcttatatgtttgaattaaggaaacaaactgaaatagccaagtagataaaggaagagcttgcctggcatgcaaagctagagaatactacacagaaagaagttcaagcacagaaattacagttcatgggaatgtcagaatacaaattctgtcctcacaatctcttttattcggtgagtttaccagttttaaagcattaatgaaattatttcaggtaattactgttttactcccatttttattgtctggtgtctctttagcacaacccattgaatcattctttcatcttaagtcactattcataaatgcacatgcaacagatggtttatattagatcatgtgatcctttgagccagagaatgaatttctatttgggtttcattcgaaattatctacctcagagataactgaaacctaacttgatagtattccctgtattctatttaatactttaaaagagtatgctttctgtttttctggttgtgtaaaatacaccttgaacacattcagcagactgctatgtacaaagaaagtgttcaataggtgtgtctgctgccgttttaaatttgggtgttagatattctaggtttcatcaaaataaggcattgtttcaagttgtttccacaataagagcatatatgcacaggcaaaacatattttgaaatggataaatggatacatatggatatgggtgatatttcttaatagcgtagctggattgactcaggcagacccttcagccagacgttttctttgaactggatcgtctctcctgtagcagaggactccagccaatgaagttaattagtgccagattaagatggtctcagcaggtggctgcttcagactctctctctcctctgtttgttgaagcctcatcgttggagaagggcttgagtagtcttgtgttactgacagctgtctactgttaatggaccatatgcaatgatggtaaagttgccatcaactgttgatgaaccatatgtaaatggtgaacagagtagcagatgaatacttagaaacaacgaaaggccttcactgctggactgagagtcagaaccttaaaatgattttaagaaaaggttgctaaaactatgtcatgatcattatacctttactgcacacaccctctgtcactcagtttgaggatctaagacagatatgccaatggaaagattattgtcttaggtcttacaaaacctgacatagaaggctataataccccacagagacatgatttttcagtttcattaatgaaaagaaaattaataatagcaaattaatcactaagctcaaccattttgaaaagttaaaagtattatttaagggaacatacgtagaagaaattcattatcaaatgaagagtatgggaggacttttttttgaaaggcagtttgattctacagggatgccctttactttctgttaagagtatgatgttctataagctgagatggggaagaagtagctacttaatttacagagaggtgattaaagattatatacaatgaacatcctcttaaagtaatataataatgataattgccaatataatagctaggtattttggatgtcctactcatttcatccactcatcattcttatgaagcagatactatcattatctttattttatagatgagggaaactgtagcctaaagaaattaagtaacttgctcaagattacgcagctgagggttttaacctcagtctgtctctggaacctctactctttttttttttttaattttactttaagttctgggatacatgtgcaaaacgtgcaggtttgttacataggtatacatgtgccatggtggtttgctgcacctatcaacctgtcatctaggttttaagccccgcatgcattagttatttgtcctgatgctcttcttcccctttgcctcccaccctccgacaggccccagtgtgtgatgttcccctccctgtatccacatgttctcattgttcagttcccacttacgagtgagaacatgcggtgtttgattttctgttcctgtgttagtttgctaagaatgatggtttccagcttcatccatgtccctgcaaaggacatgaactcattcttttttatggctacatagttttccatggtgtatatgtgccacattttctttatccagtctatcattgatgggcattagggttggttccaagtctttgctattgtgagtggtgctgaaataaacatatgcgtgcatgtgtctttatagtagaatgttttataatcctttgggtatatacccagtagtaggattgctgggtcaaatggtatttctggttctggatccttgaggaatctccacattgtcttccacaatggttgaactaatttacactcccaccaacaatgtaaaagcgttcaacctctactcttaagttatgctctaaactgggtacggttagtttaaaggtgaagtgattttgccccatttggaccttatttccaataattggaccagttattcaagtgacatccatggaacatggtatatgtttgctaactcattttttgaggtaagaataactgaataaatgggtaaaatatatgtgtaaggaagctattgttattgcattgttatgccacagggggcagttattttcctgccatgatactgatgagagattaattttactctttgtaaaatgtaagaaattacaagaatactgcaaagctgttttgcaaactccataaagcaacatatgttaagtgtcttgactgcagaagaaagttgttatacacctaaattttattgagtctgattctctgatttccattttagaaataaaatgtgtaaatctaaagacaaaaatcctttatgcaggagttagaaattattactcttggccatcctgcttacagcccatgtaggaagagattcagcacccaaaaacttcctccttacggctttatctgtggcttttaagatcagaaccatgtgtcaaagtctagtgatcttgttacttttctacagaaaagttatacagcagaaaacgtaggagggtaatttaaatgaggttagaaagggaagataattaaagaaaatctaatgatttactaaaatgaaggcataatttacaacatgtattatacatcaaatacctttaggttaataaaataaagcaagacatacttattttcaaataaccattctatactacttctgcctatattataggagttttaccaggctctcgtatctgacagtgaaatgatgctcatggactaaagtcttgtattgagagtttggaggctgtggtgctagatttccttttactatagtaacttgttttgtgatacttgctaagtcacgtaaaaagttgacctttagacattccttctatgtaactggtttagaatccatgacctcaacattttttgttagttatgttgtgtttttaatgctacaaaatgctatgattcagggtcaatgggatcttcaaatatttagttattaactcagcttaagcaaagactgtattcataaattgtatataatattagtagaaatttaaatacaattgtaaaaatgaaaacaattgaaaaatacttaaaacatttattacaaaggtgtttttcaaggttatgatggcacaattacacagattggaagaactataattggcactttcaactttaagaatactttcaatacaactgacaggttttcaaaaggaagaaactccaatacatcaagaaaccattgaccttttcaagtaatcatttccatgctagtgttaacaaaagaaacatttcaaatgcataatctcatcgtgtagtttttagagaactgttgcctaagtcactgttaatgtaaaataaagtcagaatgcttttgacttgatgctgaaatatgttggatttcagcaagtctttaaaaaaatattttcccacttgtattattgatgaaaataagatgatcgtagacacaccattcacccatttagtgacatttcacataattgtttaacatgtttttcctgtatttattgtttccactgttttacttccatgttgtgttttttttttacttgaaatgaagactgtagcttcaaacattcaaaatggaattgagacctaaactattctacctaatggtggaggctcaaagctgattatttgaagtatctgaataatcttctcagttcttatcataataagactgtccaagaatgcagattgacattgatcagttgtgagtctcttccttatgcccaattctcttgcccttgcatcagacaagctaaactttggatacttgtacacaactagtttcagttttggtggttagctttcaggaagttaagaagatagagttcttatgaaagcaagctaggaagtcttactttctacctgtgtggccctgggcaagttacttggcagattttaaggccagtttcctcagtaggcttaatgatattgcctacatcattaagttgatgtgaatatttctggagcgaatccatgtgaaaatggttaatccactgcctcacatttagtaaactattcaataaatgtcagtcattctgatgatatagatgattattgatgatgatgatgatggcagtgaagatgataatttcagagaagattttatctgtgcagttcttgtagtatcattcttaacctctcttgaaaaagcataggttccattgtataattacagattctgggacagaaaattaatggaacaggcttttgtaggggatgtgcagttattttctcaagtccccaaccccctaaagaatatctgatttttaagagatcagagtgataatcaccccaaagttggtcacagtctactagcaaatctcacaatcattgctaaacaattgcaacacctctgtaccactcttttttctgttattagcaaatcacagttctcccattagtgagagcaaacatcaaaatcgccttacatgtctactctaaagcaaagcactttgctgatcttttcaaaagaaaagactgggtgcttctggaatactatcttttgtctactacatgaatacatgtcattaccactagtctttctctaatttttatttttccaggacctcctatcctgcctcccacatttcctacctagcttgctctcttttctgttcatttgagtttccacatgcttcaaagaccttaggctatgagtggtagaggctgtgaagccttacctaatagcaaaagtggggaaatggagtatataattggatatccaaaaccaattattatgatcaattctttgcatgaaataataggcaacactcagatgaaaagtatcctagtatcaaatattccatacatatagattcttgcatgttttaacccttatttatttataccttgagatagctctaagccttctccagtctattaaactatggcaactaatatcacttgtacatttgttttccatcagggaattacatatatctaattataatctcccttttttttcatttttctccaaccttagggaatcatagtttcttttcttttcttttccctctttctattcccaatttcatcacgttccctcagaatagtattacttccacatctgcatatatttttattcattaattcatttaaaacacacaaacacacacacacacacacacacacacacacacacgcatgcacacacacccacagtttcttcatgtatcagaaaactatagtagattttggagatccagaagcaattccaacataaaggtcacttctctcatgaaacttatattcaagcgggtaagtagatcataaggtaaaagcaattgataagccctaacaataaacattacaaggagattaacatcaattatggtgatgtaatggagagtggctagataggcaaggtttttctggggagatcatatttgagcccagacctgaataagaaagcatcagacaaggaaagatatagggaagaaatacaaagtctctctggcagcggcaagttggcaggtttgagttcacacacacacacacacacacacacacacacacacaaaaaaaaaaaaaaaaaactgtgactggagcatgacaggcaagagtaagaatgagacaatactgggatggagaagtagtcataggacagatcatattgggcattggcagtgaacttgcattttgttctaaatataataggaatccattggaaggttgtaagtaggatgtgtgatatggtttgatttgccattttagtttgccactttgactgcttttggaaaatgttttgtagcaagtcatagtgggtatagtgagatgtgtggttggacgttgttacaattcttttggattgttctaagatggtgacattgtaattaaagagaaattgacaaattcaggatatattttggcaacagaggcagtgagactagcagatagtcccattgtttgtaatctaatagaattaccctaattatatttgacaaatctgaccacagtgcctgggacaaatgtgaatcagggattgggaaattaagtactgagtggaaattctaaccataaaaaaagagaaaaaacagtgtagtcaaccttaaaaacatttaaaattgttcataaatccccttcaaaatgtctgcaagactttccatcagacctaccggtgtcttttaaataggcttttctgtaaaaacaaattattcatattttgaaaagaggaattctttttccattcctaaaatacataattagatacaaaataggtaaagaaactagcaacgtgcacatgtgaattaggcaccataatagacgttgtaatataaatatagtgtacattcctcatactcaaggatttcatattccagtggagtggccaacatgtaaacaacaatacaaacatcccaatgcatctcagagggtggatataattgctcatgaaattctgctcaaggatgtctttctagaaaccggtatttatcactgatgactgtaggcacatgaattccaaagaaaaggcccaacatggaccactctatgcgtatatggcatgctgtatatcagaattatccagtagctacaactagtaaaattgtgataaattaataaatgaagtgatgaaagagttgagatgtggcttgctgtgtaggctgcaaaagattctgaaaagcccaggtgctgtggtcaaacgtttttgatgtatttgaacctgtaaagtgccatactgtttttctcagtggctgcatcattttatattgctaccagcaaggcacagggttccaattgctccatgtccttgatgacacttgttattttctattacagtcaagagccacataaggatgtttcagtcaatgacgaaccgcatgtaggatggtggtcccataagattataatgctgtatttttactgtaccttttctatgtttagatacataaatacctaccattgtgttgcaattgcctacagtattcagtacagtaatttgctatgcaggtttgtagcataggagcaataggccataccgtatagcctaagtatgtaataggctgtatcatctaggtttgcataagtacattcaatactgttcacacaatgaaattgtctaaggacatacatttcttttttctttttcttcctttctttctttcttttcttttttttttttgagacagtctcactctgtcacccagactggggtgcagtggtgtgatctcggctcactgcaacctctgcttcgcgggttcaagtgattctcctgcctcagcctcccaagtaactgggattacaggcacacgccaccatgcccagctaattttttgtatttttagtagagatggggttttgccatgttggccaggctggtctcggactcctgacctcaggtgatccacccaccttggcctctgaaagtgctgggattacaggcgtgaaccactgtacccagccattaggacacgtttcttagaacctatccccatcagtaagcaacatgtgccattaagtgacacatgactgtactttgataatagccacccaaatgggcatgaagtatctgttaagtgttttaaattatgtaccagatttgcaaatatggtgtacgtttttgggggccagatgcacaaatgtgaatcaggattgataacacaagtaaaagtgaaaagaaatgactgtcttcataaataattcgctcatctaaaaaatattattgttatgtttgtacaaggcactacgttagcctcaatgtatacattagttagcaaacagaacctgtcaagtccagtgggggattatgggcatttgttaactaactacatgaatatatagtgtggcagatgctcttggtgcccatccacatgcctttggcagtgtaaagcaaaggctgtttacttcgaacgcctgtgaatctctgcctgaggggttttgttcctggtaattacaacatacttggcccacgcaaggggtaagccctccatgctgaggcatttatattcctgggagaagccctcaagcaatgatggatgagaaatggtaaataaatagttcagtttctttgtccctcatttgggatacctctgagatgtgttctatattttctcccagagctccatagcaggattaagctctaattgctcatggtgctaacatacttgtgcaaatagtacatatcatgtagttacctaataagtctgcacatcaaccatatgattgccacataagttagtactccagaaacatctcttacactttaaaggagctcttagaactttttatagggtcgcctaaaatatatagaatatattataccacggactactcttttttcatctattaaagtttcagagggcaaatgcctgaaaatctactttggtggcaatgctgccaaggagaaatggtgacattgctgtgaatgagcttgacccgaatgatgttaactacaatatattgcttcatgtttagtccaaagtcacagagaaggctttttataaaactactaatctgagctgatgactaaaagagaaatatttaaaggtctttcctcctctccattgactcagtataaataggaatgacatgcacatagtgaggggagaatgtggtgccatgaatagagattttgtagcacatttttcattgactttaatgagatgcgtgtggataaatgtgttagtgcggttggcagagtgtcttttttttccaaagcatcaaggtttagcctaatgtctcagtgaatctttgaaatggagctggaattttaaagataacaagtagtgttcagagagcccattgacccagggagcttgcaaggcccctaccagtttcaacagtaatggaaacatttggcaacattgaggaattaaggcaagtagccctggagttgtgggcatttataaacaagtgcaaaggtaattacaggaaagagaatgggagaggtactctagcagtgaataatttttcattgtgttgattttgttgctgagaaaaatctcagaattcctagatttccatgtttagttacaggacatgcctttccataggaaaggctttgctgatgtccttagggcaatgcctttaacatgtccttggaactcttatatactgttggtatgaatgtatagtagtacagccactatggaaaacagttgtggagatgtctcagaaaactaaaaataggattaccatttgatccagctgcttaatatccacccaaaggaaagtaaatcaatatatcaaagggatacctgtactcgcatgtttattgcagcactattcacatggaatccacataagtgttcatgaacaaatgaatggataaagaaaatgtggtatatatacacataagggaatactatattgttcaggtataaaaaagaatgaaataatgtcatttgcagcaacatggatggaactggaagtcattaagtgaaagaagacaggcataaaaagacaaatatctcatggtttcacttacatgtgggagttaaaaaacttgatcacatggaggtagagaatggaaagataggtaagagacactgggaagggtgacttgagggagaggatgaagagaagtgggttaaagggtacaaatatacagtaaaatggaataaatacagtgtttgatagcagagtagggtgaatatacgtcacaaaaatatatactacttgggtgatggacacactaaataccctaacttaatcactatacgtagatacatgtaacaaaattttacatgtacccccatacatttgtgcaaaaaaagtccttaaggcaagactaaaaaataaagacagtgtaagtcagtcagtcaacagtttgattgccttctatgtacagtaaacagtgttagctgttgtcaggcatgtaattataatgcataaactcgatcctcgaggaatttgcaattatctgagaagattaaaaaaagtctgtgagggtaattgatgatatctcaatgccaagtgtgttataaatgagggcatttaggatacacatatagaaaatagacagccccaaatgttccacatattatataattcagtcaatcatcattacaaatcagtggaatgtactgtttattactattttacaaatgaggaaaatgccgggggtggggcatagaaagcttagttaactttcacaaggtcactgaatttaatagtggagcaggaatttaaacccaggtaatctgacttcagagtttgtgtgcccaaaacatgaatctgtattgaaagaagagaattgccagttttatcagaacaggaaaaaaaaatgttcagccttgaatgaagggtgtgctatagatgaatgaaaagagaatggggtggggtcgtgggagtgtgtggatctggggatgtgtttgtggggaggtggcacaaaatgataatgcttcaagcagcagcttgaaggtggaaattaaaatggcacaatatgcgtgtatatgtgggtggaagaatgagtagcaattcaaacctaggcgattttatgtaggaggttagttgatggtaggtgggaatgtagattggtacaggtttttaggcaagcaattttgcaacaccttaaaatttaaaaagtacatggcttcttattcagcctttcccaaactaggaatgcattccacagacgtacttatactgtattgttttaaaagtgaaaaaaatgacatagatgaccttcaaaaggagaactgttggattgtattttagtgtactctgaagtatttaaaaagatggaggctcatctatttttatagacagcgagagatgcttgtaatttattgtacagtggaacaaagtgatttgatgaacaatatgtataatatgattctattttaaaaattaatcaagtcaagaaacacttatggaagcctcactatgggctgggcactggttccagtatatgggatactgtagtggaccaaacatgcaaacagatcatactaaacaaatctctgacttcttggagcttacattcttgaggggagatagacaagaaacaataagcagaataaataagtaaattatataacagaagtatatcagtgcatgaaaaaataaaaagaaaaggagatcaggtaaataggattgggggtgctgattgggggtggggtgggagatagtcttaaatggggcagtcagggtaagactcattgagtaggtgagattttagcaaaggcctgaaaaacatcaagaggaacagcagtgggtcaaacataggccttaaattgggaatatgtctggtgttcaaagaacaccaagaaaaatggtatggctggtgtgggagaagtgaggggaagagtagatgagaggaggttgtagagttattgtggggtctggattatataggttaggactgtccaaaacaaatattatgtgaacctcatatataattttaattttttagtagctactttgaaaaaatggaataccaggtgaaattaattttgatagtatattttaaggtaatatattcaaaatatcatcattttaacatgtaatcaataaaaaagtattaatgtgatattttatacttttcgtactaagacattgaaacctgcggaatatttcccatgtaccacacatctaaatttggactagctacatttcaaattctcaatagcctcaagtggctagtggccatcatattgaacgacaggtatagagttgtgtaggtcacttgttatgatttggcttccacgtggagtgaaatagtcattgtggaagtttgagcagaagagtgacttagtctaatgtacatttaaatggatcactctgattggtgtgttgagaaatgcccaagtttggaaggaagaggggaatcgtgcatagaagcagggaggcctgttaggaggctgttgcgccaatccaggcaaaagatgatggagactcactcagatccaagtgttagcagtcaaaatggggagaactggtcagattgtagatttattttgaaagtagaaacagtgtagtttactgacatattgaatggggaaaaaggttgaaaggtgaaaaaggaatgtcaaggataatatcaaggcttttggcataagtggaaagatggaatttccatcagttgaaattgtggttctgcaggtggcacagatttggaggaaaaacttaagtgtgagattgctattatacccccaagtgaagatttgagttgtcagttggatatatgagtctaaatttgagaaagaagtctagactaaagatacaaatttgagagctatcagcgtaaataaaaattatttaaagctgtgagactggatgaggtcattaagggattgagggtagatggggaagagaagaggtctgatgactgagtcttggaaccctctaacactatggggactaataccagtctggatggatttataccatattgatgattatttttaccattacgtaggagaatttcaagggcctggccaagaaggggaacttttaatatataactgtatttttaataataaatatatataatatacatttatatattatatatataataaatgtatataaaatagaattttataataaatgtataatggttctggaatttaaaaatatgtgagcaatacagagaggacttacagctatagctcagatatataaagaagttgtgaacttatcactgttgtccttacaacaaggaaaagcttgacaactaattatcaatggatattgatgttcttatacacataagagaactgaatttgcagggcgaactttcatcgcaaacctaaagaggcaggtacctgcaggaagtcataaactgaagcatttgcttacctggggctgaagcctccagatgccatgaaaccatatgaggaacattaaactagaaagtctgatgaattgctggggtggttaagtatgggctagcaagagtgtgtacagctccttgagggccacagtcatgggtgtggggtgtggcttatacttacctaggcttttccttcagttagtacactaggctgtcattaggaagattggggataatccagagaaacctacctactgactttctctctgccttggtgattgtagaagtttctaaaggatattttcactggatataagattctgggttggcaggtttttttttttctctcactccacccaattccccgaatgactaagaagagcatagcaccctgacaacctgtgatggacatacagtgtgaacaagaaattaactttttttgtttgtattttagcaaaaacaaacagcaagttgtcagtacaatcatgttgattctggaaagcaagcataaggaaattttatgttttatattacatacagattggggaaaccattggatgtcttgaagaagagtagtatttgatttacccaataaaatcatgttctttgaatattaatccagtagcgatgtataggcaaagattctccactttctgaactaattctgacccttggctctattatgtgtctgaagttatttaataggaacaataataagaacccaaaccaagtgataattaccagaatcctattcatactattaaatagaattagctttgtgtattgtttgaggctattttttttaaaaaaagagaattttaatagtatcttaatgctttatataatttcccacaaaataatataaaaatactcatattgagtaattctacctgtttttacaattaaatgtccatcgctaaataatatttagctaggaatgtagttccttattattggctgttatgccaaaagataaaaaatttcttgttctataatgcctttaaaaatagttgtctattgaaaatatatctattttttttttctgagacagagtctcactgtgtcgcccaggctggagtgcagtggcctgatctcggctcactgcaaactccacctcattggttcacgccattctcctgcctcagcctcccgagtagctgggactacaggtgcccgccaccatgcccagctaatttttttttgtattttcagtagagacggggtttcactgtgttagccaggatggtctcgatctcctgaactcgtgatctgcccacctcggcctcccaaagtgctgggattacaggcgtgagccaccatgcccggcctatatctattttttaccggacttttaattaaataagaatctagagattttacctaattaaggaaaagcatgttggcttcagaaataatttttatgcatgccccataagtctttgaaaagacaatttaatattatgcctaatgttatttttgctttgggagaaaagtaacctatagccccaaaaagtcttatatatgatgggttgtcactcatggcaacttacagcaggaaggattgggtctagattttccttactttgcctcagatttttcattttcgaaaaaatgccccttttcatgtgttgcaactgaggagagttatgagtcaaacgcatcctgttttcaaactcatacatgatattttggttaataaatgcatcaggacctggaggacaattgacatataaaagaaacatagaaagaaggcagccaattgtgtctgtttacagactaaatatgacaaaaaaaggtctgtgagagttttaagttctgcctgttccctagaaatttctactcatttgaagatgaaccttgattgaaatgtaaagtttcaacttctaagaagctgagtaacatacacagcaggaactgccaatatcgttttaatagacatgtcttgtaaaggtgaatttcaatgagttttcagagctttctgaacagtattatcacacgttttaagtaaataggtcaatgttatcatttatgtataattttattgctttagtgctatatttttatgattattttacaaatactttactaagaatatactgaagtctcctgatgattttatgctctttcttattcttgttttactcgagaagttttaactttgaatccctacttagctactttaaaacctgtctcatttttccaacttacaccttgcatcatctctctttccttagagcccagacatcttgcggagccattcacttcttcctaacattttagatactccaatcttttttctatatttgattatttatttgtgaatctcaagaacagaagtagtctatccccaaaacatgcagagagctggaaaaagtatagacatatacaatttaatggaaggaaggaaggcaggaaggaaggatatgaattatatctctaaattggaaacttcaagccttatgtctttataatgatatatcataatttccttttaaaagtcaggaactcagaccaagacacaaactcatgcacatgctaaactgtgaaagcatacatttacctgtggtgacgttagctggcagttttagttggctcagaaaaataatcttacataaggaaagagcctccctccatgagcagccttgaaagtagaaaatttaggaagaatgtgtcaatgatcaaatctactgaaaatcagcaatatcttttgcatacttgtggagtaaggtgtgacaagttattagtggtatggatggctgagcttttctggaaagaagaggacatttttcaaatgtgccttgtattgtgcatggtcctttccatggttatacctacatactggccagttgtaaacattagatcatattaaaatcattcatggatctttcaaaaagacttagactcccacacaatagtagtgggatactttaacagcccactggcaatattagacagatcatcgagacagaaaattaacaaagatattcaggatgtaagctcagctctggaccaaatggatctgatagatagctacagaactctccacccaaaaacaatagaatatacgttcttctcattgccacatggcatttactctaaaattgatcgtataatcagaagtaaaacactcctcagcaaatgcagaaaactgaaaccatataaaacagtctctgggaccacagtgcagtcaaattaaaactaaagactaaggaattcactgaaaaccgtacaattacatggaaactgaataagctgctcctgaatgacttttgggtaaataataaaattaaggcagaaatcaagaagttctttgaaactaatgagaacaaagatacatcgtaccagaatctctggcacacagctaaggcagtgttaagagagaaatttatagcactaaatgcccacatcaaaaagttagaaagatctcaagttaacaacctaacatcacaactaaaagaactagagaaccaagagaaaaatcaagccacagaaatacaaacaaccatcagaaaatattacaaatacctctatgaacataaactagaaaatctagaagaaagggataaattcctggacatagacaccctcccaagactgaaccaggaagaaatagaatccctaaacagaccaataatgagttctgaaattgaggcagtaataaatagcctaccaatcaaaaaaagtccaggaccagatggattcacagctgaattctacccgatgtacaaagaagagctggtaccattcctactgaaactattccaaaaaattgaaaaaaggggactcttccctaactcattctatgagaccagcatcatcttgataccaaaaccctgcagagacacaataaaagaaagaaaacttcaggccaatttacttgataacattgatgcaaaaatcctcaataaaatactggcaaactgaatccagcaacacatcaaaaagcttatccaccacaatcaagtaggcttcatccctgggatgcaagcaagcttggttcaacatacacaaatcagtaaatgtgattcatcacataaacagaactaaagagaaaacacacatgattatctcaatagatgcagaaaaggcttgtgacaaaattcaacatcccttcgtgttaaaaactcacaataaactaggtattgaaggaacatacgtcaaaataataagagccatgtgtggcaaacccacagccaacatcgtactgaatgggcaaaagctggaagcattccccttgaaaactggcacaaggacgcctgctctcaccactcatattcaacatagtattggaagttttggccagggtagtcaggcaagagaaagaaataaagagtattcaaatagggagagaggaagtcaaactaacacttttgaagatgtttaaaaaaagcaatggggaaaggattcccttttcattaaatggtgctgggataactgtctggccatatgcagaagattgaaactggaccccttccttacaccatatacaaaatttaactcaagatggattaaaaacttaaatgtaaaacccaaacatataaaaattctggaagacaacctaggcaatactattcaggacatagcctgggcaaagatttcatgatgacgacaccaaaagcaattgcaactaaagcaaaaattgacaaatgggatccaattaaaataaagagcttctgcacagcaaagtaactatcaacagacaacctacagagtgagagaaaaatttttgcaaactatgcttccaacaaaagtctaatttataaggaacttcaacaaatttacaagaaaaaaacaccaccccattaaaaagtgggcaaaggagatgaacagacacttctcaaaggaaggcagacacatggacaacatgcatgtgaataaaagctcaacatcactgatcattagaaaaatgcaagtcaaaaccacaatgagataccatctcacaccagtcagaatggctactatgaaaaaataacagatactggtgaggttgtggagaagaaagaacacttatacactgttgatgggagtgtaaattagttcagccatcgtggaagagtgtgacaattcctcaaagacctaaagacagaaataccattcaatccagcaatcccattactgggtatatacccaaaggaatataaattgttctatcacaaagacagatgcatgcatatgttcactgcaatactattcacaatagcaaagatatggaatcaacctaaatgcccatcaatgatagactggataaagaaaatgtagtacatatataccattgaatactatacagccataaaaaagaatgagatcatgtcctttgtagggacatggatggaactggaggccattatccttagcaaactaacacaggaacagaaaaccaaataccacatattttcttttagttgggagctaaatgttgagaacccataagacacatagaggtgaacagcacacactgaggcctaccagagggtagagggtgggaggaggaagaggatcaggaaaaataactaatggatactaggcttaatacctgagtgatgaaataatctgtacaacaaacccccatgacacacatttacctatgttacaaagctacacatgtactcctgaacttaaaataaaagaataaaaaaaatcgttcatgagtctttacaaaatcttaatacctgagtctcaggattgagattcgaagtggggagggggactggaggactttttttgagttgataaagaagaaactggtactttgaaagaaggtatacgtttcttccttcctcctttttggtaatattctggaatcactgatccttaagactcccaggattttcaagttgtattctgttgcatttagatgcaaaataatctaatgtagtattttccacaatgagcttcctgaaaggctgatcttctctgaaaatgttagtaacctcatatgataaataagtaaatactaatgagtttcttccaaaatatgtttagaactctaagaaaatcactaaagaaatgtaaatagttcttactattatgcaatactttttcattagaaatacagtaccaaatcaagaatgccaaggagaatgagaaatcattcattactttaatctgttcaattaatatttttgagcatctactatatgcctggtatagttgtaggtgcttgggatacatcagtaaaatgcattaatacatgactttaattctgcagcatttagaaaaaaactctctgatgtttgatgggtttttaaaatatcgtataatgttctttattcatttttcattcaaatttataaatgaattaaaaaataaactaaaccagactaatttgctttattcatatgtaaagttaaaaataattagatattgatcatttcttacaagatttatttcattgattccttttattcttttgctgtcaaatacaagagtgaatttctatgaactgtggagattttcaatgcatttgaattaaaagactatgatgaacagaaaatgacacatccatacatgaaacttctctgtaagtgaaagctttattatatatttctttggggaaaccttttgccatgaagaaatgaagcaggttctgaaataaatttgaaacaaaatttttatgcaacttaagcaaattttacattggtaaatcacgtgatttattagaattttacaaatattacaaatgtaacatcttacactttatcaagctaaacaagaaatagaatcttttctggttgactggctgacatgaaatagtttttgattcaagcaaacttctgcaagtagctctttgtaaacagaaaaataagatagatggatatatatagataaatacataaaactaacttatttgactcttatttggtcccaccagttgggcttttagggatgttttctgcattcaggaagtttcttgaaataaagatgagtatttgttgttatgtttgtctgcagagaacagtctgcaaatagtcatatgtgtttcataaggatcgcctcaactttcttttttgtttctgttttgtttttgcatataggtagggttagacataattgtaaatactccttcttaaaaaggatatatatgcatcggaatttaggaaatggtcatataatggctttgaatcagattaacctggatttaatacaggtccctaggtattgtggaccctcatacccaattctctttgactttgttttgtcatttgtcacataaagatattaatatttaatatacaaggttgttataaatcaataagataataaaagtgtaaagagcactgcactgaacctgccttatggtaaggattcattggaaagtaattatttgttattactgttattattattaagcatctattatgtgttagggttgggaataataaatggaatattatattgggcataggtttcaagtgtagtgtctagttggagaactaaagagtatatgtttgaggtaataactaaaaataaaaacagtagtatggatgagaatagacagtttttttttaaatgtaagctttggaggtttttgtgacataaatattataaatggtcctgaagaaatctgaacctaaatttcttcatgtatacagcccatttatactgttcattaggtagaaaccagctcgtagatgaccttcaataaagtttgtattgattgctaggtttttgaggaaacaaaaacaagagacaattcaattttcccagcttatttctttttgaacagtagaaaggtgttacatcttgttgctgccaagtggagcagattaaaggtcaggacagcatgcaagatctgtttctctaataggaacattccagcacacaggaatgggggatggagtaatttttagtctatgtttctcatgaaagtcaagaatagcataacattagaggtacttttttggtctcatgtttattcagtagctttgaccgtagagttttttcctatttagtgactatattctacttggaaaatatgatgtaaaagaaattcgtagagaaaaatgcaaataccgttgcatatccccaagtaatttatgctttttcttacccccaaattcttgaaatatattcatttgtaataaaaaaagtccctgcacctggagttatcttttattttcctttctttttttaattactctgacatataattgtaagatacatatttatgaagagttgagacaggccagaatcaaattttcttgtccagcctacccagctgctgatggccatctctgagataaccaacttgctcacacatgctcctaatgatttctgttatatagttgagagggagtgtccgtctgtcagcactaaatgctatttgtgaaattaatggcacaaggaaacaatgtagctctgatactagttgcagctatacatgttagctgattttgaaaaaaggttggaatttagtaatatctttcagtcacatggtatttttccctctactcttcccctggttcatggcattctaagcatatcaaattacctactacttgttattgcaaatgatacttttaaatttctgatttgagatattacttgacccatataaaaatacaaaatgactgatttttttttattattatactttaagttctagggtacatatgcacaacgtgcaggtttgttacatatgtatccatgggccatgtgggtatgctgcacccattaacttgtcatttacattaggtatatctcctaatgctttccctcccctctcaccccaccccaccacaggccctggtgtgtgatgttccccttcctgtgtccaggttttctcattgttcaattcccacctatgagtgagaacatgtggtgtttggttttttgtccttgagatagtttgctgagaatgatggtttccagcttcatccatgtccctgcaaaggacatgaactcatttatggctgcattatattccatggtgtatatgtgccacattttcttaatccagtctatcattgatggacatttgggttggttccaagtctttgctattgtgaatagtgtcacaataaacatacgtgtgcatgtgcttttatagcagcatgatttataatcctttgggtatatacccagtaatgggatggctgggtcaaatggtatttctagttctagatccttgaggaatcaccacactgcttccacaatggttgaactagtttacagtcccaccaacagtgttaaagtgttcccatttctccacatcctctccagcacctgttgtttcctgactttttaatgatcgccattctaactggtgtgagataatatctcattgtggttttgatttgcatttctctgatggccagtgacgatgagtattttttcatgtgtctgttggctgcataaatgtcttcttttgagaagtgtctgttcatatccttcgcccactttttgatggggttgtttgtttttttcttgtaaatttgtttgagttctttgtggattctggatattagccctttgtcagatgagtagattgcaaaaattttctcccattctataggttgcctgtgcactctgatggtagtttcttttgctgtgcagaagctctttagtttaattagatcccatttgtcaattttggcttttgttgccattgcttttggtgttttagacatgaagtccttgcccgtgcctatgtcctgaatggtattgcctaggttttcttctagggtttttatggttttaggtctgacatttaagtctttaatccatcttgaattaatttttgtataaggtgtaaggaagggatccagtttcagctttctacatatggctagccagttttcccagcaccatttattaaatagggaatcctttccccatttcttgtttttgtcaggtttgtcaaagatcagatggttgtagatgtgtggaattatttctgagggctctgttctgttccactggtctgtatctctgttttggtaccagtaccatgctgttttggttactgtagccttgtagtatagtttgaagtcaggtagcatgatgcctccagctttgttcttttggcttaggattgacttggcaatgcaggctcttttttggttccatatgaactttaaagtagctttttctaattctgcgaagaaagtcattggtagcttgatggggatggcattgaatctgtaaattaccttgggcagtatggccattttcatgatattaattcttcctatccatgagcatggaatgttcttccatttgtttgtatcctcttttatttcattgagcagtggtttgtagttctccttgaagaggtccttcacatcccttgtaagttgaattcctaggtattttattctctttgaagcaattgtgaatgggagttcactcatgatttggctctttgtctgttattggtgtataagaatgcttgtgatttttgcacattgattttgtatcttgagactttgctgaagttgcttatcagcttaaggagattttgggctgagacgatggggttttctaaatatacaatcatgtcatctgcaaacagggacaatttgacttcctcttttcctaattgaataccctttatttctttctcctgcccgattgccctggccagaacttccaacactatgttgaataggagtggtgagagagggcatccctgtcttatgccagttttcgaagggaatgcttccagtttttggccattcagtatgatattggctgtgggtttgccataaatagctcttaattattttgagatacgtcccatcaatacctaatttattgagtgtttttagcatgaagggctgttgaattttgtcaaaggccttttctgcatctattgagaaaatcatgtcgtttttgtctttggttctgtttatgtgctggattacgtttattgatttgcgtatgttgaaccagccttgcaccccagggatgaagtccacttgatcatggtggataagctttttgatgtgctgctggattcggtttgccagtatcttattgaggatttttacatcgatgttcatcagggatattggtctaaaattctctttttttgttgtgtctctacccggctttggtatcaggatgatgctggcctcataaaatgagttagggaggattccctctttttctattcattggaatagtttcagaaggtatggttccatctcctccttgtacctctggtagaattgggctgtgaatccatctggtcctggactttttttgattggtaggctattaattattgcctcaatttcagatactgttattggtctattcagggattcaacttcttcctggtttagtcttgggagggtgtgtgtgtccaggaatttatccatttcttctagattttctagcttatttgcatagaggtgtttatagtattctctggtggtagtttgtatttctgtgggatcagtggtgatatcccctttatcattttttattgcaactatttgattcttctctcttttcttctttgttagtcttgctagcagtctatcaattttgttgctcttttcaaaaaagcagcttctggattcattgattttttgaagggttttttgtgtctctatctccttcagttctgctctgatcttagttatttcttgccttctgctagctcttgaatgtgtttgcttttgcttctctagttcttttaattgtgatattagggtgtcaattttagatctttcctgctttctcttgtgggcatttagtggcataaatttccctctacacaccgctttaaatgtgtcccagagattctggtatgttgtgtctttgttctcattggtttcaaagaacatctttatttctgccttcatttcgttatgtacccagtagtcattcagaagcaggttgttcagtttccatgtagttgggcgattttgagtgagtttcttaatcctgagttctagtttgattgcactgtggtctgagagacagtttgttataatttctgttcttttacatttgctgaggagagctttacttccaactatgtggtcagttttggaataagtgtgatgtggtgctgagaagaatgtatattctgttgatatggggtggagagttctgtagatgtctattaggtctgcttgttgcagagctgagttcaattcctgggtatccttattaactttctgtctcattgatccgtctaatgttgacagtgcagcgttaaagtcacccattattattgagtgggagtctaagtctctttgtagatctctaaggacttgctttatgaatctgggtgctcctgtattgggtgcatatatatttaagatagttagatcttcttgttgaattgatccctttaccattatgtaatggccttctttgtctcttttgatctttgttggtttaaagtctgttttatcagagactaggattgcaacccctgccttttttttgttttccattttcttggtagatcttcctccatccctttattttgagcctatatgtgtctctgcacgtgagatgggtctcctgaatacagcacactgatgggtcttgactctttatccaatttgccagtctgtgtcttttaactggagcatttagcccatttacatttaaggttaatattgttatgtgtgaatttggtcctgtcattatgatgttatctggttattttgcttgttagtgggtgcggtttcttcctagcctcgatggtctttaaaatttggcatgtttttgcagtggctggtactggttgtttctttccatgtttagtgcttccttgaggagctccagacctgccctacaagaatgactgattgttagagacttttttgtgtttctatggaaaaattaaaacatatgtgagagagtaaactgctgattattctatacaaagccttctagcatatctttctgactttctgtaaatggaacatgacttgacgtctacctccaactcaatttgttttttttttttttttttctgagacggagtctcactctgtcccccaggctggagtgcagtgatgcaatctcggctcactgcaagctctgcctcccgggttcacgccattgtcctgcctcagcctcctgagcatctgggactataggcgcccgcaccacgcccggctaattttttgtatttttagtagagacgaggtttcaccgtgttagcaaggatggtctcagtctccagatctcatgatccacctgtctcggcctcccaaagtgctgggattacaggcatgagccaccatgcctggcccttggtgtgttttttaaaacacaatcaaacacataaacattcacaaagaactacttcagaaaaacaagaattcactggactagagaggacctttaaaaaatctgaaagcttctttgacaagaaaggataattgctgtatatctttcttattgagtataattttcgtttacatattttattttgtgtgtttttaaaaattattattaccgggtaattatgatagatataactcagaatacgcataggtcaaggcatgggatagggattgtatggagcttccatactccccactgtgtgccaccctcttagcacatctgtgttttcaccaacccagaagttcttcatacaattttaaaacgtaattaataaaagatcttgcaagtctctgaattttcttaccttcttactcataggatcaggcaaatttcaatctctttgtgaaaatgctaacatgttgagaatgagcaaggcagagcagtggggtggataattctaataataaatcatgaacaaaagtaaatggtgatggctgtgatggtgtgaaataacctgatggtggcataggcctcttgaaggaatactctgggaatctcccttgtaacacttttaagagcaaatttaaaaaatcgagactatttatgcatttttgttgtatttagaaaagcatcatgtacttaaatggaagaaaaaaagtgagggatacttccagtgttggatggttaagtttttctgaagtctatgtttattttcaaagttatttatgacaatgaaataatatttaatgctacagctatcacagtgcactcatttatttttttctaaattgtgaagaatacatggttaataataggtttcagataggtatctggattcatgtgaatgaacttaaaaagacagttttgatgatcattctgttgaggatagaactgtggtatatgtgatcatgggttttatttttctcatgtgtaaaatgaggtatataatctgagtctcaggtgactccaaatttttaccattcttcacatattgatattatgttcaagaaatcaatagggataagggggaattaaggataataatttggttctacttaataacacacactacttgattattaacaacattgcacgcaagtgttaatacagctcatttgctttggatggaagctgtaatgtctaagattcaagcataccttcctttggtgatggccttcattcattcaaccaatatttttgtagtgactgttgtgtggggattgtggtagaattaaaactttaaggaaaaacctattataaaactccctcacaaaaaatacgataaattgaaatttaaacattatttaagaaattttattacttggcagataataaatgatacttactgagtgctaccacacccaggcactattcaattcactctacagttattaattgacttatatcatcctcatagtgttcctatgaagtaaatgtcattatttcccccactttacagatgaggaaactgaggtatagagagaataggcagtttgatcaagcttttaagattggtgaatggaagagtgtgatttgaccccagagctctagtgcctgcatgcttaaacactatattgcacagcttcttcatttagatacattgcagaaacagaggaatctaattgtagatgcatctggctcaactcctttgtgaacatagtagtaatgtaatcagaagacttatatcctcagttttattcttttatggattttatatgggaccaatgataaactttcttcatttaccccagtctcttaataaaaataattttccaattctgtgaagaaaggcattggtagcttgatggggatggcattgaatctgtaaattaccttgggcagtatggccattttcacgatattgattcttcctacccaggagcatggaatgttcttccatttgtttgtgtcctcttttatttcattgagcagtggtttgtagttctccttgaagaggtccttcacatcccttgtaagttggattcctaggtattttattctctttgaagcaattgtgaatgggagttcactcatgatttggctctctgtttgtcttttgttggtgtataagaatgcttgtgatttttgtacattgattttgtatcctgagactttgctgaagttgcttatcagcttaaggagattttgggctgagacaatggggttttctagatatacaatcatgtcgtctgcaaagagggacaatttgactccctcttttcctaattgaataccctttatttccttctcctgcctaattgccctggccagaacttccaacactatgttgaataggagtggtgagagagggcatccctgtcttgtgccagttttcagagggaatgcttccagtttttgcccattcagtatgatattggctgtgggtttgtcatagatagctcttattattttgaaatacatcccatcaatacctaatttattgagagtttttagcatgaagggctgttgaattttgtcaaaggccttttctgcatctattgagataatcatcattctcagtaaactatcgcaagaacaaaaaaccaaacgccgcatattctcactcataggtgggaattgaacaatgagatcacatggacacaggaaggggaacatcacactctggggactgttgtggggtgggggaaggggggagggatagcattgggagatatacctaatgctagatgacgagttagtgggtgcagcgcaccagcgtggcacatgtatacatatgtaactaacctgcacaatgtgcacatgtaccctaaaacttaaagtataataataaaataaaataaaataaaaaataaaaataattttcattagagtgtatatgagattatgatgatggatttcttattatatcagaattatattttcataaattcagataacactgtacagttattgttgaatactatactatgtataaatgtccacaaatcaaattttaactattcaagggtgctttcctttcaaaattagcagaaagattacgttttcaacagttaattaaaccattttgaaattacaagagataatgtagaattgtatccaaagtcttatacatttgttctggcaatacctttattcagcaagagagaagaatttattctctgcagataaccgctactcacccacaaacagtccaacatacagcccagagatgtaggcttctcattttggaaatacaaactgtttacaatgagagtatctctaaaaaaattgtttcttaggaggaaagatcgttctatcttccaggaaagggaaactccaagaagtttctttattctaaaaaattaagaaagaccctcaaacctcaaagcacataaaggagacttagcaaacaatattctgtaatatttgcagaaaaacataaacacagcatctttactaatgtttattttccaaaaatatggtaataatagacatttattgggaacttccggcattgcaatgcagaacacttttttataatgaatataaactcattatatagatgaagaagctgagttgcaaagaagtcaagtaggaaactcatttaaaccctctggagtcatgtccttccacagtgttttatatttactttcttgtagatattatggctattctaaatatttggatatttgctgctctaaaagtctttttccttaaagaaaatttttcaagttgtatttctttttcactttaaaagttattttaaacttaaagggaactttacagcccattctagctatgttactctgtattatcatttgcttatatcaaacattttgcatgctactatgactataaatatatcattttaaactttaatttgtgcaaatttaaaatgattgacttttattttgcagttagcaaataagctcccagactgaccaaaatgcttttaagggtcacatttatgttaaaaaattatatgtataaaattcccattgggaaaagtttgattccagtattcttatgtaatagccaagggagtgccagttaagtacaaatttaatagcttttctaggtaggactccagaattagtgcatgaagggaacatagttaatctgtttgaagagttcattaaattaggttatatatgctattatgaaatatagaggagcataaaagtatccagaggaaagcatagaaacaatgcaaattacttagaaccaaaaagattgatttatgatgaattattaaagataaatggatcttaatagtaaatgctctataaacagagtatatgtctaatgccaagatgctaagttcaaagaagctttacctaataattaatgaggactggaaatactctagcattctagatatagttgcccaattaaatatgttatagaaaattatctgaaaatgggaagctaactgagctcatccaaaatttagatgatgacttatttcttccagttagaagatagggatgaggccgggtgtggtggctcatgcctgtaatcccagcactttgggaggccgaggcaggcggatcatgaggtcaggagattgagaccatcctggccaacatggtgaaaccccatttctactaaaaatacaaaaattagctgggtgtggtggtgcacgcctgtagtcccagctactctggaggctgaggcaggagaatggcgtgaacccaggaggcggagcttgcagtgagccaagatccatctcaaaacaaaaaacaaaacaaaaaaaattatgacttgaatttcaattatgacttgaaattatcttatgatagtttctaataggtggttttcctcatttgtttcaattataattaaaaatagttttataattattatgacacttgtaaagatagtaaaactctgtttcagaaagcttatccatttgctgaagtttgtattgctctctcatctattccttgaagaactttaatattgaaggaaaacaatgacaacttttatgataggaaattcccctgcttaactaaaccagcacatattggtctcaaaaattgagatgacctgaatctttgaatatagtttttttacacgttgagcattgtatatagttagaaagggctatagaaactgtttcatgtttaaataattatttctttccttttataaataatataaagagtatatatcagttatgtattcagaggaacacttccgaaaaacgactaaatagatacttggccatattttctacaaaattatctaacatagaatgaacatatttattcaataaatgtatgctgaaaaaagctacatcataagtaaaatgaacaataaaaaaactaataatattttccagttttcttgataatgatttacacttgttgaactgtgatgtgtgatatacttgttgaacatgctaaggaatattaagccatgccctaattttcattattttacattcatgcattaacttgagcaagaccctaagatttatttataggtgccagttcagaaagtttttcttgctgtgaaatcctagacctgatgttttaacatatatatggactttgaaaccatgttcatttaatgcctatgaccaatagttttaatgaatgcctaacaacttacttaaaccaaacaaataattagtgtcaattacagaagtgtaaatttgactctaattaatgaatgtgccagactctacgcattggtttaagtgtaattgatcttagggccactgagatcactttaagggttggaaaaatgacaacaagtaggaagtgactcagatgtaagaatgctcactcctagaaagattaattggtgtattagtgataaactagtgggtggctgatgtaataatgatatccctatattaagatgcctcaaaataggatcaccaactctaaagcttgtaagtttatacaattactatgtcaaatatactcttttaaaagaatatctgtcacgttcatttgtccttttttcattttgattttttttctttttcatcattataaaaaaaacatcctaagggaagcatactgatgttttactttatgctttgaaatgttctcactgaactgtgttggtaggcctgggtgtggtaaattaagtggcttgtattaaaaagacaatgattgctagctagtatttttccattttctttgctgtcagcaaagtctgcttttgttgccatgataacttctccccactttgatggtgaaatctggaaggacaaaaaagaagggcatttctattgtgctattacatttcttctcttttgaagaacttctaatactttgaatgatgggttaaaaagccgagatgatgtgatgaagctgaatggtgggcaaaagctaaattatggcatattcatttttttatcagtgcgtgaaaggtcactggctgagggagagacaggcaaagtcctagatcaagagagtgagaggtggctgctaagtggggagttgagaagatcagaatactacggagtctttgtcctttttctgactattccctgcctatgttttttccctcccttctttctcccctacctcctaaccccagacaactgtcctaatgaaaagatttttaagaaagatgtcaaagaaaatagagtttttaaagaaagatgtcaaaggaaattgttgaatgaggcacaggggcagcatgagaccagagtggaggaaagtgataaaggcactttttagaagttaagcccagaaaactggggcaagaatcaaagcgacgctacaggcagggatgaggtaaccagggtcctgaagataatcataaggagctggagtctgaggcaggaaaaaaggcaagtctggttaagaggtttaaggcagaggatgacctacttagaaaaagatcttttcaacagccagacttcggactagaggggaagtaggtcaagaggcctgagagtaggttacattcgtctgagaggaagttgttttgactaaacaagaagttgtaattataccaaattatgagatcgttaaattaagtagtcatgtgcaataacatttcctccttaaatatttttaaacatttttttagcagagttgttcatcatacatcaaattttaatttgcattatgttgtgtagtacaacttcatttagactacttcagtggaagaacaatcgaaatttacgaacattctgaaagagttggaattttgcttcttgtccgtatataaataggatcaagttaacctttcatactgtgtgaactcctttgtcttatttcttcgagggctttttaaaagataagaataatgaacgtgaaagggattttataaaaacatgattaattcaggtaattgaaatagtttgatatcctaagtagtttaagcattctttctgctacctcatttggattaatagtttgtttcatcccagcactttgggaggccgaggcgggtggatcacgaggtcaagagatcaagaccatcctggccaacatggtaaaacccatctctactaaaaatacaaaaattagctgggcatggtggcacatgcctgtagtcccagctacttaggagactgaggcaggagaattgcttgaacccgggaggcagaggttgcagtgagccgagtttgcgccactgcactccagcctggcaacaaagtgagactctgtcttaaataataataataattaataatttgtttcaaaatacagcaggatggtatagtgttaaacacataaattctagaggcagattacctggattaattcctagctctatgattttctacccgtgtgaggatattggatcttaatgtttatatgtcagttctctcacctgtaaaatgggctaatagtagtgactatttcatagagtggttgtaacaatttattatacaggtgtgtgtgtgtgtgtatataatatatacaggtgcacacacagttatatatatatatacatacttaggacagtaacagaaacagagaaaatgcttatcaaatatttatgattattatgagcaatgttaacagtaattatatgtatcctaaaatacttctaaaatagtaatgatactattaatccaatcctaattttaatactaatcttaacaatatttttgtataccatcccccagctcctcctgccatttcttttctcccctttatagtaaaactcagaagagttgcctgtgcttgctctcttctcatttctcttagacctcttccagtctgggttttggagccaccactccaactaaactattcctaccaaggtcccgaatgtcctccacattgctgaattagacccaattctcaatccttaaggcagatagttgacctatcagcaacaatttatcacctacttctttgatgatgtactgtcttcacttgtctttcagaattgactcttggtataccttcagatttagttggtctttctcagccttctttctgattttgtcgactctcgtagacttctcgatgatggaagaagccagtctcattccttggtcctcttctcaattcacttccttagtcatttcacctagtactgtggttttaaatatcatttgattgttgacaattttgactaatttattttctgtttccagctcctctcccaaattccagattcgtacatctaactccttactcaagattttcactgaaagcacttatagacacttaaaatttaatatgtccaaaggctatagagccaatatcctcctcagaactggttccacaaacacccattcccatatcagttgctatagttccctgtgtctggttattcagaacaaatttctttgagtcatccttcactcctctcattttgttatactccacatcaaacagttctcactttctgttggcttgaccttcacaagagatccagatggtgaccatttcttaccacctctgctgctacaaccctactttaagtcactatcatttctctcctgaatttatgtgatgacatctggtctgcctgcttctgctcttcccctcttcaaatctattctcaacacagaagtcaaatgtcagtaaaatcctgtcagtcctcaccttgaaaccctgcagtgaaaccacaattcattcattacaaatgaaaagtgtttacaatggcttccatggatttatatagtggcccccattatttcttcttatgtcatctactcctattttccctgtaatttgtgttactctagccacagtgacacctcactgtttctgaaacatgctagacatgtgcctaccttaaggatttgcatttgctgttccctctgcctaaaaccattttcccatatataatcccacaattcctttacttcttttaggtctttaccaaagtgtcatttttttttttttttaatgtggctcttcctctagttttaaaactataactctctaactcctgactgtcacctctggcatttcccatttctcctaccctcctctagagcttagtatatgttccaacatcatgtaccatttacttatttgttatgcctgttatttatcagtcttctactagaaagtaagctccatatgggcagggaacatttttcatttactggttggatcagtacctattattttgtaggcactcaataaatacatgtcaaatgaatgagtgaatgagtattctgttgttttttcctctcccctacaaatattatgttgaaaagggttttcctcaaatgcagatcttatgcaagatacctgcatgatataggcagtgaacatcatctgctactttcgtttgctaatacaacaggcaagctcaacgtgaaaattacttactgtggcatccagtgttgctctccacatctggaatgtgtttccttaatcttatgaaacattactttcctatcaagttctgtaccacctatgaagtttttcttctctggacattcttgccaactgtgatttccaattctttagaattggtatagcacttatttttcttactatacaatttagccaatacattttatattaagtttcattgttttgtctcttcaactagcttgccaagtcttgaagggcagaaatcacatactatgccttctggtaaagcaatgtacatgttcacactccaatctatagagtattttttttttaaatcttcaaaataggttttgtctcttcaactagcttgccaagtcttgaagggcagaaagcacatattatgctttctggtaatgcaatgtacgtgttcacgctccaatctatagaatatttttcagaaaaaaatttaaaaataattttccaggaagattcctcagaatcttagtggtaacccaggagcagtggttcatgcctgtaatcccagagctttgggaggccgaggtggaaggattgcttgaggcccggagttcaagcccagcctgggtgacatagcaagaccccatgtcttaaaaaaaaattagctgggtgtagtgacacacaaccgtagtcctagctgcttgggagcctgaggcaggaagattgcttgagcccaaggattcgaggctgttgagctatgatcatgccactgcattccagactggacagcagggcaataccctgtctccaaaagtataaaattaaaaaaaaaattagaatcttagggataaattgcttaaaaacaagataaagtttcaaacaaatacctaatatacaactgtcttcaaaagacattttttagtattaatgatttaaagtattttccctttcatatttccttccttatgggtaaggaatgtggaatgtcaagccatttttcatgggttttataaatactacctattgattattcatgaaataatatgtccttttatgctttgttgttaaattcaagatattatatagcaataaaacatttaagtatttgctgaatcaaatgaccaaactggaaagaagtgatggtcaattagaatgtatacaatccttgttcattaaaatgatggctcacaggctgggcgtggtggctcacacctgtaatctcagcactttgggaggccgaggtgggcagatcacaaggtcaggagttcgagaccagcctggccaacatagtgaaaccccgtctctactaaaaaatacaaaaaataagccaggcgtggtggcgggcacctgtaatcccagctacttgggaggctgaggcaggagaattgcttgaacccaggaggcagaggttgcagtgagccgaggttgtgccattgtattccagaccgggcaatagtgtgagactgtctcaaaaaaaaaaaaaaatgatggctcatagatgatattcatgaaaaggttctctcttgccttacaaaactcttctacttatctgttaatgtatacagttaattttctacaattgcataaatacatgcacattaaacattaaaatgacttagtttatgttccaaacttacaaagccaaataaagtcagtggtaatgacagacctttaactctccccattgttcttaatggcaaccattgctactaagacagcctgtgcaattattcagtatctcaggagtacaaaccatatgctggataaaaaagtaggcaaaataagcttgatgtattaacactaggagactgcaggttgtattttgtttcatagatttgagagaatatttttattttgtttttcactattttttttccttcaggagtgtgttgcatgtttattgtcttgtgttatatatgcaacagtagattttcttaactctgtttttataaaatgtcatggattctttcattccattaacttctttgaatgttatgaaaaatgagtgttatgaatagcttaggagacttgagtgtttggagaaactgaggagacttggaggggctgctcagccctgaatatttccttttcttttcttttcttttcttttcttttcttttcttttcgttttgtttcttttcttttctcttcttttccttccttccttccttccttccttccttccttccttccttccttccttccttccttccttcctttctttcctttctctttctttctttctctttctttctttctttctttctttctttctttctttctttctttctttctttctttctttctttttttgagatagagtctcactctgttgcacaggctggaggacagtggtgcgatctcggctcactgcaacctctgcctcccagacttaagtgattctcctgcctcagcttcctgagtagctgggattacaggtgcctgccaccatgcccagctaattttttgtatttttagtagagatggggtttcatcatgttggccaggctggtcttgaactcctaagttcaagtgatccacctgcctcagcctcccaaagtattgggattacaggcatgagccactgtgctcagccagccctgaatacttctgaagtcctttcatttctctaaatattaagagagcaaacaatagaaaagtaataatcaacaaacttgatttcttacaagaaggcttatatgccaatgttttaaagttttaacattttaatatagagattttacatggtttatgttatttcctttttagtatatctttttaacttcttaaagacacaacaaatatggaatattaaacttggataaacaactctttcattataaaacaattcatccaacaaaactgtatcaaatgcctcctcagtgctaagcgttctgctagtcattggtgatacaagttgaatgaggcaaccaatgaccgaggcttcttactgttcacattcaagtggaagtgtgagaaaataaaaaatatgtaatgtagaaaagaaggaaggaaggaaggaaagagtcagggagggagggaaggaaaaaaaaaggggaaaaaagaagggaaataattatccattcagataattgctaaagcagaagtacacaggtacagtgaatagcaatttgcagccagaaaatcactattatatacatttctttgcatgtttccaaataaataactcttccaaatatctaatctctttttttaaaaaaaaaaaatcttagaacattattgaaaactagtttatgggaactagaattgtcctacaggacagaaaaatttggcccaagcagcccagttttagaaatctacttcatgttaacattattttacttagctgacaaatatttactaaatgcttattatgggccatgcactgattttggtgatatagcagagaacaaaaataagtccctgacctcatgtatcttataagaagtaggtgatgattgtaatagatcagtggatgataagcactctggacaaaaattaaaactgggggagagttatgtggtgtctgggtggaagatgttggagttctctagggtggcaaaagaagacctcactgagaagcagtcatttcaactaaatgctggaaaaggtgagggggtgagttatgtgtgtattagatctagagaaatgcaggtgcaaaggccataaggcaggcaccatactggttcaaggaaaaccaagaaggcttgtgcggctgcagtagggtaagaaagagggaggttagtgcaagatggagttagaaagataatgttgttaggagtgctttttaagggttttggagccaagaattaaacaaaaatctgcttgatggcaggaggcagcagatgacatctgtttgctactgtccttccatgtgggttgtatcattcctaggtaattgttctcatttctgaccaggagtgttagtcttttctaattagcatcctaattattttctccaactcatcttctacttggctgtctaagtgatctttccataatgcatgtcccatcttgtagtctcaatttaataccctttggtgacactccattagctttgcaaaaagacaaaggtcttaaatggtgttcaaggcccttcataatttgatgtctccaagatacctacacagcattcctcctctgggtcttgacacttgtagttccctctacctggaatgttcttttcccatttcttcccatgacagctttcttttaatcttttaaattcctatttgaatgccaccttcactgaaagacattcctttcctgaccactctttctaaagcaggtgacacggagtctatattttccatcattatcatgctgtaattttcctccttaccacaattagaaattatatattttgctttactcttttgatgtctgtctgtctcagtagtatgacgcttcatgaaggcagtgatctcgctgtctttacacttctgtaccaacaataaaagctaacacatatttaatgcttgttatttcccaggcactattcccagcacgttgcatccactaactcatttaatacttaaccatacgaggaagataccatttattaatctagactaggctatcaaggcacagagagactaagtgcctggactccaattccatggctaatagagtagaagagacaggattttaattcacacaatctgcctccatgaaatcaatgtacactctgtgcattagacaaatttgattatttattttaggtaccttatactttctataagctgaggctttcagtagtgcttcctctgccaggaatgcttatatcttcttttccctggccatatgctatctctctttctagttttcatccactcttcatctcctttccaaggcttttatgatatccccctccttccctgcccagactaaatagaagcttctctttgcctaacctctttgcttccatatgatagtttagcaattattatgctatattttaattattaattttcttatatcccctagacactgaactcccaagatggggacagtgtcttttttttttaattcccagtgctcattatagtttatggcataaaaagttggtgctcaataatgtttggttaaatgaatgtgtgacacagaacatttcaacagcatactcattaatatcgtagaaatcttacctggttcaaaaaatactaagacatctgtccaagtagaaatcataaatccaataaacccaggataatagttttgaaggaagagagatgtaggtttagaaattgtcaacagccttatgtcactgaagagaagaataagaaagctgctgtctcaaccactgaatttaaactaagctgctttagacaaagaaactaattttaagtgagaatgaggaaggacaatgagcagaagttagaattagcagaaggattggagatagggtttgactttgtgtatatctgaatctttcactaataggcaaaatttataaatcattaatatctctgatatgagccatattttgttccttgaagcaattttctttttttaaccctataatgtcataaatttattttttttccttccaacttttcttttaggttcaggtggtacatgtgcaggtttgttgtgtgggtaaattgtgtgttgctggattttggtgtaaaaatgatttgtcacccaggtagtgagcttattaccctataggtagtttttcaatcctcaccctccaccctcaactaggccccagtgtctattgtccctctctttgtgtccatgtgtactcaatgtttagctcccagttataagaacatgtataatatttggtttactgttgctgtgttaatttgcttaggataatggcctccagctgcatccatgttgctacaaggatttgatttcaatctttttatggctgtgtggcgtttcatggtgtatatgtaccacattttctttatctagtccaccattgatggacatctagattgattccacgtctttgctattgtaaatggtattgcagttaacatatgagtgcgtgtgtgtttgcacacacattggtctgtcgtccacaatgatggactacataccgtcgtttgattgaacaatgttttttttcttttggatacacatacagtaatgagattgctgggctgaatgatagctctgagtttttttgagaaatcaccaaactgctttccacagtggctgaacttatttacattcctatcagtagtgtttaagcattcccttttctccacatcctcaacaatatctgttatttttttactttttggtaatagtcattctgatgggtgtgagatgttatttcattgtggtttggattttgcatttctctaatggttagtgatgttgagcattttttcatatgcttgttggccatatgtatgtctttttttgagaagtgtctgttcatatcctttgcccatttttcactgaggttgtttgatttttgcttgttgatttgtttaaattccttatagattctagatattagacctttgtcagatggatagtttgcaaatattttctgccattctgtagggtgtctgtttactctgtttatagaccttcaagtaattttccaaacatgcttcacaaaccttgaagtacgtgcaaatattttagatggacaaacagactatattaaaacattttccaagagattccttatctcattttgttgaatgtgagaaagcaagacgaagaggatttgtaacttgtgatacaaaatagggcacaatcaaatctaatctcacctgagatcttcacctcacctttgtcagcaaatagattctttcttttgcaccctgcactataagtattctgcatctattagttttcttatcagcatgaataaataattttacaacatagttcttgaattaacaaactattttgctccaaatacctatttcataatttctctttagttaaagtttgattctgttctttgtgacattcatagttctgaatttatatttttacttcttaagcaggggatttatattttttgtttcaaactagtggtattctttatctgatcaatttcagactgaaattagattggcgtaagtgaacaattaatttggatgttagtaatgggaaatttgagttctctgcgcagactggcagaacgtctcgttgggacatgatctgagagtaaaattttgcagtatggaaaatgactatgccttctgactatacttgtcagaagaaggtagcctacaactagccgaaaatggtcaaactaagatttatggaccaaacaaattaaaataccagtaaagggcactgaaatccattaagtgacttatccaagctaatgccagacaagacggcaaccaaagactaaaaataattatgtttagtgcaagctcttggcaaataaggagacaatatatctgcagttcaacaaaatcaatggattttgagtacctgcatatgttaggcattgtaattgataataggaatacaaagatgaaaatgtattttcctatttttatttcccatagtcttcattggaagacatttgtatttccaccttaaacttttatttttaagtagtgaaagcagagggactccattatgtagtagaaaacacaatggatgttctagattcaatttgtggagtcaatccgagtcttttttggagaagaacaacagaaatattttacattttttgccaagaagtataaagtgcatatttcaaatggctgttattgcaagaaagagtggattaatcatataagtattcaacaggcacttaaggagaccgattgtgttcagttaaataatttcacttctatagatgccaaatcactggattctataacacatggtaagaccagcatgatttgttaagtgacagagacaacttgaagagtgcaaagaacataccattgtcaaaagacttgaggtttagtatttcttcagtcattactcaatctttaggaacctcaattcatcttcttataacatggatatagtaatctgtatatcttggggctttggtagaaaccaaatgtaattatatacatcaaagaacattgtaatctgtaaaatattattcctgaaaagaatgcgcttaatgaagcatcataattgattacatatgattcttccttatccttaatttaactttcaaaatatcactcaatttgtcgttctcttctcagcccaaggaattaaatggtgaatttcaaataacctctaatggtcatctattttcaaagtagaatttatgattctgtgtgcccaattttgttttcttcccactatacctgggtgcctattgatactaacctagtttaagcacttatcacctcgtatttttaaatcttacaatcatatccttatcacttcaatttatctaaggtctctcttttcaaatcatccagcatgtaatctttaaaatgacttttccgaaacataatttttacaatattacggaaaatatttgttgtttgaagtcatacagacaaagctaagccctatgtcttactagttacaagacctttcttcttattcacttctctgtgaataatagtgtctgtctcctagggttgaattgagaacaaccaagtatatagtttgcacagtatctggattagagaaatgctccaattggacctctaccacctaatcctgactcactttataactgagtagtttatcgtcatccatgggataagtatgaaaatacaaactcctttgtgattccgtatactccaaaatgtttctagtcttctccatcaccgattcttttcctgctgaaaccattcgtttgcttatttatttatttatttatttaatggcgtacaacataatgttttgatatatgtgtttgttgtgaaatgattatatcaagctaattaatcaaatcctctatttcatccaaactgttttaattttctgaaatccctatactattcacttggtctcatggcctctacaatatcttgccctgtaattatgtgaatcctatcaagtattcaagtctgagcatttgctaaccttttttaataaacctgactactttcaactcaaactgctacttctaagtatcaaaaatatttactagatccttatcatttatatttttgtttatttccctctcttctttcctccctccccttcttctgccttcctttctgtccttccatctttcttactttcattacagatttcctttcaaaatgtatatcttatacgcatatctatgctatacgttcctgaagggtaaaaagagtctttacatctttccatgcacctatgacggagagatagggaccaatcaatagttgttaattgtctgtactatgggtttaacaaaaacacattaaaactaatatatgttaaaagttccaggccttaatttaagaaacttatttatattaatgcatgtaatctgcctgacaatcctataaagatgggcagactgaagctcagcgacattaggtaatttgcccgaggtcacacaggtcttaaattttataagcagtatgagaacccaagcacattcctgtcaaagcatatgctcttaactataaaggtacagtgatgcttttgcagttttggaaaaggatccttgtgactctgggtagcgttttcaaaagatggttgcctgtgtgtctatactcaaaatgccaatagtgattattatgaattcatttagcaatgattcatagagaactattctaggcactgggaatgatatgataaacgcagcagaacaggtggttaattttgtgaagctagttggtgagagatggacgctgagcacataaattagaaaatataaagtaatgatcagttctataaataaaataaaccatggatatggattggattaagttgagtttatactttgatttgtgtggtcagtaaagtcctctttgggtaagtgacttcttacctgagaccttatattaggaaaataattctagttagtataagcgcaaggagacttattaaaggcaattagatggcttactagaaaattaaacctggatgcttcttggaaaggatcagagtgccaggagccacacacctttcgtaaatatacccaaccacactaagaaacaacttagcactgatacttgtggttcccaagttacctcagtttcttgagatacttgaaatggagagattattagagtgatttcaattaagatggaaaggggggtaagttgtgttttgcatgtaaagcttactacagaatttctcaactggtggcagaacaggttaatgaaataccatgatactgatcatctcagcctttagggtaggacccagggcagcccaaattctcacgttcattaccttcagccttgagcagccctgtttccttcagtcttccatgccgtggaaaagactggggaccactagcctatagtattggcttaagaatgtgggatagagaagaatcaaagatgaattatgggtttttaacttgattgacttgttggctcatggtgccacttactagtaaggaaataggtagggcagagcaagttatagaggaaggggaataaaagggatttttttgtaaagatgtgaggtttatgaaatttagtctttaatatgtagatgtcaaataggtagatggctacataaaacgagttcaggagggcagttcaatttggagatctacatttcagagttattagcataaagatgtagtgtaggagcatgggactgaatgaaattactaagggagaaaacagaaaacaaagagaaatgattttaagactaaggccttgtgcacataaacattttgaagtagaacagactaatagtgtgctatatagtgtatgtacaatataggaagagaattcttgatgtgatatatattttaaaaactggaaaacatactgattacacaaaactaatgcatttctacatgtgtagttgaaagaaaaaacatagttgggaataatccagtaaattataaggaggactgaacatgttggggaagaaaactttcatactaggacaaacttttttttaagaaaaataactttttaaaaatgaagcctaagagaagatattatcaaagcttataaaatcaaaaattgtatgaatagggtcaacccattctttttttaaattattatactttaagttctagggtacatgtggaaccaacccaaatgttcatcagtgatagactggattaagaaaatgtggcacatatacaccatggaatactatgcagccataaaaaaggatgagttcatgtcctttgtagggacatggatgaagctggaaaccatcattctcagcaaacacattcttatttaccaaagtcaaaatactagaactagtgctttaaagcactccctgaggctttaaagaattactctgaggacaaaatgaaagtaaattctgttttaaccagtgggtagtaaacttaaaaaactctttaccataagcggtagaatgggttgaaaatataaatagtttcaaggtggagttcatggacaatagatacacaataggttgtttaaggaaatggaatattttaatgagtggtacatctccaatcttttaattttgatatcctattttataaccactttctgtaaaaaagattatttcaagccagagttggaatagaagggatataatctgatataatatgaatttttgttctgttagcaaacatttttaaagtgaatgttctgaatagattccaattttcttaaaatagttattatgccttatgaagacctgcaatatccgtgtaagaagagcaatgctttttatatgttgtaataagtaatttattagaacatttattcacaatgatgaatcaccttaattaatatggtgagggcaaaataatttctgctatcaaatatcagtatgtacttgcaaaattcttataaacttcagttcatatgtctgtttttctttaaaatatccctaattactgacctaattttattcattttgccatttaatttatttataacgccattcttttcttctaatgcgttctcctgtttgaataatcatgttctctttattctctttttcgtctttctactggttggggaattatatattctatatacattttctgagcccttatccttaaatttatatcattcataattaatgacattctagtctaaacatcgcaagagcagtagaatgtttaaattctgatttccctcctaccatatttcatgttattgttgcctgatattttgctcctatacattgttacccctcccattagtcattttttatggtagtaaaatatttataatactattttcttcttatgagttctgattcttctttctggttcaaatttcctccttccccatgtacacatgttaacaagtacctttgtaaatctatatttcattcttacccttgaataacagttcagcaggggccgggcgcagtggctcttgcctgtaatcccaacactttaggaggctgaggcgggcggatcacttcacttgaggccaggagttcaagaccatactggccaacatggtaaaatcccgtctctactgaaaacacaaaaattagccgtgggtggtggcgcacacctgtaatcccagcgactcgggaggctgaggcatgagaattgcttgaacctgagagacagaggttgcagtgagctgagatttcactactgcatcccggcctgggcgacagagtgagactccgtctcgaaacaaaattaaaagttcagcaaggcattgtattctatatataatattctttgtgtaattatcttttgaggataatgcatcttttctttttgctgctcttaagattttgtctttcatgttctgtatttccataactatgtgttctgagtatttatacattggaacttggtatgcatcttcaagtgaggactcttgtgtttctatgattctggaacattgtctaccattatcatttcaaatattgtttcccagattctctctagtcactttttctctgattccactgtatgtgcattgaatattctcctttcatactaccacgtattttaatttctctttacatatcttctaattcactaattctctagttcaatctaatctatggttcatcacatattttgagagctttgctaaattccttaatttgtttttggaatttatgtttggttattttcaaatatatgtgttttatatgtcctctttttgttttctattttctatttttatttctctggccatttgaatcatatacacatcatgaataaaaagaaaaacaaattgttctattagtaatagttttattttgctgtccgtaaaatcaaaatacgatgagaagccatatgacagtaagatggaaaaaacatagggaagaatgagaaaatttaaaaaatagagtaagtggatggatttgaagtagcaccttatttctctttcttgcatttgggtttgcccatttttaaaaacaatccccatcccttttaccacagtatttccatgtgtttggaaaaaaagaggaaaggtttttgtgggtatatggtgaaggagtactcctacaatttcttaggactgtatgttcaacaaaatttgtttttaaatttgatggaacaaaccttttcacaaaataatattaatataaatataaaatgactgattcatgaattaccaacaaacaacttgaatttacaaaataaaccttcaaatgtatttttcccttgaatagtattttatttatatttttaattgacatgttataattgtacatatttatgaagtatcttttgatatttgaatacatgtatacattgtgtaatgttcaaatcaatgtacttagcatatccataacctcggggatttatcatttctttgtagcaagaacattacaaaccttcttctagctattttgtaatatacagtaccttactcttaaccatattcaccctactgtgcaatatgataccatattcctcttaccaaatagtaactttgcactcattgaccaacttctctccttcctcccctccctgctctctgttaatcactgttctatatctcaatgagatcaacttttaaaaaacccacatgaatgagatcatgcagtatttttcagtgtgcctggcatactcagcattatgtccttcaggtttgtccactttgtctcaaatgacaggatatcatcccttgttatggttaaatagtattcgattctgtagatataccacattttctttatccattcatctgttgttaggcattttggttgattcccagtcttggctgttgtggatagtgctacagtaaacaggagtgcagatatctctttgacgtactcatttcagttcctttggatgtatatacccaatagtgggatgactggatcctatggtagttttatttttaattttttcatgaaccttcatactgtttttcataatgggtgtaccaatttacagtcccactaacattttgtaaaagctcccttttctccaaatgctcaccaacacttcttttcttttgtctttttgataatagccattctaataggagtgagatggtatgtcgttgaggttgatttgcatttctctaatgattagtgatgttgagcatttttttcatacacttgttggccatttgtatgtcttcttttgaaaaatgtctattaaggtattttgcccattttaaaatcaggttatttggtttttgctgttaagttcttatatattctggatattaactccttgccagatatatagtttgcaaatatttcctcccattttgtaggttgtctcttcactcttgtttctttgggtttgcaaaatcttttttgtttgatgtaattccatttgtctatttttgcttttgctgcctatatttttaagttcttatctaaaaaaaaatttgctcagcccaatgttgtgaatcatttcccctatgttttcttctagtagtttcatggtttgggattttacatttaagtcattcatccaaaaaaaagaaagaaaaaaaaagaaaaaaaaagaaaattaatcactttctacatttttttttttttgagatggagtcttactctgttacccaggctggagtgcagtgacacgatctctgcttactgcaacctccgtctcccaggttcaagcaattctcctgcctcagcctccctagtagctgggattacaggcatgtgtcaccacccctggctaatttttgtatttttattagagagggggtttcactgtgttggccaggctggtctcaaactcaacctcaagtgatccatctgcctcagcctcccgaagtgctggaattacagatctacattgtatcttgatggcagtataactattattttttaaatttttggatttttaggcatcttatgtattatacaatgcctttacttaaaagtggaaaaataaggtgaacatattttgtgacttgtcccaggtaccattgtttataaatagcactaaaactaaaatgactgaattagtcactccttgtttttgtcattgctctaagtatgtgttttcttccatttatagtatgagataactcagccattttcattaaatgtcagaaaaaattttatatagatctttacacagcatgctaattttaatagttatatttatatcatatttggagtattagctttcatcatagtcctttgttatgttactcatatttttcttgatactgaatgatggaatgagtcatttctatacacttagtattaacctttcagtagttaaagaagtggcatttatttttaggacccacacaactgtttctgaacttgtaaggaaaagccatacattttttctttagttcaaataactttacatcctaatatgtatatttggttgataagtatattgattaggacaaatcagtttggaaatagttatatatgtaagaggatacttatcaggaagtgagccaaaaatgtttgtcagtagtactggttaaatattgaaattatatttcttaatttgtcagtctgtaagtgtgagcacaatgtcttagcacttgggataatttagaagcaactctggctctagattacctagcggatttctcaacgctggctgtagactttaattcaaccgtgattctgtattacgttatataataggacactatttccacaggcctatgaattttttataaatttggaatcttcactttttcattgtttttattttacctacttaatcttttttgtagtatgttttattctcccagagatcttttgactcttaaatatttatagagcttttgcactacctcagaatatcattagcaatatgatagctgttacttctgaatacttttctttttaactttcttttaataatcttccataaaagtcttctttgcatgtatgtttaatctattaattaacttctagagtctgctacttaaataggtgctatctttcttctgtccaaacttgtatagtaattaaaaccagcagtgtgtagtagaagacattttgcataccatcaatttccgaaaaatttccaaatattatggtttctagtcatatgtctacaagtttatgttttgtaattaaattcttcccttaaaatgtttatgtaaaaaaagttggtctttccttttttagtcataaatatttgatttccagtttttcataagtaatatatacatttatttctacttcagcagatactccattataatcaatgttgctacagcagtagataaaatacaagctccatgagagcagagatcatgtcagtcttcggtagttgctgcaaaaccagttttgagtaactatctttgacaaataaatgaaagaataagtttgatttcaatgtacatcttcaaaataatatctaaatgaaattcatctgtgcaggcctaaccctgtttgagtccagctgcaaatgtacaagtggtttttttttggtatagtagagtggaaagggtgaaagctttcaagctaggcaagtcttgtttcaaatcctagtgttgctgtgtaatcgctgtgtgaccttaggtatatcccttaacttctctaagccaaagtttcttaatagaaaacttgtgatggttttaacaattatgaaaaattgcattgctgaaagaagatgctcagtatatatcattgtattttacactgtgagataatgggatccacataaactggcatgcacatttttaaaataacttttatttttaaaaaatgggctttagaaattgttcaattacctaatgttctaatgcatttttaacattctctccattttcttttatttctgctatttttatttccatattccagtttatttgcgcaacttatgtctgaagcataagcaaagattcttccccagcttctcctcttattttacatcttcagttctacaataatactgtattagtcagggattggtcacaaaaagacgagctgctctatagatttcaagcagtgaagagatttaatacaaagaattaagtgctttactgaacccctggaaaggctgggagaataggattcaggtgacgatgccactagctctccacttagctacaatgttcagaaaatgagcaaattgtgcagaccacaggaaaccactagcagttttcactactgcttgtgttatcaaagcaggtgatgtttaggaagtacccagtggccactgtaaaattctcatgtctgcagaaatccaaacctctgcttctcacccccaggggaagccctaataaattttcagcctctccttagcttgcaaatctggtacaaggtttgggaaaaggtgattgatgcccaggcttccagcccctatgataacagaggagagcatggcaggtggaatgatactgagatgccaacagagaagctggtacagcttcacctgtatatgactgttcattttcattccaatttcaggcatactctctattttcagttctgatccctatgcctcctattattgcaataattattacttaataaataaatggctccaattgcagaaagaggtttacttatgtttagcatacatactactctctcttaggcatctttatatttcatttatctcagaaacttatcctttttacaaacaagtctgtagactataggtaggcaaactatgacgcagaaacgaagtccccgaggctgcctatttgtgcagataaagcttacctggaaagcagcaacacccatttgtttccacattgttagtggctgctttcacaccaccacagcagcatggaatatttgcaacagaggccatatggcacacaaagcctaaagtatttaccatctggccctttatagaaaaaagttgctgacccctactatggatattatgtaaagaaaggaactactacaggtagatttttctcacgtgcttgcctattgaatttctttcataattgatttaatgaatataggctttttatcttatgggaaaatatcatcatactgcacgtacttgtgtgggactctgtcagtgatcttaaaaataaaaatgtcatgcacccaagagaaaagtattcattcaaccaagccaatgaataggttccgaatcttcctcctgcactaggcattgtgatttcacctacatttccaaacatctgatttttaataatgcatcgtataatcttgattctcacatgcttcacaggacagccgaattctttttcaaaacttatagtcactgttgagtcataccaatgatctttgctttctagtagcttccatatcttaataacatttttaaaatatgatacaatagtaggtctattttactcccagtaattaggccttgaatcttattagcaacttgatcatgctggtcactattgagccatgaaggcaatttatgaaataaaaggcttttcattctttgccaaccaatgattcacccacatcttttcccctatcctcctgtatcttttgtatttttttctgctgtgaagtcatttttttaagacgggaaggctggcagggagggaaggaaggagggagggagagagagagagagagagagacagagaaagagagaacgagaacacaccctaaaaggttttcttattaactattctcaagtattatttcttatcagctatcatcagctatttcttcttcagcatcatcttcaggtatttttttttaatcttgtaaaacagaacacttttttctcacacattgtaacttctcccgaggtagtcctttattcttgtatgacctcctcctttgctcatcaccttgggtcttattctgcatacttctctcacttgctctttgatttctactcttcttgctccaattcttacaatttcttaacctctattttaaaaaatcttttctcttcatcattaaatgcttttacagatggaaacattcattttgttctttaaggcatttcaatatttttcttcccttgagtacatttcttatgccattttaacttgctcctttaccatctgaaatcttgaaaggggaatagttcattcttcctcttgaatatatattttcattgaattttcttcctgttaaacaagaatttatgcctgtcaatgcttttgataaaaataccaatttttttgagaaattaatttaactgtaaccaagatgtgggctttcagtttgtattctaccatgtctatgttcacctgcacataaatctattaattctggggaccattcccatccatctctgtttttattataattctgatagcaagcatctaaatatacaatctcaaattctatattcttaccagtgtatgtaagtgtatgtattgtgtgcatgtattgtgtaagtgtatgtattgtgaccacggataacttccagttacttccaacattttcatctttttctggaacaacgttggaaatccctttcaagacagaaaattccttcgtgaatgaagcacggatataaaatgcttcccctctttgtttctttggatgtagggtagctacatatataaatgtgataggccctaattcctaatttatttctttgattacatattttccagtgcaaagcatagattattaaatatctgcacaaataaaaattcatgttcacatttttttgttttgtttttttttgagatagagtttcactcttgtcgcccaggctggagtgcaacggcacgatcttggctcaccgcaacctctgcctcccgggttcaagcgattctcctgcctcagcctcccaagtagctgggattacaggtgcctgccaccacgcccagctaacttttttgtatttttagtagagatggggtttcaccatgttggtcaggctggtctcaaactcctgacctcaggtaatccacccgccttggcctcccaaagtgctgggattataggcatgagccaccacacttggcctcatgttcacatttttatcccatttatccatgtgaaattagctctaaatgtgataaccactagccacatgtggctgtgtaactttgaattaattaaaattaagtaaaatttaagatttagtttttcaactgcactagttacattccaagtgttcaatggtagcatgaggctaggagcttccaccttggatagtgcagatagagatcattttcattattgcagaactctctactggacactaaatattagaaaacatacatagttccttcatttgtaacacatctctccctatcacattaagctctcttctttgtatgaagagtgtgtaaatttgattcatttcatgtcggaatccatgggttgtacttctaaactttagtggtaatttacactttgtattatgtactcctatttctgatttcattttttcccattgtttgtcatttaattcagccaaattttcttttcttgcattctcctattctatgtattccttagatcagtggttctcaaattttaatgagcatcaaaattacttggagggtttgctgaacacatattgaagggcttaccctgagaatttctgattcagagagtctaggatttggccgagtaatttgcacttctgttattgctactcgttctgggggctcctaccctaagaaccactgcctagggaaggcttctacctctctttgcccacttttctatgcacagagctattttttatacaccctgcttcagtattttctatacagcttatttatttcttcctctatttatttaatcattatgtatttcccccataacttgaaatccatctctcttaactctacctgtctccccataccctttctgtctgtgttctctcttttcccttgcttctccaggagactttcaagatttcatttttacagacgtttcttgttctgtttccttttgctcttgcatgctggctcttgaagatggcccaactatgccttccttcctttcactataatgtgtccttggcatttaatttttattttactagtggctctcttctcagtaggcactgtggtatcactgcactccagactgaaaccacatttcctaactgtgtcctatacttaagtgacctgggaagtgacagttatatcatgtctttagctgtcttctgtgtagaagcaataatatttctctgtaacttactgagaatctctcagcaggtggtcagcacgctcaccattttgtcacctctcttgttaaaaattgctttttgcagctcaattctccaaatgtcccaacctctactggactggctcatacttaatcactttttcaaaacggtgtcacagtatgtttattttgtttctaaagctttgactcttttccttcttgtacagtctcaaaataagtttccatttttctgtttaattggaacttacatcaaacttcttacttcccagcatttgaactgctgcatgatgtgtaccctggatccattccaaattgaattaataagcagacctcaattttatctcttgctagactgtaactctcatcccctgttaagcaactcttcagtaacagcctagtattgttaaagggggggcctcttgagttagaacaacccttttcacattccacctctgcttctcatttttctcacctacacaatgggctaatattagcatctatcttatagaatcattgagaagaacaaatgaaagaaggtactttgcacaatgcctggattatggtaaatcttaaatcttggcctttactaatgttgctatattaatcacagtttcccatgaaggaagttatttctttctttatccttcaatttctttaccttgcagtagatgcaaaaaatttgcaataaatattttccagatctttattctacttctctactagcttttgccttttcctctaagttgcctatcccaactttgaaagtctttacctctgtttctcatttgcagttgaacactgacacaaaacaagagaaaacaacaagcgaataagaacacaaacacaacatcatctcagcactttctctcactgtgccaaatgttcttaaaggtttgttagttttttatcaaatcacagcttgatttatttccagcctgtgctccacaccagttgactactgttatctttgtagtaaccaagcaaaacaagtagggcaggaactactgtgcctcttgtgcagacttggaaagtgaggccacaatgacagatgtgacttagcaaggatggtgcagccatgtagtgtaaacagggctgctgttctaggctgtgaaggtggtgcaccgcagcaggacaccacagttaaagggatacctccaccttgaagacatcactgatttgttttttatagtaaggcagtttccagcactgtcatggagagaggctcctatttccaatttgcccaaaggtgctatgtgggctctcattagccaagaaaactcaactcaacacatgtgctctgctttatagcttatttactctttagtcgacgttccatacaacatagattactatgtttccttttctaattcattttatcctgttattttctttatcactctccccctctaccctgcaacaacccatttacttttcactttactatataggaaaagtaagcattaaaattcagttggacgataaggtgaaagcatgtaaagctgttgaaaagccaggtgaccattattacatgtgactacattctagactaagtgggatgactaatatattttaaatgggaagaaataatttagatagctttatttgctaatgtgagataaatagattaaagttgaaagccactcaggctattgcaaatattatagcaggagaccataagaccctgagtaggcataccacaaagtaataatgtagatgattggctttggataagaggcccagtgaggaagctaattgcagaagcttgtagttgattagttataagatgacaaggggaataaaagcaagagtttctgagtctagataaccaggatgatgatggtgccatagagagaaatggaaaaatacagagaaagaacagatttcagaggaagaaaatattttatttgaagagaggagtggtgttctggtaaaaatgtcctctaggtgatagaaaaatgtgacaggaaattagaggtaaattagaggtggagaaaaacattacatgtagttgaatagagctacttttgaaagatatcaaaggtattcagttctcaatggccaaaagagggaagctgccattgttaaggttccacagcgtaggggatctcctgcaggtaagaaatagaagaaggatgaagagcaagcacatgatttagagacagaggttctcaagaaaaaaagggatgctcagcattgtagaatgcttcttataaattaaaatgaagactggtaaaacctattctttttttctggtgatttgttacaatttaaaaaaattgtatcttccttttactatcagtgaaaattcccatgatagcttcccattttggaggcacccaccaaaaatgtccttttatatatctccttcagtcttagatttccaaattccctttttctgtaacctgacctctttctatgaaatacaaaagtttgatttaaaagatgcctttcacactccataaaatagtatacattgtcctggctgggtgcagcggctcacgcctgtaatcccagcactttgggaggccgaggagggcagatcacctaaggtcaggcgttcaagaccagcctggccaatatggcaaaaccctatttctactaaaaataccaaaaattagctgggtgtggtggtgggcacctgtaatcccagctactcaggaagctgaggcaggagaatcgcttgatcccgggaggcggaagttgcagtgaggtgagatcacgccattgcactccagcctgggcagcaagagtgaaactccatctcaaaaaaaaaaaataataataatatacgttgtccttatccaataacgtggagttttttggtttttaaagcaacacagagattcattagcacctcattagttcttgaagggaaggagctctgaatgcaatactatctgtcttccattaaaaatggaagacatcattcccataagttgggaaaatttgagatttaataagaataacaactacagtgaattgagacacatcaaatatttaaaaactgatgattttataaacatactaatcaaggaaacattgttagtttacagcattgcagcatactaggatcccgactcattattctgcaaagagacaaataaagggaaggaagcatacatttggcctgccttttttcgtaccaactgtacgtattttaggataatcacattggaaatacataaatattatttttgaagtatagtttcagctaataaatgcaggaaagaatatcacccttttgcagcccataataaaatggtacgaaatgatcaccaagcctttggctcaaaggttggtggagatgcttgagtatggaaggattagggtgaaacctcctgaaccactgctaaatcttggtgtcactaaagtgtaacaaccagaaatcaggaattacgtgagttcttgtacctaggaagtatttttgcctaattttaaaaaaagacaaatatcctctaaatcatgcatgcctgttttcattagctactttacctgactttttcatgaggaattaaaaaagttattcttctgtacttttaggactcaaattgataaaagaaaaaagtttttaattttttaaatacttcgttccctttgtcgacatgtagaatgtgagatatgagatcacactgaggaaaagagaagccagcttcatgtggctttctgaaaatatgatattattatgtgaataataattattatttagtgaaaaggtaaacaaaaatgctttgtttatatgctattagtgcaaccaaatatttgtgtcagaaatgattaataattggaaactgacagaataactggcatatgaactcttaggtctattatctagccctaactctccttgatttttattgaataatacaacaatgcttaaataatcacaaaaatgaataggaaacaggggtcattgacaatttgtaggtcaaccaaacaaatgtcttagctgtagaacattttacaatccaatagagaacaaactttatcttagattagtgaatgccaaagtgactattctttcatcagggccaaggtggcactaacactttattagcccatatggatgggtctcaaaagcagtaatatagaaactttgcagcttagctgtataagaataatgcttataaataaaataccataacgtgtaaaagtaaaaatgtctctcttctttttaaatatacttcagtctattcaagacaaagaagtagccaagaaacataagaaaaaaatgctcaacatcactgatcatcagagaaatgtaaatcaaaaccaccataagacaccacctcacattatccagaatagctattattaaaaagtcaaaaaagattggctgggcgcggtggctcatgcctgtaatcccagcactttgggaggccgaggtgggtggatcatgaggtcaggagttcaagaccagcctgaccaatatggtgaaaccccatctctactaaaaatacaaacattagccgggcatggtggcgtgcggttatagtcccagctacttaggaggctgaggtgggagaattgcttgaacctgggggggcagaggttgtagtgagctgagatcccaccactgcactccagcctgggcaacagagcgagactccttctcaaaaaaaaaaaaaagtcaaaaaagaacagatgctggtgaggctgtggggaaaagagaacacttacacactgttggtgggagtgtaaattatttcaggcattgtgggagcagcttggagatttctccaagaatttaaaacagaactatcattcaacccagaaatcccactactgggtatataccgagaggaaaataaatcattctaccaaaaatacacatgctctcatatgttcatcacagcactgttcactgttgatatgcccattaatggtggatttgacaaagaaattgtggtacatatacactgtggaatactatggagccataaaaaagaatgaaatcatttctttacagcagcttgggtgcagctagaggccatcatcctaagtgaattcacacaggaacagaaaaccaaatgccacatatactaacttataaggggaagcaaaacgttgtgtatttataaacataaagatgggaacagtaggcactggggattactagaggaataagggaaagagcggggcaagagctggaaaactacctgttgggtaccatccccactacctgggagatgagatcatttgtactagaaaccccagagtcatgcaatgtgctcatgtaacaaacttgcacatgtacccccgaatctaaaattcatacaaataaataagtaaacttcgatatattcagaagaaacacagatacctgcttataatttaaaatagaaattttgagaaaagaaaaaacggagatagttttatcagttcttaacagtgtagtcataagagtcagtcatacctgggtttgaatcctggctctccggcttactaacaagttaccttacatctctaaacctgtttcgctatctataatatgagtctaataatagcaccaacccttagacaggtgtcagaatagatgagaaaatttatgtaaacagcttagcatagcgcctaacagattgtgatacttaataaatagtaactatcatgattagtatctgtcatcataatgaattccagatgaattaaaaatttagatctgaaatgttaaaatataccaaaatccagaaggaaatatatgattttcaattgctgatctataaatagaagagaacattataaatgatgaaagacattataaaaaaagaacataaaacaatgactaactggaaatataattgccatgaaaagtaacacatttaatatccttagtgtataataaaattttacaattaagtaggaaaatgtaaatcaaaataggaataaaagggcatgaatttaaaaattttatgacacgcatacatccacaaaggaaaagacaaaagaaatgcaaaaggctgcatggcgttcagaaaaggattagtataaagaagaaaaaagaagtaacgttatctgcaatcttacctcttattaataatcactgtttaaacttggtagagtctctttcagacatatccacatgcatgtgtaaatacatacatacacgggcacacacacactttgcatcctatctgcattttgcttcatgtttttccattattccatggtaattttttcatgcctaagaacagtctttaaagtgttttatttggctctgtagagtattagtatgtcaatcaggtctctagttgaaggttcctgaaactcaacttgaactagattgtatatatataaaatctaatacgcacgcgcgcgcacacacacacacacacacacacacacacacacacacagagagagagagagagagagagagagagaagcttgtttcacgtaaccaaagcagaggaaagacttgatggaattacagaaatgaggtatttttacaccattaataatcactttgatttggcttagctttttatgccagctttacatttttaggcaagttttctctggtatgtcagggaacattgacacaaataactccaagctagtatctccatgtctccaaattcagagaaaagatgaacaggtctgcccttctaactctaattaggggaactccagggaagacctctgttggatatttgggtcatctgcttattcctggagcagttatgtggccaggggcataggataagtagcctagactcttatcaatccagagatgagttaggagaggctgttatgagaagaggatggacaggtgctgagcagccgaaaacaatgattgccacgatatgaatgtcccacaatttattcagtgttttgtacgttaatggatacttaagtttctctaccatttgatcttataattaatgttatgataattgtcgtcatgcatgcggctttgttgaaatttttattggttttctcttgtaggataatttactagaattgaaattattttatgcaatcccatgtagctatgaatacatagagtcacatctttcatgtacttaacctgtataaattcaattatgttgaatcagaaatacagggtagagaaattaagaaaacagtagtggagatagagtgagtgagaggaccagtgagaagaataaaaactagttgaatagctcagccgtacttacctcagaatcaatgaccttatgcttagagggagcagcatgaactaggagtctctagtcctatgttatgtcagtttttctcaatgttggcctgcttcttgtagagtgagattgtgcctagctgagtttcattctagtggtaagagttagattttctttttttgtatgccatggactccaaacacatggcaacccttaatctagtattcctccaaagaaaacagcaatctgttcaacaccagaggaaaatctgacgggcttgtacttaccaagtcattatattatattttgtgtgtatgtgtgtgtgtatgatttagtgatatctcaaggataattttgagtatgccctattttcatatttcataccaattctaaagcctaccccacaggaacttgaaactctgctcaattgctaaattaccattaccaaataatttatgtcaatttaaactcctaccataggatatgtacaggcacatttcacctcatccttgcctgttctgggttaaagcactttagagttaatgggaagaaagaaaaataattatttaatataaataacaaatacagaggtggtcagccacatttcattttaatgaaatggggccacgagaattccagtaaatcacaattctacttctataaataaatggaaaagaaaatagctaatcttgtcgcacctggaagcctcaaacctaagataacaacaaagctgattatttttatagtgatcagatcttaagaaatacaccagcatcttatgatgctatgctagaattattttaaaaaacatacagccggatgcagtggctcacgcctgtaatcctggcactttgggaggctgaggtgggcagatcacctgaggtcaggagtttgagaccagcctggccaatatggtgaaacacgtaaaaatacagcaagggatttattctacaacattaagattttcaatttaacagacatattctatgtgtacatatttgcatgatactagcactgagcaatactcttctgttaattcaagttactctgaatttaaatccccagacttccagaatattaagtctgcttatgatcagtgatcatttattaacttttttgcattgtattttagataatttcacagttgtaaagaatttcataggttattgcataaaattcatgcttttgaatataaacacacatgcacgcaaacacacacacacacacacatatcccccatgctcacgtatgtttattgagacacttttcacaatagcaaagactcggaaccaacccaaatgtccatcaatgatagactggattaagaaaatgtggcacatatacagcatggaatactatgcagccataaaaaaggatgagttcatgtcctttgtagggacatggatgaagttggaaaccatcattctcagcaaactatcacaaggacaaaaaaccgaacaccacatgttctcactcataggtgggaattgaacaatgacaacacttggacacaggaaggggaacatcacacactggggcctgttgtggggtgggggtggggggtagggaaagcattaggagatatacctaatgtaaatgatgagttaatgggtgcagcacaccaacatggcacatgtatacatatgtaagaaacctgcacgttgtgcacatgtaccttggaacttaaagtataaaaaaaaaattcttaggttgtgtgccttgcaaaaaagtcagtgggctagatttggctcatgggctattgtttgcttacccctgccctaagtcatagtttccaatgattttaaaattataaaaattataatcatataaattatgttggattgatcatatactgataatttaatgatctttatgaaaaaatttaaggtaatttgatacaattctttaagttacagaagaaaatgatatcatgagcgaaatgaaaaaaatgggataaaatagctaatggtgacaatacttttttggtatactatctggtatttatctttatttaatctttggataatatgtacattcctaagatgaaaatgagaatgtaatttgaccatttgaaaatatatattcttacactgacttaaaaagataaagtattgataatttcacatcatctctgtctttgcattaaaaagtatcatggaacaatagccacactttttggaaattcaagattccataaaatatagtttgaaaaacacatggacgtgtttattaatttctcctttcaatattctttctgggcatactggaggaaaattgacatgaagaatctttaaatttgttatgaaaagtagaaggtggcatgtaggcaaaactttcccctctgagagtgtttctgcattatttctttgcatgggaagatctcaccaccaaagtgtagcatgtctgtacccaataggaaaatgcataccctgatattcattttaatgaaaaatttcaatgacgtataatcctttgtcattctttcccaaattgaccctctgatggggtaagaaaaaaatgaattctacctttttcatagatagtaaccatagaaagctctggtttctagagagattcaatcctttaaaaaggaacataaagagaaaagggatttggagagaaattaattctaagactctagacctgcatgtctgtgtaacccaaattctagcaatatctagaaaatagaaatcaaatcaactaggaactggtaatacaattgctaagacttcctttatcttaggtccagcagattcaaatgacacactctttaaaaaaaaaaattattatttttagtttttgtgggtacctggcaggtgtatatattttggggatatatgagatgttctgatacagacatgcaatgtgaaataatcaaatcatggagaatagggtatccgtcccctcaagcatttattttttgtgttaaaaataatccaattacactcttttagttgttttaaaatgtacaattaagttattattgagtatagccaccctgttgtgctatcacatagtggtcttattcattctttctatttttttgtacccattaaccatcctcctctcctcccgcatcccccattacccttcccagcctctggtaaccatccttctactctccatgtccatgagttcaattgttttgatttctagatcccacaaataagtgagaacattcaatgtttgtctttctgtgcctggcttatttcactcaacataatgaccttcagttccatccatgttgttgcaaatgacaagatctctttttttttatggctgaatagtagttcattgtgtatatataccacattttctttatccattcatctgttgatggacgcttcagttgctttcaaatcttagctattgtgaccagtactgcaacaaacataggaatgtagatatccctttgatatactgatttcctttcttttgggtatatacccagcagtgggattgctggatcatatggtatctctatttttagtttttttaggaacctccaaactattctccttagtggttgtactaatttacatttccaacagtgtataaagggtccccttttctccacatccttgccagcatttgttattacctatcttttggatataagccattttaactgaggttagatgatacctcattgtagttttgatttcaggtgacacatgcttgactttagtatgaaagtgtcattgacattggctgtctagtcagtgtctaatagccttttctctatctttgtcataaaatctatcatcatctgtggtctactttgactcttttttttaatgacccctgagatagttgatatggaaaatacataaatagttgaataattgtatgaacttttcagtgtcttctcaggtgacctaccagaggagaagtagggtatagaatgacaactttttaattagggattttttttcccttaagaaacagctatggaataatggaaggaacctaggttttagattttacatatacacacacaaacatacacacatgtgtgtgtatgtgcatgtgcgtgtgtgtctgtgtatttatatatatatttgaaatccatttattccacctctcaatcttatctgagcctgggggatgtgtgtgtgtgtgtgtgtgtgtgtgtgtgcatgcacatgtgtgttcatattcaaaagctaagcatgaattttatgcaataacctgtgaaattctttacaactctgaaattatctaaaatacaatgcaaaaaagttaagtgatcactgatcataagcagactgttgctattctggaagtctggggatttaaattcagagtaaccttgaattaacagaagagtattactcagtgctagtatcatgcaaatatgtacacatagaatatgtctgttaaattgaaaatcttaatgttgtggaataaatcccttgctgtatttttacgtgttgtatttataaagatataatgggctctaatttttagagagtcctgagaagtccatgaatattaaacacatcgtgtggatttttatttatcatcatctctgattttatgttcgtgaaattataactcagtttcgttggagttctaactacaggcctagttcaacaaaattctgatttccatcatcttgactacattgattttgtgcactttgatctttactttgtattatataaaagtcaatatgttgatctataaacacatctgctgcttggatagtagttattttagaattggctctctttccaagcacagttatgacactgagaattggtactgtatgctccagtcagcacttcccagtcacaaaccttatgaagaatttaaagaactatgtggaggaaatactctttgttctaattcaacattagtgtatagattgtgtttgtgaaaaactgtatgagaaactggtctttttaaaaatgtttttccttcagttctggagtgtcaatatcaattttattctgtgattagaaatcgcatgactacagcctgtgtgtcaaatcattaattcattgaaattcctaatcaatgtaatattgcttttaggataaagttttagtaacttactgagtgggctctctctgtctctctctctctctgtttctctctctctctctctctctctctgtctctctctctctctctctctctctctatatatatatatatatatatatacacacactatatatatacagacattatatatataatgtgtgtgtgtatatatatatatatatatatatatatggcagtctaactataagagctatactttttagtgtaaaaaggttgtatattcgtgcattggatggatacctaaagctgagaggttagccctacaaagtattaaaaaacaactcaagaagtaagaaatcaagaaatgatcaagagttccatagctagttaaaacaaatcagcagtctcaaatgagttcgagtgtgaagtgaaataccacaaagatgaattattttagacctgatgtgaaaagaaatgatggtgtaagaatatgagttacagcttacacctatatgtgtgtgtgtttgtgtgtatgtgtgtgtgtgtgtatgagtatatatatatgagattatatgggaaaaagctaaagagtatatatggaaaaagtactttccagctatacatgggaaaaacaatacatgggaaaaagttataaggagttttagtttagcataagtgttctagttatctattgatatataacatagaacataaaatgtcacttttgttacattttactgaaaaggtaagacaaaagggcagccagtgttcaagaggaagggaggaatagaccccaactctcaatgaaggaatgacatgcacatatggaagggattgaattgttgaaccatattggagacagctatctaagaagtaaatattatttaatgatacttttgtatattggatatcactatcatgacaaggacatattgaaaatagtttacctgggtaattttactctcatctacttaattaaagtaatacatatagattttgtccattcatttgatgacagagagtatgacacagtgagtatgtccttttgggtttcaaattgatgaagcaggcagacctgttatcattctggggacgcttcccagtttggaggttctgagtgcaagagggcattaggaagacagagttccctactgctgctgcatctgctcattgcagtatgggattgggtctaaaattctatgactttgaggaatattaccagattatataattttaaacattccaagaaggaattgtagtgatcttcttgtccaattgttttatcaaaaagatacgaatactaaagcccagagaagttgacctcacaaagatcttaatgtatgagctatatagactctgaatctaagtcttttaactgctgagttactactcttattattccatatattgacactgctttccaaaagtctgtggtgtaattatcaatctggcaatccatgtaggaggactgttttcaccaaacggtgaataaaactttgttatttcattatattttcatgttttgggatctctaacagagtgaaaatgtttagtcaacttgaaagaagtatggtagtgagtaatttaagtgcatatggtgagctggggaggatctagttttgatgggccctgaagcttttacaagtttggctctactctgtaagaagaaaggatgtaaaattacaactgcaaaataagtacatggctttaaaagaggcctgtgtagtttaagaaccctcaagctcaagcttcatcagtctctgtggttgagttgattagtttaattgaaatactagagtttgggaaggacttaagaacaaggtgttatttcttcaaatcgttgtcgcctttgaaaagggtaaccttttttctggacttaaagtgctatccttccaacgtgtataatagtttttaaatgcaatcttgctgacatgtgtcaacatatgcaaagaaattgagaatactttctagctcttagtggtatgatactgccttgcataatgatttagacatgcagctctgccttttgtatatctccagccaccaacatttaggtaggaagcaagtactattgatctttgaaaactaaagaattgtgaatgatgcatttgattggtatgttaaagctatcctttgtatgcatatttttgtaagtcgttgaaatacagattatttgacctcaatttctccatctacaatatgaggatcaatgaggatattatatcatgtctgttgaaaatggttggatataagtggaggccagtggaagtattcagtgaaatgatgcatttccaaaatattgttttccagccaatgtccagtgttagtattccacacatggaatgcatgataggtatagagaaaataagggtagtattttacatcacagagtattttgagataggcaagaccattattatgtttgccattcttgtgaagaaaatcagttgcaggatattaacttatttaccttaagtaacatagctgggagtcaagcccaagacttaggacacaaagggcagcaggctttttaatcatcccactctgtctctttgagaggccaatagaagtttctaccatctccactgtcataccccacctggaaacgattgcattctcaaagtcttgtaatttagcttttcattatgactgcttttctctgtgttacttaattagaatctgcagcttttggcaggaaaatagtcaaccaagcagatttctaataagcaatgtctttaggggagaaagtcgaagtgagcaaagagaagagaatgaatgcgtgatagtagctgctagaatatattagttgcagacaaatttcagtgagagtgtcagtcaccgtgaattaaatttttaagtgaagtggccggaaaaacaagaatggaatggagcaaagcacatatatcatagttcagaagatttggaattctcccaaacttgtcatcctttaatggagaacctgttaggaacaaaggcagagcctgcattaatagaatgatcttgggaaatgccttccaaggacatctttttaacattcttactcagacttgatattttgaaaggtttttctgttagataaataaacttttaaaaacagtaattaatatgtatcttatttaaaaatagtcacatataatgtaggccaatggataataccattatgcattctgaagggttgaaaattgctagagacccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaagaaaaaagaaaattgctagagacaatctagtctagcttttggaaacaacttttacagaaaataaatgttaaatactgggtgaaaaaacagtggtttcactgttactgacaactatggattaagagcgctttctacccctttctctcgaaacatttcattgttggtagatgaaaaagagagggatggtagagtctgttgagaaatgctctcaacagagaaagtgagttcttcctactgggatgataacattaatatggttctttatcatgttgcaccttagaacatttcagattcctattttgtctagtaaatagttgatcacatggttctctgcatgatgttgatgagaaactttaaaaaaaatctattctccttaaagcccatagttttctcaaaattagcttttctgctggggtgattgcaataaactactactggagtttaaaattgtgcctatttttccaggaacaagcttaaatcctgttaaactagtgtcaagcccatagtttgcattgaagttaacatggagggagtggcagactagctttccgccaggaaatgtgagggtatttagaccccatcatgctgtaaaacatttttcttaaggtgtaaacattggatatattacccaggaagttaaaacatatgcagctaaagggaactggattttctcagtctgtcaaattatgtgtgtctgcttcttaatcattatcatgaaactgttctatgggactacttgaaccaagttagctttcaattagcatgacgttatattggcaggtctaaactgttagacaaaatatgattctggcatggacagtacatacatgaacaatttattggtacatttccatggtccagcactatgacaacttattaaacccttaaaactctaaaacttgcccttctattttgtgttatactcacttgtggaaaagaactccaacctgaattaaattcaactatctacctgctcctcaccttcacccaagttgttcagcattaattaaataaatcatattacctttctgacttagtctttgtgatcacatatctccaatgaacctgaaatggtgtcaaataatccttttttcttataatatctctctctctctctctctctcactttgaagaaacaaggtttcattctgtcgctcaggctggagtgcagtggtgtgatcatagcacactgcagcctcgaactcctgggctcaagatatccacccacttcaaccttcctagtagttgggactacagatgtgcaccagcatgcccagctaatttcttgtttgttttttgaagaggcagggtctcactttcttgccgaggctcgtcttgaaatcctggccttaagtgattctcccactttggcctaccaaaacacttggattacaagagtcagccaccatgccttgaatcacacaatccttttacttctctttgacattcactttaccactctttgagatattattttgttaattctcctctatctttaaacttcttactctttgcacaccctgcacactcagctgtgaaacagtcaacttacctttcctcccatttattattttacaaatgatgcattgaaatagaacaagctcatatttctatcactaaatttaccactctacctttacctttacctctatttagagtagatgaactctgctactatctgaagccaactctgaaggttatgttttccaatgatctctcgaagactgctccttcaactgtctcctcccctatatcaccaatttatctctcaatataaagtcatccccatgagtatacaaatatagcttttttcacatgttaagtaaaatgtcccctcatgctatggccctattgacttcacagaaatatctgtctaaaagttatctgtatttgatatctttgctctctcacattccattatctccttagtcaaaacaatgaggtttctgttcctcgcaaaatgtccacgttaaagttactaatgaacgttgtttaccaaatccagtggtcaattctcagttctcaccttagctgatcctttatataatttgacccagttgaccacaactttcatttcaaaactttttctggttttacgcctacctcattactttctgatttactttactgattctttttttcgatttgttctcattatgttgtagttcaagacctcaatcctgagccctcccttatatttttccctctttagatgactgcattgagttttttggctttaaataaaatctgcctgttgatgactcctaaatatgtacctgcagattatatttatcttatattgtttccatctgtattagttatctattgctgcataaaaagttatccaaaccttagtgtcttaataacatctattatatcatactttctgtgggtcaggaatctgggcatggattatccgggtcctctggctcaggatctctaacaaggctgcagtcaatgtattggatggggcagcagtcatctcagggtctgattggggcaggacccactttcaggttcactcaataatggtttacaaaattcagttccttgaaagttgagccacctgcattttcttaccacatggtcttttccatagggcagctctcaaaatggcagctggcttcatcaaagtgagtaaacgagaaaatgtcagcaaaaggtgggccagtgttttataacttaatctcagaaatgacataccatcactctggccttattaccaagtcactaggtccatttctcactcaaaggtgggggattacacaaggtaatgaataacaagaggcaagggtcatatatggtatgataaaagcatctcaaactttatccaaaacaaaacgacttcctgacttcccaaactttctatgcccctagccttcctcatctcagtaaatggtagcacaatacccctttactctctgaccaaacctggaagtgatctttgatttctcttttactcactaaccatacccgatgtattagtaactcatattattgttatctacaaattattcaccaagtctgatgaccttccatcattacctttgttaaaattgtagtctaagatgatataaattcttgtctgaactactgcattagccttctaccttattaatatcttttcttcctttcttttgttccattatagtacaagtgaacttgttaaaaatgtatattatcttattagtacttgtatttgtctcctagggctgccataacaaattaccacaaacagggtagcttgaaaaagcagaaatttattctttcacagttttagaggctagaagtcaaatatcaaggtattagcaaggccatgctctcgcagaagtctctagaggttgattctttcttgcctcttcctggtttctagtggttaccagcaatctttggctttccttgacttgtagctacatcacttcaatctctgcctccattgtcatttggccttcctcctgatgagtgttagtttgtgtctcttcttctaaggatacagtaattggatttagggtacaccctaatctgttatgaccccatcttaacttgattttatctgcagagccactctttccaagatcacatatataggtactcagagttagaatttcaacatatctttttagaggacaattcaacctgcaacagtcccctaccttaaactacaaatggctttttactacaaatacaataaaatacaaaatacttactctgttaataagcctttacatgaattggcctcagcctattctttgtgtctcacttagttccactctcacccttattcaatctactccaaccacattggccttatttatgttgtacaactatgccaagcttgtcctgttcttatggcctttccatatgttttatatctttctggaatttttctcctgtatccacctgtgactgccttctcctcatgatttaagtcctaagttacagacaacttcttggagaaattaaaatagtaacttctgtactccatcactctctaccctcataatgtgtattaactgacatatattttttatttgttcactcatgttttccctggcaagaatgtaagcttgatgaagataggatatgggtctgtcctgtttcttcttatgtctctaataccctaatatctaggacagtgcatggaatatattggtcaatgagtttatgtccccattataacctaaaagagcaagatgatatgcataatagctaagtagattctggaaagtagaatgctaatttacctctgatcttctgaacttgtggaggtggtaagaactaatgtgtagtatttctagatgtggtgggaagaacagtcaatcttagaagtcaattcttagaactccaagcagggaaaaccatatgctaagtactgggaagttaagaagcaacaagatcaaacagacataaagcaatttatattctctttgaggagacagtgcagctcctgcaataaagcaggaacctcagatagtgaaaatctttgagctgagtgactatagccaatacctagttgaaagtcacataaatatcacttagaatttcagtccatgcagagactttgcaagcccacagtttccagagaaatagtagcatagtctgcaggttgaacattggatatagatcatttatgtcctttgtgtatatatttgcatcagaggtttcagaactgttttatttattattgactatttaaattattgtcagtagaaaacatagaacctaattttctagctgcatgaccttgggaaagatactctaaatagacaacaatagcatctacctgattaataatttctaaggattaataagatagtacatataaagtgctcagatacatgcctggcacatagaaagtgctcaacaaatgttggcagttattattaataatgcttattacttacaggcattgaaaactgaatgtgaaaaattagatatgaacttgtagataatatcacaattatctgtaaatgctaatgataaacaaaaatattcctgttagctttctggcttttcaaatattttactagcttcctattgctgctgtaacaaagtatcacaaacttcgtggctcaaaacaacatagatttattcttttacaattctgtaggtcgaaagtataaaatgaaatttatggagctaaaatcaaggcattggcagggctaggtcttctagggcttcaggggagaatctgttgcttgcatcttctagttcctagtctttgatggaattccttggctcatggctgcatcactctaatatccacttccatcatcatatggccttctctctaactttgacactcctgctactctcttataaggacccttgtgattacaatgagcccaccttgtaatctggaataatctccttatctcaaaattcttcactgaatcacatctacagagttccttttgacatgtaaggtaacatgttcataagttctggagattagggtgtggatatctttgcaagccattattctgtctagcacaaatgcagtcactatcttttaattttaacagttattttgaaacaaatacattctattattgctttttcctctataagaggattctattgacacattggcacataggacaaatacttatatttcttttccttgaagcttcagtggtcatgttctcgctgagtaacgctggggtgactatggagctcttttataaaaggtaactagtttttctgtgctccatggcctcagaatggaatttttattgtttgataaagctaattattgtgaatagtgattaaacttgtgatctgagggtaccagccatgccccagattatttggaacattaggagatatttttgcttgtgacaactaggtgaaggtgctactggtatctagtgaatacaggccatggatgctgctaaacatcctacaatgtacaggacagcccacctccccaacaatgaataatctatctcaccagattaatagtaccatgtttgagaaaccctgccataggcaattttaagaaacagtattattgcttgggcctttgcttttcaaaagtgtggtgcatggaccagcagttttggcatcacgtgggtcatcagtctctttgaaatctccccaagtgatcccaaaattcagccaaggctgaaaatcactgccttagcttttctcccattatcttaccctactcataagttgttatggttatggatatatagagtttaactggaaaaataaaactaaaaaatttgccacgtgtaacaaacatcatatattagagctctaattggcataaagccacctttttcttgagaattgcaataaataataaattcctcagtgtactgaattgtaaacacacagatatgtggtaagagtcaggtttatccaactattcgttaaatatattggcagggagaactcacaaaggagggcaaattcactcagctaggatcatgtttgcagcctgcaagagcgatgatggaatatatttgcttttcctccctggctctgtcacttgcctcatccaatctgctgactttagaacccaaaaagtttctttggtatgggcttttggagctgaattacagtggagggcatgatgaatacgaaaggcgtaagaaaggtgaattagaaaagtggcagatagaaactgtgtagtgtttttatttatgctctctattcttcagcacagtgcactttccattttagctagtcaggttcatccatttacagtattttttcttgtcaccaaataagtgtgagctctattgaatttcacagaattttctggcagtgtatgaaacatatcaatttccccagtaattcccagtaatttaagtttggaattattatacaaattaattcaattaagactacagttatcagcatagccctgttaatattctgtggcttataaaaataaaaggtaacatggatctaactagacaccaatgtttaagggtaatcatacattattgtattcaatgtttgcagtaatcctttgagatacagactattcatctggccattttacagatgaagaaaatgagatattagatattggaatgtcaagtattagtaatttttccaagtttgcatagctagtaagaagtcgagctgggtttcatatacaaggacttttactcctgagtgtgtgcacttaaccactttcattgtatatttcttcaggtctgtcttcacaggcaagcatcggctagtgccagggattttctaaactatattggttacattaggcaactctagattttgcaagggatgattccattgtttttaatgaccttgattgaagccttttcctagccactattcccctaagatgggtagtttctctgctttgccaaatctgagagaaagacctagtgtctcaaaatacatttagttgctcctgttgatgataatgttatggaaatggactttttctatgcacctttgcagttccactgatctcttgtttagcagccttgacagtgtctttatattgttgttcacatggtttctgattaaaaccccatgatactaagctctgactagaatacgaaatctaacccgaattagtttatcatgatttcttttgtttaatttcctttttaacattttattgaacattgacaattatacttgtatatatttatcaggtacagagtgatactattatgtgtgtgtgtgtgtgtatatatatatatatatatatatatatatatatatatatatatagaatgtggaaagattgaatcaagctaattagcgtattgctcatcttaaatacttaccttgcttaaactgtaaaaaatactttatcttaaagcatttattgactaacttgattttaataaatgaatgtagtattaagtaaattaaaaaagaaattaaaacttgactttcataaagatataaaatgaacttttgtcaaagttttatttacatcactaattaatgagggaactagacaagatgttacacctgacttgatggagttgtcaaagaaccacaaatttatatgcaataaaggaatattgaactcaattgaacacagcatgtctatccatagaacaataatcaattgcattctaccagacacaattaataagcatttccatggataagaattgtttgcattgctattagctttctagatgttcactgtatctttacagagatataaaatagcttattcaaaagcaaagttacacatataagatcagataattcccagaggctccacctttccatggaaaggatagctaataatctctcttgcttgtttcagattctcaaatgtttccttaaagtagtattaggtggatacatttacaggcatatctcttccacagtatacatttcattctttcaatcacagtgtgtgtgtgtatgtgtgtgtgtgtgtgtgtgtgtgtgtgtgtgtctgtctgtctgtccagaatctattttaattagattcagattgctaacctggtgttttttattagtgatccattaaagtggatcatatggttgaaaacagtggaagttgttgcattgagaaaatattttgcacaatgtgatttatcaggatgactcttggatttagaaacgtatggcttttacttgtagaattagaattataataaatcattcagattctggaaaaaaagtaatataatttgatcctttaaaaccttttctaatgaaattttaaagaggcataaatacatacatatttttgtaaaaaatagtgcatgttcttttttttcaaattagggaaacatagcaatgtggaggagagccaaaatcagtataattacttatgatagccagctcatgtgatctgctgtgctgtagtttttaagtcatttttctattattaatagtaataatattattcatactatggataattttctctatacagcattatattatgctttcatctcctttccatgttattttgactatttttgcaaattattaatttcagaagtatttgtgaaagctaaataatattccatcttacagatattctctacaattgttactagtcctctatattagtcaatagaaaatataataattatctctttacataaatctgtctggattaatgaatatttaaggtggtatattatttacctatttttacataacaaattaccaaaaacttagcagcttgaaactatacaaatatattatcatgtagtttctgtgggtcaggaatctgggcacaggttagctgactcagttcagggtctcacaagtgtgaaatcaagatgtcatctgggtcttaggtcttatctgagacttgaagtcctcttccaagctcttatggttttttgcaaacttgagggttttttttttatttatttttatttttatttttatttttttttgtggttttagaactgagtccctcagctcctagaggttgatggccattccctgtcacatggctgtctccatgacatggcactttcttgttgaaagccaaaaggaaataatctctgctacttctttcctctaaccttttctatctctaacctctagaaccttttttaaaagaccacctgattaggctgggcccaaccaggataatttcccttttgattaacttaaaggcacctgattagtggccttaatcacacctacaaaatccttctatctttgttatataatataacctaatcatgggcatgatatctaccatatttataggccccacccaaacttaaaagaagacaattctacagggtgtggacacaagggagtggaagtcttggggcccatctcagaatttttaccacttacagatggatttttagaagcaggatgattgattcccagtggttaagtattttaaaggctatatattgagaaattgctttccagtaaaactgtactaatattcactcccatcatcagattatcagcatacttgttttactatatccatattgacataatagtcatttaaataactttgattactattttcctttctctataattatatatgtatgaatatacaaaattacaatcatggcatttttgtgtgagaaaattttatttttatttgacaaattattttagtatatgcttttatttactatcagttttatgattgtaatatttagtgactgtatgtcttctaggtattacctattcacttgatttgttcattttctatattcattccctttgctaattttcccaatagatttgtaagcattctttatattatatgggcactagcctattgatgtgtatgttggaaatatgtttgctaatttatatttgacttttaactttccctatacaatttatatttttatgttctaaaaaacacaataaatattccatttgaattttgactagaagtgcatattcccattttggaaaaatttgacattttatgccaaaattgataaagtagtcaatattttaatcctggagcatattatttgcatgaatttataatggaataaagttttctaacttcttgtcaccataccctactactaataaaaattttacatttctctctttctaatatttacagtcactgcctaggaattccagatcaaagctaaatgaaaatagtaacattaactatccttgccctcattctttatattagtttaaagcacttcgtcagtttaaaaagaaaaaggttttctatatttttatagccataaccatgattttctattccttggaccaaactctgtttcttgaaagtttggaagtactcatctgtattgttttcttcaattaacatttttggagtttatactttaatagcattttgagattttaaacggttttgggtttactcgtaattttcttctgtttaatgaattttagttatttttatccccaatcatccattctgtaaaatttacaaatttagtaaaattcagtgttctaaatattttatgtcattgtatattttataacttcttcagttctaattttgtttatatcattgctcttttttttcttaatagattagagggaagtttcatcaactctttgtaatacaaaaccggttttgacagtctgttctttaagcactattggtttttaacctcctgaagcatatagtcaggacatcttgagagtcaaaccaaccctttccttaccagattcctgtacaacttttcagcttcacctggtgccacccagtaggtgtgccaattatcccatagtaactgcgcttactgctccagtagtctataggtttgcaagacattccacagcattttgtgttagattgctccacagtgaactccacagtgtttaattctcgggacaatatttaaataaggcacagatgcattttggataagattatttgactgctgcgtatagtattcttcatcaccttgtagggtaatctgccaagaagcgtatgacttcagatttttattgataactttggttttttagtcatattgtgaattagcttttggagatcagtttagaagcttggttgtaagatttggaaggtcaacattcccttgtcagagaagcgctataggaataaatggtcttctgtttagaattgtgttaaaaagaaaacaagcaaattcccacagagttttgtcagggccaatttagaaaaaaattatcttggtgacctaaaacttgttttcgatgatctaaatgtatccccctccctactccccaactcatattgaatagattgtcaagtatttagctttattttcatcagtggttttccaaatggaccatgcactctttctgtcctactctacctgtaatctcttgcccaccatttatttaaccctttctaccttagtcattaatgaactccctcttctgcttccaaagtcagcccaatgccaccctcttctgtgaatgttttcatgacctatccaggctgcactgagcactttccatggattcttgagaagtcgtctctcataacatgtatccctttgctaaaattgttgatttccatgtctctcttccatgtaatccttgccacagtgaccatttcctaatcattttgtacctcagtatttagaacagcatctgcatcatgataggcactccataattaaaaaaacaaatgtatacataactttataatttgtgtttaatttcctcaaggtagtagccaaagcttatgatttagacacaagtttccctgtgactaattgtaaatattgtgccttttagtaacttatggttgcagagtatctaagagcttctgtttatcctctccccaggaaatctatctcataacatgcatcgctttgtgtaaattgaactcttggaaaaatactttatccgtgtcaggcacaaatggatacttcaatttttgattagagtgaaaaatggttgctttaatcttgaatatagtaatggcaaaactttaaatattaagtaaaatatagtgaatcatttttttagcataggtaattactacatacaagccaggagtggaaagaaggcataagaaaagagctagcattagaaaatgtctataattaaatgtcattgttaaacactaatagtcaccataaagacaagtattttatttaaggcttatgaaactttgaagtaggtatttgctacctcaacatgttgaggaaaagtaggtaaaaactgaaataaatatggcagatacttatgtccatgctttgtaggtgagaaaactggggcttataaagatgaagtaacttgcttaccttaacatacagtaaggccaataatccaggtttttctgattctaaagcgtattctccctgctttatagttaagaataaaacaaatgagtgcagcttccctccctttcacttccaaatttacctttatattcacccatttgtactttattttctacctataaaaggagtctcaacttccccatactaatatctcttccttctagattctcttctttcctctgaatctcttttgcctcagtttacatatgtcatccagaattccccagttaatcctcaacttctctaccctgaattgtggattccacatccacattcaaaacacattgttgcttgttttgaatgttgtttttgaaaaacattcaaaaacaagcagatgaaacctagtttccaccttggactcttttgattatgcccacttatactcctatttgtgtaatgaaaagactggtcattagcatcttaactctgataccagttgtcttttttatttcgagacaggatctcactctgttgcccaggctagagtgtagtgaaataatcactgctcactccagcctcaacctctggggcttaagtgatccacccgcctcagcctccccagtacctgggactacagcatgtgctaccacacctggctaatttttaaatttttttgtagagatggtggtcttactgtggtgcacagactggtcttgaactcctgggcccaaatgatcctcctgccttgacctcccaaaatgttaggattacaggcgtgagccaccaacgctggcccagatgtctttttttattctcacaatacacaaactctcctgattgtatccttaaatatccttgcttgcttattttacccagtattttctgattcacactccctctgtggcttgcttttctcactttttctccctcttgattcattttgcctgtcctataaatatttgtaagccccagggtggataatgtgagccttcttctcttctttatctgtacttccttcttgtttttcctaatacatgttcttaacttcagctacagttacagtgttgtgttatcttccatctctctactaagctcctggctaatattttaataaactacatgaaagttttaacagggccagtctaattaaataggtaagcatttgtttcctttattggtttgtgagcctttttgattagactccattgcattgtctttgtgtccccactacatcatagcaaaacatcttgtaactagtgtatgctcaataagggtttatcaaatgatgggtttaaatatcaaaattgaactgcatataatagcaaccatatccagtctttcattcatttatttttttccagctagtattcattgagcattggaaattaaaagttgcataaaactcacatttacccttcaaggccttccagtcaagtagaaaactgggatacacagaaaacttgatagggaaaggatgtgaatattagtagtatgaattaattggtagtacttacaataataataaaagtaataacaattaactgcaataacaacaataaaaacagaagctttgcctgtaatctcagcactttgggaggccaaggcaggcagatcagttgaggtcaggagttcgagaccagcctgcccaacatagtgaaaccccatctctactaaaaatacaaaaattagccgagtatggtggtgggcgcctgtaatcccagctacttgggaggctgaaagaggagagtcatttgaacccaggaggcagcggttgcagtgagccgagatcgcgccactgcactccagcctgaacgacagagagagactctgtctcaaaaacaaacaaacaaacaaaaatcccggaagctttgatttgttgttctttcaatgtgccagtgctgttctaagcactatgctatatatactattataatacttactttgcaaataaagaaactagtcacagagaggttatttgttccaaatcacagtttataggtggcaaagctgggatatatagactttctgctcttaaccattgtgatatgctcattctgcataaggtttagtagtggtttatgtgaagccaaatggtgaatggtattgacaggaaacaggcaactggtttcaggtccatttatccagaaattgaggcctcttgaaattagttcaccaatagtataagcaataagaaaatatgtgagaacctcactaaatgattatgtacagtttgtattgctatttctgggtgcaaattttgattatgcaacaaggatagcaaaacttggatgtctatggctagatacatttaatctgttttgcaatttaagacacaataaacttcctcaaagaagtttgtaaagattattatagattgaccaagatgttaagtctgtgaaattctatggatttctttttgtgttccctaatacataaagtttcaagagattcagttaaggatcttgatattaccaaattgatgctttccacacatattaattttaagaaatagaattgcaaactagcctatatgctttatagaaatgaaatgagtaaggaaatagtattttgaacaggagtaaagtaataagatagttgagctgaaaggtcttgcagtgtatagttgggtcctggagtttcttgggcagtgctgattaaacttacacagagaagaactgattctcacagctaacctgaaggctgaaggtgtcaacttgaagatttcctgcagctccagttagtgtggtggctgggaaatggtattcgggttttaggaatgcatgactcagatttgtactttaatgtggcagttcatcagatgtgtctgatgaatcagctctttggattaggtttcatttatgtctttatgtaaacttaaggtctttggatagaaaacttaaacagattgtcatcccttaaaggtgccgccattaaaatagattattttccatgctattacaaattcactgattttctgaataaaatggtgatggtgacaccttgccacaggtgaatggattttgcttttgttttgtgaattaaaatgtgttttaacagacttattaatatgagtaaattaatcaattaaaaccattcagaagtatctgaatgaggctctgggagaacccaaaatgtgatagttttggcattttcatctttaataaagttatagtgattgagagctggattgatcagtcctcaagtgtcttgcaaagaaaggtgtcctgtcataagtttacaatatatttgaactgtgttctgatttcccactttttgaaagtcggtctttcagctccactatctcagtcttatacaaaaagaaaagaagcagagagtagaatggtggtggccaagggctgggacaggatggggaaaaatggggagatgttggtcagagggtacaaacttgcagatatacaatgagtacattctggggatctaatgtacagcatgttgactataattaatgatactacattgtatacttaaaattttttgagagtagatcttaagtcttaccacacacaaaaatataacaactgtatcagttgaagtatgtgttagctaactttatagtggtaatcatttcacaatatatatgcatatcaaaacacactgtacattttaaacatatccaactttgtgaattatacctcaataaagctgagacacagaaggatgattttctgaggaagacaatgttcgtttatttaatttcaaatgaaatatttctcctttagaaatccaaacacactaggttagtgtcccttcttatattcctctgcaagccttataatagaaagaaatgatttttgggtagtttcgttgagtgttgtttcttcttcttctttcttctttcttcttcttcctttgttgcttaggctgtagtacagtgacacaatctcagctcactgcagccttgacctcccaggctcaagccatcctcctacatcagcctcccaagtagctgggcctacaggtgcactccaccacgcccagctatttttttttttttttgtagtgatgggggttttgccatgttgcccaggctggtctcaaactcctgggctcaagggatctacccgcttcagcctcccaaagtgctgagattacagtcatgagccactgtgcctggccagagtatacattcttttaataaaaacaaaagtcttaaaattatcttacaatatcttttagaggtttttgaaagaaaattataaaatcacgattaaatattttgaggcagacagcttatgatttaatctctgttggaaagaatgacactgaataaaaccacattctattgcagcatggaatgttaaaaatgtcagtttggatgatttttattaagataaattgttagtgaaataattcttttgacgggattgtttccatttatttaaatacaactagggcgtttaaataaaaaatccaaaacctcaagtgaacataagattttaaagcattttgggggtgagggctatggaggcataattttggtattaccagtttcgatttaacttaggaaccacaacatatgggaaaatataatagaaatcctggttatattctttccttttgtgtaattcattgcaccgatcatgtttgatcaaagttatgaaactctaataatattgctatctatttttaaaacatgtatgtttttcttctttttaatctttgctttagggaacggcctttaagagctggaagatgaaagctccgattccacacttgattctcttatacgctacttttactcagagtttgaaggttgtgaccaaaagaggctccggtaagcagtattcctctattttttatgtgtttttatagcttaaagtgatagtgctacatctacacatgtgccattagtggaaaagttgagaatgatcagttatcaatattgtggagatattgtagatattatgagtaaataggtggagcacactcatagggaattaggaaagtgagagtggattcaaaagaatgtggcttattttatcgattactatgaattggcatggattcaatagcaaagccttgtatttagatttcattttgtggtaggattttaagtattcttatataaacagtgttatttaattttttgcatggaaatattattgtatctttgatgttaacttttattgttaccattttgatgtcagctatacttagggaagattcttttcagggttgtactccagctgatttgatgaattgcttggaagtatataaagaaaatactagtgttattgaagaaaatgtcatgaggaagcactaatattttaataggaaatatagaggtaaagtaggatggtaatgaaaggaactactaaatagattaatgttggcatttatgaaaaactttacatgttatcaggcatcttggtttgtagtggactgttgatagttcaattgtatgggacaattgaataaataccattatcaatgtgaagttgtatcttgtctagtaagtcactaataatataaagccttgccatgctcacactatgtggagtcacataatttttgaagttatagcttttaggtatgaaggaagatgaagggtattgtgttttgttgctagaattagaatgtattgtctgttagttctagagagcctgtgggaaaaagaagatgagataatgtacaagaggttgcagtgttgtgatataagcaattgcatggacaaaagcatctttggagttcagaaaggaaagggaatgaaagggctgagatggggctgtgaagcaaacatcttaaccatgaggttaaaaggcttcaaactcactttgatgatataacgaaaaagcccacatgcaggggaaatagggagcagctctgctctcgtgagcccctcctggggataaagtctgaagggaaactggggagggcattgtgcatggacaaaggtttggtgcatggttgaaagttaaaaaaaaatactgagactgttggttctagcatatttggttattatacagctgttgtatctgccattgatgtggttataggcaacgtgaaaaaaatactgttgttatgtctacacattatttcatctcttcttctcagtggatcttctgaatgagataaaaccctagggcaggattatgatgttgtggtttatgtaattcaaatgggttaatgggaaataacatatatcttgatttctttaattgtactatgctcaagtacaattgagcataaccaagagagttagagtaggtagaaagaggggtaaatagtgatgaaagctgataatttttacaacactgatgttttctggaatagaaatttacattaaaatcacttaagataggtttttgagatagtagctatatataagagaaacactcatttgtgtaagtattataacaaaatgacaatagttcatccaaaatagaaatattgattaattctttaaaactttatttttctggttattaccactaattatataaaatctgtttttttttcagttctttctgtgtatgtcagatctatgatttatttattcaaatagaaatgttactcctttttaatcataaagtaatggtgataggtccattctatataacctctaatttgggggcaagaaattttatcaaactgggacttactttgtgtgtttgagaagcatgagagcagagctagaaacatggggcagttggaaaatgcaaatttaatataaatgcaaatattaaaatgtctcaaaaatctatattaagtgattttaatgtaaattcctattctagaaaacgtcattgttgtaaaaattttctgctctaaagacctgagaaaactcaagaatctgtctcaaattcagttttattttaattttgtaattatttgagaagaatggtaataagatgctgtgctaagctaagcagaagttctgagacctttctctcttcagtttatgaatgcagttgtcacgtaattatataataccttctaaaccaaatgtgttttctatattataatgtaaaaatgacaaggcaggtactgggattttgcagcatgcctgatttgtttacttttctatatgatgtgaattaacataccttccttcccctagtgtctatattaagatccagatggatggaggcttgtttgtttgtttgatttttggatattaagtgtgcactttgggaaggaataatattattctatccacatactttcatagcttggactgatttcagctgatgtctgttcctgtggcacctttgtttgaaggaagcagatatgtagcttactgaatagtgtcattactcatctccatacatcaagtagaagaggagtgtagttggcatcttttccttgaaagattaatagctcaatcttcatacccagcccaacctataaaaccagcagcaccatggccaggggataaaaatcaatttttgatgtttgattttacgtattaaccaagaggacttcttatctttcttcttttgtcttatcatttaattctcttttgattctttattttattcatctttttgaaaggtcagtaaacatgactcaaaacccaatgcttttcatgtgtcttttactagaatattatttttagttcactgtgaccactagaaaaccagaactagatattttaataattaggaacatatacaatattatattacacagagaaatattgatttttaatggcatgttaattttgtagagtgtttactttagattaacacatatggtcattccataaaagtagatattgttttctcattaacagaactaatttgaaagcaataggaggtcttattacacaagctggaaatgcattatttttatcacattggcttacagtcccatcgctgttaatttaaggaacagattaaatataataaggcaggccgggcgcgttggctcacgcctgtaatcccagcactttgggaggccgaggcgggcagatcacgaggtcaggagatcgagaccatcctggctaacacagtgaaaccccgtctctactaaaaatacaaaaaaattagccgggcgtggtggcgggtgcttgtagtcccagctacttgggaggctgaggcaggagaatggcgtgaacccgggaggtggagctcgcagtgagtcgagatcacgccactgcactccagcctgggcgacagagcaagactccatctcaaaaaaaaaaaaaaaaaaaaaaaaaaaaaatatatatatatatatatatatatatatatatataaaaaataaggcaattatatcattataacattcttgattgaaatattaaaatgcaactttataacattttgttttaaatatcacttcagatatgtacaatatgtatgacaactaaggactatatctggtctctcaggtaaagtcctaaagttgtgcctacatttagaatgaagacttttaatatctatggaagcacatattcagcattcgttacacaatagattttatcctgggacaatttcatacctattttttttagtttttataagtagcacttgatgaaagaggctaagatgaccaatattaccaatccccgtcaagcatgtgaaatattatagcaattcagtaagtaaacatctcggttgctgtcatttttagaattctgaaaaaaaatcccccacatgtaaagcaaacgcttgcttggagaatctttgtatctcaaccagttgaggaaatttagctttacattcttgtttgttggtccctttcttcattccttcctcccttctttccctttttgttctttccttccttccttcctttcttcctcccttccttcttctctgctagtatatttatctgcaaataaaaataatttattttcatattcccactgtgtcttggtaggacttttcaaactataaaaatattattattactttgtctgcatggttgaagtatttgaaatattctatctttacaaggccattcaaagaggttagcatagtctttgttaataatagctattcttaaatatatacattttaaaatggtgtataagaaaatctgcagtaagatttgggagcagggaaatagtataaatagttgaaggactgttatggacaaagtatgactatagcactttgcggggactaaagtgtgagttgtaatttgcctgaaaagtttgggatactgaagaaaaatgaagctagaggggtctggatgtagaaattaggtaagagaaggggttccatgatgtttttctctcaaaaacatcctcagaatataagatggtgagtgcaaggaccatgattaatgtatgcttataatctctacagtgccaaatatgctgtttcagagtcagggttcaaggaaatgtcttaatgacttaatgacttaatgactgcatgaatggttgagtgagtggttttaataatcagagttacatcagtgaggatgctacaggaccaaaacgatattagaaagataaaggtaaaattaaatagaggcatttaagaaaaatgatttttttttcttaaagagcaatcagtataatgtataatgtgagactactgaagcaaaagatataacccggaataagcaatatctaggacataataagggtttagatgaagacaatgaacctttacaaatggggagtgttttcatgggcttgaaatgcagttcaaaatctgttaaagggtaaggaaaatgattcttcgagtatttttctattggaattctactacgtttagtgccgctttaaagaagtactaatgtcattgtgcagaattttgaatttaatggtattgttccataatggccattatgaaaaggctgtagctcatgattactaatacaggataaataagcaagtgacttcagtataggaaaaaagtattcacagttattagaccatatggagaagagtaagtggctgcattaccaaaaagcacgttattttaggaggaatttcatctatataaaagctccctaaagcatccagctattagagagtaaaagggttaccaaaaggagttgatcttctcttcattctagaacctgacaggggacacctgtttgtgtaaatgatttagatgcaattcttctagacagcaagaggaaggcaagcctcaaaaggttttcctaaacttgtgactctaggcccaaataatttataaaaggtaagagtagtcaaataaccaaagacacagtttcagttctaatttttgtgttgttatgtatggatattcatttaagtaaaagaaattatactactgtgtaaagaaagcgagatttaactgaataggaatgagaaagtctagtgggggtacttccatctcatgtcaatgtgatttatgtgcagctgctctcttgagcattcctgtaagtcaatgagcttaatttcacatgattaagagacaacctagtcccccagcatctgccttttattatgttaccatgtgtttattctcagtttgtcaaatatgtcaaaaaagataaggtgtttctccttattttcctttggggtagcttataagaccaaacttctgggactttgtttctttaccttttgaagttaaaaaaaatgcactttaattttttctcaggaaaaaaaattctcctatttattgtaatttttacaaattttgaaattagatctagagtaattttaatattcctttgaaattatgtccttaaataaaataataagtctaataaaaatggaacttgcacctaacaaacaaaataaaattagccaatgtctttgtttagttatatctatgttctgttatacctatattctgttatacctatgaatttccccacaaacttacccattcagttttagttgtcagtataattttatatagagttggcacagatgaataccaattgtggaaaatgatgcctgcttcatggtgagttaaggataaaaggcagtatgaatgaatcttccaagttgactaagacttcaatgaggaggagaatattccaagttaataagtatagtattccaagttaatccaacttattaacttggaattcaaactaattaacttggaatattattattattagttgtattagtattccaacttattaacttgtattccaacttattacttattattgcttataataagtaataatattcaaagtatcataagtatataagtgtggtactgtattatgagggtacaaaataatatattgttctatgtatttgatgggagaggtgaggaatagagggaagcagtatagaagctggcaaatggtaggcaatataagtttgttagagaaatgatgttcgtattattccattttcatgctgctgataaagacatacctgagactgggcaatttataaaataaagaggtttaattgggctttccatatggctggggaagcctcacaatcatggcggaaggcaaggagaagcaagtcatgtcttacatggatggcagcaggcaaaaagagagcttgtgcagggaaattcccgttttcaaaaccatcagatcttgtaggactcattcactctcatgagaacagtgcaggaaaggtctgcccccataatttaatcacctcccactgggttcctcccatgacaggtgggaattgtgggagttacagtttaaggtgagagttgggtggggacacaaccaaaccatatcattccaccccggcccctcccagatttcatgtcctcacatttcaaaaccagtcatgccatcacaacagtcccccaaagtcttcactcatttcagcattaactcagaagtccacagtccaatgtctcatttgagacaagtcaagtcccttcggcctatgagcctgtaaaatcaaaaacaagttagttacttcctagatacaatgggggtacaagcattgggtaaatacaggcattccaaatgggagaaattggccaaaacaaagggactacaggccccatgcaagtccaaaatctagcagggcagtcaaatcttaaagcttcaaaatgatctcttttgactccatgtcttgctcatctgggtcatgctgatggaagaggtgggttcccatggtcttgacagctctacccccgtggctttgcagggtacagcctccctcccagctgctttcacgggctagtgttgagtgtctgtggcttttccaggcacacaatgcaagctgtcggtgggtctaccattctggagtcttgaggatggtggcccccttcttacagctccactaggcagtgccccagtagggactctgtgcgggggctctggccccacatttctcttctgcattgccctagcaatgattctccatgagagccccacccttacaccaaacttctgcctgggcatccaggcatttccatacattttctgaaatctaggtggaggtcaccaaacttcaattcttgacttccgtgcactgccaggctcaacaccatgtggaagccaccaaggcttggggcttgtaccctctgaagcaacagcctgagctctgtgttggtccctttcagccacagctggagcagctgggacatagggcaccaggtccctagactgcacacagcaggaggaccctgggcccagcccatgaaatcacattttcctcctaaacctctgggcctatgatggtgggggactgctatgaaaacctctgacataccctggagacattttccccactgtctcggggattaacattcggttcctcattacttatgcaaatttctgcagccagcttgaatttctcctcaaaaaatgggattttcttttctatcacattgtcaggctgcaaattttccaaacttttatgctctgcttccctcataaaactgaatgcctttaacagcacccaagtcacctcttgaacactttgctgcttagaaatttcttccgctagataccctaaatcatctctctcaagttcaaagttctacaaatctctagggcaggggcaaaatgctgccagtctctttgctaaaacataacaagagtcacctttgctccagttcccaacaagttcctcatctccatctcagaacgcctcagcccggaccttattgttcatatcactgtcagcatttttgtcaaagtcattcagcaagtctctaggaagttctaaactttcccaccttttcctgtcttcttctgaatcctccaaactgttccaacctctgcctgttacccagttccaaagtcgcttctgcattttccggtatcttttcagcaatgccctactcctggtaccaatttactgtgttagcctgttttcatgctgctgataaggacatacctgagaccaagaagaaaaaaaggtttaattggacttacagttccacatggctggggaagcctcacaatcgtggtggaaggcaaggagtatgtcacatcttacatggatggcagcaggcaaaaagagagcttgtgtagggaaattcccatttttaaaaccatcagatctcatgtgactcattcactgtcagaagaacagtgcaggaaagacccacccccataattccatcacgtcccaccagattcctcccatgacaggtgggaattgtgggagttacaattcaagatgagatttgggtggggacacagccaaaccatatcaatgtttattgtagagatagcatacaggcattcactgctaggaccagaggattaacccctgatccactggtggtcaactataggcttgcacgtgatccataaggtggcttggaaattagggacactggtgtatcagtatcttactgatgttttaacaaattgctacaaatatagtgacttaaagcaacacaaatttattatcttacagttcttgaggttctttatcatcacatctcctctgactctgacccttctacctctctctttcccttataagggtcttcattattatattgggcatcctcagataacccaggacaatcatttcatcttaaaatcatgaatttaatcaaattggaaacgtaccttttgccatgtaatatgacatagtcatatgcttcagggatgaggcagtagacatctttctagagaacattatttagcttactgcaactggcaattagccaattcaaacaaactgtctattgaatgcgttgaagactagagcaagaattgtcagccaggagccagatgggaatggaagagaaaagaacagggaagttgaaaacttttgctgaagggcctgtgcaatccatggtgcatgataaaaggtgcagagggtttgtagcaaaagaagaaaagggaaagaaaacagggcagagggaaaggaaggatgagagatgcggaaggagaaagaggaaactgatactagtgatgctttggatcttaagaacattttaagattaatctgcactccacacatatactttcaaaaatacccccttttctttgtggtaggctaaaggcgtctgtgttcctttcaacaaagtaatacctgacctgaaaatgatttccagacgtaaagtaatagcagtgagaatagtgaagacagaagagagagcaattttaaagttagactcaattgaaatagatgatcaattagatgtgagaggttataaagaaagaggtaaagaaaaacattctgtaatgagaggattgggataccatccatcatattaaaggtccccaaagcacagaaacttgaaatgactacttattgaaggaaaatagtaaggtctttgtgactaagatgaagccccaaatgtagattgaggatagaatatgagggattttgaatatcttgcaaggaattttagattttatcttgagaacaaaatattttggctgagatatttaataactttgcaaatccctttagtagaaaattcagtctgggtggttgggcctctgatttgatagatctgttcattgtggtgtcttctctacaccataaagatgaaacttcttgctttgtgtatgatggtgttacacacatttgtgagtccatcagtaaagctgcctttgcagagaagggaagacacacaatcaaactatgtaggatcatacatgaaaatggcatggtcaaacctggtgtttgacatgtaacactccctgtagaaaagactagggtgggattccagaatgaccagtaagggactcgataaaaatcgtatttacatatactgagggcctgaaaagcaatcaaaggcactgaaaataaatttctgaagaatatataggatctagtgagtgtttggagatgaattgtgaaataattcgaggagaggttatattgatggtgtcgccaattacagagagaagatgaatggcaatttttgcggggagagtggatggaatgaagtcaattcggaacatacaagctgtggtagtcactggaagtattgagctaatggatttattggtctggaattgtactagtttcctgtggcttctgtaacaaattgtcacaaactgggtgacctaaaacaataaaatttattgtctcacagttctggaggccagaagcccgaaatcaaagtataagcagggctacacttcttctgaaggctctgtgacagaaaacttccttgcctcttccaccttctggtggcttcagttttccttgggttgtagctgctaccatcttcacatggccttcccctctgtgtctttaatctccttctgcttttctcttataaggacacctgtcattggatttaggatccactgggaaaatccagcatgatctcattttgagatctgtaaccttaattacatccacaaagattctttatccaaataaattcatatgcacaggtcttggcggacatatcttttgggggaccactgttcacactgcaaatgtcaaagcaagaggtatggattttgaaattgtcctcatattgagagcaacatgatggaatgagattatccagggaaaacatgcagagagagaagaggaaaagaaaagggaaagggtgaggatcaaggattctgtggaacactagccctgaagaggctggcagagaaagagcagccagtcagggaaagagactaagggaaagctaagggaggaagaaagagaccttacttgttttggttcctgcaaaccaagagtggagaaagtttcaaaatgaaagaatgatcatgttacattctttggaaagttgtgtcagataactgaaaatacgtcattaaatgaagattcaggaaaatgtaggggtggagagacaacggagtctgaaagaagttgatgtcaggttttaaaaagtatatattgtacaaaatcagtatattaaagggcctttgcatattaaagggattttatttatttatttatttatttatttatttatttatttatttatttattttgagacagagtcttgccctgtcgcccaggctggagtgcaatggtgtgacctcggctcactgcaacctccacctccagagttcaaatgattctcctacctcagcctcctgagtagctgagattacaggcacccgccaccatgcccagctaatttttgtattcttagtagagacagggtttcaccatgttggccagggtggtctcgaactcctgacctcgtaatccgcccctgcttggcctcccaaagtgctgggattacaggcgtgagccaccacacctggccagggattttactttttaaagtttgtttaactgtttagaaattatgctttttctatttaggtaaaacgagtataaaacttgtggtcatccatgctaatgaaaagaattgtacattagtacagatataatagtatagataaaattttttccaatcaaaaacttctttttttttccaatcaaaaacttcttttagcaagaattaaaacatgttttgccatagataaacctcctgaaggaagggtgatactgatttaattttcgttttttcatttcataaatacagatatggaagatagcttacaagtgtattataattttccacggttaatcttcatgttaagtatcgtaagttccaggaaaggtctacagacagctaatatttacactccaactttcattcacagtgatgatcacaaaaattacatctttttagttagtatctcagaagtggcttacattaatctgatgagtattatattaggttggtgcaaaagtaattgcaatttttgccattactttcaatggcaaaaaccgcaattagttttgcacctaccttataatacccacagcagtggaaattaaaacacttgggtttcaatgcagctgctaacgagccttgttgattgggaacatgtccctaactgaagctgtcatatctttggtttcctttttcataaagttttgcactacaacattgtccatacaaataatagttcatctttttgttcctttcacaaatatttattgagcactttcaatgcatactaagtatatacctgacacttttttctgtaacttattttacatgtttgcaaattgatcacacgtttaaaaaggcagagtttgtgaccagagtacctgaggcccattgttagctacatttaactttgtgctatacagtttgagtcagcactacagagtggaggatgttattagcttaaaacaaaggttctgttaagagaaaaaaaaattagtttttatttctttttaaatagcacacagtatatcattagaaagccaaattaaaaataagatacttctccttgcatgtggtgatgtgattaagtaaaatttggtttgtcagtttcaaataccaaaccatgttttagtctatttttgcttatttaaggcaaatttctttttgtagagttatggtctcttaagacatctatgcaagacaccttgcatgggaaatgttgccttaaggcgatgacagtgaataactttgccaagttttaaaatctctgagggttatatataaatatttcttcaaaaaatgtcagtgagcctcttgtgagtattctcaacactattcaattgtcatttatgttttactaactgtactaaaatatttccaaattagttttgctaccttgagctcaataaagtactgccattggcatcttactttaagttcttaatgcatattccacttattttgtattccaaatattatgttgtaaatagtaaagaaaaattattcttatcaatgatgaagaaagattttcatactctggtgcattaatatttttctgaaatatattgtcatatcagaaaaaatgcaactatctgaaaagaggattcttccaattttttctataaatatgttctataaagcaattgtactctccaatgccatcttgtggctttttaggattgatgaaaatgcggtaataaacacagaacacagggagaaataaacatgggaagaaaacttctgatgaattattgctcagtgattattttacttgatcttaatactgttcaaacatttatttgccctgatttattgccttaggttttataaagagtatatatatatttctcctatattttgctacatttttataatagaaatgttcattgagatcttgtaaggagataaaaatatcgtatttttatgatcttagcatcatgtccatttgtagccctatattaccagaattcaaattattttgacaagtgcattgatattatagacttattaaaaatcctcttttaatacattgctgtcattaaggtcttgtcattttaataattcaggtgtcgaaaggagaaaaagtcattaaagattttagttgctcactattataaataagagctgctgagaagaatatggaagtgaagatcttgtgtggatagatgtgtgcttcacgacttaggttttcctgctggtctattggacaggccttggaataggagatgggagggcctaggtagaatcaagctaaatggaaagcactagtcatcaggcaaagttaccttgaaaaagcagttacttttatctgcatgtcccaaagaatgaagaccaagagaaattattggtcggcaatgttttgtttttttaaagtgaaaaattttcaaagggtcttaacagttataaatgcgttttcaaacgaaaggcatataatacaccccccacacacgaaaatattagcatgctaccaatgttttcaaactttgataagaatatttttcctgttatgagcactcatctaaaatatgtacaactgtacttgattacgtgtgtttcttttaggattttatgcatggaacctacttcttcttaaaggacaaagtaacaggttgtgtacaccaatgttaacaagcatttattgaattcctagtatataccaagtgcttgataacattgattcacatcagctatgcctgggcataaaaaaggttaaaatgtttagatatttgtttgtagaaacttgccttttgtattctttatttaaaaaacaaacttgtggaaaattttattaatagaaaccaaggcaatatgatttatctttattaatttgatcattcttagttttctatacctatgaatcatatcctgaaaattgtttatataatttcctcataactttgctgatttttttaagaaacatatggagtgcttatttttgtaactgcatgcctttttactttataaaatccatgtatctgtcatgtctttggaactggtggtgctataggcattgtcctttcatattcactagtcagttctaatttattctttgtatttagcaaatgttttcagacaaaacatactgtaaacaagcaactggactgaattctctgggggattaaaaaagatgaacaatctaccacctctgctattaaataccttgcaaaaaataagtgatatgagatatcatacatgtatagtatattactttcctattgtagctgtaacagatcaccacaaatttagtgtcttaaaacaacacaaatttattatcttatggtgatgaaggtcagaagttctaaaatccaggtatcagcagggatgcattcctttaggaggctccagggaagaatctgttttcttgctgttcccagcttctagaaaccacctgtattacttgtcttgttgctccttcctgaactcaaaatcatcagcatagcatcttccagtctctgtaacctttacttctactgtcacatctccttctctgactctgactttcctgcctccctcctgtaaatatccttgtgattacattgggcccaccactttaatccagaatgatctctccatctcatgatccttaacttaatcataccttctaggttccttttgccacttaacagtcacaggttctaggaattaagatatggacatctttggagagtcattattctgtcaatcacagtggtatattagagtagcttttacataaaatagtttgatatggatggaatacatctatatcagggcacagtacagaataagtgatgagggagtgtcaggagaaaaggtggaaaaagatagatgggagccatatcacaaggactttgtatgacatgacaagaaatgctaatattatgctctaggaagtcaggaaccattgaagaaattgcagcagagcttagtaggaataacctgaccagatagattggaaagagctctaagacaagagagtgggaaatgaggccagtagtccaggtaagaaagtcatgaactgagccagtaacagcaggaataaaagaaagagagatggatttgattgctagtaaaaactggaagtaataaaaactagcaggtgattgtacagtgaagagagggaggtggaaggtaattccagctgcttttattaagttaaaaattctgttgagaactagtagctaatgttatatttctagtctatatttttcctggtcaaatacatttttgggttttcaaaatgatgtatcttttgcagtgtggattccgactgacaaattgtacatctgaaataaaaatctgcgtttgggtccactgtagggttctttcaaatgtcttctacccttgtgcctataatgaagtattgtatcaatgggtcttgccttgataatctcagtgaagaacttcaagttaacacagggagaagctttttatttttttaagatgtcaagtttcttttagtatgtagtgctaaattgtggtatacctacatgcatacacacatatgcacatgtatccactcaaatatacacacagttaactattaattcacaaaacacacttgtattgcagctttcctatatgccagttgctgaggattcaaaaacaataagaatatatgatcgctgcattttaaaaatatctgttttatttacctaactaaatagtataagctcgttgagtataaaaacatctttatccgtttttatatgtatacatatatgtatgtatatatatatatatcttttgtaatcgctatgcttaaaagagtcattgcataatcagtactcagtacatctttgtatttcatttctggatttaagaacactgaaaaatctcatcacagcactctctattttcctgtggcaatgtacatgcatgtcataactcttctctgataccagaaactccttgaggaatgatctctatataggttaagttcattaatgaggctttacacatagcattatttgaccaattgttatataagcaaatgaataattttaacttacatgaaatgaatagtttcattagagtttacatttctctgaaaaggaggaattaaagctttatttttagttggcagggtgacctgaccattcatggttattgtgtataatcccctgctgaaattgtaatagctgaagctgaaagcactgagactatactggaaagtgaatcttgagatggcactccttctttagctccaaagggcaaattttcagttactttgttataataggaattgtgcagcttttgcctccttcttatctttgagagattttgccatgtctgtacatatgaaggtcattccatgaaggaagagcagatacacaaaaggactcctgcatggaagcgtggctggaaggagtaaggcattagccaaagcagctgctcaatgtctccatgtctctcagaacggatcataacaaaccctaggaatgctggtgaatagaagtggcctacaacattgagggtgtttaattttaattcagaacataaattagttcaatttggcaacttgcgcattcattctgccactctaactgacatgctgctccgtgatgaacagtgatgacttactgtttgtttcaaaggcatgttttcgctttctttgggagacgtgcttggtttgttttgttcaatttttaatgatacatgattttattttaaatttctttggaaactgctttgtatcctagggtttccggcttcctgtgaattgaggagaggttattaccttctaagttttcaattaggaaaacaaagcaagtttggaagctccgttgggaccttgtaaaccctctcaaagcatgttctgaaagagacaatttttgtgcaactagctctaattgtctgagatgagactatctacagaagctaattggagagtgtctcattctgcagcatgtatggagtcagcagaatagtaattttgctttcttgggttgtttttcctttttgttgttgttattttgttttgtccacacttcctttcagtacctagcattttaagataaatctttctcaatttaaaattacttatctctaatggtaaggctcaggatttccatatagacccttcccaaactctgtgtaataatgttcctaaatcctcaaccattctttagacctaatatggaattagtaagcctttgatggacttgtattcccttttgctttacctggatgtgatattaaattctgtttcaattttaatgtttgtgttctgaattacagctggtaggtacagaatagtatttatcacattttctttcttatgatcaccacctgagtgattacgttgttgacatattctgaattagacaagaacatatgctcaactaaattgatgccttacatagaaacttgcatataatgaatttcatttgtgcagttattttaatttttgattacactttttggttttagttttatgttttctcatgcttctctaaagctgttccatcatgacttaaaaactaagacttctctgaaacttggaaatttattatgcagatctcataattatcctaactagaaaccaggttcaatataattaaggaaaaatatttaaactttatagatgtacgccatttgttctcctattcatcctacatttgatttttagtttatagtctttaataagtggggaaaacagaattacattgacactttttggatttaattggaaggttttcagaaaagctcttttgcatcagactatctcttctacaaatgttctagtgatgactgatgactctagaagaaaactccatcaaatggaaggtagaagaggagtcccaagtaggaggcagctgagaatgcagagtaggagaagcttctgaggcagtgtatcaagtaatatgtaaggacagagtagagacttgtgtcttcctccttcttctttctgtgtccaaggctacactttgccattatatgattttgacatcaaataaaaccagttttcctcgcagtagattgaggcaggtattatgaagaaaaggatggacaatgccagtggattaatggcttaactcagacacgtttctgttgtgaagaaaccttgagacaaagtttaagactgggaaaaataacattaaaatcagatgttttgagttaagaaaaaacatatagatgctgtttgagatcattttaaatggaaacacttagtttatgccaccatgtggttataccacaccatctgtaaattagtgttcaatgacacattattaaaacttatacattcaaactcatggttaattttaatctagatgcctacatctctgcgaattgcaagcatgtaaaactgaactcaacttgcattaatacatgaagagttaatgagaaactgttttcctgtgtatatgaatataaatgcatgttttactatttcatatagataatttatacattctttacatgctttatgggattatgtagttacatatttatatgttataatacttgaattggaatgggtattaaacaagacgtaggcttttaatatgaaaatattaatatgctttaatataaataagttaaatattttttggaaaacaaattaggtattcattgccagcttataaatatgaagccttttaaatttatacctcactttagccaaaagaggttacgttactctttgcaattattatttttaggagaaggagggtatttttctactattgttgcttttttctcagcatttttgagtcaatgggtgaaatgcttttactcagtgctgtttttgcaccaagtacattgttattttacccattgtaaattattctctcaatggtttaacaggctaaacccttaaataagaggtgtctttttttaaagaaaatatttggaaacgtgcaaatgaaaagagtaaatctatttttggtcgggttgtccaaactcttcttaggatcttatagctagtatttgcttttttaatggctgtttgaggtgtgtttaatttaacaagaatatgccagggatttactaaattatataagacagttctttttttcaaaaagtagatctagtaattttatttttcatttaatactcattcaacatataatattttgagttgtctactatgtgatacctactattctaggaacttaggataaaatgatacatgcatttctcatgaagagtacagcctagtgggcttaaataaacaagataatttcataataattcatgctatgaataaaataaaacaagttagcatgatagtgattggcaaaggtagttacttcagatagggaggtctctttgcaaagatatcatttgagttgagacttgactctgaaaaaagagcccattaagtgagaacatgggaaaagctcattccaagcaggatagtgagtaccaaagatatgcagcagtagcaaacaagacacatttaagaaatagaaagatggtcattatggatgacaggtagtgacgaagaatcatgcagtgagtcaaattgtaaagttttcaaagggtgcagagcaatgattggaggagtaaaatggaaggaaatgttggagaattagccgtggccccttaggtcatggtttagagtatgcattttattctcagtgtaatgcaaagccattggaatctagcaaatggaagactgagtatatgatttacattttttccaaagaatctttttttttggctgtggagtaagaagctatttaaatcatcctagcaacagatgacagttaccagatcttgggtattaagtggaagatggagagataaagactggttcgggtacagtttggaagtaaaaccaaacaggacttgatggcatactggatataggggatgaggaatatgtaagggatatataccatataaagaagcacagatgacttctaagttttatgagtaactgtattgatggtgggactatttcctgagatggggaaaattagaggagggagaggttcctgttttcgaaatgtagaattaagttcgagattcctattcagtcttcgagtggctttgtcaaggagtctgcaggcagctcagtggacaggttaataatggatatttaagtggaaggagccattggcatgtaaattgtattgaaaaccatttgcctggatgagatcactcaagctaagtctaagtagatataaaaagtagaggttgcaggacagaaccctaggatacttcaacatttccgtagttagtaaagaagtgagataccagaaaagtgagagagaaaatatgagtgtgatttcatgggagctcagaatgattcaataatacgtaattaaatgtattgcatagagctgagaagtgaaataagatgaagatagaagattgctcattggatttggacacaggtataactatcaataatgtaaagcaatcaatgaatatcacagaaaagcatagaatggtgggtaggcagaagtcaagggagcaagcccagaagtcttatttgcaatatgggcatgacactgcagcaaatttaaaatcttctattgaatgtaaaatgcatatgaattttttttgtatgccactagatagctaaaggtgaacatgtaggccaaatggaaaagcaaaaagaacagaagcatagagatcaaactattttagggaacaaaaactagttaacatcaaattgattgaaatttgcttcacaaccccatatttctcatgcccactgtcctatgagatctattatgctgttatgtaatgaagagctgtgttaattattcctgccacctgcatctaatgaaattagatgtgaaatttctgataggtacagatggccacttgaaaaaaacaatccagtttttcttttttttctatcagctggtcaaatctcataagttagaaatgttcagactataaaattaaccccagcattcttcatttgtatagatactaagtataaatgacaacttcctcaagcccaaataacttgtttggatttagagtttaaatactatccaattaagtgtatcatgctgacacattgtcatttaatactccctttggtagagggttaagcttgttgaattatttcaacttaaataatctgataaccctctcccagtttagttcagttaattttatacaaataaaattaaatctcaaaatgcatataaagtaagagcataatacagtatgtaatggggcataataaagttgccaatattataatgaagcgcatagaaaaagtgtgacctattgtaattagtaatgtgcacctctgacaaattgtaaagcatgaattttcctggtaaggaaaaagagaatgtgtggtaatggtagctaaaatcctattcgttttgcatagattgctatcaatattctgaagctgagggttgttgaagttggaatttagatggttgaatgaagatgtgctctggaaattaggagtacagatagacccacatggtcagataaaggaaggctgacagaataaagaagcaagacatgggttggttacttgagttgtggagatgaatgtgaaataaattgaataagatacaatgattagaaattgatacattaagcctggagatgaatacaatgattacgaatatgttcagacccacatatgtaccaaatgcaatggatgtcagacatctcactgtgaaagcaggtgttgagatgtgcaagacttaaggtaaccacaagctgagagaggagcagaaacatattaagaattctctaaataacagtattaaacaaaataatgttgaagcccagaacgtcagagattttctttataactccctcatatgaggtgaaataacctacttaaggttgttcaactggttgtgtggcctactaggttagaccatcagagacagtgtggtcctccttggatgagttgtttaggagaattatacatgatataaagaaaggtcacagccatgtgttagaaaccgacctttgtgcattactccttctgcaggattccaggggaagaaaaatcaattgctgactaaatagcatatttgaattacagagatcagcaacagtataaatattgcaggaaaatttatatataaagaaacttctatgtgcctttattagttttgtccacacaaaatgaaacaatgtgtgtatatatatatttttttcaggcaagcacccaattgaatttcagaaatcagaaaacaaataatttaacctttctttttaattcaattatattgatttgccaaagaatcactctctgataaataattttaaagtgtcaactctctgaatattgtaaaatatgtaattttgggtaaatttaactacatattcttggatccttaccattttcttctcttgaatataaaagatttagaatatgtcttgatgattttttgcttgttgtaattaaaatgtcaaacttaaagttgttaaaatgtacatctctctgatactagtaattcttttctcttttaaaaaacatacttatccagtatttaatttcatatgtctagatttgcttaggcaaaaggtagaagtgcctgctcttcagtttgcacataagctaatatagtttaatatatataaatgaatgtgtataatagaagtatattcataagttagaacgtgacatattacctaacataaaacaaataaaacagataactcagtagtttgaaagggaagcttaagggtaatactatacatatagtgtcataacactatcatgaaaatctctgttaaacgctgtctcctcaggcacattctgttaactcttcctaccacacttgtcacattacccagtttcattttcttgacatcacccagggccctctgaaagaattttctgtattaacatacttgtttaatgttccactgtccatataagaatgtaaactcagtcatagaagatttttttttcttgttcacttctatatcccgagcatctcagaacaatacctggcatatgaaagatgtttgataaataccaatgaaattaatgtttgaatgaatgatagcatttctgtttcgttgtatttttcattaaaaaattcaagtttctctcaactgatttcagatattccttcttttctaacatatgcatgcagcactatgaatttccctctaggtgctgctttcactgatccccaaaactttgattattgtcatttgttcaaaagattttaacattttttggaaatgtcttttttgagtgtggattatttagaaatgtgttatttaattgcaaatacttggagattttccaggtatctttctgttgttgatttccaatttaattccattgtggtctgagataatacattgaatgatttctatccttttaaatttgttaggttatgctttattgcccagaatgtggtctatcttcatcagtgttccatgtgagcttgagacaaatatgtattctgccattgttagatggagtattctataatgtcaatgagttaaaaatgattgataatgtgactcaggtcatatatgtccttaatgattttctgccattttaatctactcattactgatgtaggagatgtttaagtcttcagctataatagtggatttgcctgttttcagttctatcagttttggcccgtggagcttgatgtgctgttcttaggtgtaggcatgtttaggattgtaatgtcttcttgggaaattggcccctttattaagtaatatacctctttattactgataactttgcacatttggaagtctgaaatgtcttaatacattaatgatcttaaataaactaaaactccagcttgcctttcgagcactgcacagtacagtagtttctgatctttctgttttgcctctcttagtgtggaatctctgccctgcaaatgagctgagtcccgagtgaatcaggacccacgtattctgtcctatgaaggctgagtgcaagaggagattacctcaacttcttggttgcactcacagtgattttgcttcttgaaattggaattagaaagaaagagaaatgctagcaaattgctcctcctaatgagttacggtaatctttgattgggaaataaagctagagagtgccccatcttcttagccatatccattagtaattgagcttttgcctagttgagctgtgtggaaggttgtaggaggaaaggagcagataatggttcaaatgccacagactcccactattctaactgaattttagtatgttttcttgaataaatgtttcgttcacttactatattcctttggggcaattttcaggtttgtgtgtgtgtgtgtgtgtgtgtgtgtgtgtgtgtgtgtatgtgtatgtgtgtgtgtgtagtttttaaaaaactgatttcacaagttttgcttgtttcactagggaatggtccatagagctcatcatgctgtcatctcaaaagtggatctttccaactttcctttgattagtgttagtatggtatatctttcttaatcattttgtgtgtaacatataggaatattcatgtttaaggtgggtttcttgtacacagcacatccttgtgtcttgattgtcttaatccattctgaccatctctattttttaattggtatatttagactaggcccatttattgtgattattgaaatagttgggttaatatgtacatgtttgcaactgttttctatgcatttgttctttgtatatttttatttcccctctttttctggcttttctggctttgattgagcatttatatgatccattttatcttctctcttagcatatcaattatacttctattttaaaaaatcttggtggttgccctagtatttgaaatatacattattagctaatctaagtttatcttcaaataacagtatactgctatatgcatgctgctggtactttataatacagtgatctcaaatttttcttgtattacctatgacactgatattattcacataatttaccctcatactatatttacctaatacattgttactattattaaaattagcagttatataatataagaataataaaaacaaaatactttaccttcatttatttcctcccttgatgctcttcctttatgtagagccagatttataacctatattattttacctctgcctgaaaaaacatttcacatttcttgcagggcagatctgctatgatgaaatccctcaagttttgtttgccagagaaatgctttatttcttcttcacttctgaagtataatttcagtgaataatgaattctagattgatgttttttctttttttattgttacatgatagatgtatacattttaggggcacatgtgatgatttgaatacattcatagaatcaaatcaggataattgggatatccatcaccttaaatatttatcctttctttacagtaggaacattagcattattcttctctagatattttgaaatgtataatagattaatgttaactgtagtcaccctactaatttatcaaacaccaggccttatttcttctatttatctgtgtatttgtacccattaatcaacctcgcttcatcccctcttaccccaccctgcttggcctctgacaaccattaatctaccctctatcttcatgagattcaattttagctcccacatatgagtgaaaacatgtgatatttgtcttcctatgcttgtcttattttacttcatttgatgacttccatttccatccatgttgttgcaagtgacaagatttcattcttttttatggcagaatattaatctattgtgtatgtatgtgtgtttatgtatatatatatatatatatatatatatatatatatatatatatataatttttttcttaaccattcatccattcatggaacttagattgaatccatattttggctattgtgaatagtgctacaataaacataggagtgcagatatgtctttgatatattgattttatttctttggggtgtatgcccagtagtggaatgctggattatatgatagttctatatttagttttttgaggaaactccatgctgttttccgtagtggctgtactaatttacattctcacaaacagtatatgaggttttcgcttccttcgtatcctcgccagcatctgttagtccctgtcttctggacaaaagctattctaactggtttgagatgatatctcattgtggtgtttttaaagtaattttaacctttattttagattcagggggcacgtttgaaggtttgttatatgggtatattgtatgatgctaaggtgtggggtacaaatgatcccatcacccagttactgagcatagtacccaacagttagtttttaacacttgccctccttcctccctccttcctcgagtagtccccagtgtcttttgttgccatctttatgttcatgagtatccagtgtttagctcccacttaaaaatgagagcatgcagtttttggttttctgttcctgtgttattttgcttaagataatggccgccagctgcctctacattgctgaaaaggacatgattttattcttttttaatggctgcatattatgccatggtatgtaacattttctttatccaatccaccattgatgggcacctaggttgtttccatgtcattgctataatgaatagtgctgcaatgaacatacaagtgcaaatgtccttttggtagaacaacttattttccttggggtatatacccagtaatggaattgctgggttgaatggcagttctgcttgaagttctttgagatatatccacaagctgctttccacagtggctgaactaatttacatttccaccaacagtatataagcattcccttttctctgcagtcttgccaccatccattgttttttgactttctaataatagccattctgactggtgtgagatggatgtatctcactgatgcctgttcagttctcaataaatctcagctattgtattgttaacagtaacaataatgtaattatgaatcccagtgtaaattatttgatatataaacctaagataaagacatttattcaattatacatatatgaaatttgacctgatagctcttcatgaaacttataacctcttatctggaattattgtgatggtaaagggatcaccattttaaaatatatactcagtgatattttctagaaatatattataagcaacaattgtataaggaagacacaggaaaaaaaatcaagtttttcttatgaccaatgtcttcccactctaccatttctaagacctcagatactggatttcatgtactgtaacctatgagtcagtaaccatcaactcccaatatcatttcatttgtagtaggtccaccatgtatcaggcagacctttcacagtgatagatagtatacagaagctaccatgctgagatagcaacagtttgccataatctcatgaaacaccactaataggagactgctggcagagtcaatataatgcataatgtgcttagagacatttctgaaccaattgtaccagtcatacatctagcacagaatagataagtaaatggaaatattgactttgacacaggagacatgttttaaacaagaatacccaagctggataagatttgaggtcaattttggtaacttttaaaaatatccctgtctaagtattgtgacttttgtcccaagtgcacattactagtcactttatcttaggatacaggcaggtagctaagtaattaattcttaccaggcaggttctgctaagcctcctctggaagatgacctttttaaaatgttgacctcacatatagctgaatgatggatgtgtcacttactggcaagctcttttctgttttgatggggagtgtttaagatcattggacttgtagtccacctggtaaatggtgacaggattgtgagtctggatatgattgagcagtttagtaatatatataattttcatgactgtctgaaatctctagacaccttttcacttttgatcatgatttcaactgctgccgcctgaattacaaatcaaatgttagaacaatacatcatgatgctagaggcatagcttaggcatgccagcaagccaaatattgagttttgtgaggggggttgtgaaagacaactttttacctatttggaactaacttgaaagcatagctttagatttacaaaaatttaaggacacggggattgctattttgttaaggcttgtttagggacattgaaccttaaaagtctcaattttgaagaagtagtgattaatatcatttgggacaaacaaagattttagagatgaaatggtaggtgaccttgaatttgtaatttgtttgcagtgtatcccaattaagagcgtggaaaatctctggttaatatcaaatgtaagtactctacattgtaaaactggcagtaaagatgggaacatctctgtaaaatagttttatcaaatgagtggcttagtgtaagaatttgatttaatttatatatatacattatattttatatggaaatacaacaacataaatacatcaaatgtgctttcatcttagactctgaaaattggttaatgcctgaaaatttctgaagtcctggttgaggtttgctgtttctcaggtgacttagggctaaggatttataacttgattctaataaattctgtatgtaaaataggttaactttatttaaaaggtctcatgaaatttttaagtgattataggacttacacttaagttcctgagctaaatttcttctgtcttataatctgactgatgtcttcagtatgacctctagcttctgaacgtccattattttttctcccgtacactctagtttctctagtactatcttgagaaattacagaacaggtatttgtgaaatattggaagcatgtacatagttcctgtgttattcatattggggatcagtaaaagtattttaaagctagatgtcatagttttattcctctgtctcctcgatatttactccaaaaatgcaggaactctacaagaaccatggaagcatgctactatgtttgtgtttatatgtgagttacaagtcagtccctccaaacacccactccccaggaaatatacctggacatgttcatcatcttaaaactactctgatattatactataaaaataatgaattattcccttaaagaagtatagatgtgtctgagaaaataaaaacccatgaatcttcggatcctttaagaattatttttttggaatcttgatatgtcaagtgattcaaaatgtttgttatatatgtgcatgtttgtgtgttgcagacaagataattatatggagcaagctaattaatttattttttcttattaacaatttcttcatttactgaagggtgttttaaggtaaatatctttattacaactaaaaatgtactgaagaatatgtcgtaatattagcaagatttgcctaagcctgtataaccaaattggctaaaacaaatatatacactcttaagataaactaaagtgaagtttaagccatacacatattgttatgaagtctaaatttttgtaataagaaataggaattcatcactggcaagagatttttagttgtaaatgcttataaacattttgcaggtatttaaaatcccatttagttatataaatcattctgtggaaaataataaaattgtgtaagatcagaattgttccagaaacctaggatgcaggttactttttaaggataactccagaggcaaaattaaatatactcattatcaggttttatatactcattaatatatgtatatgtaacattaagaattgcatagttttttccatttataccaagggaaacaaattggagcttttaaataaagtctttgatttattatattttctccccacagataaagaacttttgttctatttttacctttgtgattactgcataaacatagtgatatatatatatatatatatatatatatatatatatatatatatatacatgtactgtatctacaaatgaaagaacatttaatggaattaagatactttatcagagaacagtctatgtttactctataaaatactacctactcaaattatccttttatattctcaatataaaaatgatgaaaacaaaatctacaaaatgtatgaagataaccatttgggggttttgtttttagtttgttcaaatggatactttactccactgtggaaccagtgggttttgtccctgatgtaacagtgatatttatataattaaatgactatttttgaaaatgaccctcaagataatctatacctgcttcttccttataagtgaggaaactgatgtctgtgacgatgaagtgactgacttaacggtatgcatctaattggttgcagagcctggattaccacttttgatgtttctcacttacctgagcatcagtgacatatatcatttggtgcaatgctggtttacaccactcactgcttcatctacctgccttgttattcaaataggaacaacacattatatcatgggattaatacaaatagtaaatgtacatattagtcaggaaatcagaaatcatttcaggttttttaagtcggaagagtttcaacttaagaaattagagaactacataaccaatggaaaaactgaaaacagagaggtcagggaagctagcatttgagttcacgaaatcagaatgttggatgatcaggaagccattgctggctatatgtgcaccaaagtgggtggttcacaggaggagctcactcaggagctgccacggactcctcatctgtcatctgattttgctacagctgcccttggaaactaatggcccatttttctctcaacccccaaggaaagtacaaatgcttcgagttggctgaaacagttctggaatatacaaggaaaggagttacagaaaatgtagttacaggtttccccttgtgatagagagtacaaaggggccgtaatgatgctgagttgacaataggcaacatataaaccagcatgaaataataacaccggacgctgtcaagcacagagaggtgtttggtaaaaaatattaaaagaaatataactaaagccaatgcctgcatttttaaaagaacaaatttaggacaaattgaaacattttaacttgatttgaaattatctaaccaggaatggttaggcatttacttgaatttagatttaattaatacatgcacatgtatacatataaaagttggagaagtttcatgatagttcttcttgtttgtggggtgtttgtctgaacattatctatatttactttgttcctagatttttttaatggagaatatccattcagtataacattcaaaggttcttgggattaggatgtggacaaaattgagggtccattactcagcctacagcagaaattgtagttccagtaacagtatgtaaaattacaaaaatcttttaagtttcccaaagacatttctcagtgtactagaacactttctaagcagtattgtcagtgtacacagaaatgcagatatgtatggtaaagcagtacattgtgatgtgggttatttggacttgagtcattttgcctagacaaaaagaaacttttttcctttgcaagtaatattaccaaaatatttcctagcctcatttgatctctaagcttcaccacacccctggctttcttcagccctagtgtaaggtgagtaatgggttgtgcatgtaaagataatgcgtaccacggtgtaagggccagaaattgggtgaagtttactgatggaaggggttatttcttacacattgcttcagttagcatccttttggtcagaagaaacaaaatctaaatcaaattggcctaaattatgacagagatgaatatgtttattatttaaccaatatacacagacacagggtcggctttaagcgtggttcatagtttgagttagaggttttgatagcattaggtctccagcttgattcctctgtgattatgttggctctgttccctgctttcccctcccaccatccacttagtttgttttggggtgatatacgattgacttggaagatactaaactgtacacaggaagggttccctcaaagagctcctcatcatgtacattccagaactctcctaaaaaggattcatctgcagtctcatagtaccttgtctgcagtttttccttaacctcctttaaatcaaattttatattagttctctgtgtacacattgataatgacttgttaaaccagggtttagaaagcagttgcctgtggaacacatgtggcccacagcgtgtttttgtgcagcccacaagctaagaaaagtttttccagtttttaaaaggggtgtagaaacaaaaggaaaggaataagtgactcagacctcatgtggcctgaaaatcctaaaatatttgctatctgaccttttatagcaaaaggttgccaacccctgtgttagactatcagatacaaggaactgtcttattcctgacacattgctgttgtgcctaatgcagttgtttccacatagtgctgtcatccttaaattgttcttcccatctaccctccttggtcaagcttttctgtttcattcggggaggacatgttgccatgggatatcttattaattcaggaggggaagacttgtgggagatggctggtggacatagatgagataaaaattctcaccaatgataaagtatctgggaactaaaaggaccttgaacaatgccctgtccaactgcatcttgctacagaagaagaaataaggacaagggatggaaggggtgtacccaaggccataggtcataatcagctgctaaggcatcatcaggaccctgcatcttggtccagtaccacttccaccaacccctgttattttttgtgacacaacatcttttccttataaccaactcagatatataccaagctgctgtatccatgcgaggaccatccgagactgttcttttaacccaagagtttcccagaattccatagttactgctgaaaagagtgagagtgatcaagaactttcttaaaaggattttctctttcattgtgtttcattttcttcaacccatctcataatacctcttgagatttctatagtcctttaatgctatgtccttgttccttcccggtagttatatttcaatggccctagcttcaagatgtctttggctgctttctaggagatctcgttgatattatctcatttatttattgaataaaggtggtgacaaaaatgtaccagatcttgacggtaacttatgtgattgttcattcaaagattgctaatggcctgttaaagcccttagatttattaatttcctcatatctcattctccttgattgccctctcattccaactattaactggctttgtaactatagctattatggtacttcagtctccaacttgccttccgatttttctgatagctccttcccccttcttagttctaattttttcttccaccacctaagtatgataactcttagtatatttatttcctattactgctgtaagcattatggctaagtgacttaaaacaacagaaatttattgtcctagatttctagaggtcagaagtccaaaatggggtatatgggttaaaattaaggtgtcagcacaactgtgtacttttggaagctctagggaaaaattaatttccttgtcttttctagcttctaagagaggcctgctttttttgccttgtggctccttcctccctcactccaagctctgtttctgtaatcacatctcctttttctgactttgaccttcttgcctccctgatcacattgggaacactggaagaatccagaataatcttcccatctcaagttccttaacttaatcacatcagccatgtcctttttgccatgtaaggtaacatgttcacatattctaaggattaagatgtgtacactttgggggccactattctgcctagtctacttagattgccaccattggatctcagttgcattttatttttcaatcttactggtaccctctgcctgtttaaaaatgtaaattgttttacaaaagtatgccttgattcataaaggttatttatttgcatttcaaacttgttttctgtaaaattattccaatcgattcttactttaatttacctacacctcaatttaagctcctattaccacttgaattgattccattcaaataatatcatttgaccccctgatttcatcatctggaccatctgggtactccaaaagagtaacctaaattacttttcaaagtttttccctttactttatgtattctcaacatactttattctctcccattgctatgctttttctttggtgtctgaaattccttctttgaaaactctagtcagaatttcttatcattattcaaggtctgtatctcaatggtgacttcttcaaattaataattatttataccacaaatcctatgtgtctcaaccccttttaaattctgcccttccccctattgaattttgttattgtatctggcagtagtcatttttctttgctttgtgttttatgtaactgtgtagtgttctgtcctatcctcctaccacaccacccagggaagagaaaacacatcctgcccagattcatatctcctaagtcctgctccgatgttttgtacatcaaagtataaataatagcattactgtgatgttatttaaaattacactgtatgtggctgtgctgatttaagatatgtgttgaagaattcacctgccagccaactatacctaaatgactgtctcctgaatttatttcattaggagactttttctgattttaagaaacaccttctggcatagcttctgagttatttttgaaaaccctattatagttatgttggatagatcaagtaatccagggtatgttatgcaacataccctttctgtatttgtgtattcattagttgcattcatattgactgagaaacactgtgccaatgttatgaagggtatgcagatgtgtatgccaaggtggctgtcttctaaaagcttccaggaggatatgttccactgtgacttttccaactacacaacagcagaattctagcatttagcatgtttgtgaaactcctagaggcaattaacacattatgtgacagaacctagctccttaatggtattaaaaatgcttttttgaggccaatgagaacttgatatacagcaggataattctttagaagtatcttttatttgacatttattagaaatgaagttgtcatgaaaaggcatggatgtttatatgctgctataagatagtcatctcagcaggcattttgatcagtcattacctttgacagagaatggcacaatagcatgagagcctgcagagctttctttaaagatggttcatataataggggcatcgtgatacttggagtattaatccaatattgagggaaattccgtgcccctaatgcttgaatatctatgcagattttggaatatgtcattttcagtagctttgacagatatgtaaataaccatttccccaaacttcataattgcccatgtcattaatttttctttttactgttgcagaacattttcctctttacactcaagaggataaattattattgtggttccatttcattggaaagcatacacctgcatatttgagaatctttaacatttgaatgtataatatataatataattaagtaaatcttcaggtattgaaaatgtacttttgaataatcacgttggcctcctgataataagcagtgaatagtaattgattagattagtatgctatttttttgaatatagtagcagtgactcaataaggtttaattgcattcctgtaaacatatggatggttcaagaattacttctttgtaaataatataaattggtaagactctgaagtgaatgacacagatttgatatagtaagacatttgaatttcagcttctctgagcactgatactatttcatcattgaaatacaaaattatggaaatgctgaggaagaatgaatgcttatttataggcacaaatcaccaatattaagctgttatcaaaatctttacctaaatttgttggttgcaaagttctgtaataggcttaaaaatgtgcagtgttcagaaagtaaattcttatttgatttgccagatgcaaataatgtatttgttacgttcattcaattattaaagaaaatttatatcattcttcctatcttgtagggttgatatatattacttggaaatgtgagacaaacgaaatgagtgtaaaccctaagaatatccattggtggactaaaatgtaaattttaatttctgtattctcatgtagcttaactagcatttagcatgtttgtgaaactcctagaggcagtttccacattatgtgacagaacctacctccttaatggtattaaaaatgcttttatgaggccaatgatgtacaatgtacaataatgtacaatgtttatatacattgacttgctaatttattaagtatccacattttagcctcttagacctactctgaagttgacttaactttcaagatgaacagtcatttttgacaccctgccatccccttgcaacagagaaaggtatcctgatttttgtgattctctggcacctaatagatgcctcagtgatatagtgttcttatgggaaggttatattgtattttaaaacatgaaaataccagaacagagtcaggatcatgaagccaactctttaggggggtacattagctggttctaaaaccttttacctgtagaatccctattcttgctcccagatgctatattgttattgcagacatggatgttttagctccgttagcactggagacaagcttccctacaccatagtagtaatatagggagagagaaccagtacatcttgtgtgaaagtttctttgcatattcaagtagtttcagaggcagcccaattataagaattaggtctataatcttaaatatgctgtaaagatcattaattatctgtgtaaatattggagaggatcagcatggataattaaattgaatttatttgaacataggcagttttcacattggctgttgaagttgctatttgtgcaaaatatataatttactataattaggacactttctgagaagttttttttgatgtgccatattttcatgctcagcagaaatacatataaagcataaatattttcttcagctacatatttttatttaaataatctccattattttaaattcctaaacatttatattatttaaaaacctgaactaatctcattcttaactaggtttgtaggctgggagtgtcagagctatgtataggaaaatttgctgtctttttactcattagtctaatcaagactagaatagactacgttgagtgtttactcatattacagatgggactaaaaatagaagatttccaaattacacatttaatatgaaacaggaagtgattttgatgtagactatgtaaaagttttcttctgactttattaggttattttttaattcataaaaagaacccccaattgtcttgatcttttttctaaaatttgaacaattaaattttacctttacctacagtggctgtgaagaggatctatattacgtggtagttatttgtacatttaattaatttctcctgtcagtaggactgaaaagttttattcatttatttgtacttacagcaaagataaagttagagaagtaattaaaatgtgggttgttttgctttcccacaaatattgaatgtcattgacatttttgtatctcttctgttagcttaattaagagttgaattattttaagcaacagttgtatgttttagtcattctaaaagtttaatctacctgtgaaaatccacttttcacctgcggtattatgtcaaattgttttctctaataacacttttataagtacagtttatctctccttagcagtataattttgcaaatgtcttgaaagtttctgatttgtatgtgtctccactagtttactcttcttttttttgacctgggactagatcttagaatggtctgtacatttagtaatactcatcattttgctacttttagagctacatcctggtttcattgtcgtaaattgaaagataaatttagaattcatcttgccaatgagttcagacaagaagaacatcaaagtcaacatttaatgtgaggaaattgaatataaactagtacttttcatgaaatcgttatatgtgaacatcagtctatatgaagtcccatctcagtgaaatatctaacaaagtatggcctgttaatagtttcactatcatttcaagtaattttaaaatataacacgtttctagcattataaaataatttagaatataaaaggctcctttccatgtgcttattgccatttgtatattttctttggataaatttcttttcaaattctttccccatattttaatttggttgacttgagagttttttttagttgtccctagactatttgttgaaaagattattatttcccacattgaattgtcttgttagccatatcaaaaatcagttgactgggatttctattacctcaaacattaatcgtttacttgtgttgggaacattccaaatcttctcttctagctattttgaaatataaatatgtacaactattatttatcaataaaaaatcaattgactataaatgtgagggtttattttaggaccaccgatgtctgttcttttgttcataccacacactcttgattactgttgctttccagtaagttttgaaattgggaaatatgagtcctccagttttgttcgggttttcaagattgtttttgctattcttggtcgctggtaattccagatgaattttaggcacatcttgtcagttttggccaaagcgatgctgagatgttgaaaaggattgccttttgatagggattgctttgtcaatcaatatgaagggtatttccactgtaatagtgttaaatcctttgatccatgaaagtggatttatttaggtctttaatttctgttaacaatgttttgcagttttcagtatacaacttttgcacttcttttttaaaatttatccataagtgatttattatttttgatattattgtaaattaatttgttttcttaatttcattttcagattgctcattgtaagtgtatggaaatcaaattattctatattaattttgaatgctgtatccttgctgaacttggtttttagctctaataggtttttcatgtatatgtatagattccttagtattttctgtatataaaatgatgtcatctgttaatgcctatagtttttcttcttttccattatagttgcctcttatttctttttcttatctaatttccttggctaacgtctctggtacagtgttgaatggaaatggtgagtgtggaaactcttgtcttcttcctgatcttaggatccagccctttaccatttagtatgatgttagttatggttttatcatagatgccctttatcaagttgaggaagttcccttctgattccaatttattgaatgctttatcatgaaagggtgctggaatttttttttttttttttttgagatggagtcttgctctgttgcccaggctggagtgcagtggcacaatctcggctcacttcaacctctgcctcccaggttcaagcgattctcctacctcagcctccggagtagctgggattacaggcacccgccaccatgcccagctaatttttgtatttttagtagagacagggtttcaccatgttggccgggctggtctcgagctcctgacctcatgatcctcccacctcggcctcccaaagtgttgggattacaggcgtgagccaccgtgcccggcctggaattttttcagattttttttttcatcttttgagatggtcatgtggttttggtttcttattcttttaatatggtgtatgacattgattgaattttagatattaaataagccttgcactcttgggaaatattcctgttggtcataatatatgctttttatatactgctggattctatttcctattattttcttgaggaatttgcatttatatttattagggatattggtcagtagtttttacttcttgaattgtctctgtctggttttggtatcagagtagtactggcctcatggaatgaggtaggaagtttatcatcatctttgatgttttggaagaatctttgaaaggttgatgttaattcttttttaaatgcttggtagaatagaccagtgaggtgtgggaggtttaaattttatttgtgtcaagttttaagttactgatgcaatgcctttacttgttacaggtctatttacattttttgtttttgttcttcagactgaataagttgaattaatctattttcatgtttgcagattctttcttcttccagctcaaattggccatggtgtatctctggagaattttttgctttagttgttatactttacaactccagaatttaaatttgcttcctttatttaatttttatctctttattaatattctctggttgatgagatacaattattaagctgtcctttatttctttaactatggttttctttagttatgtgcatattcttgcaatcgctgatttcaagtctgtctagtaggttcagtacttgggctccctctgcaacagttattattgatggcctttttcttgtgtatgggctatacttttctattttgtgtgtatgtgtctcaaattttttttgttcaacatgggacactttagatcatataacatggctactttggaaatcaagtctgtcctcctccctgaagctccagggtttgtgtagttgtttatttgtttagcaactttccttaactaattttgcagagtctgtattcttttttaaggcacagccactgaaatatcttcttggctaattcattgctcaggtaatgattgagaatttttaaaaatgccttgaaccagtaattctcccaacctttgcccagggtttctctctctctctctctctctctctctctctctctgtgtgtgtgtgtgtgtgtgtgtgtgtgtgtgtgtgtgtgtgtgtgtgtgtctgtatgtgtaagcacattttcaatattctggcaatttacaactctgccttagccttttcttccaacttgtgtagaggtgggagattaaggtgatctcacgtcttttctgggcatgactatagctctgaacttactcacagcctactagatccccagaaatatttcagagctttgcaaggcctcctatgaccatctcattttatagatttttcttttacattttttgtctatcttcttgtttgtcccatgtggcttcaccacctaaggcagctgcaaggctaaataattgagactgatagtttttgccatattagggatagaactttcctcattgagcaaattctgagtcaggtgaaataaagagaaattcttgaatggggtttttcagccagctaccagagagataaaatagtagtagttctctggggatggagctttgtgacgagctccaaaccagtttgtcctctttattggctcctaggctattgtttttttcaaggctaatacagacttggggaaagagggatggaaatagggaaagttaaaatataacagtgtttgttatttttactaaaagtcagccatttttcttgaataaatgctgttcagattgttgctagattttgtttaattttcagagttctgaaaaagttgattttgataattttctggatttttttatttcatggaaacaagaatttcagagtttcatactccactattccagaagtacttctcattttaatatttttgttttctttatgatataatattttgacaatttttgattactttgtacttaactttttaaaaaagctattaatggtttcagttttttaaataattacaatagtgcttcatatgcttgaagtacttattcttttttattattattttatattgatataataattgtacgcatttattgggtatagtatgatattttgatacatgtgtacaaggtgtaatgatcgtcagcgtaattagcaaattcatcaccacaaacatttatttctttatgttaggagcattcaaaatctttcttctagccatttgaaaatatacagtaaattgttaattctagtcaccctgcagtgctatagaacactggaacttattcctcctatatcaccgtatttttgtatctattaacaaacctctccatatcctccctccctcctacccttcccaacctttggtaatcactattctcctctctacttctatgagatcaatgtctttatttactcgaagtactcttaaaagtttaggacttaagtatttgaagaaattcacttgctttttgtttttattctactcaatactttttaatataaagatttacagtcccccaaattctcttttcagaatcttaatataattattcatttcgtcctgaaaactgtttctttccaaaattaaacatttgttgtcatttaataaaaataaaccagaagtagaagagctggaaaatccctccaagttcatctgaactggagaaaaatcaagtctaaattactaaatattttgaaaagtacagagttttattacagtaaactttgacaagttgcctttatttggaaaagaaataacctatttttctatattctattttagagaattaaaatacatttaaagccttatattgggttggtcaaggttttttttttttaaaaccttagtagtttatttttgtattcaaagtatcttccagcatgtctgttaaatttcttatttttttcaattttttttttttttttttagattcagggggtacatttgcaggtttgttgcctggctatattgtgtgatgctgagatttgggatacaaatgatcatgtcatccaggtactgagcatagtacccaacagttagtttttcaaccctccctacccccttagtaggctctagtgtttattgttaccatctttatgttcatgagtacccaatgtttaacttccacttataagcgagaacatgtggtacttggttttctgttcctgcattaattgacttaggatgatggcctctagctgcatccatgttgctgcaaaggacatgatttcgttattgtataaaaaaccatacagctgcatagtattccatggtgtataggtgccacatattccttatccagtccaccattgatggggcacccaggctgattccatgtctttgctattgtgaatagtgctgtgaagaacatgagggtgcatgtgtctttttggtagaatgaattgttttcttttgggtatatactcagtaatgagattgctgggtcaagtggtagttctgttttaagatctttaagaaatctacaaacagctttccacagtggctgagctaatttacattcccaccaacagtgtgtaagtgttcatttttctttgcaaccttgccaacatgtgttctttcttgacattttaataatagccattctgactggtgtgagatggtatctcattgtggttttgacttgtgttcctctggtgattagtgatgatagcacatccctttagatcaataccaattcaatataattcaaatatctatatttactgaatgttatgatgtaattgagtttcttcacaatctccacaatcctttagaaaatttctaagctttaactaccttctatagatttcatgtacaacatgtaacataataagggatagcagatgaatggacataaaaagcaattgggccttttccccgatatttcatgtgcaactaatgaaggagaaatagactttgatttaaaatctactggtgacttttatgtaatgtagtgggcttgagaaactttcagtatttatgggttcaaatatcattttataattttaataatgcatttatgtaaacattaagttaatgttttctgaaaagtacagcatgtatttaatgcaataaccactttcaaattatttattgaggtgaagttttcttgtaatgaaatgtagatcttgagtgagtaattcgttaagttttaataaatgtatgcatatgtgtaactcacatcctgattaaaagattacatttctatcactccacatctttacttcatgctccttccagccatttcctaggtacacaccaaaggtaaactacattctgatttctattaccatcaattaattttaactgctctagaacttcatataaatggaattataccgtaggcaatttttgtgtgtatcttcatttattaaatttaatgtttaaaaaattcatccctcttgttaggtatgttggtttttcatttttatttctttattgagttttttcacataaatacacagtaattttttattcattcttttggaatggagatttttttggatatggcttcaaatttgggactattatgaagaacattcaggctatgatttttcaaaaggggcatgaagtttaaacaaaaagccttcttataattctgtagaaagtgggtaatgtgtgagtgtgtatattatgcattaatatgcttacaaaaatgatatatatacacacatgctaaatgtctaataataatagtaattataatgacaagtaacatttgtttatgttcgctttgagctgggctcttgcataagtactgtacatgtttcattccatttactcctcacaacaatttgtaaagtaggtaaattaccatattatctctgacaagtagactgtgcattttggaggataagtgatttgcctaagatcatgcgcctagggagcggccaactggggatttgaaatctagttcttacactgtcaggcattgtactatgcctgctacttcctaatagttaacattatttgagctccactgtgtgccaaatatctgcatgacacacacaaacacacacaccgataatacagtgtagaaagataatctatgtaaagattagcaagggtgcagtggaagaataccccacatagaggtcatttcctcttcagaggattaaggcaaaggccaccaaagtgacttattagaggcagaagccagtcagaagaggtataatgtttgacctacaaagggcttaaaacttatattctgtttgttgccaacatttaaaaattaggatatcacgttaatatctggatttctggcatcctcctacacatcatgatatctgaaaaccttgcccattgccatggtctgaagctgaccctcaactacttcccttgggcctgcagccagccttgatggcttatgctttctgaagagaggaatatgagtttatgaatattaaataattttttgaggagtggctttaagctttaccttaaagaatttcaatagagatttccaggctgtgtgagggaatagtacaatgcaaggaaagaatggcacttgctgggtgagctgaaggaataggaattaggtgggaactatctcgattgcccaaaatccagcacagtggggggaactaatcagaacataagatctgaccttaatatcttaggaaattctatgttttgaaagcttttatagaggaatgacaaaatcagagctttaattttctaacaggccaaatgcagcctaaacattgcttattccagaaactgtcatttaagtgtggttatttgaattgaacatataggctgaaatgcaataaaccgccatttttgtaggttaaaaggaataaagtatcaagtacatgcagtttggcattacaagtttgcctagtagcactttaaatgagtcactaatttaatatattatttcttttataaagttcatttatactttctgaaccaagacagtggagctggtacaaatatacactgtaatgcctccctatttgttgtttcctttaaatctttaaaatgtgtttttatatttgttttttgagatgctgaatttccataatatttattagaatattatatgtattgagatgatatttccctatgttagggagaaaccatttgtgttatataaacaaacaataaagttgtctaaaaatagaagatccttttggaaatgttgatgcctaaaagacaaaattatgtggatgaacatacgtaagcttcagtgagcttttcttgtactaggcatttagctgtcttgcaactgttaatcagcacaggccttaaaacagctgctatcagattaattagagggaatccaggaaataattcaactgaatgtagcattcatgtaagtgtgttgaaggcaattaagagtaactatagtcattactgagacttccaggaagtatgccaaagggcttgaaagttataaaatgccttttgcttcccaattttatatatatatatatatatatatatatgacagagagagagagagagagagacagacagacagagagagagagtccatatataaacacacactaatagcaattaaaaataaataaaattgaaaagcttgaattacagggtgttaactcacttctctctttgaaattaaggggccaagggaaaacaagaccatttgtctaaattcatttagaaagaaaaggatttatttaaagatgctgtggcagataaaattacgtttcatttttgtaatcctagttttcatagccaatgaaaggcttaaaataaaggaagttgatatttcaccaaggtcacacgatctacgagaaggaaacttaagaaagtttcctaatgcgggatttaaatccttaaaaacttgctgtggtcatcatcggcatcatcatcgtcatcatcatcaccaccaccaccaccaccactgctgccattaattattattattatcatgacacaaaggttgattacctggcatctcatctcatttctactgttcttaggtttcttgcctgtcttactgaatgacagtatgttactcaaaactcagcatggcaaaaaatctgggttttttaaaaccaattttgcctgtggttggcaccttgaaaaaaaacgagagaccaagaaagagggagccgaggatgggagtggaagataaagatttaaaagaataagtattgatattcttttctctttatttttaagtgacaaaacttatatatatttatggcattaaatatcatgttttgatatgcgtatacattgtggaatggttaaatcacactaatataggcattacctcacatacttaatatcattgttttgctatttaataggtctaaaagctgaagtcagagaactcatttatttatgagaattttggtgtgcaactgcattttgctatgtgttacagtcttttaacctacttccaaatctcttcttaaggatgagctagaaggagagactggctgacactcctcatttttgaagccttggcttttataaaaggggccttcagtgtagcaaaaggcctacttataattctgtaaaaagatgttcatgtttttcaggaacgtttgtctctatttagaaaaaataaaatgtagtttgggaatagcggaaatgattgattagagtgttacacatgagacaaaaagatagatgggcaataccgttcctgtgttttcatgccctgttcctcataagcaacagggcaagagatgataattcccaggagaagcaggagaggcttctggatcatgaggtgctattctcttacagaggtgctaccacagttactaggtactcattccacttcttttttttttttttttttttttttttgagacttattttgattaccaggcctctggtttaccaagtgtcaagcccaccacggtcccatcttttccttatctccctcttcaatattcctgtctaccaccacccttccctcacccacatagcaataccacataccatcatttttctccaagccccatctcttaccccttgcaaactctgccattgttttcatcccagttcaaatttcctccacacaataaaatgttctccccatactgtgacttccttgaccttacgttttcctaggtgttattatcttcaccaaatcactaagtgtagattatgtatctttgagtgttcatggattcatgtggttagctctactttagcacgagaaacaaatgccctggaatcactctaggaagaacgttagttgctatgtggaaataaggagaaagaaatattttagggatggaaactgtatcacagaacttcagtttttgaaaaactggaaggagtcttagaatccatcccgtctaaacccctcatttgagagttctagaatctgagagccagagggcttgcacatctggtaagtaatggagtatattcttttgacagtaagtactaaaaattaggtcttgtaattccctggccagtatactttccacaacactacacagaatctaagctttggcttatattatttgaacaacttgaacaaaaatgaggtaccagattttgacagctggaaataaccggaagtaaaaggggttagtattccccaaacaagaaatagacgaaacaaagatgcagaaaagagaaatgagtgtggtcctgttagggaagaacatatgggtcagtacaccatatagtaccaaggctgggtaaaaggagtcttggtgaaggcaataaaaggaaatgtttttctgctaaagaaattaaaagtaatattaaaacaaactcgggtttttgtcttccttttttttgttatcaccatgacctggcaattgcaaacaataccagtgataaactattcctccttgaaaaaaatactttataatctaaattctaaatagtatctgctgttataatcagtatttaataatatatgtataagcattaaattaacccatatttattatatgcttgaataaacattgaattctacttggaagtttactaggggaattcctaattgtaatggtgtctctgacacatgcacactgaaatacgcacattaattttgagagtaaatttataaaaatttcaaatgattggagcttgcttcagaaggacttcatgtctccagctcctatggcactacataatcctgcatttaaacagaagctttgaaataaaccatgtgaacacattgattataaaggtgaggaaaaagaacttgagttagaactcaaattagaacttcgttctattgtgttattctgtgcgaacacttggaatttttatatgtgcttaaagtttaaaacgatgaaacagtgcaaatgagttataatgtttttggtaaatgcaaatttcaggttataaattttccagaattttagtaatatctctaacattgaaatttgaccttcttgatgctagaacctataccaaactgtggtggacagaatttactgtatcctaagcaaaatatgcttagaagtaaaattaatattacctatgttttttcttatatttataattttataaatctgttgataattaaaattaatgaaatgtatttcatgatttagatggactttaaaatatgactataaagcatcatttgtttagtgaaacaaaatataagtaattggacactattttgaaatgatattttaaaataataattacttttaattatatgtgataccaaatttttaaataaaatgtctattgaacagctagtgttcaaggcattgagcaaatgcatgttgacagtgagagctacaagccacatctaaacatcaaggattaatccatcatgatgatgaaaaatagatagcaactattatcagtacatatttttaaaaaatttatgactatttaaatgggaaataatttgtttaagtttttacattgcatatttcaacaacttgtcttgataaaggaaactcaggatgtaagcctgacacccaaagagagttggagggaattcattcattaggaaaatataaggaagaaatcatgacatcagttacctctgttaataaaaaaaatcagaaaagaacaagtaagtaaagtggcattttagaatatatagtagagtttaaaactgttaaatatttgagcataagtattttgctttgagagagaagaaaaaaatactacaccaagtaagaagtgctagttgcgtctcttagagtgtaccaaaacgatattggacattggagcctcgttatttgtcacctgaagatgactcatgggaatagaattctaaagcaatggaaacaggcactttatataggagtaaatatcacaaaacacatttttaaactcattattttgaaatatatacttaaagaatttgcaaaaatactagagttcacccatcttcctctgatagtggcatttcgtataaccgtagtacatgaacaaaatcagaaaattgacattggcacaatactgttaccttaatatagaccttattcagatttcaccagcaagcacattttttaacactaaaactttaaaaggatttaaaatatatatcctgtttttaaatcttattttttgtgagtccatagtaggtgcatatatttatgggttatgtgaaatattttgatataggcatgcaatgcataataattacatcagggtaaatggggtatctatcacctcaagcatttatcctttgtattacaaacaatgtaattatactattttagttatttaaacatgtacaattaatttaattgatttaattttacatttaaatattttttgtggataaaagtatttaaactaaatttaacttaataataagtatatatttctatactcattttctgaatatgagttataagatggttggactttatctctttattctatgtcttaaaagacttaagcttccgtgtctaagttgtacttcccaatggagtcagaatcactgagactagaacccctggaagctagaatgagacagatacagtagtaactggagctgtggggaaaccttaggttatatcctccaaatcatcttaacagcaacaagtatggaacctaatttccaatggaaatatgttttatatgtggtcttgtaaaatagtcctgtttatgaacaattctatttcagtacgacaatagacatactgaatattaaaccttaaattccagcagagaatttcagaggaaaatatttttttcaatataatatgaaaaatagtgtcaatgtttgtcaaaatgtgactctttgaatattctaatatactaagcttgaaggaaaactataaatctttttgaaatgtcttttccattttttattttagcaaagtatgcaatacttaatattccagtagtctaccagtagacaaatttacacttattatgttcaccacaaagtcttttatgactaggagattcagaacttcttataaatcttataccataatgcataacttagaataatttacataagaaaaattcaactcaaagactaaacagataccaagaataacatattacatatctaaaattagaaagcacacagacacattttagagataatagcaaaagctttttagtgcacaaataaagttagtagaagaaaaacaaggtaaaatgatacatatttttaacattacagaacattactaagaatacattgcctaaaattgatttataaacagagaaaagtcttatgctcacaacccctctattttaatataaatttaaaaagagagaaattgcaatgaaattgataatcatcatataagccatgatttgcacctttggtacacatcataattgcttggggagtgattttggaatacaccagaataaaacctggtaagtggtagtttgagataaatcaaataaaacacatttttttttctataacaaacaaaaggccaagtctggaatcattggtttctgtatggtgtattttatccaggactggcttatagattatttaagagttaaaattatgattacatggtcacatatatttgactttagacacttttaaatttagctatatattttaagtagagattcttatgaatatggaaataaaataatgtacaatggtatgataatctgatttatctaaattctgagttctagacatgccagtgagctacactggtagtaggactcaaaagtgcattatgtagggaaaaacatgatgaattgatttcttaaatctttctcagctagtggtcccttagtggcttaccctggtttgtcacctctcccatgatatttatcaatacttatgaacattttagaacctttctagccataatttggaacctaaaatgtttacctatgcatgtacttcaaggataaatatgttatgattatgttatttgaaggacctggctagagtggagcctacagctgaagtaaccagagttgggagggtatgttacgatataaatttcaaaaaaaaaatagttttaaaatatggctatgtaaaaataacttctattacttgtattttatgaacgattcaacctgtataaaaaatatagttctgtggaaaaagtttgatattagagagttctgttctttaatctctgccacattttcgctaaacatcttttctttgacctcggccaaattccttaactgttgaatctcctggggtgcctgtgagaattcaaaatgcacctcaaaacagcctaatacatggcagacattcagcaaatgttccattctcctatcccctaattatcacacaagacaattacttttaatctgtacatattgaggagctttgcatgttgtggacactttgtcaatattcgttgaaggaatgaaattgtggattaaatttgctgtattataaaactgatatcttttacttaataaaagcttggcagtatgaattgatagaaaatgagtaagtctatttatttggtggtaatgaagattactgggataagtttccaaagcaagttataaaatattgttccattaaacttttaaaatgggatttgttttcctgctttttgcctcatacagaataagtatggctctgtttcaagattctggtgtgttcatgatgacctctcaagatcaattctgaatcacagggagaaaacgttgaaatgataaagacatggatactagaaatgcaagcaagttatagaccattttatttacccatttttttttttagctcaagcaatttcgtgtcttatatttatggataaagttgaaataaaatttccctttttttctgttaaatattaagagtctggggattagttatgcagcatctatttatttatttctgtcttataaaaattatcttaaagggcttggcttaatttctataccataaagaaaaaatgtgtaagataatccctcgctatcgggatcattttcttatataattaatgagctgaacgtaaaagataggtgaatctacaaatttatttattttctgtcttataaaaattgtcttaaagggcttggcttaatttctataccataaagaaaaaatgtgtaagataatccctagctagtcgggatcattttctcatataattaatgagctgaacgtaaaagataggtgaatctacaaagaaaatgccccaggtaccatccattaaagcatgttgctgctatatgtgcaagatgtccagggtatggcttccataattataaacaatttactatgtctcaattattatttcaattgttaattcccttgtctctggattgatgctttagtgcatcatttattgtggatattttggataaaatgaatctttggattttgtaaaaacaatatttcaaatttgtatgcatctttgaagtctaaatagcatgttatacaaattgaaaattgactgtaagagttgctacagattcaaattttatgtagtttattttttatatcttgatttgtgaagaaacaaaaaccttaactttgcttggtggcaagaacaaggggattagaacatgaacacacaggatattcagagcagtgcgtttgtaaggcatgccttatttgagtttcaggtgcttgctcattaagatgaaatttttgtcaggcagtgtgtattgggagtttgctacttgaaaatcaatagtctgcattctctgccttattgtttcaatagcctcttaactgatctccctgctttcgctattgagctccctgctgcctagctctttgagctcatctcctaacacttcccctctctccagccttagtaaatgcccccacccacatccatttgtgatatcttttcattttctcccaccaagaggtggagtttaagctccccctttttgaatggcatatgaccttggaaattcatatggtcggaaattcaaatttcccaccaaattcccaccaaagttcccaaaaaaggtgggaacggaacgtaaacccccaccaaatttgaatttgaaattcaaatttggtgggggtttacgttcccaccttttgaatgccatgtgaccttggtaatttgccttgacaaatacaatgtggtaagattgacatcatgccatttctaggtttagaccttaggagaccttgaatgcttccatttattctcttggaaccctgctatcaacagatgatgaaagacttaacgttttactcaccccattcgacaggtggccaatcatcagacatgagcgaggccattgtagaacaagaaatcccctaatcttggctaggtttcctcataggtctgggttagctgttgtgggtactcatgtcttactttaaaatatggttatttaatacctctgtattgttattcctctaagaagatgtaataagtcctctggaagatatgacattaatggacttcgctgaagttttctgtgactctttatgtctcttgacataaaagacaagaatctctttaatagaaacaaagtatttgtctctatatttttatggttgaaaatgtgacttaaactagctacaatgaggaaagaacatgttacttgattgagatatggtgtttcctttagaaaagagaaatgcagttcttattgatattgtcttactggcattgtgtacagtttgatagcattcagtattgagtcttttgtgtcacagttcttgaaaaagctttgattcttgttttaagattacctatatcttgagtgattttgaaagcaagtgccaagaaaagatgttctattgatgtatacatgacaggtgaaatatcacaccttttcagaaggcttctctggtgaatttaattccaaagacaaccagagtggaggtggaagtaaaagatacgatttgtcatgttattataagtgcattacaaaagtaaagaatcatagcccatgcaggaggaatgatgtagggtcttgtttattagacatttttccccagggtttacatagcttagggattatgcaaacaaaaacaaaatatatatagtccaagataaacaagccatattgaaattgatatgtatgtatggtattaaatattgttagatttttctgaaattctcattttttatatattcaacacacattactttaattgtacgtattaaaaaaatttatcaaaataatcaatgatataaaatctctccttatatgatttaaaataatctagctatgtcagattaaaggaaactattctgtacctctatatctggtcaactcaggatttaaccaatagggcccagggtatttttagtctaaataatatacatttatgtttaaatcattgatttgaatctaatggcagcttgttgaaacatcaactgagtgcttgactttcacagacaagtaacacatttttgactgtagcatttcatctgaacaatacaaggtcaatcctcatataaagtataaataaatcaggggattctattgtatacttataacacatattcatatattagaattttatgaagttaaaaagattttattttcttaaagattatttttagagcagtttcaggttcccaacaaagttgagaagaaggtacagggatttattttacaccctctacccctacatatgcatagcctctctcattatcaacatcccccaccaaagtggtgcctttgttacaatggatgagcttattgtgttgacacatcattatcacctaaagtccatagttttcactagaattcactcttggtgttatacattctatgctttgggacaaatgcatccaccattatagtatcatatgtattttccctgacctaaaaatcctctttagttctcctattcatctttccatctgcctagcccctagcaaatactgatattttcctgtctccacagttgtgccttttccagaatgtcatatagttggaatcactcagtatgtaaccttttcacattggcttctgtaacttagtgatatgcatttaagtttcctccatgactttttatgacttgatagctgatttatttttagcactcaataatattctattgtcgggatgtacccaggtttatttatgtgttcacctactgaaagacatattggttgcatctgagtttttgcaattatgaataaaggtgctataaatattcacgggcgggtttttatgtcaaaatacagttccaactcctttgggtaaattccgaggagtgtgactactgagtcatatggtaagagcatgttcagttttgtaagaaactgccaaactgtcttttagtgtggctgtactattttgcattccaaactacagtgaataaaagttcctgttgctccgtattcttgccagcattttgttgtcagtgttctgaattttggctattctaataggtgtgtagtgatatctcattgttgttgaagatttcatttttagtcacaaaaatcatatagcattggaaggaatgttagatagcatctggttaaaatcaccacttaatgtataaacttactctgcaatatttcgttttaagcaatcatctcatccagaatccttttaagaccatctatggaatgcttcttgtcatgagatgcagaaaagctgtatgctaccaaacattagaaggccccagggctcagtccttggacatctttgctttgtgcacttactgccttggagatctcttccagtatcatggctttaaataccatttttatgctggcaattcccaaattttcatcaccaacctggacctctcccctgaactccagacacatgtatcaatctgcttagttgacatctttattttttgtctaaatgggtatgtcacacttagcgaccccaaacaaattccttactttttctcccacacctgacccttcacattcttcctcagtagtaactttatcctttcagatgatcatgccataaccttcattccttttagctcttctttttcatgcactccagtctatcagcaaattctttcaactcttccttgaaaagaagagttgaatggactcaaaatttgactaattctcaccacacctgctgcatcttagcccagtgccccttgtctctcacctgttttatttcaatagtcttgttactgttttctctgctttctcccttgctccctttaactgttttattctgaatatggcagccagcgtgattccttcacttaccaattgtatgatattcttctctattcagcctctacttataatggtcttttatctctctcagaataaaatcccaagtccccacagttgctcacaaggttctcatgcataaacatctggctccccaatgcctcttagtatatccattagtgttttccccttgtttgctcgactccagggcacaaggctcctctgttacatcagacacaccccctcccacgtcagtgccttgcacttgctgttccttttgcctgggatgctttccacacagctatctcatgagtcattcccgctcccctgcctgtcacagtcagctccttcaggtcttttctcaaacacctctgcttagtgagtccttctctagccacctgattaaacttgcaacctacttcttaactcttttcaccaatgactttttatatatatttaaataatttcttattgtctgtctcccttcacttcagatgtcagctccatgaggagagagttttgtctgttttgttcactattatatcctgcatgcctacaaaaggccctgctttatatacaccatagaatactatgcagccataaaaagaacgagttcacgtcctttgcagggacttggatgaagctggaaaccatcattctcagcaaactaacacataaacagaaaaccaaacactgcatgttctcactcataaatgggagttgaacaatgagaacacatggacacagggaggggaacatcacacactgggacctgtcggggatggggggaaaggggagggagagcattaggacaaatacctaatgcatgcagggcttaaaacctagatgacaggttggtagatgcagcaagccaccatggcacatgtatacctatgtaacaaacctgcacgttctgcacatgtatcccagaacttaaagtaaaataaataaataaataaaatgaaataaaaattaagtcccctgcttagtaagtattgattgacagaatgaattattttttatacattctaaatattagggaattctgtacttgtagggttttttttttctcaactgtgtattttaaaggagagaaagcaatcaacaactcctttgtttttaatttgggttttctatatttaacagatttatcattttattttttccctcagtgaacttgtttattaaaaagaaatctgtcactagccaaaagctgtctaccttttagctactcggcaatattggtgcataatcatgggttcttgggatgcttccaactttggtttgacctttacagattagctctgaattagggaccactgctgggtgagaagtaaggtgtaggaagaagacagatattccaacacaatctggaataattagaaggacgaagacaacaaggaaaggagactattttcagtgcttcaggcctcatttttataactgctgacacaagcctgctattaaaatagtcacatttcctcaaatattggactttcagatgcaaacggcgcagtcaaatagttctgttaacatgacctaattttcagagctaggtgttatatgtgctttcattctgagtctgtaaacctttagacctctgattctttcagccctaagctgatagtattattgtctaaaacctagcaattttctctgtaaactttatcattttgcattttataaaatcctttatacttacctatgtagagcttggagtttactatcctagggagaaggagtacaaggcaattaaaaaaaaaaaaagccccgtattcaaagcagaatgtttcaaaaagactctacttctgaaaaggggaaaaaatcaccattgttctgttggctgaatgtgttggaagtatctcaaagaagtacaattgaattaattatattttcatctctgtgtacccattcaagtctgagaacatgcacttcactgtagttttacctccttctggattacacgagaagctgcaagattatcaagatgtcagacattcctattgggataacatgacatctttactaaggacttctgtgggtctgatgttcttcttcctagaaaatcatatgaaagatactttaaaagtgccatgtacccacttgagcttattttttaattctgatttttaaaaatattttactacttaaagtgacatttaaaaagcatattaaacaacgatataagactctgacttcacaaattagtttttctaagaacatctaattagacaacttggattgtgtcttaccagggtgcatagatgtaaccaacctaagccagcccttttgacaatctgcagtatcaaagcaaaatggaactctcgtcttatacttacattagtacataggtggtctttcttgctcatctttatcccctttttaaaaaccatagcatagtgagtaacacatcttatatactgcgtattagacacatttctgtttatctttgtccctgtcttatgaatcttcattttgattatctgagcagtgttgctgatttgctctactggctttattcaactaatgccagtactcccttattggactaaggtcttaaaactaccgtgtgcttatgtgtactaaaggtagttactgtctgcaagtgaggaatacatttgatggaactgattaattagggtgattttctgtttttgtggtcaattgaaatcttttgttaattttagctttgctaattttagctgaattttctacagtaatttttatttatccataagtatttgatttctgcaaattggaagtaaaatcactcatgtttgtttacctagttggagctcagatttttattaaaatattgttaaaattttattaaaatatgcctataaaagcatagtgactggctgaatgcattgtgatgctcacgaaaatgccctctcacatctcctaccgcaagaaacacaactgagtactgggctcgagatgctgctttctggatccatcacagctttggtgctgaggccccactcttcttaggagctgcttctagtcagtgacagagtgcagcagcaggggtactaaaacgggcccattgctgagggatgtgggaactccactgatggcaatgtgagctcaagaatccccatgaactttacactgcactacagtgtaaagcttgttttccttcctccctctcttccccctattcttcaaagaggttagacccacatcgaggtgagatcggtctcttggcctcctctggcttcctcctgttttctttcataggtgttcctctctgaccctgcctctgataactcttgggtttgtctaatcttatctttgtgtctgcttttccaggaggagaacctggattaccacatgcaaaaaagatgcttttgtccaaataatttcatgtttgggccccttattcgtatttggccacaagttttaaaaacctgatctgtagtcctaaacttatatacccctatggttttttttttttttttggaagctgttaaataagtctgaatattctcttcatttatgttgttgaacctagcattcacttcttttcaatttgaactccgccaaccagtatggaaaagtatagtctcttctgtgtctgccagtcaaaggtagtttgtttaccccatttagcaaatcatgacaacttgatgactctttactaggtccactacaatgttgatatgtcggaaaacactttcacaggctactagatcctattatgcaattttgtaacagaggctcaggctggagttaaggactcacacttgccttggaagacgtgacaccctgctatttagaatgagtggtgctttgttttgttgtgcctgttatccaggatcaagacaatgagacatttaccatccccctgcatatcattttggcatgtatccttgtgaagggttgtaggaggcagcagttattaactccttaactgcacacatattttgcaaaaatagaaattttgcttgtggatagcctcccagagttgttatggtgactcatcaacaatcatttctaacacctggatatcaatacaaattatttgggaactttggcggttaagtattacctaaatcttggtgaaaattccttccttattaaagtattatcggcatactaacagcttgctccatacatccacaattaatatttcaattttattaaaaacatctgagaatgctgattttataatgtcaactttaaatctggagaatctctgagcatgaaatggtacagtagttaccatcgaaggagcagctgaaggtcagcctctgaggtgcattaattcttccaacattaactcttgtaaaaatgtcactttattgttattaagtagaggttcttaaaaggcccattaactctggtggctacaaagtggcacatcaattataaatttgttttatgtaaacggaacccccaaatgacaccatcaacatattgctttgtacttaggatcaaaataatcaaagccactatttgaaaatgtatttgcttgatttctcagacagaatctggggatagctgagcaatcatatctcatgcattgaagacaaattgcctcagtgaaatttctattatagtttaagaaaattatcttcctgaatttgacacactgaggtggctgggaatgtagttatccagcaacacctgcttaaaatgccaataggaggtatgtggtaactttgttccactcagttgctacacatgacctttggaattgccacagctaccttacagcagagaacagggacgcacacagggattttcagagaagcactaaggaaaatttgaaatgaagctaaattcaagaagtaaatgatacttagaccttttgcaaagaaaacccagagattttaaaatagacaatagcatgacaatttataaaaatgaagctatttaaacagtatgatgtatagtattcacaatagcttaaaatattttattcccaggagcaacctaatccataactttttttttttttgctaaatgttagatgttgatatttgcaatgcattgccttaaattggaagattataacaaatttgtgtattttatggtgtactgtctatgtattgtctcacagcagctttgattcacttccatattaaccttgataatttgcttctttcaacattcaggatgaaaactacttaatataattaagttggcaaagcctgcattttggcattttatcccactctacattttcttggtactgctttttctaccctcttaatttttacacatggaaataactcatgtgcctcattgtaagtcagtgtgttatttgccaagagatattctgcatgaggtctctaataagatattgaaagaatgaaaggcattttcttattggacttgcagtcatcagaatccacagaaggggtaaattacggccaaagctttacagggtaatggttaagcatgcagaattggtgcctgaatgctcgccttcagatatttgctgtatgatttggggcaagttccttaatctctttgtgctttcctttttttttttacttctaaaaagtgatgtataaatagcatttagcacaatccatctagtacactgagaactctttattattatgggcttctcaatatcctgatatagatagacataaatgcaaaccaatcacagaacagtgcttggcacataggaagtgctcaataaataacagctaccattaaaaatagaggcatgggattgatctggattttctaaatccttgaagttctaatagttttgtacagcatggggtggaaatgagcagagcagtttacaaaagagaaaacaaaattatgaatgcagactgtctacagcaacttcaatgcaattgcataaaataaattataaatataaatgcctgcagtttccacggggaaagctcaggttagtgaagggggcctaaaatgtaggtatcattggtgtcgaaataaatatacctttgaaaacgaccttttccaaccccattgaagttatctacctctcttatgaattaagtgtagaaacattgtgaggagcagggccaaggttaataagcaaagatttcggaccaagtttttatacctttttatcctgtttccccattgcaatcccctcagtgcatgtgtgtgcgcgcgcacacacacacacacacactctcactcatgcttctaacaaaaatatgttgttacagtacagattctcagtaaacatttcttaaataaaggcagccataatgtatgtttgttagcctatattagtgtgaggaaataaagtagggctactttataaccaaaatgaggaaaataaacagtaaaagaaaaataacgccaaaacaaatatgatttatttatttatccaggaatcacttatcaactacctacagatatatagatcattaagatagggtagctgcctttgggaagtttatagcttaaaaagaattataagatgtataaaagtttcaaagtgtggttaaggactgtcatagaaactctgtaagatgagagtgtttaattttactgactgtggttatgaggaaagttttaaagagaaggtacaatttgataatatcatcatagtgaggttttcattgagtaggcaatggaagggcacaaacagaagatatagaagtgtgaaacatggaggaacactcagagaactccaaatattttgaaataagtaaatcattgggctttcccagaggtatcacaagagatatggtcagaccagagtcagattatataccttaccaaggaatactgattttctagattgagtagtgtgaaaccagagacataaaggcaattcaattggatgtatactttagtaagatcacactaggaatatagtgaagaggaccagaggaggaaagacaaattaagaaaacaccagcatgtcaggtgagagaaaatgagtagtagcaatagggatggggaatgaggaatgcataaaaagaggaagaataaacaggatttgatcatcaattggacttcaggatgaaggagagaaaggaatctaagatacccctaggttttttggtttagagaatatagatgtgaaatttaggaagatgtgaaatttaggaagatgtgaagtttaggaagatgtgaaatataggtttgattatgctgtatttaaggaacctgtgggatgtctaggcatagatatcagagttggagggtgggatcagggaatgtggctagaaagatatatttcagcaaataattagtaggtaaaatcactggaatgcatgtgatgacacaccagtaatgtgtggagtgggaagagaccaaacgcaaaatcctaggaatccaatttaaagagcaggaacaattggggcaggggaaggggagagaaagagaattgttaggaaagtaagacaaaactcaggataagagagctgtgttgtggaaatcaaagatagagttgtgctatggagagattaaataaaatgaggtcatcagtgaccttggcaagaccagttcctgggaacagaatgcacacaaatctgatgattgttcttgaaaagggacagacatgagtaactggagtcagcaagagtaaatggttgtattaagcaaatgaatgaagttgtctcagatcctcttatcttgtagtgttgtgcctagcatatttgacatgcacagcatcttttttgtttgtttatttgtttgtttttgagacagggtctcactctgtcacccaggttggagtgcagtggcgcgatctcagctcactgcaacttccgcctcccaagttcaagtaattctcgtgctttatcctcccaagtagctgggattacaggtgtgcaccaccatgcctggctgatttttgtatttttactagagatggggttttgccatgttggctaggctggtctcgaactcctgacctcaggtgatctactgccttagcctcccaaagtgccaagattacaggcatgagccactgtgcccagcccagtgtatcatttttaattacttccgtcctgtctgcaacattagttttggaaataagtactaataatggctagaaaagaaaaaaaagatcatataatcattccaagaaaataaattaatgaataaattaaatattacagtacaccaaagaagggggaagtaatggaataataccttttatttttcctttaaatttatttttaatttttgtgggtacatagattaatatatttatggggtacatgagatgttgaaataataccttttagtttcattaatatgttttctgaataaagacaaaaaacttatatgcacttattgatctgttgcagtcatttctagttgtttctagtttcagtttctttacagttcattataatgcatttacttctagtgcaccatagttttctagtttagagccttaacgcctacaaagttgccaatgactttgtctggagagccctttttattaagtttcattttgaaaagtttctttcacatcagcaagcagatatacaaataggaaaaatcttaattataaggtaagattggaagagatttttaaaaatcctactctacagtaaattctggaaattgcaatatagtccatatctttgtttctttgggataaattctaggggctttcaaatgtctctatgtcaaagaatatttaatacaaaatctccaagtggtcatataaattgttagcagtgaagaaactcaagttctgtttcttggtcttcataatcatggtgagattattgtttattttaaatctacctttaaaagtgaaattatgtaatacctgtgctttggagatagcagctgcatccaaagagaccttcaatgactttgagacattaggaactcctgttgaaatgaacctatgtaggcaaatctgtgtttgtctgggttagaatatgtgactgagagttctcccgataaacttccaggtagaattcaatgtttactcaaggataagtcataaaaatgagttaatttgaagcttatgcaaatgttgttaaaactcaacaggaaccacagcaaattgcttaaaacttggaacaaaggagttttttttccaagagtactattttgacacagatacaccgtgttttattgtgctctactttattgtactttgcagatattgtatttttaacaaattgaaggtttgtgtcaatcctgttgtacagtacgtctatcaatgccattttttcaacgcatttgctcactttgtgtctccgtgtcacattggtaactctcacaatatttcatactttttcattgtgattatgtctgtcatggtgatctgtgatcagtaatctttgatgttattatgaaattgttttggggcaccacaaaccatgcccacataggaacttaataaatgtgtgtgttctgaccactctatcgactagccactcccctatctttctccctcttcttgggcctccctactccccaagacacaaaaatactgaaattaagtcaattaataatcccacaatgtcttccatgtgttcaagtgaaagaaatagtaacaggtctctcactttaaatcaaaagctagaaatgattaagtttagtgaagaaagcatggtgaaagctgagataaggtgaaatctaggcctcttttgccaaacagccaagttatgaatgcaaaagaaaagtgcttagaagaaattaaaaatgctactcagtgaacacacaaatgttaagaaagcaaaacagccttattgatgaaatggagaaagcttgtgtaatctggatagaaaatcaaaccggctacaacattcccttacgccaaagcctaatccagagcaagatcctaagtctgcaattctaagaagtgaggaagctgcagaagaaaagtataaaggtagcagatgttggttcatgaggtttaaggaaaaaaagctgtctttataacataaaagtgtgaggtgaagcagcaagagctgttgtagaagctgcagcaagttgtctggatctaggtaaaattattgatgttggtgactacactaaacaatagatttttggtgtatacaaagcagccctctattggaagaatatgccgtctagaacttttcatagctagagaggagaaattagtgcctggcttcaaagcttcaaaggacaggctgcctttcttgtcaggtgctaatacagctgatgattttaagttgaagcaaatggtcatttaccattctgaaaatcctagggcctttaataattatgctaaatctattctgcttgtgctctatacatgcaagaacagagcctggatgacagcacatgtgtttatagcatgggttgctgagtattctgcatccattgttgagacctattgctcagaaaaatatatttctttcaaaatattactgcttattgacaatgtacctggtcactcaagagctgccatggagatgtacaaggagaataatgttttcatgcttactaacacaatatccattctgcagcccatggataaaggtgtgatttttcaagtattatcatttaagaaatacatttcataaggctatagctgctatagatctgctatagctgtgatagatctaagcaaagtaatttgaaaatcttctagaaagaatttaccattctagatgccattaagaacatctgtgattcatgggaggaggtcaaaatatccacattatcaggagtttggaagaagttgattccaactcttgcagatgattttgaattcttaagacttcagtggattaagtaactgtagatgtgttgaaaatagccaaagatctacagtgaggattggagcctgaagatatgactgaattgttataatatcatgataacattttaacaaataaggagtcacctcttatggatgagcaatgaaagtggtttcttaagatgaaatctactcctggtgaggacgccatgaacattgttgaaatgacaacaaaagattcagactattacatagacttagttgattaagcagtgacagagttgtagaggattgactccaaattttaaagaagttctatgggtaaaatcttatcaaacagcattgcatgctacaaataatcctttataaaaggaagagtcagtgcagcagacttcattgttgtcttattttaagaaattgccagtcacctcaaccttcagtaaccaccaccatagttagtcagcagccaccaacattgaggcaagaccctccaccagcaaaaagattaagatttgtggaaggctcagatgatcattaacatttttagcaaaaatgtacttttaaaattaagttatgtacattgttttcagacacaatgctattgcaagctttatagactacaatatagaatacacataacttttatatgcaccgaggaaccaaaaaaatttgcgcaactcgcgttattgaggcatttgttttattgcagtggtctggaactgaatctgcaatatctccaaggtatgcttgtattatttagaactgccagcacatggtgataacggaaagcaattgactttaagtgaattttattattactttaaaaaattatctgcagaagatacatttgtttgttgtctgctccctatgcctggtctttggaaaaagcctctttttaagcaattaacatcctttttcaaagttaaactttttctttgataaaatttaaatgataaatatgttaaggatcacctatttcttaaaatattgaatgatttcaaacatatatgtcatctttactaagattacttacccatgttttccaattctgctagaaaaccagtggatcattctttgaagggtagacagtgtaccttataggttagatattatttcttatgcaacttatagtacacagaaatctatttttaaacgtacagtaaaagttaaacatacatgcagttataatatgcaatgatggtctcctacaaaaaagatcttagctattgattgattgattgattgagacggagtctcactttgtctccaggctggagtgcagtggcgcaatcttggctcactgcagcctccgcctcctgggttcaagcgattcttctgcctcaagcttcccgaggagttgggactacaggtgcgtgccactacgcacagctaatttttatatttttagtagagactgggtttcaccatgttggcgaggatagtctggatctcttgacctcgtgatctgcctgcctcggcctcctaaagtgctgggattacaggagtgagccaccgcgcctgggcaagatcttagctatttaaaatacgtatttcaaaatctctccttacctagtatctatctttgtttacttaagacgttgtaatataaatttgaactaggttatggtatttatgtttttaaatcatttaatttttccattgagtaccactctatggaaaaattattattattgatatacaataatatataattgtgtaataattatataatattgatatacaataataatatttattactattattgtatatcaattatttattgatatgcaatggtggtctcttacaaaaaagatcttagccatttaaaagatatatttcaaaatctctacttagtattcatctttgtttacttaagattattgttataatataaatttgaaataagttatggcatttatgtttttaaatcatttagtttttccattgaaggtaccactcacttcatattagtaagatttctgtgtgtttcttttgaagaattattcagaagcagacttcattgttgtcttattttaagaaattgctgatactagctagatatttacataaattgctttgactaaactataattaccttgtcactgttttctagtcaattgtaatgcagaaaaaaataattcaaactattaatatcatggtgaaaagcatgggctctcataggacattatcaagctaaaattccatatgtgctactaatcatgttaattaatttctatgcctaattctcttcatctgttaaatggggctaataatactacatagctcattactttgttttgagggttaagagtaaaaacacacagaaagttcttataataatatctagcatattgtaagcactcaacatgtataagttattttaggagataatatataataattatgtatttatttcattttcttttctttttttttttttgatggagtttttgctcttgtttccaggctggagtacagtggtgcaatctgggctcactgcaacctccacctcctgggttcaagcaattctcctgcctcagactcccgagtagctgggattacaggcacacaccaccacacccggctaattttttgtatttgtagtagagacggggtttcaccatgttggccaggctggtctcgaactcctgacctcaggtgatccgcccccccgcttagcctcccaaagtgctgggattacatgcatgagccaccgcactgcgcctggcctatttccttttctttgcttatgttgcaaagtgagaaatgcctcatatttaaccaagttgtccctaggactttaccaatctaagaatttttttttctgagaaaggcattctgaaagtcaaatctagatatactttaaatcaatatcactttaaacatttacgttagccatgttttttacagtgtaaaagactatcatataaattctgttaactatgttttattgttccctgttgtaaatttttatttatttaataaatctgtttataagaatttttttctcaataatactactgaaaaaatagatttcatccaagcacagtgttaactagataagaaaccaacccaccctattttaatagcagcattaatacttttccttaagaaaacaagacagccacttatagtataagtaagctaagaatgtcaaaagggcgctcaatatgtctttcttcaacataaaaagtgatgacaatcgatcagtctgactttcacaagaggctccctaggagagaacagcatactgataatagtaagggcaggaagcctatttagttgttttatattctgtagctctctgactgtcccagtagttacaaggcagcatgtttgacacatagctaaaattcaagatgaacgcaacacacaaaaagagggcaaaacatgatgggaccaataaggagagatcatttcttattataaaggcattaacttttttcaagatgagtgacttggagttttgagctgaagggttggctagaagaacacttcggtttacaaagagaaatgcaccctgtaatgaactgcagtggactctaaaatgaaattgctggaggctacataagaaatagaaaaaacctagaagcacaatgaaaaacatcccgatttacagcatccctaaaggcagctgagggttgaccccattactttcattgagcaatttgttccatctctcctcacacataccctcactaggacttctaaaatagaaagatgcacaacatcccttagccctttccactgtctcaaaaaggtccccaaactttgtttactaaagttttagaactttatgttttactgtgtttagtatttatttaattttctattttttttttccccttgacctagatcatagaataatatacttagaggacatttttctaaatgcaagttgctagaaatgacttggcaaagattagtacaattcacagtgtcctgcagcaatagaattaacgaggagtttttttaaagagagactgatttaattttttgatgattttgaaatataaatgctaagaagaaaatttgaaggaataattttagataatttatatctaaagtgttacaagcattttatgaaacactagctatcagattagtcaacagctttggttttaccgtcaacagatattctttaaaacattcatacaatttattgtgtgcttatgtatatctttatgcaatctttatgtgaacactcataggggactattgtataatgctatcattgttagcaacatttgtgctttgtttctgaagtcttttactgtactagtaatttttttctttgcagaaactaaagttttctattagaaaaactttagttggatcctgatttataagcagatataacaaacatcatgagagtcctagagaatatcatgtaatcttcagttgttcaatctgatgattaaattgggcagagaaaagagttccagttatgtgaaaagtatttaccgtgttaatgaatctgtgccaaaacgttcatagaggctcaacttcaggccactccctgtgttaattgctggggtaagatgtgtaacgtagacacttgcctctggatgggtcaggctccagtgggaccaggtgcattgcaggaggaatgcattactttgcccaagcgcttattaggactttgaaaagaaatgctttcattatattatttgatgttttgtacatttcagtgtcctggctagctttgaagatttcagagtaaaaagccacaatttggagattgatatttaatatttagaaacaactatgcttctgtttctctctctgatactactaaaagcaataaaccaaatatttattaaataattagttcatgggaaattatgccatttttttttttttagttggagtctcactctgttgcccagtctggagtgcagtgggaatgatcttggctcacggcaacatccgcctccccggttcaagtgattctctcacacagcttcccaagtaactgggattacaggcacatgctaccacacccagctaatttttgtatttttagtagagatggggtttcaccatgttggccaggctgtctcgaactcacgacctcaggtgatccacccttcttggcctcccaaagtgctgggattgcaggtgtgagccactgcgcctggtctcaaaccttgtattattagattaaattggggacctgcaaactttttatacaaagagccagatagaaaatatgtttggctttgcaggccgcatagtatctcttgcaactactcagatctacctttgtagcatgaaagcagtaatagacaatatgtttaaaaaaaaaaaatgagtgtggttgtgttccaataaaccttgatttacagaaacagatgcttggaatgatttggcctacgggccttttttttttttttttcttgtcaatccttgaattaagtaaagaaagtgacaggtttcctgctagaaaagggtttgttatgaggattatgtgatttaatatatgtgagatacgtagagccatgtctgcatgtagtgaatgctgtaaatgtgttatttattataataactgttagagaaatgtagaaacacatctaaaccatttataaggattacatcttgaatatatatttctttaaaacctggatcagtgactactactatacctagatttcaatttatcaaccaaccaaatacactgtgaaggattttgtggatgaaaaccttcagatgattgagtgtttcgattgcatattgcatatataagggttttctctaatagtagatatgaatagattcaataatatatgcttttttcatttgccattcatatattctttaaacttctaaccatttccccaaacttggctcattaaactgatatacattggtttactgtttatactcctgccttattttttgcatattataaatataatacaggtgtttctcagcaagaaagacaattgaataccaatgttctgaaatattcttgtttctgtcaaagacatgttcatcacaactctaccacatacactatacacatatatactattttttattttaccagatttttagaaatatccaaaacctaaaatattccagttgggggacaattatgttctactgggataagagaaagacagaaaaatgtggctttagaagcctagaaaagcagtgatttagttaagcatattcaaattttagtaatgcacagtcctgactgacacttaggactttttaatgtatctttttatttgtaggtaagattaaatagaaaataccatatttaaatctgtgaattcaaaacgatattttttgagtgcctataccatgtccaggttaagtttttctactctaatggagctaacattttataaaataacatttataaagtaagataacaaatgagtttttaaaacttggatataatttttactagagaaatactctcataaaaaccagagagactaagggaaagagttatgaaaaatagagtgaataactattttagatagggtggtattgaaagactgtttagagaaggaggcatttgaacagagagagttctaaatgaagtgagagagcaagtcatgtgaagatctagtagtagagtgtttggacagtgggaactacagtgtgaaaggccctgagatgagaaaaaagctgggatatttttagaaaagaaggaggctagtgttgggcatgaaggaaagtgatctgaaataaagtcagtgatcatttagggcctcgtgggctgtttttagatcagtgtagctctctgaggcagacatgagatggctgtgggtagggcagtgctgtgaacatcattaaagttttcccaagacccttctggtccatccagtggtagtagatataccagtagggaagctattatagcatttccctgggaaatgatggttgttagactaaagtggcagcagtgacaagggtgggaagaggtgattcaggatacatgccaaggtagagctaataggaattgctgttgagttgaatgtagagtgttggaaaaagagctgagtcaaggatgttttctatttgcgtcaggtagattctggtgtcatttactaagatgggaaggtttatgttgacagggagttgttaagaatcacaagttcaggccagatgcagtggctcatgcctgtaatcccagcactttgggaggtcaaggcgggcagatcacctgaggtcagaagttcgagaccagcctgaccaatatgatgaaacctcgtctctactaaaaatacaaaaattagccgggctgtggtggcatgtgcctataatcccagctactcaggaggctgaggtgggagaatcacttgaacctgggaggcagaggtcacagtgagccgagatcatgccacggtactccagcctgggtgacagaaggagaccctgtctcaaaaaaaaaaaaaaaattaagagttcagttttaactgtgttaggtttgtgaggctttctctatattcaaatggagctgttgagtaggcaattaaacattggaatctagagttcatggaagagatctgaattgcagatatacatttgagaggactcggtatgtaaatggtatttaaaaccatgagtctgtataaatatcatcaagatagtgagtgtagacagagaagtccaaatactaaatcttgaggtatttaaattttagttgtttggcagaagagatgaaccttcacagaagaccaagacgtgcaaagcaagttacaaggaaagctaggaaagtgtcacagccctcaagccaagtgaaatatgcctcaagatgaaatgtgtgatcaattggcaaaagctgtatagaaattgagtaagatgagaactgtcaaaattgctcattggatttggcaagatgcaagagaatgttggccttgaaaagaagagtttcaacagagaaattaaaaactgcagttaatgaaaaaaataggtgaggaagtggaaacaaagagtataaacaaatatttgactgagtttgctataaaaggagcagagaaatgctcttgtagctgactaaagacacgggacttaggaaggttattttttaaatggatgacattataatacgtttgtttgctaataggaatgttccaaagaaagagggagaaatttatgatgctgcagagaaaaggaaatattcaaatagtaaattctgccataaaaaggaatgaattaatggcatttgcagcaacctggatggaactggagactattattctaagcaaagtaattcagaatggaaaaccacacattgtatgttctcactcataagtgggagctaagctgtgaggatgcaaaggcataagaatgatacagtggaccttggggactctggaggaaatggtgggaaggaggtaaaggacaaaaggctacaaattgggttcagtgtatactgctcgggtaatgagtgcatcagaatctcacaaatcaccactaaagaagttactctgtaaccaaatgccacttgttccccccaaaaactatggaaataataaataaataaataaatagcaaattatttgagtaggcatgaagaaatggaatccattgcactagtggagggcttggactcagataatgacaataatggccatcattttttatgagtcatttacatatattaactcatttaattctaaaaataaccctgtaagctgtattttattaccacctctattttacatggacagaaaaataaacacagcaggttaagctagtaattggtagaggtggtttccaaactcaagttatctcattccagagtaccactctagagagttatatgttatacagtagatgtacatattataactgggaaaaaaggcagactacacagataaagttagggaattttttacatgtcttcataacaagatgatatagtatagtttttattctatttttcactaaagttaagtgcaagattatcatctgagaataagaaggagggatgggccactgagggatggacaatatgagagttgaagaagggatgggcaatgtagggaaagagcaaaaggtatgaaatatttgtcaagtacaggagtaaaatggccatggaaaatgacctgcaaaatctgccagtgccaaggtctcttgaagatttttgtcattattttaaagtgagatgcatcatcatgtgaggcagagagctaatttctatccatctttgcttcaaggtgtcaccagtgaaatatcgatggtgggactgacaggtaatctagaggaatagagcatgcctttcgttttcatatctgtcatccttttatctggcatggaggtgtgatggctagaactttgctagtcataattgaccatggagataagtaccacactctaggggtggtaggatattgagccaggcggcagaagtttgttctctgatgacttcattgaagtgccacagcagtcctggacttttcgcctgcagacatctctaatgggagtcagaaataaatgtgtatcttgtctaagcctgtttaggagtctcttcttcttatagtcagacttaatcctaacttattccagaatttgttttcagaagcgggttgctaaagggacaaaacctaaaaatatgactttggttaaatggaggcaaacaggtggttagcagcaagactcagatgttgcagtttctctcaacataggccactgttctgatggacacatggcatatagggagaattattttaaatatactttgggttttttttcaggtgagtaaaatggagagagaaaaggagattccacaatttcctttagtaacaaatttcactgtctagcaaactttactttcagggattgctttcaggtatgtcacttaatatttgtaccacttcatctaatttccattttcttatatactaaactcaagagacacatttagttaaaatttttaataaaatcttacacttgtcagatatttcaaatattttactttactcctgtctattataggaaatccaaaactgacttatatttaccttcttaaaccttgatatgttctcacaatctttttatttttcaaagatttatatcagtttatgacagtataactacaaaaaaaagtatagtcaccaaagtaaacaatgacatactccttgtcaaatcttagggcctatttccacgctcttggcccttatttcttatcttgcctttttcccctaaactgagagccaacatcatcatgggcgtatcaagtagagacagatcaatttgtgttggaatccagttagtcatttactagttagttatgtacctttagctagtcagaatttctttctaatcctcagttttcatccacaaaatgaactgtgttaaagactgaataaactaattttgtttactcacatttagtttatactttttttttaaaaccttcctttctttggttcaatttacaccatgcaccacctacattagtacctattgatatttgcgagggttttatgtctttgccccttctccatttctataaccatttctcaagccttcaacatggtactccttgccagcaatcattctttgctacctgtgttcctacccattctctagtttcttccagaggttccttgtccctcagcaggtctgccttcttactgcctcctgcataccgcccacttgcaccattttctatatattttctcttgcatcaattttccattgcatataataatctctagttcacaaacctgtatttgtaactctattttaaagacaatatttagtcttacttcatcccagaaatcattgactaacttcaccacaattgagacatcacttacatgaagttcctctttgtatgtgtataatttatcctcttataccattaaatttcttgtattgatcgttgattttattttaggcttgtcttaattatccatttaggatgtaaaatcttccttgtcttcatgatccgctgatggtataaaacttcctttgtttaaagaaagataaaactatctctgctgttccctgtcccatgctttgcagtgctatcactatgaggagaatttattaatttatgcatgctgcatttaatatgtaaaagcctttaaatacatgaagattggtactacaatgtcctcgatctttgctttcttaaactcaaatagtcttagttactttaaaacattttgcctagtgttatttttgtgtgtgtgtttcctctaaattcaagtgtttatattcttctttagttgagatccagaatcggcctcactgccatcatataatcaaattcatgcagagtggattggggagtttaattcctagcatctcctcttacctttgcttccatttaaaaatttaattatttctaaaattcaactaaaggccctcatttattataatttatatcattgttgaattattaattggttatttatttgctatacattatagtcaagcctgtagctgaataaagtataccttgatacattggaatacttatataaactgcataggcactaaggggctaaaagaaagtaaagtgggatatgataataaatgaaaacttattggagtagaaaatgaaaaaaatttaggttatattttatttcttttaattaagatggaattcatataacataaaattgaccactttaaagtgaacgccaatggcatttagtgtagattttattttactttatttttaacagctttattgaggtataatttacataccatacaattcaccctcttaaagtttaaaatttaatagcttttcatatatttacaacattgtgcagccatcgtcacagccaattttagaatattttatttaacccccaaaaaaccccatacctattagcagtcattccttattttcctgtatccactatacctaggcaaccattaacctactttttgtctctatagatttgcctattctggacatttcatatgaatgaaatcatatatggccttttgtatctggtttcttccatttagcataatgttttcaagattcatccgtggtatagcatgtatcactactttgttcctttttattgctgaataatattccatattgtgggtataccatgttttattatccatattatgccatattatggatatacattcatcagttgatgttcatttctgttgcttccatcttttggttattatgagtagtgctgctataaacatttgtatgcaagttttacttttaatacctgttgtcagttcttctgggtatatacctagaagtgtagttgttggattatgtttaatatgtaaacatattctatgtttaacattttgaggatctgccaaacagatcctttcctgatttctaaaatggaatatttatttttttaactgtaggctttacattccttatatatctgaccactagtttattgtaccataacaggtatttcctgatttcttttgtgctttgctttcatcaccaaataacaacttccttgaacttttaaaattacatcatttatagaatagaaatatgaaaagagttttgtgattcttagacatgaacacttccataattaaagatattcttacccctatggtaacacatggaatgaaaaggaaaatttgattcctaacattctattaattttattttctttatatatctcttccatgatgctgccaaaataattgggctcaatttaaatgcccttgtctgcttgccagtgggatgcatctgagaattcaactgtgctacattttgtttgaccacctatgtgttctactaacccctctattaactaaatgcctttttgatatagtcagtgttacttaattccaagggaaatctggggaaaatattgtaatttactgtgtacagtggagataaccacagtatgtaatatccattattgtatgggaattgtactcaagttagtccaatatggagtgatggttttaaaccttttagttaggaattaagtaaacaaatatttgtgaagcacccacccactaaatcatacaagtcactgaattaaggagagaaagtgaaaatattaatttgtggcttaattattaatagcatattaaaaatgtaaaggtttattatggttttagtcggagtttatccttcattacatatacaagtatgaaaggaaagaattatagcactaagccggtaagagaaaagcagcttgattctcttcagagtgaatagaaggaacataaccgtaaaaggaatataaacaataattccgagtgggagagaaataaattatttttaaaataattcaaggacatggcttaatgcaatgagataacatagacctgctaacctcattccagttaacaaagcacatttggttatattgtatcttttacagtttcatagtttgctgttttatagtaggaacaggataagctttaactgccttgttttcctttattcttccttttttgaccctgttaaatttaggaaagcacacacttggctcataagtgcttgttcagataaaacagtgtgcttccaaatgtagcagcaacccaccttcatcagaatctcctaagagggatgtgattgcaaaaatatcatttttcttagccctacatcatggctcttagatcagaacctctaagagttctgagctgagttatgatatagggctaagggagggcccaggaatgtacattttatcagtaaccccaggtgattagggtagggtccaggaatgtacgttttatcagcatttccaggtgattctcacatatgctaaagtttgagaaccactatactgtactgtattccctgctgtagtgactatgattgagcagaatggttaaaagcatggactttggtgtcaggcttatttgaatttaagttctgattctgttacttcattgtgatcaaaacttggataagcctcttaaattctttcagcctccactgtattcagctataaagtttaagataaaaggtgattataatctctatttacctaaagaataaagacttattaacataattctgccttatcattcttactattattagagatagggtcttgctctgtcacccaggctggagtgtagtggcatgaccatggctcactgcagcctcgacctcttggactcaagcaatcctcctgcctcagcctcctgattagctgggactacaggggggaaaccaccaccatgcctggctatttaaaaacaattttttttttttgtaatgacagaatgtccctatgttgcccagaatggtctcaaacccctggggtcaagcatcctcccaccttggcttcccaaagtgctgggattacaggcatgatccactgcacccagctgctgcccaattattaatagaatcttcctttattcttaaaactatcccactttagaggataaattatgtgatctagcatagctatgtaatcatttactgtgatgattatatgacatcacttatttgatttgatacagttggcacataatacatattttttaaatgttcttataattaatgctatttttaaaaatcaggccaactctgggcccactgcctaggagttagcccttctccataaggagcagtaaaagcaaacaaacaaacaaatttgattttttttttattttaacagagtactcaggattatctactgctttaattgcttttaaaaattgatttccatggaaaagaggtcactgattattgattgttggctagttttgtcctccatgggtacaggtctttaagtcattttgtcctcattgtttttactagcttggccatgccagttggcattgtcttgtgctaaaaggcattttgtagtagagactttggggaaaagacattcaagagaaggataataaaagtctgtacagtggaactatagtattacacaaatattattgtctataagccctattacctacaaaagataaatatgacattttccttctcttattagcttcatgatgaaacaccttgctattctgccttcagtttgcttttcacttccaagtaagtatattctagccatgggagagaggtatttaggtgtttttcttgtagttagatgggaatcctagactctctactcagactgctctgagcctaagttttttttttcactttttttttttttttttttttgagatggagtctcgctcttgtcgtccaggcaggagcacagtggcacgatctcggctcactgcaacgtccgcctcccgggttcaagcgattctcgttactcagcctcccaagtagctggaattacaggcactcgcgaccatgcctagctgatatttgtatttttattagagatggggtttcaccacgttggccagactggtcttgaactccttacctcaggtgatccgacctccttggcgtcccaaagtgctgggattacaggcgcgagccaccgagcccggcctctgagcctaagtttatcagtaatctcctaagtggtgccataaggatatgagttaatgtacatagagttcgtagcagcacatctttgttctcaattattgttttctttctttcttttttttttttttttttttttttttgagacggagtctcgctctgtcgcccaggctggagtgcagtggctcaatctcggctcactgcaagttccgcctccggggttcacgccattctcctgcctcagcctcccaagtagctgggactacaggagcccgccaccacagccggctaattttttgtatttttagtagagacggggtttcactgtgttagccaggatggtctggatctcctgacctcgtgatccgcccgccttggcctcccaaagtgctgggattacaagcatgagccaccgcacctggcctattgttttctaataccattattaagaagaatattggtggtcttaaaattgagcgagcagcagattttagggtaatatgggacttatttggctcattggcttctttcagccaccttgttcagattttttgcttctccagtaaaaaaaaaaaaaaaaaaattgttcttctttgtgagatggatgggggaaaaagaagtcatatagtttaaggagaataaggaaatcccaatatctgaacatttgagggagaagaactcaataatcaagggccaagtgacatagcagatatattgtgttttgcagtgtctgactgtcaacacgtaacaataagtggttgagattttcatactcaaggccttattcattgctttttagaaagtgtttttgttccacttccaatgaaggcataattctcaatgaaatatggaaagtgttgtagtcaacatgaaaatacatatattcaaaatagcatagcattaagcctgaagtatccaccatcatttttattcacatactactggtatttaaaatatagaaaataaatagaaatatagaaatataaacttctacagctattgccttcataaattacaaccttcatggctatcatatgtcccaaatatatgtttcagatatgtgcaaatgatgataaagaaacattcaatcatcagttatctaggagacaatgatacacactaggttatcttgagttaattatttcatgccaaacttaagtgactatgtgagaaccatatgtttggtgtgtaattcacactttcaataatgtttgtatcaactgaaatatttttcaatgaaccagcatccttataatgaacatggtgttattataaggaagctggcagtacaagtggtactttgtgttttctcatttcatgctttcatttagatttaagatgttcttggtttcatttccaagttggcatgagttagcagtaaataggaatctgctggcttgtgttacatttgcttttctgatacctctaaagaaagaatgggaagaattcagaacagtaatcagttttaattgaggttatccagatagaagtctttgttctatctaaatatcaagccaaatttcttggtatataatcagaaggaaccatgttgatttctctacttattgatgggtgtatgctttgattaaggagtcacagggaaagaagatggtaatattctcatagattaatgattgtggattttcagcagttaagaattgtattcaacctagaaaacaacttctaagaatcattaatagtgcaattcatagaagtagggttgattaaaattatgaataatttataaaatgtaatatatggatagaaagagcacattggctttatttaactcatgattaggcatacatgattattccattttcttcctttagcattgacttttagattatggaaggagaatgcctctagagagttaaagaataggcacagcacaaaagtaaaaatgaatgctccaaaagtagatatatgttgtgcttctgatgactttgcattttgtaatggatttccatcaaactgccttgctgtatcagtcagaatagtctaggttacattgtagtaatgaacagccccgaatatgaatgggctaaaactgaaaaaacaaaagatgtgtttgcatttagctcttgctatatgtctatttcaggatggagttgctggctgatatggtttggatatttgtctgctccacatctcatgttcaaatgtgatctccaatattggagatggggcttggtgggatgggaggtctttggattatgggggtggatttcttatgaatagcttggtggcttggtggcatcctcatggtaatgagtaaattctcattctattattttcttgagaaactcatatttaaaacaagagaaatgtaggtatctctaaagactgtagtaacccaattttattgatgatcagaggccaaaaaagccttgtaaccttacatgttgcttaatcctgatcatgtaacagaatcgtttggcaagagtttgaaatgcgtgaattcttggctcctattttcaatgttcctaatttaggaggtttagggtgagacccaagcatctatatttattcccttaagaactggttgttaaaaagagcctggcacctctctctttcttcttctcttgccatgtaatgtctgctcccctttgccatctaccatgaatggaagctccctgaagccctggtcagaagaagatgctggcttcatgcttcttgtacagcctacagagccaggagccaaataaatctgtgttctttgtaaattaacccagcctctggtattcctttatagggccacaaaatggactaagacgggacatgggctgtgttgcatgctatcccagactcaggcctgaggaagactccaagtggaatgctcctggtcactgtggcaggaggaaggggagtgctagaaaatcttgcaatttaattaaatgctgtcgtccagaagtgatgtacagcatttctgtccacaactctttggccagaattattctcatgaccctgccaagggcaaggtggcaaagaagtaccattctttcatgtggctgggagggaaaaaagaaccagatttagaagagcattagatatctctgtcacatctgaggaacaaattagccatcagagcaaaggtccaggcatcccatctcggcaaacaaagcatgattaaccctagagctgctgattctgagctcaccctaacttgattccctccactggccccaagctggcagctgtagctttgcaaacatgataatgcttctcttgttagaactgaatttagaattggcagcaacagaaacctgcaagctgcagttcatttgtgtatccatgcttaatttaattcttattgaatgaaatgcaccctcattttattcttgctggaaaaaaaaaaaactaacaacataaaagccagtccaactattaaatcaagattttctacaagatttgtgttaattattctctctgtcctttcacaagaataaaactgattttatttatcagttttgattcatttttgatacttgaaggaatgaggagtacagaccagctatggactatgtttattttcctgagaaactcatatttaaggcaagagaaatgtaggtagctctaaagactgtagtaatccaattttattatcagaggccaaaaaggctttgtagccttacatgttgcttaatcctgaccatgtaacaaaatcacttggcaaaagtttgaaatacgtaaattcttggcctctactttcaatgtttctaatttaggaggtttagggtgaggcccaagcatctatatttatatttaaatctcaccaggtgattccgatgggcagccagaagtgagaactgtcctggaatgttatgtaaaagaaagttattatttttgaacttgttttctaaatcaaataactatccaaacctaattttccaactttaagaataaggccatctatttagcagtacagaatccatgcttacaatgtttctggttcacttcttatgtgaaaacactgaagttgttaaataattcatagattattttgcaatcctgccagtctttatgtgtttcatgttcttgtttataagtcagtgagtagggaatacatccattttgagaatgccactctgttgtagttaatagatacagatcccattatcatagttattctaatatatgattcaccaaaataatggacaaaatgatgtaactaacaattgatttgcctgctctaatacctttctttaaaacactgtaataaaacaggaaatggttttttttaaatcatatattttgagtcaggagactagagttaaaatgaatcctagagatggaggatagtaaacgccaattgtgaagccagtaattacaggaatccatgtagtaataaacttattgtttctgtcttcaaagtacctttacttcatcctgtttaaagcttctgttgcaagcatgtcattttgaaagtaaattagactaaacatcattctgatgtccatagttcaataaagtagataaaatgcatattctatgaaagactgtcaaataaatattatgcttattcatctctctgtttgctttaaaatatactttaatttatgtaaatgagcatttaatagaaataaatagtaatgaagccacataatgcagatattgtcaagcttaaacaatccagacataggtaaggagaggcactattcaaaaggattattttaagagctgggagagggactattgcagtagaaagaatgctctagctatgagatctgtattttcaaagtcagataaaaatcttttctttgcctggccctcacctgagcactgcatatgcttactttatctcaaccctaggtggtatgaattactatccatttttagctgtcaaaattgagacacagagaagccaaatatgtcactgatattttggtttatgggggtagtgagcaaagttaggaagaactaggtgtagggaaatggtattgaaagggtggcatgacggcatgatcatacagttgattagggaatgctttttcctaacgtaagtcaatggtccagaaggcctcttaaggagaggttgtatgccgactcaggcggtgtgcatgtgtcacagttcagagacctgaaggaaagagagaagctttagttaaatttggtgaagccaaactggtaggtattttatccagattagtcagaggtataaacagttcatctaatcatttatggggtaaagactgggaatttggagggtctgtgtctggccttgtctaagtaaacaagaggggcatctgtgagtcttatctaagtcatacaggaaagacagtaagcctccagaagtaaaagggtgggaagacatctttaaccatcattgtttttcaggatcagagggctctgggaaagttcatggttcatataaagcaatagggtctagctaagtctcatccaataataggtatcatttagtgattgcctggccctcagttgagcactgcacatgatcactttatctcaaccctatgtggtatgaattattatccagttttaggtgttgaaattgagacttggaaaggccaaatatgtcactgaaatttagtggttaatctagaattcaaacttgaatgtccatagtaaaaaaatcaaactcatagtcatttatactatgacatcaaactgaagtagaaggtgcaatagtttgtttttataatttataacaaagtcattaacatttttaattattaaaagctaatgaatttttatggttcttttatttttctcttgcattttcatagatgagttccattcagacagtttgacaattaaccatgaaatctaaaaatcagaaatgattagtgccttgagttatacaatgagaccccatattgcttaacagttagaatctattgaattaaaaattaagagaaatataaaatattcttcaaagctactgagttatgcttaggatactggtctttgtaaaggaagaggaatgcaaaatgagtcatgttttattcaaggatttaaagtccagtgggaaagctatgacaatacctaatatataaataattataataataaaccacattgtcaaaagagaggtataaataagaaaggaaggtaaataaagattaatttacatttggtcaggagtatttttaagaaattgaaaaatcatacataaaaactaaaaatattggtagttttattaatgtggaatagatgattgctaagttagcttaactagatttagtaattctgtgaatgcatgatatatgtcaaatatagtacagtctttcagagaaaaaagtcatctttcaaaatgtgaaaatgctttcctattattcccaagtttcagtcattttagtgagaagtattagtaggttgtggaatacatatttcaagaaaaatgcactcaacttttaatattactcttggatttaacattgaggcagagaaaaatgctctatacagtttcaaacagatatgtattttgtgttctgaaatatagagattgaatgagagacaggaatgaacaggaccctaaggctgaaatctttacaaaagcataactgtggaggaattcacctcccaagtgaacttctctgattctcttgcttttaaacattatggcaggctctgttctttttctttggaccttgctgcgagatcctgctgagaagttctctctgcagtctgctaacagacatgtacagtgaaaattaaaattattcaattcatatatgaatgagcatattatatccagaacctacagattgtatttttgtcaatgtatggttttaaactgtttgaatttaaaaagcaatggaaattaaaatgtgactaggactttaagctaaattgttttaaaggagagtaatctgtgaaattaggacatctagagttgaaccatagagtttagaattgcaagaggacttaaaggtcatggaatccaacctcccacacagtgcaggaattcccttgtaagaaattcttagtaactagtcagctaagctctgtttgaatatccttagtgttgggaatctcactacaggggcagacatgccacttttgaatagctctaattgttaagaattttctgaactcagaaataactacctagcaaaagaggagtacttaatttgcatcagtgctttgaaaatttaaaaccaaagaaatggaaaatatcaaataatttctaaattgaataccagctccaaggggcagaattagtctcaatcattgtttggtaacttttaatactgtttccctcatgactcataatttcataaatttttgctattttgtttactaatataggggaaaatatgtgtttcagtggaagagcatgcattgtcacatatagcacaggcttgtggattattagattctagtctatcattgcctttcagctattttataactataaattttgtcttatttcacaaaatttccaatgacttctctcccaatcatgggtaagctagctttgcctccatttgcaattcagttcccttactcccagaaatgtgtgctttttaattttcctttgaactggttataacatctatctggttttcttattgaatgaataaaaataatatttttaatacatgctcattttcatttttatatctgtattagtcattattttaccttttctgaaaattatcttttaatatttgtggaggtattcccaccaagatgcccaatgatttgcttactagagccagatatactttctcatcagagaagggcacctattgagcagtttaaacctaggcttctacctaggatttctgactaaataattttgttgactgtctttcttatttttattttccactctactaattttgtgttttgcttttggtttgttttcagccagtaagttatttctgattgctggcaggaaatgttgggaatttggttttatggtctgaccatttggtgaagttattgcacatcactggcaagagtagttggaaatttggcctcaacgtcttatcatttgatgagttctgtaaatgcagtaatggtttaaagagttattttctctgtcgggtgtaagacgacagagaatcttgtttggtagggttttctatttgtcttatttgtctagtttgagctcaagtcagtgaagaatttcatgcccaccagaaagtagatatctagactaatgagtttttatttctgtgttcgtgttgaaattttagaattaaagataaccattttaaagatgctcgatgagctaagagagaaaacagataattaagcaaaatcaggaaaatgaacaaaatgaaaatatcactgaagacatacaaactataaaaaaagaacaaaaattttggacttgaagaatataatagctgaattgaaaaaaatcaccggaagggtttaccagcagacttgattgactaagtggaagaaagaatcaatgaacttcaagacatgttatttaaaattatcaggtcagaggggcaaaaagtaaaaagaatgaacatatatgaagagagactacgggacttatgggacatcaggtgggccaatatgtgtattatggatgtgccaaaaggagaagagagagatggacggacagagagctcaattaagaaaaaatggctaaaacatcccaaaatggaggaaagaaatacaaatataaattcaagaaattcaatgaactctatgtaggagaaaccccaaaagatccacacagagacacactataattacattttagaaagtcaggtacaaagagagaatcttaaaaattaaaaaaatatatatatatatcttgaaataagtcatactatatctttaaaaaatcaagagaaaaatgacttatcctgtacaaggtagctttgacaagttatcagtgaatttcttagcagaaaccttgcagaccggaagggagtgggatgatatattcaacatactgaacaaaaaagaacagccaaactagaatactatatctggcaaaattgtccttccaaaatgaaagagaggccgggcatggtggctcacgcctgtaatcccagctttgggaggctgaggtgggcggatcacttgaggtcaggagtttgagaccagcctggccaacatggtgaaaccctatctctactaaaaatacaaaaattagctgggtgtggtggtgcacacctgtaatcccagctactcaggaggctgaggcaggagaattgcttgaacctgaaaggtggaggttgcggtgagccaaaatcatgccattgcactccagcgtgggtcacaagagtgaaactccagctgagcccccgccactgcaaaaaaaaggagaaattaagattttcccaggtaaataaaagctgcaggaattcatcaccagtagacctgccctacatgaaatgctaaagagtatcctgtaagttgaaatgaaaggatgctagacaacaacatgaaaccatataaaaatattaaaatttttgataaaagtgaatatatagacgaatatagaatcctgcagtattgtaatgttaatatgtaaatcacttttaattctggtatataatttaaaatacaaaaccattttaaaaacctataaatccataataatagaaacataatataaaaagatgtcatttgcaacatcagtagcatacagtgtgtgtatgggagagatgtaaaggggtagagatcttttatgtgattgaagttatcagtttaaaatagactcctataactttatttaatccccataataaccacaaataaaatacctatagaaaataatcctatgaactggttacaacatgtgccagtttcctcactgaataagaagaaataaaatcttcggcatgtattcatatcttttaataaaagcctatgcaaacctctctttttttgtataaatgaagtagtattggataaatagatatttataataaaaatactggcttttgtcaatcttgttaaagttgaatattgataatatagtgtgatctaatatagctctgtccaatagaaatttttgtgatgttgaaactttatctattgtccaatagggtaatgactagctatgtggagctataaagcatttgaaatatggccattgctactgaaaaatataattcatttaatttaacttaaatttaaatagtcacttgtgatcacatattgtacagatctatggagtgagacttgtaagtattgccagtggcaaggaagtaacaagcctaaccatgaagagtttttgctatgtttctgtagtagaaactttcaaaccaacttacattctttttgcctgcttatatatgagttaagtaaataaaaatgaaggtttttagaaaagatcctttaaaaataatgactttgtgtattttagcatataaaaatttattttaaaatcttataccaacacttttaatcatataaaataaaatgtaacagacatctttcattatttgtaactaatatgtgtatttaattcagtttaaactgatagcattccttggaaaccaaatgcttttcaaatgataattcttagaatttttacatatcttagaagtgtttcttttgttctttgtttttttgtttgtttgtttataaaataaagacatgttacacttttgtgctagtgatctaaatgatgcaagacatgtaatcttgggagaaactagatttggaattttggtgttaaactaataatatgaacatatagcattgggagatatacctaatgctagatgacgagttagtgggtgcagcgcacaagcatggcacatgtatacatatgtaactaacctgcacaatgtgcacatgtaccctaaaacttaaagtataatttaaaaaataaataaataatatgaacatataggtaattaaatgacagtcagaaattgtcatctagaagtagatgtattggtcatctcagaaaataaccatacacaaaatacagaaatacataaaaatgcctgggatcaactaaaatttttataaagttatttttgattatcctacaaatagggatttgatgaatactaaggtatagaactttggaaactttatacttgggaaggtgttgaattatggcttctgggaaattataccaaaatagcctgctgttgaagtgaagctaagtttattgcttattgtgataatgaggattattagccttgacagaatctcattctagagaaggaaggacatagactgtctgtcatcttcctctctttcacaaacagtgccaggaataatatcacagaatcccagagtatctatattcgaaaatatatttgaaattattttggcaaatctccttttataaacaagcttttgaattctgagattgattactaaactaacatgcattgtttcatctaggtttgtatgactgatcagataacataccttattattttatcattcagacttgaacttaaaggcagagaaaggacaaaaaataaaatatttatagattatttggcaaagtataagtatctcacatctgtaaaattttaataaaattctgcaaagtttttgtgtcatgcttgcctaatgtgatttatctgtcaattggtatatagattccattaaaattcatttttaaaaaggtggaattatgactgtcataaatgtaaaataaaatggttaaaaattttatttagctcaacagttaatgaggaaaccaataagatgttacaactggtaaaaagagaattttaaaaaatacaaaacacacagatacagccaattaggaactgtgaaatgaatgtacaaatagatgcaaaaaaaatgcttcgtatccacaagacagtaatcagttgcatctacaggaggcacaattcatttacatatctatggacaataatcattataattattataatcagttttctacaatttacagagatgtaaaataactcaaagacgatgaaaggcggatatgactcagaagggtgctctagagagcacatccaattaactttttgcctatttcaaggactttcgcagtgtttttcttataaccccaatgaaaatgagaaatggtttccactttaccctactctccatcacgtcatattagtgttgcctatttgactcattagtgttatttgcctgactcctgcagccattttaatataaaaatttgaaattcctactctcaagttgaacatagaagatagtcaatattctaaatttaaaaggttaaaaacttaacgtatttgtttttaattttaacatatgtttaataaaataagaaacttgaacaccgtagtatttatggtctgcataatctgttggatttacctaattcatggattttaatacacatgttgtctttaggttacccctgagggcaattgtttttggcatacctagcataaagcaggtattccctgtaagattttttcccatttcatgtaaaaaggttaaatgctggtttggtggatcctgcttcaacattatgaagatagcatttgaactacatgtctttcgggaaattatatatggatatatctacagatgtagatataatagatacaaaccagtaagaaaggaaatctaactttttagtgatttcctttttacttttaaaaaattgctattgaattttttcagttaaatagtaacaaaaataactaacaacataggctccatacaaaatttaatttgccactttataactttttcaattcctttatactgtataaaccacagattttttgtttctagcctatagtttctgcctaaaatacaggaaatgatacttacaataccaaaatgaaaccattaaaagttttggatgctggattaagtgatataccacttaaataatgatccaactttgtctaaattcttcaagaactagaatatatataattttattatattatctcctttttacattgtttttttttcctttggatctgatttttcaaaactttagtctaataatgtatcactctgtaaagtaacattccttgtaagatttttaaagtagaaaatcttttcacatgaagatatatatgtactatatacatatatgtatatatttctaaaccctgtgttctttgtgtaattgatggaggattggtctgtagagaacaaccaaagttgcaaatcatggagaaaatctctctgaagtgcaagtaagataaagaataaaataattggagcattgttgttttaaaaaaaaaagcttctcttggaaaatgtccttaagtatacgtggttagaaaaataatgaatcctagctttaaatttgtgtgatttaacttagtttacgaatgtttatgtttttcattaatggaaaaacgtttaccaatgaagaataacatgaattgatttataataattagcatgtttaatttcaaggatactgcctcaaaacactgaattaagttttaaattattatgcatttgaccacagagagtctataccaagctattatgatgtagttatgtttgttttaatacttcagtctccacataaatggcataagataacctcatattcataatactctaagtacgtgcatgaaaaaatcaaaactgttatttgaataacaaagctcatgggacaaggaaatgatgccaaactatcttttaggaaattacagagtaaaataagttatttactttaggtacagtatttaacttgtacctagtacattgatttaacattcacatctctgataaagagttacctactagtgtcagaaatcccatatatctccaaggttttactatggctcgaatgcctcctccacacattcaggtgttaccaatgtggttgtattgagaggtggagcctttaaacaatgattaggccatgaaggctcctcctgtgtgaatgagattaaggcccttattaaagaggttacactcagtgttcagcgatcttgctcttcctccttccgccatgtgagaactcagccttccttccctccagaagacagagtaagaaggccctcacctgacatcaaaatgccagcgccttgatgttggacttcctagcctccagaactgtaagaaataagtttttgttctttataagttaaaaatatataaatacataagttatttatcatgcaatatttaaggaatacctaagcacatgcgtgctcaccatctagcttaagtaataaaacattgccaaagcagcgaaatcccctcctctttgtctgttcccttccttccctgatcatctctcctgtcttccagatatacttaccattctgaatatagtgacaatcatcctatgcatttgttatttctttttttaaatatagctgtctatccccaagcaatatatagtattgttttacagtttttaactctgcataaatagtgtgataaaatatgtgttctgaaacacacttttgttttgctcattgtacttgtgaaattcatttgatatgtgtagctctggttcattctttatcagtgacataatatttcactgtttggtctacattatcaaatggtggcctactcagaaaagaatgtggttaaaaaaaacccctaagttggacaatattctgattattatgattaatttcagatttattaaactaaagtttattttgaatcaactagcaatgaaaaaataaatattcatatttaatatgaccataaatcagcttttctattgcctttgcatcaataattaaaaaataagtaaataatgcactgattcaatagtcaggtgctatttatcccaattctacctaatttagaggtaatatattaggtaggaaacctaagagtatcagtactgattagtgatttgaggcagaaaacttgcaaattaggctgggaattgctagtaaggttctggattcaatcatgatgaagtgacttggttttatgtgcctaaggaccctgtctaatgagttgtatcgtcttaataggccacgtactggtaaaaaaaaaaaaacaaaaacataaaagcaagcaaatgttaatgatatctcaaaagagctcattaattaggcagtcggcacctcaacacagaaaaaatttctggccatgtggccctcaccccactttagccttagcaggtagaaaaactaaatgcttgaggagtatttgttactaattacctctgattggtatgccatgtctggtctcgttttgatatagagggcaaaaaacatgaaagccaatgaacattaaattgccaaagtgagtgtaacacagcaagaacatttaccatttccaccatgtttcatcataaatgggagaaataatactggagttgtggaggcaggggttttggagatatcacagatttgagtcatggacagctatgtagtgctatccattatcttaaaaaaaaaagtccttttaaaacagtattagtcatgtctacaggatattttctcagttttgcataaaatgcttcctgacattttcatgctaatataacattaaatatttctgttgtataacaatctcactagaacttggttttccttttttttaagacgtgaattttaagtggtggtcattatgatatcattgaaaggaaaccagaactaacaataattaccaaatacagcccttttattacctgtttcccaaagaatctccattttatgtaccatttgacaaatgcaacctattgtgtaagtagcaaaaactctgcaggcagagtgcatttttaatactttattacattaagactcaggtttaaaaaagtaagttatttctgttagctttagtatttttcacttcatagaaaaagcttttgtctgaattgtcctattttggggttcctggatttagtaagatgatataaaatactatactattttaagatattattaatactccactactaagaatataatattaggatttaattattttttcttgcctatacatattagactatatatttgactttgcatttgcataaagagcatattattacaatccctaacatttcttagatcgtaaggcaaacctatattcaaatgagaatatatattgaagattccatatctataagcctgagataaatgtatgatttggtgagagggagaagagaatttataataatgataaaagctattaacactaaaatattttaggatttttagcacagtgtcattatctacatgaagaaattgttatacttgcaagtgaaatagttccacgtgaattcgaatggctgggctagaaattaggaagttggtactatttggaatgaagcacttatcatttttctttttctgaagacatattttttcactcatctcttctctccaacatctttcaacttattaagcaggtcgcctaaaggagaaaccatctccagaaaaattgcaataacttctttagggctttcgtatttggcttcagtttctcctaccttccgtaatagattcaccctctttgttcacctttctaaaggaggcattgtaaggaagctttcttacagcgaatttacaatatctggtgacgtctgactcctttttttttcttaggctagacactttctcactgaaagaagccttttgtcggcatctattatgctactttcccaccgttataaatcctctatattttcttaaataggacagatgatattaggtatccagttccaatgccatagcacttgaatttaaatgtagacagtgttttattctcctaatctctgtaaactctgatagttgctttaacagaacgtgccttttttgtttgctttgttcagtggttgagctttaatagtaagtgaggagggaacatagataaaagaatgtctttaaaggccatgaaatcttccctcagtttggaacaaacaccttagcttcaatgtctctgccacttagcatatttaatttctttggacaacattgtccacagtgttgaaatgaatctgacttgaaaagctcaggcatttttaggatatatattggcattaataaatagtgtgttttgacttcagagctgtgaattacccctagttccctgataaaatatttgtaattggattttttttggtcagtattaaagtgtgtttgagtttcaagagagacatgaggagtttttaatatagaacaatttattttacttaatatcttacatttatttttggaaagtgattcattgtatttaaatttctcaaatattcaaagcaccaaggaaaattatagacaatagtttctattattatttgcttatttttctattggaaaaacttttgtttttttctcactatacaaataagttttttcaattagcttaataactttgaacaacacatttatttgacactacatttaactgttgtcaaaaatgttattggatcatggttgaataattaataaaccattgggtactttctacagaaccattttagttattttataataaagtccctcataggagatattagttgaggtgaaaattgttcctatcagtataagcccaagaactcttgtctgacaattaagcaacaaataattattgtgccctcatagaaaccactggtagctctttcatgaatgaatgacaatatttcactttgtagttaataatgtatgaagacagatgaaggtgtttgtgacagataatactccttcgtgaaatacagaatcactgctctgcaaatagtattcattaagggtgtggtatttgtctggattaagtagtttttggtggcatgtatgtataaccaattcaaaaatgcttaatgaaaatttatcactatgatagttataaggttgttttatagaatacaaagtttgcaaatgcagacaggattcataaaggagagaaagtagaataggcatgctatcaggaactcaggcagaactctcaatgtagtctctgagtttacttggtctcttgatttaattaattaattcagtcagtcaattggtcatgtgtctatttactcaacaggtgtttattaaggaccgtgtgtctaatccagtcactggaactatgtataatacagacttgacttaaaaataatatataattcacaaaccatgctactgacccatttaaattgtataatttgatgatttctaataataaccatagagttgcataagcatcactacaaacacttttagaacattttctttactccattaacagtcaatccctatccccctttcccctgctactagcaaccactagtcttctttctgttgctatggatctgcctgttttggatatttcatatgaaatgaatcatgtaatatgtggtatttcatgactggcctacttcacttagcacactataatccaaagtacttcttcctttttttgcagaataatataccgttgtatggatgcagcacattttatttatcctttcatcagctggtagacatttaggttgtttccacctcttggttattatgaataatactgctatgaacgttcacttgcaagtttttgtgtggagatattggtggtttgtgtttaaagtattgaggaaccagatttaccaaaacagctgcatcatttttcactccagctaatagtatctgagggtgccagttcctccacatccttaccaatacttgttattggtctttttcattatggccatcctagtaagtatgaaataaaatatcattatagttttaatttattatctctctaatgactaatgatacagaacatattttcatatacctattggatattcatatatcttctgtggagatataaatctttatagcgtttggtaatttttaaattgggttttctgtgctattattgaattataagagttctttatatattctagatgcaagttttcactcgcgtccgagtgaagagaccaccaaacaggctttgtgtgagcaataaagctttttaatcacctgggtgcaggcaggccgagtcctaaaagagagtcagcgaagggagttggggtggggctgttttataagatttgggtaggtaaaggaaaattacagtcaaaggggggttgttctctggcgggcaggagtgggggtcagaaggtgctcagtgggggagctttttgagccaggatgagccaggagagggaatttcacaaggtaatgtcatcagttaaggcaaggaccggccattttcacttcttttgtggtggaatgtcctcaggtaaggcaggaacaggccatttaaattttacttcttttgtgattcttcagttacttcaggccatccggatgtatatgtgtaggtcacaggggatatgatggcttagcttgggctcagaggcctgacattcctgtcttcttatattaataagaaaaataaaacaaaacagtgttgaagtgttggggcggcgaaaattttcgtggtggtgtggagagataatgggtgatgtttctcagggctgcttcgaggtggattaggggcggcgtgggaacctagagtgggagggattaagctgaaggaagattttgtggtaaggggtgatattgtggggttgttagaagaaacatttgttgtgtagaattattggtgacggcctggatacggttttgtatgaattgaaaaactaaatggaataagagaaggagaaaaacaggtattaaaggcctaagaattgggaggacctaggacgtttaattagagaatgcctaaggaggttcagcatagccttgccagcaaagattatttactttaagagttaagagtggcggtttggggatagcaccaggaagtatcagctgtgatgtcttggagaagcagtgtaaacaagagcagggcatttatgagtagttgagactggtgaataggagtatgactagacagaagatagcagggatgacaagttttttggggtgcagtctaagttggtctggtgtctggaatgagactggggccgaataaaaaggagcgtctatacaggagcttaaatgggctgtaccttgtagcattctgaggacaggcctgaattctgagaagggcaagtggtaaaagtattgtccagtcctttttaagttggtggctgagcttggtgagttgtgtttttaaaagaccattagttcactgaatactaagagcctgagaaactgcttgggtgatttgactaataaaggccggtccattataggactgtatagaggtgggaaggccaaacccacgaattatgtctgccagaaaggaagaaatgaccgtggtggccttcttagaccctgtgggaaaggcctctaactatccagtgaaagtgtctacctagaccaagaggtattttagtttcctgactcggggcatgttgagtaaagccaatttgccagtcctgggcgggggcaaatccctgagcttgatgtgtagggaagggaggaggcctgaataatccctgagaagtagtagaatagcagatggaacactgagaagttacttccttgaggatagatttccatgatggaaaggaaatgagaggttctaagagacgggctagcggcttgtaacctacacagaagaggttatgaaatgatgacagaacagaatgggcctatgaggctggaaggagatattttccttggtctaagaaccatttgccttgtgtgggaagagattgataggtggaagtttcagcgggggagtaggtgggagtgaccgatgtgaaggagaaaaactggccatgagggacagaagttggaaggctagctgcttgtctagccaccttatcagcataagcgttgcctagagcaatgggatctgacgccttttgttgccccttgcagtgaatgactccggcttcctttggaagtaaagcggctttgagaagcgtttttttattaaagaggtattaatgatagaggacccttgtgtagtgaggaaacctcttgcatggtggtgcaggatatggaaggcatatttagagtcagtataaatattgatgtgtagtacctttgcaagagtgcgggcttgacttaaggcaatgagttcagcttgttgagaggtagtggaggagggcagagctgtagcctcaatgatagatgtggaaggtactgtggcacagcctgcctttgctggtgagtggcgattaggcctggtggaactgccatcaataaaccaagtgtgttcagggtgaggaacaggaaagaaggaaatatggggaaatggggtgaatgtcaggtgtatcagagagatacagtcatgggggtcaggtgtggtatcccgaataatgtgggaggccagattgaagtctgggccaggaacaatggtaattgtgggagactcaacaaagagtgaatatagctgaaggagccggggagcagaaagtatatgcgtcaggtgggaggaagaagatagattttaggagttatgagaactgtagagagtgagttgagcatagtttgtgatttttagggcctctaaaagtattaaagcagtggcagccgctgcacgcagacatgagggctaggctaaaacagtaaggtcaagttgtttggacagaaaggctacagggtgcggtcctggctcttgtgtaagaattctgaccgcactaaccatgcctaggaaagaaaggagttgttttgtagaagggattggggtttgggagattagccggacacgatcagcagggagagcacatgtgtttttatgagaattatgccgagataggtaacagatgaggatgaaatttgggcttgactgaagtaatgggggctgtctgtgaagctttgcggcagtacagcccaggtgatttgctgagcctgatgggtgtcagggtcagtccaagtgcaagtgaagagaggctgggatgaagggtgcaaaggaatagtaaagaaagcacgtttgagatctagaacagaataatgggttgtggagggaggtattgaggataggagagtatatgggttcggcaccacggggtgggtaggcaaaacaatttggttgataaggcgcagatcttgaactaacctgtaaggcttgtctggttttaggacaggtaaaatgggggaattgtaaggggagttataggctttaaaaggccatgctgtagcaggtgagtgataacaggctttaatcttttcaaagcgtgctgtgggatgggatattggcattgaggggggtaagggtgattaggttttaatgagatggtaaggggtgcatgatcggtctccaaggagggagtagaggcatcttatacttgtgggttaaggtggggggatacgagagggggatgcaaaggaggctttgaactggggaaaagggcagcaatgaggcgtggctgtagtccaggaacagtcagggaagcagataataagggaactgggcaggtggggataactaaaaaagagtgtttaaaagaatgttttctaagttggcaccagagttggggagttttaagaggtttagaagcctggctgtcaatacctaccacagttatggagttaagggaaacaggcccttgaaaagaaggtaatgtggagtgggtagcctctgtattgattaagaaggggacggacttaccctccactgtgggagttacccagagcgtctgtgatggtcctgtaggcttccgaggcaatcaggcaatgtcagtcttcagctgctaagccgagaagatctgggaaggagtcagtcagagagcctcgggccagagttccacgggctctgggagtggctcccaggtgagttgaacagtctgattttcagtggggtcccacacagatggcacgcggcttaggaggaatcccgggctgtgggcattacttggcctggtggccagatttccggcacttgtagcaagctcctgggggaggaggttctggaggaacccctggcagctgcggttcgggcatttggagttcttctgtgctggagatgtggctggggtttgtctcacagtggaggcaaggaattgcaactcagaaatacattgctacttggctgcctctactctattattgtacaccttgaaggtgaggttaattaagtcctgttgtggggtttgagggctggaatttaatttttggagttttatttaatgtcaggagcggattgggtaataaaatgtatattgagaataagacggccttttgaccctttagggtctagggctctaaagtgtctcagggttgctgccgaatgagccatgaactaggctgggtttttcatatttgatgaaagaacctaaacgctaactgatttgggagaggtcggataaagaaaaaggagcattagccttgactatgcctttagcttcagccacctttttaagaggaaattgctgggcaggtggtggagggctagtctcggaacaaaactgtaagctggaccgggtgtcaggaggggaggtgataaaaggattatagggttggggagtagaggctgaggaagaattgggacctggctcggcctggcgaggagcagcctggggaggaggggagaggtcagatgggtctgtagaaaaggaagattagaaagactcagcaatgcttggggttgagactgagagaacaagcgggagggaaagaaggaagatttgggacgagttgcattgggaacaaagagtagggagggaacaatgtgtgaaagaatgcctggacgtcaggcacctcagaccgtttgcccattttacgacaagaattatctagatcttgtaggatggaaaaatcaaaagtgccattttctggctatttggaaccactgtcgagtttgtattggggtcaagcggcattgtagaagaaaataaggcgtttaggttttaagtcaggtgtgagttgaagaggttttaagttcttgagaacacaggctaagggagaagagggaggaatggagggtggaaggttgcccatagtgaaggaggcaagcccagaaaaaagagagtagagacacggagagaaggggttgggggggttcttgccctccagaaaagcagagaaggggtagagacacggagagaaggggtcgggggggttcttgccccctagaaaagctgtacttgccgctaagggtgaaggaccaaggcaggcgtccctgcgtggccagagacctctgaaacgtgggtgaataatcaggcaggcgtccctgcgtgattaaacaccaagggaagactgtcttcccgagcccgtgaccagcacgggagttttgggtccacggataaaacgcgtctcctgtctctaccagaaaaggaaaggaactgaaattaagagaagggagagattgaagtgtggcgccaagattgaaaggagaaagaggttgagggatagtgagagaggttggagaagagaataaaaagaggccacttaccggacttaaaattggtgagatgttccttgggctggtgggtctgaggaccagaggtcgtaggtggatctttctcatggagcaaaaagtaggaggacaggggattgatctcccaagggagttcccccctccccgatctgagtcacggcaccaaatttcactcgcgtctgtgtgaagagaccaccaaacaggttttgtgtgagcaataaagctttttaatcacctgggtgcaggtgggccgagtctgaaaagaaagtcagggaagggagttggggtggggctgttttataagatttgggtaggtaaaggaaaattacagtcaaaggggagttgttctctggcgggcaggagtgggggtcagaaggtgctcagtgggggagctttttgagccaggatgagccaggagagggaatttcacaaggtaatgtcatcagttaaggcaaggaccggccattttcacttcttttgtggtggaatgtcattagttaaggcaggaacaggccatttacatttcacttcttttgtgattcttcagttacttcaggccatctggatgtatatgtgtaggtcacaggggatatgatggcttagcttgggctcagaggcctgacacaaatcccttatacatatgatttgaaagtattttttctcattccttgggttccctttttactatctggacagtgtcctttgaaacacaagatttttaaattttgataacctctaatatatctattttttgtcttttttgttttaagtgaataactagtaagtctgcctaacttaagatcacaaaaatttctcctgtattttcttcaaagagttttatagatttagctcttacattgaggtctgtgatttattttgaggtaatgtttgtgtgtggtgtgaggatggagtccaatttcattcttcaaacttctttttttcccccttttttttagagcaaggttttgctatgttgcccaggctgatctcaaactcctgggctcaagcagtcctaccgcctctgcctccctatgtgcctggcgaatttcattattttacatgtggatattcagtttttctagcttgatacctatttttataatctaatagaaaggactggtgctcctcaaacttaaatgttagtaagaatcacctgaggttcttgttaaaatgcagattttgttatggtagtgggacctgagagtctactttcttacaaacttcctaggtgatgctgctgattctggtactgggactttttttttgtttatttttgagactgtcgcccaggctagagtgcagtgttgtgatcatggctcactacagacttgacctcctgggctcaagagatcctaccacttcagcctccagagtagctgggactataggcatgctccaccatgcctggtgtattagtccattttcacactgctataaagaactggctgagactgggtaatttataaaggaaagaggtttaatgactcacagttcagcctgtctggggaggcctcaggaaagttacaattatggtggaaggcaaaggggaagcaggtaccttcttcccaaggtggcaggaaggagagtgaacacaggaggaactaccaaacacttacaagaccattagatctcatgagaactcactacaagagaacagcatgggggaagcagcccccatgatccaattacctctacccggtctctcctttcacatgtggggattataattcaagatgatatttggctggggacataaaacctaaccatatcaccaggctaatttttgtattttttgtagagacagggtttcaccatgttgcctgggctggttttgaactcccgggctcaaatgagctgccttccttggcctcccaaagtgctgggattgcaagcatgaaccgtgcctggccattcctgggacattttgaatagcaaggaaatagacaagtactaaacaaagaattataagtgcattctaactgtgcatctgttttattttcacctgtctgacaactggctttctttgctgcttcccgtatgtgggagactataacctctatactgcttccaagatcacatcccattaggtcaagccataaacttaggagttgcaaaatggcattgctaagcctgagtttttaattcccagcagagatgagccaattggctaccttagacctatcagctcttaggtgttcagttcttagttctatcagctgtggctaggggtctggcttgtagagggctcagtgggtcagtggcagctcagagagaagagagttgtgggctggccagaaactgaatgcttttctacagatgtacaattgaccttctgtgtcatttcacagaagtgtgggcatctttgactttaaattgaaaattgttaaaggcatggtaattagcaggagtcaggaattctccaaatgactgttactgaccaattctgggcagaggagggggaaaaagaattttccttgattaccagctaaactgtgtttcatatttagcaacatgaatgatttgtgtgacttcactaaggactccgattggaacacaggcagtcctagtgcagactattgagtgggcagtcatgggtaaggtactgagcctttgtggaagctttctcatttatagactgaggaataatagctgttctgcaaagacatttttaatcattttgtttctggaacaatgtgtaggtgctgaatctgttagttttcctctctttccccgccttcctacttccagaaaagattttctgtgatttacatataaatgatcaagtataatagggccattaaattacggataaaacaagagccctctaatggaaagagaacatagtttttctacaaaaatcaaggctaagatggttactctaactgaataaaaatttaactatgagctttctggcacacatcataaaaacagaatagatgaaactgtttttaatatataaaaatcttaaaataccagttaggagagagaaaatgtttttttctaacattaaaatcatgtttacatagaataactaataagaaaaatggaatgacataattgacaatgttttaaaagtatcaaatgataaaacctttttctagtatgctccttgaattctagcctctgcacactgtctagtttctcatttttaggtatttgttacattagcatcccacttccaggtatttttatttggaagtatttttatttggaagactgggatttttattttagaagcatttaaacaaccagctttaccttatctattgaatgtctctgttctagctccccctttctttgtcccttataaagggaaaccagtagtctgttagtgaagagtgggaaaatcactaacttactgtaaggatattaactcttatatatcacataaaacatatactaggtccattacatagtacaaagaataagttgctacagtgccaataagcatgcaaataaatttgataattaacagctggtaggatttatgcatttattcactcatcatctattgagcatctattgaatattggaattatagcgagtaacaaaacaatggaccatagattatatcagaaatcttcatggttgcatgcaaatgaaagaaaaaaatagaatgaggatttatgtgcttagggcaaacactaacatagagccatttcttaggcacacatcaactaattttatactatataattacagtgcttaggtgaaaacaaataatacaatgatggttttaataaaattaaatttaactccctcttgtttcactgttactgtttttcaattaggaagcatcatgccatttgaaatttgggtaatacatatattattttcaatatttagatagcatgtatgttaaaaatattttaacttttccattttgcttttcacttcatgttatcaccctatttggacatttaatttttcttgcttgtattgttgcctgtgctgtacaatctctttattgctgcttttcttcaatccttcctgcatattgccattagactcttttcctaaagaatagtctttgttgtgagagtctcttgcccaccatctgaaatgctgatggctgaaattcaaggctttctaagagatggcagaaactaacttttttgcctcttattttgtatcactacattcatgaaagtttgaggtataataattcacacaaattcatcacataaaactttaatttgttttcatttgcggtattctccatgagtaggatagcgatttccatcctcactcgctcaaatattactcagcctttcttgtatagctcaaaggtcacttttgtgaagctttccaagttgacttcagctttcaggaatttccttcatctaactctttaagtaatttgggttagtttatatataacccagaaataatggctatgtgactcccactctatagagtaacattttttaaatctgcatctaatgatcttaaataataaggtgtactttttgctagattataccatgacatgcacacatttctccagaaatcgtcagtaagaccttcccaaagttctatattcatgtcagccacaaaattatctctctggcttcctcccattcatgtttgttcattgcctagattaagccacttcaccttccttatcctttttttttttctttaattactacagtttggttctgttgcccaggctggagtacagtggcatgacctcagctcactgcaacctccacctccctggctcaagccatcttcctacctcagcctcccaagtagctgggaccacaggtgcatgccaccatgccttcctcctccattttatcacatcatgacactctgtcttcttgctggaagttgtcattggaacttctgctgtttcctacttcctagggaacccagaattttcataccttactctcaacccatcagttcccctgagagttcaagaaacttccaggtaatagcagttcttctctcactctaaccgatttttgttgtgagacatccttgtggagactttctggtaaataaaactttctactactgtcttttctatatcattttcaacaagtactttctacacctggtaatagtgcatgttttatctactcttcaaaactaagggaaaaaatgaggacaggaagtacttttttattactcatggcttaactcagaggtccccaaacgtcgggccacagaccagtaccagtatatggcctgttaggaactgggacacacagcagagttgtgcagtgggtgagtgagcattactgcctgagctctgcctcctatcagatcagcagtggcattagattctcataggagcaggaaccctattgtgaattgtgcatgccagggagtgagggatttaggttgtgtgcttcttatgagaatctaatgcctgatgatctgaggtgaaacagtttcatcctgaaaccctccccaccgtctgcgggaaaattggcttccatgaaactgatcccttgtgccaaaaagattgagggccactggcttaacctttagcaagttctcttctttgggtgaaatacaagtaggaaatgaagcttcagtcacatattttctttccttttttttgtttgtttgtttttttgagatggagtcttgttctgtcacccaggctggagtgtagtggcgctatctcggctcactgcaacctctgactcctgggttcaagtgattctcctgcctcatcctcccaagtagctgaggttacaggcacgtgccaccatgccctgcgaatttttgtatttttagtagagatggggttttgccatgttggccaggctggtctcgaactactactgacctcaagtaatcctcctgccttggcctcccaaagtagtaggataagcttcagtcatgtattttctttctttcttttttttttttttttgttttgatcacaggcatgagccaccatgcccggcccagtcatgtattttcgatacaagccgggtgtcattgacatctaccacatgtccacacggcatttcgttcttctgcatgtagtgttaaagaaggtgtagataaaattcctgtcattccttccttttctaagcttgcatttcttttcctcctcctaaaaagaaatgataatagcttaaccaaataaagcaatttctgattatgcatgatataatagattatgttatcaggactaggtaagacaatcaacaactaaccaaatatcttaatgttggaatttattatgcgctacctatatgcatatattctatgggcaaaatattatattcatataatgcatacatatgtgtattttaagatactttgtggtttttctaaataattgtattatatttaaattatgagaaaagttaaaatattaactaatgaataaaattacatgtgtatatatgtatctgatatatataaccatatatattatatatttatatatgtgtgtaatatataacctatagtcttccctctttctccattacaagatagacctacagttatagtttttttaacacaaacttctactgaagatgcagagtattagaatttcctttcttgctatcaaactcaaacattatcatcctcatggaaacattaataatagctgtttactgtaccattagtaggtaccaagtactactctaggagatttataaaaattaaattgtttaatcataaataaataattgtgaagtgaattttgagaacatggaagctcaaggacacactgtaagtgcaggagatggaaaaaagggtatataaaattggtctgaatatccagattaaaatttctagcattcttagttggaatggtatatataacgaaatactgtgtggaactcaaaacaactactattcatcgtaagcatatttctcacagtagcatcagccacagcgtcactgagcaaagtagagaaagtggttgtgaatctgacaggccgtagcttaacatctggcacaataaatcattattatcacattcttaaggttagaaaggagtgataatttaaatgtttacataaaagaagtcacgttttaaatttctgttttcttggtaagttatacttcttagccacagtttccttgttcataaaatgggggcatttgttagatctgtaaggatccttcaagccttacaatttctacaaatttgtgattcctttcaattaacattttatcaccaaactaaattatcttaaaggttgaaagaatatgagatttaaacccaatgagttattctattgcattagattcagaagaccaatggagaaaaaagtataaaacaaatatatgcaatagagaaatatcaaaagttttccataatatttctacatgtatgtatacattgaaataacaattttaatacttaccatttaagtaaaatcatatatcgtaacttagagaataaaagcttttctaaggaattcaataattagagactttcatggtatgttgccttatgattctcttttgatttgctttgaggtatctgttacttctttgaagtttatgtttttcttacatttagttttggatattttctcccattacatttttcttccataatctctaagataaacacatttattattaaaatgcagtagatttcactagatctttaaaactcagtaacaaagtatcattttctatgcattattattatcactactaatctgtaattttatagtattgtatatacttatattattttcaggtttttggatcacatttcctagacaataatgagaaataagggcttctatttaaatggatattcaaaaagtatcatatatttgctgtggaccttcatctcagtgaatttgtgaatgtattatttataatgaaaataaaataagtgaatgctaaaaaagtttttccttttgccaggggatttaccagaaagagaacaaaatggatcatggtatgatacttttctgtgtaaatatatagagaagaaaatctaccaaagatttaacaatgattttcctacaattggggtgggaatggaatggtgagattcagaacaggttcaactctctatgtggtatctttctgaattagaacattttgaatgaatttgtatttctttaataactactaaaatatgttgttatattaagatagtcatatttagagtatttatactaattcttgaaatcacaacaatttatttcatatgtaaagaacaattgcaaaaacctctgccttgatggagtttacggttcagtgggggagagggtgataataagaaagtaaaagatggtatgtagaaaaataaaaacacagaagggcagtaggaagtgtgtatgtgtgagatataattcttagtaagagaaagaaggcctgtaactgaaaaattaacatttgagtgaaaactgaaagaaggcaagtatattattagtccagacgttctcacactgctataaagaaatacccaagactgggtagtttataaaagtaagaggtttaattgacttacagttccacatggctgcggaggcctcaggaaactcacaatcatgatggaaggcaagagggaatccatgaccttcttcacgtggcggcaggagagagaagagtgaggagtgaaggggaaagagccatttataaaaccattatatctcatgagaactcactcattatcacaagaacaggatggaggaaaccacccccgtgatctgatcacctcccatgaggggtctccctagacatgttgggattatggggagtacagttcaagatgagatttgggtggggacatagccaaaccatatcagcaagggaagaaaccacgcagttgtctgtaataggaatttcaggatgaaggaactgctaggacaaaggctctgagtcagaagcacatttggatagtcacagtaagtgggagtgtggtaggagatcaagtcagagacgtaatgaggtaataggaaacttgggccatggtgagaaattttatattggctagatgagttaagagtgaaataagcattaagaaggaagtaagtggttgggtaattgagtaaaatatggtttgagtgcctcaaaacaaagagcaaatatgaatagagaaaatactatttccccagctagcaaagtatttttggaaaaattaatatcttctcactagacatatgtatatatccaagctatttaggtaaataatttgatttaaactgataaataaattaagatattttacaatctttcattcttttcatttttttcatttatttcttgagtatctattatgtatcagaagacaaaatcacatcatactctcaagtttacagtctaagtctacaacgtaagtctaatatatccagccaaagttagatttgcatttattttgcatgataatgttagaatggtttcaagtaacacttggaaagataacctaaaatgaaaaagtttagagagtgaaatgcatattattttttatgtgggaaacatgaatcttagttgtgaaaaatagccttgatgatactctgaggaaaagtaaccaggttttttttttaaccattaagtgtgatgttagctgtaaattttttgtgaatattctttgtcttgttggggaagtccacttttattccaaattttctgacagtttttattatgaatgagtgctggattctgccaagtctttctttacatgaattcatatgattatatgatttttctttagtctcttgttgtagcggattgcattaattgatgttttattatttttatttttattagtattttttgagacagagtctcactctgtcacccaggctggagtgcaatggcacgatcttggctcactgcaacctctgcctcccgggtttgagcgattcttgtgcttcagcctccctagcagctgagattacagacatgcaccaccacatctggctaatttttgtatttttagtagagacggggttttgccatgttgaccagggctgtctcaaactcctgacctcaagtgatgcgtacacctcaacctcccaaagtgctgggattacaggcgcaagccactgtgcccaacctaattgatgttttaaatatcgaaccagcattgcatacctggtataaatcccacttgttcatggtgtatgtaattttttatgctttgttggattagattatttaatagttcattgaagatttatgcatatatatttatgagagatagcttttatttgttgtaatgtctattagggtttggtactaagttaatactggcctcttggaaaaagataggaacaattttctttacttctgttttatgaaatatattggaagattaatatttcttccttaaatgtttggtagaatttcctggtgaaataatcaggtccttgttcttttgttcttagaaggttattagtaattaattcattgtatttaatagacatagacctattgagattatctgtttctccttgtatgagtttgtgtctttcaaggaactggtttatttaatataatttatccaactattgaccatagagttatttctactgttgctttattaccatctaatatctgtgggatcaatattttacttttgatattggtaatttttgtctctctcattttttcttggctagcatggctagtggtttgtcaaatttattgatctttccagagaaccagcttttgatgtctttttttctattttccttctttcagtttcactgttttctgctctaaattttgatgtttatattcttttttagatataaagtgttgttttttctctggtttcctagggtgaaagcttagagtttcagatcttttcttcttttgcagtacatgtacctaatactatacatttcccttaagtagtatgttcactgcatcccataagttttggtcagttgtattttcattttcatttagtaatattctagaatttctcttgagaattctccttgactcgtgatttatttggaagtatgtttaactttcaaatatttggagattttcaaactgtctttctgttattgatttttagtttaattccattgtggtctggaagcatacttcatgttatttctattcctttatatttgttaaagtgtgctttatgggccagaatgtggtctatattggtgaatgtcccatgtgagcttgagaagaatgtgtattctgctgttgttggataaggtactctataaatgtcgaatatatcaagttaattgatgatgctgttcagttcaactgtatcctaacaaattttctgcctacttgatctatcagttactgaaagaggagggttgaaatctccaactttaatagtggatttatctatttttcttttcatgtttatcagcttttgcctcgtgtattttgatactctcattaggtgcttacatatttaagatgttatgtctacttgaagaatttacccttttttgttatgtagcgtccttccttatccttgatacttttcttgatctgaggtctactttatctgacattgatatggctattccagctgtttttttaaaataatgttagcatgcgatatcattctttattcttttattttcaacctatctgtctttgatacttaaagtggtttcttgtaaacaacatcaagttcagtcttgtcttctcatttactcttacagtctgttttttaattggtgtattttgaccattcacatttcaagtaaatattgatacagatggattaatgactgtcatatttgtaactgttttctatttattgcatctgttctttggggaaaggaagttaaagtcactaggtttattattccttgcaacataaattaatggctctggggggatatatgcaggtctctctgaaagtgtctattgtgaacttctagttttctttttttcgaaagccttgaccatgcagaaacatgaaactgttcatatagcattgtttcctgacagtttatagccaatctatgtcagttccataatttttaaacttagaacatttcattaacctccttatttcctttttataaacatcttcatttttcaggcattgcatttaacttgattctgaaccttactcagatgattaactcaatcctttaagaagatattgaatttctgaagaactttctcaataatgttgatttaaaatgattaatgatagtccctttacttcccattcatgcttaaattttataaaatacaatcctttttatttagaatttaaagaattttccttaaatattgtgaggtgtagcagtaacagctttttgttttgagcaaaacttttctctggttatagtaaaaactggtttattccccttcgcaaatttgcaaactcaccaaaagccctcaatctgttcttccacaaagatgtaataaagcaatttgctgttgaattctcaaaatacaagtatggctttaaaaacaacttcttctggatatattttgtgcaacagcattttaaaattcttgtttattcttttgaccacctgtgaaatttggagtattgtattttagccaggctaatataatcaattctgccaactctatgtcaactacaaggaaatattcttacttaaaacaaataaataccactaattagctcttcatttcgtgaagtctgagaatgtgaggctcagatagtaaccattgaaaaaagacaactcagaatgttgttatttgagcataattctattggttctctgacatgaaaggaagcctttctcccccaaacttcaagggattttctttatttgatctgagaatcactgataacttttgccattctcaacccaacctgattccttgtttgttatgattttaacagtgacaacaaggaaaaacatttgatgttagtaatatgtgaaatcttaggattctgtgtcattccctttattttataggtcaatacatatttaatacatttctactgcatatatagaaaaggaaagtgagatttatatactaaagcatgaagtacagtgtcacaaaagcagaagaggaaagaatttcaagaaggctgaaactgtcatcagtgttaggttcagcactatgttttcattaaaaaaagaagaaataattttcatttgaaaagttaaaaaaaaaaaacgttttgtaaagcttttggaatgagtcttactatactacacttgtttttgtaagactgcctgaccctaggaattctaagatagatgactaatatagataatggttgctgcttaagtgtgcttatgtgtaaccctaattcatcactgtccaatggttaatagatttagagtagctgcattaaaaaaaaaaacacgtgaggtctttttttaaaacataatctgtcttgtctttgtcattttggcaatagaaaatgtagttttattttgataaaggttgaagaatttattgggagaagatatctgatggcattaaaaatgtctccctcaaagcaatttaagatatcaaagttacttattgaggctcaatctgttgacacagtcatacaccaataatttcctaaaagcagtacagaatactaatgggtgattattttttagcaaagaaaatgcaaatatattctgaattgaatgaatgttatattaaaattagatgacgaatatttgaaatgaaggagaaaaagttcattagcagaaaaatctcatgaatcattaatatttccactatagagcaagttgattttttattttagtacagtaatgcatagtatcacatcaagtcatcttttgtttatacggttaaaaggaatttttcaggaaagtatttacttcataaataaagcttttttttctggaagtaattgaggttgcatagcagtgtcttcagtacggttaatgttcaaagtgaaaagaaaatatacacaaactttgggtggagaataatacagatttcaaacacatcaataattcatttgacatgaagcaaggaggggcggtgtgtcctacatgctctgccattttctctgctagaattccacttcccccattgtatcctctcaactcccacaactcctctttaaattttagttcaaatatcacttcctcaggaaggcattctcagattctcagatattgtcagtacctactctatacttatttataccaagtacttatcacatatagaattaaagattggtcgtttaatggtgttatctgtcactaaaaagaaagttcttattgtcatggaacatgaccacattgttcacagttgtattcctatgtccagaaatggcactttgaacataatgtccactcaataaatgtttgcttggatgactaaaaaaggagattttttaaatggggctagaaggtatattgcttccaatcgtcagggactttggatttgtgtttgtgtgtttaggctactagggagccatgaagagtttttatcagtagattgacaaaaggaaagcaatactcttgtcaggttgtaatgtgtagagagctttaagtgtagcaaaactgcagggaaggacactatcagagtactgatggcagttcaccttgaagacagtatggtaacaataacatacgagatggtagcattgggaaaatattcatgatacattccaagggaagaatttatagcactttgcctttgattccatgtggaggaggagtatcctagataattttaaggttttgagccaatggataagatgaatggtaatggcattactgaagaaaaggcaattcaagaaaaagagcatgtttggggagggataacagtagcaacaaaggcaacaaattgcctcttaatgagaacatgctgtcttatatcatagtagatactacacacattctttctaatttgtgcagtaattcagtgttactcttccatttgaaccgttatggaaggtaaggctcttagaggttaagaaacttgcttaaagtcaaacagttaggatgtggcagaatttggattttattccggattttatgctggctccattatgccatttttgagaggataagatgttaaattaagatagagaaatgatagaaaaaatatgtgtatatatacacatatacaaacatccatgtatataatgtctgtatatataactatagatgtatgagtgtgtgtgtctccgtgtgtatatttgttgtgtatgagaaattgaaacacatttatgtatggatatttagcaagtggtgaggaactttgagatgaggattctgcagtgatattgatgttggaaatgggcaatttattcccatatcaggttctaacatttaaaatgcacctgaatttgtattaagaaacttgtcttgctaaattttaattctatcagattaataatagccacagagcttgtaaagggaatcattattctaaccttttgaaaaaatttttttgtagctcagtttaaaaaaatggaatcatcagcaaaagtttatggttgttttgtcatccagagtgtttccattaaaaaggttttgtgattattttattcagttatattaataataaaattcgttttaatttatatttattgtgttccatcagattcttctatttgtggtgacaggtaacttaacacccttgaaaacagctgtttacaagatgccattctgtaatgtgggtttctttctcttctaatgggaggtcctaatgagcaatgtaatgatccaggaagatgagcaaaaggacttaataattgaagattgagtgcaagaagtgttctgtagaagtttattaaaaataatcattgggtattttggagataattatttcacattagaatggagaatatgattgtaccagaaaggaacatgggcaatcattctgtctatccttgtaaattcttgatctgcacctctagaattttggttctggccagtttatgctgactacatccatttttgaattacatacataattttagattgtacttcatagtcttatgcttaacagtgtgttgcctttgaaaggtatttcagtttcaatgtaagcatttcttagctcctcaaattgatggcaagctcctcctttaaggtcagcatatgttttctggagatttttatatcctttaaactgcctaatggtgagctgaatacaaaataaaaaataatacgtaggccaactatttggaaggctgaggcagaaaaatcacttgagcccaggagttcaaggctgcaatgagctatgattgcatcattgcactccagcctgggtgacagagcaagacgctgtttctaaaaataaaataaaataaaataaacttagggaattagatacagcatctcttatggcatagaaacatgaagatatttgtttctgtcaactcagggtgaaaataatctgatgaaatggaacaatctagttgaagttcagctctggctatatgacttccgctttctcacctataaaatagtgataatcaaagcatttaccagttgtatgttatcagaaattgaattttaggtactcctgtgagcatttggaatcttgttaatgttatcatttttcctaataccatcatgtgatatataatactgagaacttggaaatactaccttgtgtttttatacccagaaaactcaagtagatacaaataattagggtaatttgaatgagataaatttcagaaattaaactagtcaaaaatttcaatatttctacattttttatgtgctaagtgaagacctaggaaactcagtgggatgacagcaaatacctagacattgtgctggatcggtacagaaagataaatgaggtatttacctcatttatggactctatacttaggactctatacttaggaaatatggactctatacttaggaaacttagggaattaacataagcacaggaaatataacacacatatcaaatgtagagtcatcaattatttgaaaaatgtaaaatgttcatcatatagccatctaccattgaataattttagatgatctcaagtctcattattgtaagtcacttcccctcctcccacaaatgaccttaaattattccaccaactctgtatcttattacttcttttgtcaaagcgaatatttggtaagtaaaattttaagtaaattgcttcagaatgtcaccatcttatttcagactttcatgtacacttcaacatttgaacctttttttttgtacttaatgggactaaaaatatctgcactacctgtacgacacattgttatttgaatactttgaaactgtaaaacactttgcaaatactgagtatcattatttaactccagctaaacaaacaaggttgatatagatgttttcaatgttgctgcctgacagcaaaacatgtgttagctcagcaagagatattctgtatatactctatgaaaatactcgcagatgaactttccattaataaaaactaatcgcttggtaaagaggatattatttgtttcttcttctatcccatttgttacaaatttaggcatatgaactacaggcatatgaaaatccaggttttacagtgaaaactgtagatcagtggcccccaacctttttggcaccagggaccagttttgtggaagacaatttttccatggacagatgatggggggcaggggcaatggtttggggttgaaagtgttccacctcagatcttcaggcattagttagattctcataaggagcatgcagcctagatcccttgcatgcacagtttacaatagggtttgtgctcctgtgagaatctaatgccactgctgatctgacgaggcagagctcaggcggtaatgcttgcttgcccaccactcacctcctgctctgcagcccagttcctaataggccatagaccagtaccagtccacagcctgggggtcggggaaccctgctctggattcttgcttcattctctgatattttaccatgttttaagaagagttagggaagattataggtctaggcaatataatgtaatggcaagtcctcaggctccaaagtcatagatttccctttgtatcttggccccaatgctaatgatgtttctttagaaaagttgcttaaaaataacgtttattgaatgcgtataacatctcaggtactgttgcacatactttacatgtatgggttatttactattcccagaaacactagaagtacattattattattgtttctatttgatagattaggtagctcaggtattaaagagttgacgcgagatttgatcccaacagtgttttccagagcctgttatttttttacaccatgcttctcaggctctgtttattatctataaatgagattaaaaggtgatctactttatcagtttttgagaattaaatgagacaataggtgatgaataaattacaattcaacagcacctgtaaatgctcttgatatattccaaacatctgttggccaacatattcattttttttaacttgggtagcagtgttaacactagcatagcttctaaatagtgaaaaagaaaaaacaaatatatctatctatctatatatgtatgtgtatatatatatatatatatgcttgttaatttgaaatagctaataaagaactaagtgaaatcagctacttacaagtagaatgaaaacattaaaactaagtacaatttaagaggatgtagtgcattttgatgggctgattgttagtgtggaagagactttatttcttccctactaacattcactgttaaattggattaagttcctaattttagtcagtcaagcatataaaacctagaataaccacagagagtaggagcaaatgtagcctacaccttggcccccagcatccctaatgagggcacataactcccagaaacactgtttccccattcttaggtcaattcttgctgggacactggctttttattctcccagcttacgtcatcattcaggaagttgtaaataacaatctatgaacatgcattcaaagggaatggttacaagctcagaatcaaccagggtcacatcttcatttgggtttaacatattcaagaactagtgtaccccaagcctaaaggtagagactacctccagcgctctagcccagaatagctgtgtattgtcaagccctaacagtttatgaatagatgctctgcatgtgttctttagagctgtgctagaattgtgtgtttgaaactttaatttgtgtaggaagcacctgcagagattgttaaggggatggtgatctggttggcctgacttggggagtgagttttctgcatatccaccagattatcagaggatgcccatgcagctggtcattggagcaaacttggaataccaagcctgtaaagcacagatgatgcattacctaggtgagcttcacacatttgtaaggaagttttaagatcgatcttgtcagatacccagagccagatgactgcattttaaatctgtgtgctgctctgttttttaaaactaacatttctattctaggaatcttttattataatttagatctggaatgacttttttctaaatggctcccaatgtaatgactgtgtcttcagattcagcaaccatgttttcattatcctctgaatcacagagtataattgtgcattacagtttggggtttgtttttcctactaagaaactccttttccttgcgtcctttctgataaatatcattaatttttccactatggaataattctacttcacttttgaaacataacctcatttgaatgtattttaactgggacttcattgcctgagggaagatggattattagtgacatgtgtcttgcttcttgatacagaaaagataatataaaagtagtgtttctactatatcttaaaaaaagcttcatataagccaattttctttaatgatattgtagcaagggaaaatattgtacaactcatttaccttcatttttacatatttttcaacctcaatgataattctggagatattcatgtgccttatcttgaaatcaaattaaatcattcttttgtgatatgacacgcaatttgtgacattttgagccaacagtatattaagatttaattttcagttcattatagacctagtgcctaaatgaaatttattgagactaagtaactctgcagtgattgtgggctgatggttcaagtacagtgattcagtgattcttagtaggggagaagataggccatgtaattgaacttatctctggatttttgaaaggttgaggcaatacctgttcttccaacccctcactggctccacatttcaaacacactatacctgagttggaaatatcagcaaatgtgtttctagatggatatgtgaaaataaataattattggcttactgtgttttttaaaattgtggtataccatacgtaacatttactgctttaaacattttaagtgtacagttctgtggcattaggtacattcacattgttatgcagccatcatcaccatccatgtatagaactgagctactattttttaagatgtattttttcccttagattcttctcttctgagtttgttaatgatgtccaattaaatgtatgcttattttatatgtatgaggttactttttaaatgggaaagttgagctccatctgcctgagggcactgtaaaaatttaactttcaaaatataattcctgttttgctgttgttgttcctcatgatttccttttttatatgaatattttctttaaacatattgacagtcaatttgacaagctgtcacttctggcaaatgccactttttccattagtaacttccttctttcaagaaacactattagtcactatatcttattatattaaacatctccttttaacactggtaacataaaaatgttttactaacagttctcacacaaaaatatcatattgaaacaaaaattagaggaccagaggcatttactcagaaagaacaaactttttcttagtaatgacagtgacccaaccaatcaaataaattgaagaagtaataaaatgaatgcatttttatctgaaacggatgccaccagtaacattttgggaattccaatttaaaaggcccaatgccccccatgcaagattagtttttcaagatacttttacagggctaggacattaaaatatttgcttctctattggagcagctctttcaacaagttggaggactgatcacatccctttgccaattgcagttcagataggctctgggaaggcaaagtacaggatgtcatgcaagtgaaaacagaagtgattaatcttatggatagatcaaggaaatttatctgaactttagaagtgagacttgatgctaaataggtgtttggtgtatgaaaactaaggatgaagcattcctggtaaatagaaaggcctgattgaaagctctgagctgggaacacagcagagggaagcctactttggaaggagggattggtctggcaaagtgctggataacacaggttgtaggtcatataaaaccttgtagggggtttgagcttcttgaagcctatgagtgcaatgagaagccactgaaaggtttttagcaggaaattaacattgtttctaatttttatttttaggaaaataacttgctactaagtggtgaatgggagacaagagtgtctgtgaggctaaaggctgttcttgctgaagccccaaaatacttatttactctttcttggtgtaaatgagatgaaagatactacaggaacatcacatgtgttcaataactgcgcgagtgatatacttccctacggggacatgaacagtacttgaacagctgttaatgtctgttgcccttaggaaatttatttcatcaagcatacagtgtttcaacccttattaacttatttcataaggcataatatatctgactgtgatctgttcacttaatgctactctgctctttgcacgagcatgggacaaccagttgctctctgtagtcgtagtttattaacgtgcaattaaagacatttatcatatctctgaaaatgtctcttctcccataaaattaacatcatctcctcaaaaagatgcttacgatatatgctggattatagttactgttaaaatgtattcagaaacaaaaatagaattgaaaactatagaggaatttttttaaagcatgggctttggaatcaaacttgtgtttgaattctagttctgccacttaccagtcatttgcacttgagtaaggtacttatcccttctgaacttcagtttttcatctggaaataggcataatgacatctactttatgaagttgttggttatgtaaagccatctatgaaaaatggttagaccagtgactgacacatacgcattccataagtgatagatacataaataatataaataaaaaatgaatgctatagctgacaaatgtgattaaaaagtctacaatgcaaattatttttataaagtataaaatccatgtgaccatataatatactaggacaagaatgcctgttagatttcagattcaagacaacatactaagtttaagtgtagttatctttgctaggttagctttatgtatttgcatgaataattgtttaaatttgtctgattgtactacggactggcaggcaataaatttcattatctagtcttaaaatgtgaagagaagacagctcaaagttcatttctcatgcctgatctttctgggggatacaatgtacaacatcagataattcttttgccttcttttcttttgtgcatccagtaacagttatatcatttttttctgaatcagccttttcacaaaaccattatgtgataagctcttgtcttggaaaacctcaacagcttcctcaacacctatattttaaatcctgcttaaatgagattaaaatacggcactctgttaagctgtaaaactggctttttgcttctcagttgagtgttggtttgaatgtgtcatttgacctatattgctgctctgaatcttcctcggttgccccaatgatgacagtttcaatgatgtgggtgtttgcagcagagttgttcctaataaggaagtaacgctattgtctttcagacatcattcagcctgaaaagtactatttttcccacctagagctataaatgtctgtaaaatcttttcttcttttggtagcatttgcagcagcagcaggaaaaaaaaatagtcctagtagatttgcagcttttgtagttttggggtgttgtggttccaggctaagattcactcacccttcttcaaaagttgtatacaaagggttgatagctaaatggtgactgaagtacttgatttattagtatctggcagtcatccaatatgtactagaatacaagactctctgtcaacaatagctgcataaagagcaaactgctctgcctgaacctaaaataaggccttctgctgtctgcccgttaattgaagacaagtgggccaggagtggctgaggaaaaacgaacaaagaataggcaattgtcatgcacatggaggcactacctgtgcctctttgagaaacagaaatcccctgacctggttcttacattgagagaagctaacccagcccagtaatacattttagctccttgcatgtataattatgaccattgaaaaataggatactacctttttattgggtcaggtaagatgcaggaggagggagagcaaagtgccctacttgagggtgggattgagattagaatgtgaagagaagagcagaaagcttccttcttacacaaataaaggttctgtggattcatctagaaaaatgagttaaaaaaaaaacgagtggaactatagtttctaaagtctgtggagttgggacaaatggtaattataaagactaaatgtgaatactcatagttctttaatttgattgtattaccacttaattcatagttttgaaggaaatagccattatattagatggcacattaattttaagatgcaacccaattttcaaaatgttaaaatggaaaagaaagttaaagggtgattgttaggacaagcatctccaaatactctgtgtggaggcattttaattccatgctcttgcaaaattaaactcaaaaatgtttcaaattactgggtgttatatgcccttctggtggaagccacattttctctttcctttctttccctgtctaccctccctcttccccttcctccccaaatctatcagtaaagaccaccttgctgtgggcagctagctgaaagagaccatctgccttaggaatagcctacactagattcaaactacaaagaagcaggttgggggaaagaggaagtgaggatttcaagtcaagaaagcatcctgcctactctggcaaagtattctgccagcagcatatttggattcacactgtgggtttaattctttccgtttaatactttttgttgaccttataaagccaaaaaataaaggaacacccatggcactgctggaaagaggtaactgatttctgatgaaccggtaggcattttagccactaaccaacgtatcaaagtgggcacaactaacacatgttaacagttttcccaaagtaagaagcttggtttggagtgaacaggccttgtacttttgagattttattttatgattttgtgaattgatgttctgtggggaaaaaacttgccttagttttaatataatggtcaatgactaagaaaaatcaaggagttgggctgggtgcggtggctctcgcctgttgagaaatttacatgtccatcagtttcttgtattgtagtttgaaatcaagaaactacctcagtttcttgtacaagtagtttgaaatcaggcggtcaagtttcattctaccctgctagaatatacaagaatccaaagcaataatgtaatttatacatttcaaaaggctaatgccaaattttatcagcaaattggtcataagtctccaactggaacaaagtgagtgattgttgggcaatgtagtcctgcaatgtgaaattcttgtatgcattccttcttaaaaggaagcaaaataagcctttcctatagaatttccacttcaagattccatcatcggcacatatcaaatactgttggcaatgctgaaagtaaaagcaaggactcacataaagtcttttgttgctgaaattaaaaatagttgtcactattttcaatatcaaaatcctatggtttttgacaggtttaaattctctgttgattcatttcagaacagggtcatctttttatacttctttgacattttaaaaaataagtagtttggctagaaattgagtgtttcaagccatcttggccctttgcaccctaaaatttcagtagcactgtcaagcgaatcagttcttaagagctggaaacacaaagaagacaaatatcaaagaattaattaaaatcttttcttgaatgacaaaattgacattatctactacttatataaggagactacattgtggattaaccctgaaatcagtacttggaaagtttattccagtgtgtttcactgaaatttaaattcatgacatttgaaaaatgtaagttataattaaacactgagagtaattcttgtggttattgtatatttgttaagtattccatggtaaatgtgacctgtaaatctgttaaattaaatacttgggagtaaatttacttttactttctgtggaaacatttggattaccccaacagtaaaagtaacagattaaaaatataatattctttattttcaacttttatttcaatatatatgccagtcaaatgccagtgaataataatcacatttgattgtcaaagctcatggaatggtacacctaagatttgtacgtttctttttctttcttttctttttttttgagaaggagtttcgctcttattgcccaggctggagtgcgatggtgcgttctcggctcactgcaacctctgcctcccgggttcaagcgattctccagcctcagcctcccaagtagctgggattacaggcaagcaccaccacacccagctactttgtagttttagtggagacggggtttctccatgttggtcaggctggtctcgaactcccaacctcaggtaatccacccacctcagcctcccaaagtgctggaattacaggtgtgagctatcgtgcccagcctgtacgtttctttatatatgaagtttgcattaagagatcatgaatattgaactctagtgaatgatatgcctgctgaagtgttttaagggtgaagagtactgatgtctgcaacttacactgaaataaaatggagtgatatttggattaaacgatgaatagatgggtgggtatgtaataaagcacatataatacaatttattattgaacctagatggcgggtatatgggtgttcactgtaaaattcttccaacttttctgtgtgtttgaaaatttttcataataagatgcgaggaaaaagcttaaaacatgcttgaattataattctataatatattaatattaaaatactggaagtactcttgcttcatcaaagttactttcaaaaatattggtttttgtcatcttcaaagcatgtaataagaattttttaaattaagtattaaaataaaacttttaatgtttgaaacttaaatctcacatggcactgttcctattatggattttgggggttagacctgtagctacccatggtatcttctttcagtggctcatatatacaagatttcaatttgtagttccctcactaaaaacaaacagcctctgatgaaatttatcttgatagggacatctgaaagtgttgatgaatgccaaggactctaatggaaaacaaacaaacaaacgataatttaaaaaatactgtttgctttaaaattctactaaaatggagttagtctacatgataacattaatcccatttgctgtgccaacatttaagaaggaatctgtggtttatcatctggtttgccaattttttgttaaatatgaggaatattttagtaataattttttaaagattacatgcaataatagcttaaactttaatacccattaatgagtatccataaagaaaacaattcagtaccacttaaaaataatttgaatatcagtcatcataatacgatgaacacatttgatagagaatatgtgaatagaagtacattgaatcagttttattctatctacagatgctgaatggcatagggaattgtgggtctcatgaaattttctcagaagtacccggaggatcttcactaccagactgataaacacaattttttggttctttgcccacacaggaaacttttctagaaaagtttcaaagaatacatgccgaaacatgaatcctggaaaagaaaagtgatcttctaaatttgaaaatgaaagatttatgtggctctcacgtgaaacatcctctggcaagggagtaggtacatgatggaaatacatggattttcactgaagaaatgaaaatataagtggcaaagtaaacttcatttatactattgaaatattcaactgaggaaagtacattacttttaaattggaagaagcaagggcacatgatttttttacaggccatgtcattctctcatttctttcatattgaaattagttggacttttctttatcataacgagtgttgccacagtttacacctgccattctgacttttcgtataccacctgttgagaggaatttttttttcattctgttatctacatcattgaaaaacttaacacaatccatgtaaagaagaaacaaaaatatacttgtaatgttcacataaatatagaaatataacttaggagtccacctaatgctagaatttttatcgcattttaagtgttatggagttttaaaatttccatgtgacttaatagctggaaggaagcattaatatttaaatattaatttcaataaagataaaacaaattaatacttttaaatgaatattttaaattccctaacgagaagacaattgcataaaattaagtatgtattttagtttgaagaactaaatcattcgtgatacatgaccgtactacctgccggattcatctttttgccaaatatttcaatagtaattcttgaagtcaattctcagcacatatcaacttttactgttgtggtgggtgagagagtggagaatcaggctttaaggtgaatttataatttactatgtgaatattgccaggagttagaatgacctttaaacattttgtgaattgcctatttcaatacttaaggattttgtatacgcaaccctgtacagtaattatcaagcatactaaagttttagaactaccaagttaaacttaagaaccaaaggggccaggtgcggtggctcacgcctgtaaagcactttgggaggctgaggcgggcggatcacaaggtcaggagtttgagaccatcctggccgacagggtgaaaccctgtctctactaaaaatacaaaatttagctgggtgtggtggtgcgtgtctgtagtcccagctactcgggaggctgaggcaggagaattgcttgaaccagggagtcggaggttgcagtgagccaagatcgtgctattgcactccagcctggcgacagagtgagactctgtctcacacacacacacgaaaagaaccaaaggacgtctgttttgcagatatttagacattctattatttgctttacaaataactaagaaatacctagtgatgaataagagttggatgggtgattctgtagctaagctgttcagtaccgtagccattagccacctgtggctacttaaatttaagttcattataattaaacaaaatagaaaatttggttcttcagtcacagccgccagatttcaagtactaacagccaaatgtgcctagcagcttcgtattgagcagcacagaaagacatttctatcattgcagaaagttctactgaagagtattgttctcaactgttcatctccctgggattttatctattttgttaaaagatcagacttctaaaaacataacaacttgttttgagaattatagaagctatttgagattcaagttatctcatagaaaaagttgattgtacattttaggtgttgtattttctgaaaatatctagtattgttaaaacaagagtacttagtaagaattattgatatggcactgtacattccttgtcattaaaaaagtggtcagcacaaggaaaaaaaaaacatatatagtttaactaaaaatcacttttcctctcctaaaattattctttaagttgtggtttacaggcttgattatagcaaaccatctcaatgcctgcatgcaaatagctaaatattattgactaatctcattttgaattcatagccacaacaattctcaaaggagattcagcctctccaagcaccaaacatcctattccatttccacttcttattctctaaactgattttcacaccttcttctctctcttcaaacctccctctcacaacagttatgtcttctttttacttcattgaggaaaagaaatatgacaccccatttccctcattttttcatctgcaaatctaccagctcatctggatccaaatctacattctcctcttcccaccttttttttagagatggaatctccctctgttgcccaggctggagttcagtgtgtgatcatagcttaattactacagccttgaaatcctaggttcaataaatcctcccacctcagcttcctaagtatctaggactacaagtgcatgccaccacgcctgggtaatttttaaatttttttgcagagacagggtctcactgtgttgcccaggctggtctcagctcttggcctcaagtgattctcctgcttcagcctcccaaagaactgggattacaggtgtgagccactgtgtccagcctaaatctacactcttggcctgcctttcagttttactggaattgacaagtttacctgttctcatatcatgtccagcctttccacttggactctggatttcatttacttttaacttattcatgcatgttcttttgaaattatctctctcctccttcaatatcaatttttttgtgtgtgcctataaatatgttctgctgttttctaactttaaacccatataaaaatacgctcttttgattctcttttctctttcggatattaccttgtttttctactctccttgctacatgcaaacacacatcaaaatctagaaggaattattcatactttttattgcaattatttacctcgtattctcttttcaaattagttcatcagggcttccctgacataggctggttttctttcctcctttccttccttttttttttttctttcttgtttttgtatcctatggtcacatgactattgcattgtcaaattgaatggccatgtctctgttcttcccatacttgatccctccacagaatttggcacagttgactacttgctccttctggaaaactgtcttcttttgtactgagccacataaaatcatcctggtttcctcccctctcagtttccttttctcatcatttctgtatccccaaatgttagtgccagttctagcttcatacttttttttggattaagtcatccaatctaatgtctttaaaatgctaactatatgcaaatcacccttaatatgtttttatatttaattctaacttatctcgtgaacatgaggcttttttcccctcaaacagcttacttgacatacccatgggagtacgtatctaatatgaatgtcaaacttaacataaacagaccttttgatttttttccatcagacctcccagcataaacaacaaacaaacctgctgagccctcactgattaactggttccattatgacccgatgactaaagtcaaatttataaatgcttttataaacttcatatctaatcatcagtgaatcttgtctcctgtacctcgcatcccccaaatctggccacttttctgtttcttcattatcactaccttatctcaacccttattacttctcacctagactgttacaattatttcctgtcatgttttttttcttttgtcaccatacaattaaatctcccttcttcctctacagatacaataatctttgaaaaggtagaccaggtaattttactccactgacttcctataaccctaaggcaaagatctgaatattttaacctggtctacaaaatccttcatgtcctaacctctgcctagctttttaccccacgtcattccctttcccacttgcatctcaggccaactcctacattagcatctttatgtagttagtagatgtttctctgcatgaaatgttcttacttcagatcatctctatgtgggcttctcccttaattgatactttctcagaaatcttaattaagtgatactttctcagaaatgcctttcctgacctaacgaaagtaggaacagtcactctcaatcacttcaacctattacagttgtcagtgtggaacttatgctctctaaaatctttcttattttacttatttactgattaattatgtatctttatctgcacaaaataatctccattttatccccactgtctggagctttgcctgttctagaatctgaactctttgtatgaattaaataaggatgaagtcaaaacaaactgtactgttttttgtttcaagtatcaggcgatatttaactatttgaagttatgggactaccaaagttactccttctggttgacactttactgagacaaacaccagtgatatgaaatttccatatagtcatgcatcacttaacaacaggcatatgttctaaatgcattcttagacaattttttgttgtggaaacatcagagtgtacttacagaaacctagatagtatagcctactacaaacctaagctatatggtagagcctgttactcctacaaacatgttactgtactgaatacttaggcaatttgaacacaaaggtaagtaattgtgtatctaaacatttcttaacatagaaaaggtacaattcaaatacaatattataaccttatgctaccactatcatattatgtggcctgttattgacagatacattgttattctgttcatgactgtattagtaccaggttgtggctgtttctaatatatcctctcccactcctctcattccttactgaagtcaccagggtagtagcaaatcactggaaccagacctataatatatctgacttggtatctgtaactgttctgagaaacatgtgttgaaaggcagccaggctgcctgatgattatttagtagctgtctttctttactgaacaacagtgaataatatctttgatctctgccactgagaaataaacagaacccatcaggaatttaatccctgggaatgattttcacatttcctggtatagacgtttgattttgaagctcatatggtttgcacaataaatatttacctatttatgtcaaaatgcatgttaaatcatttttatggttggtgtgaggaatttgtgaaacaatcccatccttttgttattactgtgtttttgtaagaggacttctcacaccttaacctcatcaatagtttttcctgtgtgttaatgcaacaaaatggaagcaaaaagatatattttgttttcatttattttattcacctgaatctatccagagggaaagcactggaagtgttttctttttaagagtgttaacttgtattcttggtaagatctcatcaaaagcttaaataacgaaggtaagagtcagtattctgtggacagcttagctctacacaagaccttctgtccatcttgctagttattttccagttaatggaaatcttatagacagaaaagctcatgttagcttctcccgcatagtattatgtcaacaatccttactctaatccttgatgcagctctttacctaaatgttatagagatggagaatcacagctgccagcaattcaaaatataacatgcagtagctattttttaaaaaaaattttatttgctctcataaaaataccatcttaaagggtttttgaaaatttacttgtgattttgtctttttttaaagtattgagaaaactattgagtctgaagtaaagtctctaaaatacatcttgtcttattgtaaagtaatatgactgatattttgtgtgaattttagaattagttttttcactttatagattcattacatagtggcacttgatttaaacattgcatcagtactgtagcccttgggcatcgtgtatagagtgtctattagctttaactcatttctaaaaaattaacttctaagaataagaaaaatattgaaaactcttgaaagtaagttagaaacgaccatgattttatttttatttttaatttttatttatttatttttttgagacggagtctcactctgttacccaggctggagttcagtggcacaatcttggctcgctgcaagctctgcctccgaggttcaagccattctcctgcctcagtctcccgagtagctgggactacaggcacctgccaccacgcccggctaattttttgtatttttggtagagacggggtttcaccgtgttagccaggatggtctcgatctactgacctcgtgatctgctcgccttggcctcccaaattgctgggattacaagcgtgagccaccgcgcccagccgattttttttttttcctgcaaaaccatctaagggaggtgtttgggttttcaaggaaataccggctataagcatcattggatgttttggtggggtgggttttttgaaaatgtgtatgcagataacagtgagtgatattgcataagtattttaactacttagattgtttaaatttggttaacataaaatcaaggaaatggcttgcattattctatcttttcttttctaaacagtgtttccttaacaattaattctaacaagtcttggaaccatgggcactttctttcctcctgtcaccatgattgatccctattttgttggaaagtgaaaattgagcagttttaactctaaaggctaacattatggaaaaaaatttcaactgaatttgctagtaaatgctttgtatgaaaatatttagaatttaagtacttctctttacagacaaaatcatttattttcagtgtattatgaacatagttcctagtagggtatgtaaatgattcacttttaaattatgaatattttcttccaaattccattgttaaaattagtaagtgtaaagtatgacttttaagcaatatttcattagctatcattaacaagtatttaaccaccttgtttcaaattagttagctaatgaggtataaattattaaatctgaaaattttatttggacaagtattgtatcattaatttaaaatgattacaatgtagttgaattgttattcagtatttaatattttattgcctataaaaataaataatagccatgcaaacttatttttcaaatggtgttatctgtgctatatttaaaataggccaggtgcggtggctcacgcctgtaatcccagcactttgggaggccgaggcgggtggatcacgaggtcaggagatcgagaccatccttgctaacgtggtgaaaccccgtctctactaaaaatacaaaaaaaaaaattagctgggcgtggtggtgggcacctgtagtcccagctactggggaggctgaggcaggagaatgtcatgaacccgggaggcagagcttgcagtgagccaagatcacaccactgcactccagtctgggtgacagagcgagactccatctcaaaaaaaaaataaaaaataaataaataaataaataaataaagttaggtttgcatatatgagcatatgcatttataactagatggaaacttccttaaatatttaacatttctccttaaattttatattttatagtacttttttatggttagattctaagttctacttacattcagtgtgtatacaaattgagataggggttgtaatggaatatataacttgaatatttctatttgcattgccatagcatcattttattttgctcttagcaaaatctttctatagaggctttttctcctttcagttgtaaagaatctcttatctttaaaaaatatgtctcattattttcttacaatgtaatagtaaaaacaaaaataccatcaggtttttctcgatccttcctattttcctggatgtgtgcttttgtgtttttattgatatggataaatacatcttcaaattcaagtactagcgtttcagagaagtaatatgcttcttttgttctggttcctcttaaatgttagtaataaagaaacaattaacctagatatagaacaactcagtgaagggaaaatgtcttcatgggtcccttgagaaagacctatttagctttttatgtttctaatttttaacattgagtatagagtatatagctgtctttacacttttttttttttacattttagcttatttgtaatgctaacaggtaaagtagaaaaaaaaaatcactaaaaaaatggggatttagtagaaaaagaaaactcagtccctaaataatatcctacacatttacattatttccttatgatattttaagtgttccctatgaatatttttattttcaaaatgccaaagttatcagtaattttaaagctaatactgccaatcttactcttccaattctactcctaatcttttcctcctaaatgcttgatccaagtacctccctttgggacaagtaccaaatgtctttctccatatgattttttgaatgaattctgagtgagttaattaattaattctaggaattaatatttctttgatttctagcaagccagagcattttcttcaaatgtgcattaaccatgtgttaattatatctttatgtatacactgtagacattgtgtatgtgtctgtagatttccagcttggatttatacattttaattttcattggtttgcttttactgtcttaggcccctcaatccgtgggtagaccttggaggagcaagctttcagatcttttccactggagttctctcccccattgcagctcagtggccatcatgatatctaccagaacattcagttttctgaaactgtgtaaacactcttgtaaaaacacagtgtagagtcactgtgggagagtgtcttcaaccaccattcctatcctgtaactgaacatagctgataatatgtcagtagttttatttttgtccatcattcaaatagagttccacagtaattgtttcctcttggaagataacttgcttagcagtggggaaaaaaatggattagacagggtaaaatgttatcggaaatgggccctgatccagaaccctagagagggttcttagacctcacacaagaaagtattcggggagagtccgtacagtaaagtgaacaccagtttattaggaaagtaaaggattgaagaatggctaccccataggcagagcagcggcatgggctgcttgactgagtatacctatagttatttcttgattatatgctaaataaagggtggattattcatgagttttctgggaaaagggcaggcaattcctggaactgagggatcctcccccttttaaaccatgtagggtaacttttggatgttgccatggcatttgtaaactgtcatggtgctgatgggagtgtattttagcatgctaatgcataataattagcatataataaacagtgaggacgaccagaagtcattttcattgccatcttcggtttggtgggtgttggccagcttctttactccatccttttctgtcagcaaggtctttgtgacctgtatcttgtacaaacctcctatctcatcctgtgactaagaatgcctgacctcatggagatgcagcccagtaggtctcagcctcattttacccagctcctagtcaaaatggagtcactctggttcgaacacctctgacaaaaatattctaagtataaatacatcaaaccacattgaaaaattcatcaccaagttactttcagtacagttcattaccccatatctaaaagcgatcttgaaatctgcttggttgttagtggagacgtttcacttccttgttattaaaaaccttttcgctaactgccttattaagatattattcatataccatacagttcatgcctttaaagtgtacaattaaattttttttagtatatttacatagttgtgcaattatcaccataatcaattttacaatattttcatcacccccaaatgaaacaatgtacccattaacagttaccactcatattgctcctaacccttccccctcagccataggcaactactaatttatttcctgtctgtatgagcttgcctattctgcacaatttatataaacagaataatacaatttgttgtttcgtgactgatttcttccactcagcacaatgtttttaagattcatccatattaaaacatttatcagtacttcattctttcttattgttgaattacattccattgaatggatataccacattttatttatctgttcataatttaattgtcatttaggttgtttctagtttttgcctgttataatgctactatgaacatcatttacaagttattgatgtgtttttctgtctttatgaatagaaatgctgtgtcatatagtaactctatatttaacttcctggggaacggtcatactttccaaagaggatgcaccattttatattctcattatctaatgtatgatggttccaattcttccatctttctcaacaatacttgttgttatctgtcttttttattatagccataactgttttcagcagttctgtggatttatttcactttcttgatagtgtcctttgaagcacaatagtttttaattttttataaagtctactttatttttttttagtttttatttttggtgttatttctaagagatcattgtctaatccaaggtcacaaatttgatcctatgttttcttgcaggttttgctatagttatagcccttacatttagttaatcgatcgatttacaattaaatttttacaaagcgtaaggcagagttccagcctccttccttggttatatatatatatggatatccagttgtctcagcaccatttgttgaaaaaactatttttttctccctttaaataacctggcacctttgttaaaaaataatggatcataaaagtaagttttatttctggactctcagttctactcgttgacttatgtgtccatctttacaccagtaccacactattttgattatcagcactgagagaactttaaatggtttatggggagagagtagctttgggcttccctgagggttatgtcttgcaaaactggaagctcagccatgctactgttacaggaattattggctcttgtatgatgtgagacttgtaatccagggtgactcccacgtctatcaaatgtggacactggtttatcttctggagggtcaaggagaataatttatgaattaacatattgactgttgaacgtattctcattgaagaggaatacctaatgctgccccgctaagatgctgttcttctgccttctgttctcagaatggatctgatgccaagtatagactatagtgatcttgtgagtctcagtgttcagcagagccaaagatgaagactaggtttgtgcctagacatagaaacggggtgtaaaagggtttaagctacttggcatttgtctgtgaggaagtgtatttcacacatattggcagagtatgtttgtaattaggcaaatataggtcactggaattgatctgctgtgaactaattgatctaccttgaacaaaccctgtaaccactgagccacagcctcttcaactgtaaaatttaaagactagtaattgatagtctctatccctcatgctgaatcgagcatcctatgacttgtctaagattgttcacactgtagtttgatactttcttacattcctgaaaatgtgagttttgaggttttttcagatgattttctctatgggaaaaaatagcatacagaacattctcatgacctcagactagataataaatgactgagcaatggaactgtaactgtgaatattgaaaattataaaaaaaaattagccagacatggtggcacgtgcctgtagttgtaactacttgggaggccgaggtgagaggattgcttgagctcaagcttttgaggctgcagtgagctacgattatgctagtgtactccagcctgggcaacaaagtgacaccctatctcaaaaagtgagcccctgagtgtactgtaatgatataataaccatttctatatacttatgtgtgtatatatatatgtatgtatgtatgcataatatgatataaatcatattatggtgatgcttttgattgaaagacaaggagatcttagagtgagtggttttaactctgattatgctgctccctgatataccacaatgggtgataacacttccatgagcttcaggttcctcctcttcacaataaaagttttgtgtcacttgagttcagattttcctttcaactctaaaattatatgattaatgacatgatattcttcatatacatccatgcttctttgactatttaggccatagtgtctctctctaatacaaattttcagataatttgccaaactgaattttcaagacattccttctcagaaacatggcctccaataaacaggttttacatattttttccttttcctgttggccctaacgctgtcaatcttagcctcatcgtctagcatagtcatttatgcaggatcctgtgtaaagttgatgaaaaattctgtcaatatgaaatatattgaagattgccagtttacctttttattcatttattgtcatgtcacttgaaagatattaacgtttatatctgtctaaaaatttactctctgaaaacaataaataacatttggccttttgtgttaccgtttctattgaataattattctgaggtcccctttcacccatgaaagcacagtaacttgtactctaaagtcctacaaagtattagatatataatatctaggcataaggtaaaatctattattatgcttgggtccttaggctgtgagagtgaccagtttttactttcctacctacttgattaaggtaactccagtgaggtagaaaataagggaactgagtcaagaacacaaagtgtggtatgtaattgccattttagatatcattagtagtcacactcccgaaacattaaaaattaatgacagagtcaggaagaggagagaaggtgtcttttgcattgccataatttttacaatgtctacatgctgtcctatagcctggaatatgagatttttaaaatcatggttactatcatcactcaagtgtcttaggctgaaaaggacattttccatatttcataaattcaagtcccagccagagtaatcaggcaagagaaacaaataaaggacatccaaataggaagagaggaagtcaaattatcctgttggagacaacatgattctatatctagaaaaccctatagttttgtccccaaagctccttcacctgataacttcagcaaagtttcaggatacaaaatcaatgtacaaaaatcattagcattcctatacaccaacagcccagctgagagccaaatcaggaatgtaatccgtgtcacagttgccacaaaaataatgaaatacctaggaatacagctaactagtgacatgaaagatctctacaatgagagctacaaaacactgctcaaagaaatcagagatgacacagacaaatgggaaaacattccatgctaagggatgggaagaatcaatattattaaaatggcaatactatccaaagcaatttacagattcaatgctattcctatcaaactaacaatgatgtttttcacagaagtacaaaaaataattttaaaattcatatggaaccaaaaaagagtccaaatagccaagacaatcctaagcaaaagtacaaagctggaggcatcatgttaactgacttcaagctatacaacagagctacagtaatcaaaacagcatggtactggtacaaaaacaggcacataaaccaatgaaacagaatagagagctcagaaataaggctatatacctaaaaccatctgatcttcaaacaaagctgacaaaaacaagcaatggtgaaaagactccccagttattcaataaacggtgctgagataactggctagccacatccagaagattgaaactggaccccctccttataccatatacaaaaatcagctcaagatgcattaatgacttaaatgtaaaacttgaagctataaaaaccttggaaaataacccaggcaataccattctggacgtaggaataggcaaatatatatttcatgacaaagatgccaaaagcaattgcgacaaaagcaaaaaattgaaaaacggtatctaattaaacttaagagcttctgcacagcaaaagaaactatcaacagagtaaacagacagcctacagaatgggagaaaacatttgcaaactatatatctgacaaagatataatatccagcatctatgaggaacttaaaaaaatttgaagcaaaaaacagtcccattaaaaagtgggcaagggcatgaacagatacttttcaaaagaagacatacatgtggccaacaagtatatgaaaaaaaggtcactatcattgatcattagagaaatgcaaatcaaaaccacaatgagataccatctcgtaccagtcagaatggctattattattaataaacagtaaaaaaaaaaaaataacagatgctggctggttgtagagaaaagagaacacttacacactgttagtaggaatataaattagtttagccattgtggaaagcagtgtgacgattcctcaaagacctaaaaacagaactaccattcactcagcaattccattactgggtatatgcccaaaggaatataaattattctaccataaagacacatgcatgcatatgttcattgcagcagtattcacaatagcaaagacatagaataaatctaactgtccatcaatgacagactggataaagaaaatctggtgcatatacaccatggaatactatgcagccataaaaagagtgatatcatgtcttttgcagaaactaggatggagatgaaggccattatccttagcaagctaacacaggaatagaaaaccaaataccgcatgttttcacttataagtgagagttaaatgatgagaactcacggacacaaagaaggtaacaacagacacaggggcctacttcagggtggagggtgggaagagaggattacaaaaaaataacgattgtttactacgtttagtacctgggccatgaaataatctgtataaaaacctcctgtgacatgagtgcacctatataataaactccacatgtacccctgtacctaaaataaaagtttttaaaaataagtcaaagatgtaatcttttctctcatgtttttatatctctgaaatcaagacatattttacaattgattgggagcaattttcttgcttgaacataaaataacattgaatctcgtcatcagagtatcttggattagacaaatttagtatgttcagaggcaactttaggtagggaatgacagacctcaaattccagtgtgtcacagacttattaaataggaatatggtatgcaaaaatttgctgattaatcagcccatcataactgaggcttgactctatgcctatgtgcatttttactttgtctttcacttcaaagcaggtgcagctgcacagtatgaattcaatacccatggtaaagagtccctttaaaaggctatatttttatatttaatatgtggatacagaaataacagaaaaagataaataagctatccaaatgcaaagaaaattacattcatagacatacctcttattaccttttcctctcaactctgcagaaaatatgaagcaggttggaatgttcattttatgtggctctcaaggtactattctcataaaggtaaaatgagaaacagtaaattattgtgaagtttagtaataagagcaaaaaagacatatatttatgagagcaaaaatattgagtagcatttggccaaaggatcttgaaactgatttgaattgatttaaccagtgtaaataaaaatgatttatcaataaaagcttatttctagaagtgtttttttcctgtttttactgttcttttcagaagcgttcctttgcttatgaacagtttagaatatgatctttttgtcaaataaaatttccagcaccttgcaatatcagagacgattttctttctagaagttttagaagacgtcattatgtgtcattctagacaaataagatgtgtttggctgaaatgttttagaagtctctaaggaaagaaataacctgttgattatattttgacttacttggggaaatggaaagtcacagccaagataatgctaagtctccaccaatcacattttattatgtggtgtgcttgcctttggccctctctctaccccttggaggaacaggtaaatattggcacaagtcagatgaaccctacccatcactttttggatatatctacatgtcataagaattatgacatgatcaatcaatgtaccagctaattttcataaatgctgtacctcatgaatggagaattgagttgagcatgagtgaaaattggattttccccactcagaaaaaaataagccactatatatattttttgtttagttctttttattttggttattcttcttttcctttatattattacttaaatttatttatgatactgcttcaagcaatatttaacgtatcaacattttgaacagttttaagtataaaaaaatttgaaattctgttctagtgtgaaaatacaccagtgagtgacatatttgaatgaacatttgtagaagtatgttgaccttaaaaagcaaaaggatttatttttccttttattcaacagatattcatatttgtaccagtcattgtgtaaagctctggggaatgtttcacattttcaaaagggtagagattagcgtttcattttgtttttgacttatctctcttgttacaagctctctgcaagatatttacttaagagttggatgaaatgggtaaataaaaagaaatttatgaggcagaagaaaatgtggaaccttcagacatccctttttggtaccacttttatgacactttcatctaatctagctccatctcaattgacctccatctaattagtcataaaagagaatcaagttctatactgagcaagcatgcctgtgcttcatcagtaacatttaagaaggggcagaaatgagtcaaacacttaaagatgctgctttaaaaattttaatgtgttcttcaaagatgcaagcttattaaaattttagttctgaagaagtaagcacagtatctagtttggctccactgatccttttagacatatgtcacacactttcttctcatgctcaagagggtgattacatcatttgcatagatgtccgttttatctctaatagattatgaattccttcagggaaatacttgttttaaggggaataccatgtttttaaaatctttattttgcagagagtaactatgccatcaccttgcatgtaataggtttttaataaatctaattaagtaaaagtaccattgacttctgttcttggtggtctcaaagataatacttgagtctgctaaatttggaggactaccatgtagaaaagaaaagaaaagaaatgcttctaaagattccgagtaaagctagaaacatagttccgtagttcctagtctctccgtagagagaatacgataactgaagagggctttatatgctgagatgaaatttagtttgttcaaatccgtaatgaattgccatcgggaagtactggactgcttgccactataagtgttcaatcagtctggacaagattttgagaggaattttctagagagatcttagtcatctaatttgcggctggcctacttgacctttttcttctttactcctgaatcttgtttataaaaaatgcaatgtaataaaatataatttatattgtatgtaatataaattatttatacctctgtgaatatatatgataaacaaatgaatatatacaatgtaatgttatattacatcatgggtcattttcttcctaaactataatcatttttacagttttaaaccaaaaaggtagtgaaaataagcgagcccatattaaatttctaggaagtatccctaaattgtttcctcagtcttttgacttatttcacatggaatcctaacatacgtggttgtctgtttttcatgtctcaataaaaaaagttgaccataatataaaggataattggaacttggccacatataggaatataagacatctaatagtaaaaaaaaaaaaaaaaaaagtttataattaaagagaatcgtaagttttataatgacttagaggcatcagatgaaagagaaaacttgttctgtgcaatcccaggggaaagaattaggaaaaatgaggtcaaagctgaaagaagtacaggtttctgtttaatataaggaagatatttttaacatttttctgaaaacggacaattttgcctcaagtagtttcatcttaacagataatatattttcaagcacaaaatgaaaaaccatgtaataaagatattgcagaatacatccaagaatccgatgagacattatcttagttttctactttaaatatgcaagctccttaaaacttctatagatcaacacattatgtgatggtttcaatatgcctaaggtttgatcgtgtagtatagcgttgacttagaagttgtaaatggaagaattaccttttatttctcagccagcggaacctatttatctctttattccagatacgttatgtgatatataatgggcaatgaaaaggttggtcattagagcagctttaaaaaaaaaaaaaaaaaactcatcacagcaagtggaatctgtgttgaatgtttaactgattgtaactgaaaccttggcagggggatagagagacagaaatgagattaaggtagggacagttaaagaaatagcaagagtgtcattttgaagaatttgaatttgatagcaagcattattgtgagctgttgatgaggacaatatggttatgaacataagaataatctatcagtaatgtatatgaacccttaaaatgagagaagtagatgtcatggaggaagaattgtaattttatgatttactatgctgtgatgaggagtaggatggggaattgaggggtggatacgtaacatttttttttttactcattaaaatttccccagcccctaaataggttgtcatattttaaaactctttattattttatccttgattgtctggagttgccaagtatattagtaagtacaaaaagtaatggtattaagttttaatgacaaaaaaatgaatccactgggtataattagtataccaaactagaaagggcctattcaaagatctaatgaaatgcactcagtactttaatttaaattccacaaagtgctgaaatgctggtttatcttcccaattccctttagtgtcattggtataccacctttactattgtttccttaatgtattttttctgagtttgattcgacattcacctcaacatagatttgtaaatctacttttgtgaaagttatgcaactgctgcatttggacaagtcagctcatctatgaaataaaattctccttagtcactgtgaaggtaaaataaactaactcatgtggacgtattttgtaaatataagtcaatttagttatttttatttttagttatggaagccaaagatcgaatattattatttttaataatcacaaattagttgtttttatatttattatgggggcagaagctcataatattatttaaaaaattatcgtggagaaaattttaaaaatcacatattcctcaggataaattaagatttggtaagttctccctaacaatttatggtagtttcttaaccttgcatttgatatcaacagtattcaaatattagggtaatgatttgtaagttatcttttaaggagttgtctttgtattctattttaaattttctaagaaaatcgcacgttacttgctctccccacaccatttttatgaaccgatctcatatccactgggtatgcagttgaagtttaaatgatttcacaatacacgtttcctggcttttagacagtgtattatgtgtttagattacaaatagttagaaatctatttgcataaaattttaaattatttttataatgtcagtgatttaaaattattgataatttcttggattttgttctgttcacaattttttaaaataatgattgtaactgaaagagtaaaaatatccgacatgaaaaaagctacattaaataattagcatgttttaagttacagttgaagaaaaaagtgaaaatagactaaatgagatttttatcacatttccaagtgcaaaaagaatcatccagtgttggggataggaagtttttttttttaagataagaaaaaagatcattttaaaatttgactatggttttccatcttgctcaattaaaaaaagtcatagcatgtcactttcactgttaattacctaatcatattcaaagtcagtgattgacattttcacgaatccttatgtggcataaacacgcacacacacactgtgtgtgtgtatatatatgtttgtagaggtcccttgcttacctgtagcttttgacttagtgtattaataattcattttatgcaaatcaaaaccacaatgagataccatctcacgccagtcagaatgacgattattaaaaagtcaaggaacaataaattctggcgaggctatggagaaataggaatgcttttacactgttggttggaatgtaaattagttcaatcattgtggaagacagtgtggcgattcctccaggatctagaaccagaaataccatttgacccagcaatcccattactgggtgtatacccaaaaagtatgaatcattctgctataaagacacattcacacgtatgtttattacagcactgtttacaatagcaaagacatggaaccaatccaaatgcccatcaatgatagactggataaagaaaatgcggtacatatacaccatggaatactatgcagccataaaaaggaaggagatcatgtcctttgcagggacatggatgaagctggaagccataatcctcagcaaactatcacaggaacagaaagccaaataacacatgttctcactcataaatgggagttgaacaatgagaacacatgacacagggaggggagcaacacacaccagggccagttggagggttggggatgaggagagaaagagcattaggacaaattgctaatgtatccagggcttaaaacctagttgatggcttgataggtgcagcaaagcaccatggcacacgtatacctatgtaacaaacctacacattctgcacttgtatcccggaacgtaaagtaaaatttaaaataataataataataactcattttagttagttgtttaatgagggtatgtttttacccaagttctgcttttatgggagtactggatactaattatggtttactgttatatatgtatgtatatatatatatatatgtgtgtgtgtgtgtgtgtgtgtatacactcaattaactattttcaaatatttaaaaggatatatttaatccagtacatagaaaagcaaataacaatgtctagcataattttaaatgaagggcatttatgaataacacatacagtgtgatacaaatatatagtgagcctaccaattaagatctgataaaaaaagaggtacatggttaatattatcaacaaatggttactacagaatactagatgagggttaaaataaaatcattaatttgtatctgacgcaaaaataaagcagtcaaatttctaaagactgatttatgcatgtgtaacacagtcattcggttatctttctgtctacaataacttcaatcatttattttacttcatttaatattaagcaaaactctttgtgtgtggtagtttgtaggggaaagcaataggggtagtattttaaagtaaggcctctgaaaatgatgctgcttaatttgtcatctaggcactgccattattaggtatataattatagaaaacttactttctcaacccctcactttctcattcatattatgaagattaaaatatgcaaaaatattgtgagataacttatacaaaccactccagagactgcctggtaccttttaagcattcaaatgagccataattattaaaaagaataaacttatcctccagtgtatggtaattctgaaacactagatgtctaatagattttctcatttcaatccaaacaatatttattgggcccttggtatgtttaaggcattgtgcttgattagggacataaaaatgagtaagacagggtttccactctcaatttctcccaatttagtatgctccttgaaggcagtgtccatatgttttgatcatctgcagcatttgatgtagtaaagcgtatagccatgacatcacttaataaaaagcacagtgctatttgtttatatttattacaatgtcttcttcctcctgaagagttcaatgagtattttatcagtgtcaattctattatctacttaacaaatttgaacactgaggaaacagtaagggaaaaactgaatgctaataagcactcacagtctttgacaaatttgtgtctgcaactgcaggccaaggaagcatgagtcagagccacagtaatcaagttgttccatttttcttttgaccatgcaatgttggataccgttgctttcttgacttttccttttggtctgttttaggtgtctcagactcgaagtttgtgtgatgagaggagcacagtcccatagcaatgctaaaagatgtgtgtgtatgtatgtacatgtgtatgtttgtgtatccgtgtgtccaagcacacacacatatatgtgtttggaaaattgggttttgattttcatcattctgaagtttaattccccattagagttgattcactacataccaaaggatatactggtttattcacgtattcaaattgtactgagtggctggtatggtaagtgccatgagaggtacaaagatgaggatactgtggtccatttcttggaaagcccttaaaaacttactgtttagccactgcatgttctcactcataggtgggaattgaacaatgagaacagttggacacaggaaggggaacatcacacaccggggcctgtcgtggggtgggaggatgggggagggatagcattaggagaaatacctaatgtaaatgatgagtattaacccattagggtgcagcacaccaacacggcacatgtgtacgtatgtaacaaacctgcacgttgtgcacatgtaccttagaacttaaaaagtataataaaaaataacttactgtttagcatgtaatacatcaggaaaacaagtagttatatgtactacttatatgaaataataaaaatatatagagaaatattctcagtaagaatgtggaaattttatatttgtttttggtgctcactgaaagcttcgagaaatgtagcacttatgctaaaaattcaaggatgtgataggctttagaaatggaaaaatcgtgtagaaggacgttttggcaagagggaagaacatggctgaaacattaaagaggctattaatgtttcttccaacactctgcttattgtgagacctagcaggcactaaataattaatagcttgagttaatcagcttgtagttaactgaaaaagactgttctacagaagaaatatgacttctgactgactagaagtctactattaaggcctgaagacagctgtagaattcataatgccttcttcagttcaaaaaatgaaaaatttggttatgattcagcatcccatatattgaagttattatgtaaaattatttaatgaatttactttcttcatttaattcttctaatattaataaagtgcctacttctggatacatcagctgtgaaacactggtttcattctgccttttacctccttagatatgagggtgggtgaatttgctctttttgaccctcttctttagacccattcactgtccctgatctgatctgaacctagaagtctctccccagtcctcaggagacagacaggattgaaccccatgcagagagaaggtagtatgatggaattgaattcccggacagatgtggcattgaactctggcactttatctgagtgccactggtcataatgctgtaggttaatttcctcccttaaaaaaggatggaatagcagtctccttgaagtgttataagaattttagatggtacatgtaaagcacctgtaacattcagcacctttaacattaatgcagtaagcattcaacacatgtctaaatggaaggtgatggaaaagtagtccctccttatctgcatgatacatgttctaagaccttcagtggatgcttgaaaccacagatagtactgtgccctatatatactgtttttccctatgcctatgcctatgtacctatgataaagtttaatttataaagtaagcacagtaagacattaacaataatagctaataatgaaatagaacaattatagcaatatactgtaatgaaagttattttccttctgaaaatatcttgttgtacattcccacgggcaactgaaaccacggaaaatgaagctgtggatggaggatcactactatattattgttattattattattatttgaatctaattattagtctctaacaatagtgtttggtaaacatatctttattaactagtagagtgctttaggttaggaatgaacacaattaacacttcagacagtctccaaaatgttcttttaaaaaaatccactttatttcagctatattttgtgtactcatcttgctgtatgaaaattcttcaaagataactgcagaaaaatgttaaattgagaaaaggtgttttttgttttttttttttgtttctcaacataaatgagccttgtgtgctttcatttgcacatacctttaccaaggtaaaagtgtttatatattgtcaacaatgtattgatagactctgccaaggactggcttgtggatccctttggctcaatgcctgtttttgtaaagttttattggaacgcagatattggttaatatactgtctgtggctattttcacactacaacagagttgacaagaggccttatggcctgtaaagctgaaaatgcttactatctggtcctttgtagaaaaaatttgtccctatttctccacatcctctccagcacctgttgtttcctgactttttaatgattgtcattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtacattctggatattagccctttgtcagatgagtaggttgcgaaaattttctcccattttgtaggttgcccgttcactctgatggtagtttcttttgctgtgcagaagctctttagtttaattagatcccatttgtcaattttgtcttttgttgccattgcttttggtgttatagacatgaaatccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatagggctagccagttttcccagcaccatttattaaatagggaatcctttccccattgcttgtttttctcaggtttgtcaaagatcagatagttgtaggtatgtggcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgcggcactattcacaatagcaaagacttggaaccaacccacatgtccaacagtgatagaatggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggggagggatagcattgggagatatacctaatgctagatgacgagttagtgggtgcagcgcaccagcatggcacatgtatacatatgtaactaatctgcacaatgtgcacatgtaccctaaaacttaaagtataaaaaaaaatgttcaaggatgcaaatttgaagggaattctcaccaaaatttatagacttgtagaagcataaagactggaaggaattttttatccttcaattattctaacttcatataaatgtattggaatccatgataaatggtaaaaaaaaaaaaaaaaaattgtcaactacacttttacatttagtgtgccatagaaaattgttttacaatttagggttttatttttatagaatatcagccttttatgactagtatttataattgtgaatattaaaaatatagtacacatttattcaaatttgatggatttgaataattagggaacagaattgatatctgcttagcctcattagagtgaatattatggtaggtttcagaaatacagtttctacttttattttatcatttacagccccaattaaattctcttgcctttctttctaggacaattgagaaaaataaaaaagtgcgattgacaaagacaatgtagttcactatagtggagcatctgagcttcctgacaggctagatggaaaaggaaacacagataaatacttttttaatcatgagaaaataggaagtgtatcaattactacagtaaaataaactttatcttgatgctggcttttaatgaccttaattatatgagctattgtgaggcagtatatggtagatgttaagaaggataaaattggcatcagggagatataagactgcagtcctcatatactctctggccgtgggcaagttacttattcttttagaaattcagttatgtccagttatactataactacaataaataggtaccgtagagaatttccccatacacactttcatttgtcttaatttatggtgagactatctataaaaacagaaagcattaattttaaatattaatatatttaaggattacttaaagttaaaaacacatttccaaaaatttatatttttagtttaaagtatgcacttattaagttgttaaatatcctgggcttgatgtatatttaaaaacaaagaatttaaggaaaccaggtatttggaataattaatgggcatttaaaaaagttatgtttataaattgtagggttatatgtacacacaaaaagaaatttaaatgtaacatacataaggacaacgtaaaagtttatttcttaaccttcttaatctacttaaaacttttagaaaagctcttctttcagacataaagatcagccttctgccattagcaaaaaattggaaaaatagaatacacattttctcatctaagcaagtatttttagagtcattatttttatgttttttttccaattgaagaaaatatagggtgcatatcaggaaatacaatctgctagtatcactaagaataaggaaactaatgttgacatatttgactcgaagaaaacaaaaccattattgatgacatccatgtttgaaaagaaaggaaaagtgtttttatggaaatatgtagtgtttaacatccttagaataaagtacatttggtgatatttttaaaaggttaaacaaaggcagatcttcaatataatgatatttatctccattttatttctggcttttactttgatattaacagaaatatatgcacagacatattagcaggataaaacaagggtcatgataaaactgaatttatttttgtttgaattataagtagttttacacattaatgaaagtccattgttatggttaatcccctggcaacttgatctgtgtaatgggttttcattttctttataaataattactcgctgtttaatatttcaaaaaactatagtgtaggcatattgacttgttcaataaagctcatttgtattcattgtggactcttgaatatggactatagcagccagtgaaattggtggtgttttcttgttacgaataatacaaggaaaaacccaaatctattcaattaaatttttgtgtgcaaaatttcagctatagtctaaaaacgctacataatttatattacaatcattttggctaatcagatacccaatcatattttaatagatttccctgggagaagaaatgggatttaagcttattaatctgtatggcatgcaattaagctaacattaagatgaccaaaccagtatgttttattccatttggaataggatcacttctccagagtagtagatatttcggaatttacaaagaccaagaaaatgtgtattcctttatgatttttactgcatgcttaactatttattattccatcttgttcttgaaagatttttaagttctttataaaaatacatacattacaaagtaataatacgtagaggagggaattgggacagtgttgggaagaaaagctgtgccagaagtgaggctgtccagaggtggatcataaatttgtgtctaaactttttagtactcattgcaaaaaaacatgatatcaacataattccacctttatgaattgtaactttttttacattaattactggagctcagatcttccattctagatacaaacaaaagtttagttttaatgccagatcatttaaaggcagttactttaaaatggcatcctacaagactactttctgtcagctgcctatttccacacatctataggttaaataaaccaatattgaataccattggcattacattttttcaagatttgaaagtgactcatgaatcattaaggagaggttgaattacgtcaagtgtagtttcactactacatttaactgatacttttaaaaatgtactcactttcatatggtgcataaagctctgttaactcaaatattttcattgtccttgatatttaatacctcagttattgatagcagtcaattgctcataaccaaagaaatgcaattgacatagtgtaaaagttcaatttcagtgttctttctttaaaaacccttcaaaatgagttttaaaataaagtaataaaatttctaagtcaacacttagaaatctagataagccaatagtttcatatagcgtcttcaatgttacaagatttgtgagtactggcatgtgggtcagaaaacaaggggtttgaattccagctctgctccatttttattgcaatttcagttatcattttagcacttcagaataaaaaagagatttatttaatttctaattttttttctacctctcagctttttttcaacctgtgtgtgactggattgcccccactttagttaggttatcataatatacctgtattatttaaacatacacaatctcattgtcacttccccacaaaattaaaggaaaagctctctaaaaaatggaaaatttttagcacttcagaataagagatttgtttaatttctaaatttttttctatctttcagcttttgtctatctgtgtgtgactgaattgcctccactttaggttatcataacatgcatgtattatttaaatatatacaatctcattgtcaccttccccacaatattaaaagaaatctcttcaaacaaaatggaaaagattctgaacaacgtgaacctaagaggcctaaaaatgactaggcaaaacaagtgaagttagaagtgataaaggatattgggagaaatacagtaaagacataaaaatatctattctcctttcctcatttacccccacattcatgtcatttgcctggtttatttacctgaagatatatgcccattgcagtgaaactgtatcatgtcattttatgctacacgtaaacagtaatggatatattaccatttaaagcatattaacctattcatgatgtgaaagatataattgatctttaaatgttttatgcagaaatccttgatggattattagttgttagactattttgattggggctctgggtgcactggaaataaattattgtttttatcatttaaaataatgaaatatagactcctactagccaaaacattttatcaaacacgtgacaggaatggattacattgatataatgacggatatatgtaactgagataatctcttcatgtatggccatagttagagataagatttgtgctatttttttgtttttcttgataagttgttttttcttccttcttttgtgataatttagagagttcacttttggctctttaaaagcacttcacacatactagagtctttacctaataaactagatcttcaaatacattaggtcgaatcattaaaaattactaatcttgtataaggtataaggaagggatccagtttcagctttctacatagggctagccagttttcccagcaccatttattaaatagggaatcctttccccattgcttgtttttctcaggtttgtcaaagatcagatagttgtagatatgcggcgttatttctgagggctctgttctgttccattgatctagatctctgttttggtaccagtaacatgctgttttggttactgtagccttgcagtatagtttgaagtcaggtagtgtgatgcctccagctttgttcttttggcttaggattgacttggtgatgcgggctcttttttggtttcatatgaactttaaagtagttttttccaattctgtgaagaaaggcattggtagcttgatggggatggcattgaatcttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagctcactcatgatttggctgtttgtggttggtgtataagaatgcttgtgatttttgtacattgattttgtatcctgagactttgctgaagttgcttatcagcttaaggagattttgggctgagacagtggggttttctagatatacaatcatgtcatctgcaaagagggacaatttgactccctcttttcctaattgaataccctttatttccttctcctgcctaattgccctggccagaacttccaacactatgttgaataggagtggtgagagagggcatccctgtcttgtgccagttttcagagggaatgcttccagtttttgcccattcagtatgatattggctgtgggtttgtcatagatagctgttattattttgagatatgtcccatcaatacctaatttattgagagtttttagcatgaagggttgctgaattttgtcaaaggccttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaagttctcttttttggttgtgtctctgcctggctttggtatcagaatgatgctggcctcataaaatgagttagggaggattccctctttttctattgattggaatagtttcagaaggaatggtaccagttcctccttgtacctctggtagaattcgactgtgaatccatctggtcctggactctttttggttggtaagctattgattattgccacaatttcagatcctgttattggtctattcagagattcaacttcttcctggtttagtcttgggagggtgtatgtgtcgaggaatgtatccatttcttctagattttctagtttatttgcgtagaggtgtttgtagtattctctgatggtagtttgtatttctgtgggatcggtggtgatatcccctttatcattttttattgtatctatttgattcttctctcttttttagcattgggagatatacctaatgctagatgacgagttagtgggtgcagcgcaccagcatggcacatgtatacatatgtaactaacctgcacaatgtgcacatgtaccctaaaacttaaagtataataataaaagaaaaaaaattactaatctttaactcatttgacacataagaatgacaatttcatatattttatttcccacctttcattttatttttagtctccatttaatgataactaaattttaaatattttaagaattttaatcaagcgcttctcaagatatgattaacttctataattttattatgtatgtatatgtgttaaatatgtaattattatttgcacatattttacctattccaatgtctcttactgccttcaacattcatttctgtttcttttacacaacaccagcctcaatttgttagtgtttttttgttcgtatatcactgattttgagtttatctctgatcacttgtagaacgggatttagtttttttttaatgttttaaaatattggccaggctcggtggctcacgcctgtaatcccagcactttgggaggccgaggggggtggatcacgaggtcaggagctcaagaccatcctgaccaacatggtgaaaccctgtctctactaaaatataaaaattagctgggtgtggtggtgggcgcctgtaatcccagctactcaggaggctgaggcaggagaatcgcttgaacccgggaagtggaggttgcagtgagctgagatagcaccactgctctgcagcctgggtgacagagcaagacttcctctcaaaaaataaaataaaaataaaatattatttatttatttgtaattgataaatattgtatatatttattgtggacaacacgatgttttgaaatatgcatacatttttgaatggccaatggagccagttatcatatgcgtcacctcacatacataccatctttttgtgatgagaacacttgaaatctattttttttagtaattttaaagaatatattgatattaactgtagtcatgatgttgcacaatagatctcttgagcttgttcctcctatctatctgaaaatttgtatcctttaagcaacatatcttcaaccctgcccagtcaccctctggtaaccaccattctactatctacttctatgagttcaactttagtagaacatgaatttgaatggcttcactcctaacgctgtacacatctgattatgagggtcttttcatttcctatgggtgtgattgaaagcctgaatgtatgtaaatttgggggtcataacgttttcttgcaatgtactatagacatgcatgcaaatccatactggggcaagtaagctatggagtgtctgtgtgataggctttagacattaagaagaggaagtgataagtagtagaagaggccagcatgattccttcaaggattatgaaggaagatagtaaaagtcattttttaaacagtttgtctactttagatggtaaggcagctaaagaattttgcaaaactcctctaacttcaaaccttctagaaagggttagaggatctcatgtcatcaaacagacccccaccaacaggagcagatggggctgaatgtagtttctccacttccgtagagttttaagtaaatacagctctaattacaatttgtattggacattgattctaataatccataataatgaattaaggaaagctttagtaaaataaagagaaatgtctctgacaaaaaaaagtttttctaagtaattagatgggaataaaatgtttactgtcatttttcttttgttacagagaaaaaagatctgaagataaatatcttcagctctttttaaaataacctatattttcctctttgatgtttatcaagatacgtgacgatcagcatattttaactataaagaaatgtaacatcatttttgaaatgaaaaagtaaggacaaataattaaagaaaattacttataatcttactaccccgatatttgtttagattgacactttattgtgtatctaatttttaatacatatttcttatttaaaataaaatgcagatcgttcagtacaaactattcataacttgctctttttacatgcaaggaaacattccttaatatccttacatattttaacactctcatttataatggtgcatgtggccttttatcctagtgctgtatttttaaaatcaattataaatggaaattcattggaatgtagttaataattttatttcttctcaaatatcttttcataaaaattgtgccaatttatactctccagtataagagagtgtttgtttcatccacttatcaccaatattatttaagcctttgccaatttggtaggtgaaaaatagtaatgtaattataattccaaattatttagcaattcatttgaattttatcatattttcatacttaatacaaatatgtttctcttatgtagaattcaggattatgttatttgcatatttttattaatgttttcttactgatttgtaagatgtttatgtagcaaggacattcatattttgcattctgtaaatatttggaaattttcttttagagatgttaaacattattcacttttactgtattttggatattttttcctaaatttctgaatcactgatttgattttctgcagtactaaatctgagttgtattgcttgtagcacatattttatttcaaccattgcagtctcatttctttttactttaatttcactctacatttatttaataaatgaaatgtgctcttttctgtccctgaacatgatgtaatgtaactacatatgtttataccatggctcaaatggagagaagaggacccaggtaacaaaggagaaagataaaagatagataaagatacagttgcatattggataaagtcactaatttgcaaaggtcagaagatatttctgtgcagaaaaggaattggccattaggtaggatgaggcacgtgtatacctatgtgttaaattatgtgttaaatatttgtcattttacagatgatcgtagattcctgctaaaatctcacatgacctcagttcctattactcattaatttttctcctgaatataacttcattatcatgacgtcatgataagttcaaaaagcattaggaaaagggggtttagcatttttatttacttcaacattttaaagtatttcccagtatgtgtctttaaaataatctcttatggaatatcaaaagacagagggactgataatagttacggcttgagtcaaccaaactgttcaataggaaatagcatcagtatattttctgaaaatcctgccttttgcttgaatattatggccattttgttcaaaataaaaatactcagcaaaacccttaagagaaaccttcaaaaggacaagtacatgccaagtaatctatattgtaagtgcaagggcaaagatacttctccatccttatattgaagcggttgaaaatttgctacacattgctagagttctccaaaattgtttagagtttattattattgttgttgctgttattgcagttgtttctgttaagaaaatgtgggtaaagggccgggcgccgtggctcacgcctgtaatcccagcactttgggaggccaagatgggcggattccgaggtcaggagatcgagaccatcctggataacacagtgaaaccccgtctctactaaaaaaatacaaaaaattagccaggcgtggtggcgggcgcctgtagtcccagctactcgggagtctgaggcaggagaatggtgtgaacccaggagacggagcttgcagtgagctgagatcgcaccgctgcactccagcctgggcgacagagcgagactccgtctcaaaaaaaaaaaaaaaaaaaaaaaaaaagtgtgggtaataagaggaaatatttatgaaatcgggataaatattgcgagtaatgtaacaaacagatagcttatgcccataaaatgctacattttactagctacggaagggtttgagtccactaagaatatacagaaagtacttcttgtacatcctcatttgatactgttgttgctctgatagggaccacatagcaatgtaagcacaccacagttaaagaatggttgaaaatagaacttaaggacaactgtaaatgacgtttggggagctattttctctctgtattttattttatttcatctcattttattttactttaagttctgggatacatgtgctgatcatgcaggtttgttacataggtatacacgtgccatggtggtttgctgcatctatcaacccatcatctaggttttaagccccgcatgcattaggtatttgtcctaatgctctcccaccccttggtccccaccacctgacaggccccggtgtgtgatgttcccttccctgtgtccatgtgttctcactgttcaactcccacttatgagtgagaacatacggtgtttggttttctgttcctgtattagtttgctgaggatgatggtttccagcttcatccatgtccctgcaaaggacatgaactcattctttttatggctgcatagtattggggagctattttctatggctgactttgttacccatgtgactgttcattccccctctcccaaattaattataattgctttggcttcatatttaaatgttccatatattgccagttgtctcctgggaagcaaaattgccactctttgagaaatattggtctagataaatagataccatttaatttttttgagacaatagtatgaacttttctatctgtatagacatttgattcagccaaagaataaactagattgttaaatcttatgtttcttatataaggtgttactctcacgttaagagcacccaaactatctaaattcacatatttacatcattttagcccttaagacatagcctgggaggaaaaagtatagcttaagaatggcataagaagatatatatttgttcttttctgaaatttaggaacatcaaatattttgctatgagacctgtcttctttggaagaaaaattatcagatttgattttgataatctggttctctattggaaaacataaacattcaaatgactaagcttcatatagggctctctagcaatgttttgttttctagtccgcttacacattatgagtataatctttaataatgttgaagatcctttggcttaaaattcaaactacctcttcttatgtttagcttatttttctggcagtaccactgtggtttcagataattttcttttccttttactctctcatttccaagtttcagttattaaattttggcatttgagacccagaatcctggtagtaagacttttgtttaatttttttctcccaaaaattacatttgattttaattatgtcacatgcacagagagcgctccttatccatgtgttctacatccatgtattaaccgactgtagattgaaaatattcagaaaaaaataataagtagttatataccaataaaaatattataaataaaacaatataacacagcatgtgttatactgcacagtatttacattctattaggtgttataagtaatttagagatgatttaaaagtatatgggaatatgtgcatagattatatacaaatactacaacattttatttaagaaatttgagaatcctcagaatttggtatccgtggggggggtcctggaaccaatcccctgtggatactgagagatgattgtgtgtctgtgtgtatgtgtgtgtgtgtgtgtgtgtgtgtgtgtgtgtatgacatgttgcttgttggctttattagctactatcaagtttttatactgcagcattttttaattcatgattttgataactccctcacttacttagagtgctttttgaaagattttgttcaagaaaaatacatgggtaatatgttttctaggattctctaaattggaagatatattccacttctgtaatttcttggctgaaaattcaattattgaatcacaaccattctttgaaaaaaatctgtgggcactgcctcaacgttatttgacttttaatgttgcaaaggaaaatgacaatttggatttttattcttttgagtgcaacttgtttttgctgcctagaagtatattatacttttttctttgcctttgtcgtttaaatctgtggccagaatatgttcatttttggttgtatttcataaatattgccttaataaagatgatctctattttacattatatattcctctgcatacccccaatatatctatatcaatttatgaatcaattgcatgttttactcttacaatatatctgtaattgatatcaataattaatacatagaaattaataaatatatatacaagtagatgaagttaaaattaatgaaaattgaacttctgatatattcttttatgctgcaagggattaatcaatgcgatgtctaggaaggtgcccatcctcctttgaagactatggtcctggaacaccgaggatccttaaatatgcatgtttgggtgttattacttccctggaaagttttcagaagttgtgtgtttaattctggcgttgattttaactgctcttgttccatcattccagaacctctataattcttaggtgggcttgtttttctgtgcaaacttccatcatcttctctctcttatttcttcttttcctaaaattttaattgtggtaaaatacacaatataccctatttcaccttacttccctcaccctaccccaccttcttgcagaaacttattcctttcacaattcattatatttttatatgtatcattctactcaattttctctgtgtattgtgcttatatatgtttgcataaattatactctatattgttttctgtgcttcgtaattgtgacttaatcatatatctaggaaattgtttatgagtgtatatttaaatatgacatcatttaaagtaatccttgaaaatattttaatacttcttttagttttataaatagatgtgagtggttaaaaattcatcagtgtagaatggtataacataagaagaagccatcaaatgcttccacttccatctggcaccaccatttttatttccaggaataaacacatttgagacttgcctatccacttttaacataaagtatctacgcatatacagacatatgtctattaagtaactggcttcttttttttacataaatcatatcaatgtgtctctgcacatatagatttctttatttccctttatttgctgcatagtattccatacgatggatatattttccacttaatcacgaaattaaccattcattttgttatgggtggttggctcatatacaaattttgttattaagatgcatgatatggtgcttattcatttacacctatttttgcatattggtaggaatttagcagtggaataaatttctagtagccaagttccttgggcaaaaggtatgtgcagtttgtttctagatatttccaaattattcccccaatttttacactatttgatgcagcataaatttgcttctttgctctttaagtgcaagttttaatttttccattttatttttctttctggattttttctcatttcttggcatctcaaaatgttctccttttgtgagacctaggtcttctcttacatcctatttgggtaagcaagtagtcttgaaataatttccataattcttttttttctctaaggtttgggatcagagtcacagtttatggttttgaagtagttttttaattgcgtacatgcatgtgtgaatttttcttttgactatttctggaatatacaccttagtttagttctcactaaagataacttgtttgtcttgttcttggctttgtatactctccacttgtgtagaattgtaaaagaatgttatacacacacacacatagacacaaagctcaatctcatattacattagctcagaagtcaaagtcctttaagaaatgggtgaaatggtggtaaacaatttatttttcatccatacttaggaaatgctcattccccatactacaggttgaaaaagaacttcaaatttctcttttaaacatcccatataatagaattgaaccttaatagtaagataattattaatgtgcatatgagtaagtttattatttaatatccttaaattagcacctgcatttcaaggtacagaatttgggttaggttccagtttgatcatttatttaagaacatgttgagcttatagaaggaaagtgagccttttttctctctcagaagacaggcaacaacattaaaggtctgaaaaaaatgctttttgcataaaatagtttacttaattgaacagttttttgctccccttaattcagttcttttacctagtagagaaaataaaccttaggaattaagttatagtctctaaggacagcttcaaaacttcacaactcattgaactggcataatatcagagagacttgcacttgattttattttaaatcctctagttctttgcctataagattggcattgatttcagcgtagctttcaaatgggcccaggttgcaatatctgtctatcagggatacaagtactaatgtgataaaaataataaagcaatctgtgcgctcttagtgattgtgtccttatgagatttcattttcctttataccatgaaattatttagtaaagccatctatcataaagagtgctgttagaaatacaattttctcgtgacgaatgatgtaaaagtaacctttttcaggacaatttattgattaatttgataaacatgtattttgtgccttttattcttggggcaccatattaggcatgtactaaaaaatactcacgaagcccttttaattctttgaaatgggttagatggtggggctgcataatggcaccaatattaaatagacattaagttaattaaggtgcgttaccttagttttcaaacatatatacacataggtccccaatttagagcaaaacagaaattttacaattagacttctaatgaaacttgcaatttttgttagaataagccaatctttagcatttataattgccaaattatgtttctctgcttttctgaggaaatacatggttatgctttgttttctgaagcataaatggatgtttttacttattagtcacttgtgagcagaaggtattactctcgttccttttatttcctcttcttccaattagctgacagatcaagaattcgaaagatgagaatgccttgaggtattcagatgtcatctacaacagggaagaagggtgactgtgagagtgccaaactttgctgctggaaggcagtgttatttcttgaccaactcatgtgcattctaatagtcagtgattttgcttccttatgtggctttgcaaaatgatcgtcctctgccaactctcccccctcctcttgttgttgcttttggtttcagtctgtatgacacaggagcgattttaaagcctttcatggccagtattgtatataaagaacttagtggttgcaatgtatcaattaagcaaacccaaaagttatctttatacagctgtagatattgaatgctaaaacactgttttatcaaatatttggttctaatatcatcatctaaattttaatgtaaacgtctacattaaacttttactggaacagttacagctgatttgaggtctactcctctagattagtgacattttctattaagcatgatttattttttctttacctgtaatcatttaggcaccacaaaggaaaccattgttattatagtctagagactagagcttgttggaagctttctgaatgtttttccacaagaggtggccaactcaattaggactggttcaatttttgtcaggtttagtttggttgcaaattccaccttttggtttgtaaattgattgctgctgtgatataacacaatgaccaatgggcaaaagctaggccaaaacagtgaccaaacagttgagcttgtggaactggtctcctttgcccagttacatgaacactgcaatagtttctaacttctgccactcaaaatatgtgaagcttctctaccaaagacaaggctccctttgcaaagatcacttggtagctccatcctgctggagttggtgtaaccgttcatgatttaagtcatataaaataggcactgaagctttatatactattggccacaatcagtttcataagtcttatattactctttcagcctcataaatgttcaatctcaaatctagtatttagatttatatataacttcctttccttctttacccttatatctacatactgttctaaatcagaactctttaatttagtccccttggccaatgagaaagttaagccattaaaaaaaaattctactttcaatacataacaaattttcttcttattctttaaattaaagatctccccctaaccctttacctttaaatcttttgtctttctaggctcactactttggtgatttacctattcccatgaccttactcatcattacaagcacttgacatttaaatacctagatcaaaccattcctgagttgcacatcccaacttctaacttccttatgaacatcactagttgcctgactatatattgacatgcacaattgagagtgttacagtgcaggcatgcacagcctaacaagcaagatacactcactgaatgaatgttaaagtggaaaaagtcttccaccttaaagattattttaaataatccctaaggggtgtaaaaatcatctttacttacattttaatttgtaaagaggagaaaaatattgatgaagcagttagaaatcttgtgcctgagagagagcgtccctcacttttggtccctgtagtgtgtctcttttcagttacagtaagtggcttcccacattcttttctcataagggcagtgcggccagatggcatgctacttacttattgagaaacaaaagagaatttcttccttacaaatgttatctaaaatgtagttttgaaagtctcttaggtaaagatctcctttataaaatgtaatatataattataagctggtggacttctttttgatctctaagattattttgggtatacttagattactgacaacccttagtcaagagccattagttccgtagccattagttaattattactgtatataattattagttagctaatgaagtgtaggttattattaatttggggggctgagatacaaagtaacatcaggtataaggagtttatggaagttcaaaaatgcaaattgtgagttatttcatactcatgacttatcatatggaagttctggtcccgccacttccagactctatgatctcaggcaggcaaataatttatgtccctcagcctctttaacccaagcgcaaagtggaataataagattggcctcacaaaactactttgaggaaaacattagaaaatacatttgtaagatgattctataataaccaagggaaattgttaataaatcacagtattcccataaaataacatgagttaagcattgtgtagaaggaaaataaatttcaaatatataataaatatggaagcaatgctcaaaattcaattttatgtgaaaaatgcaggaatcaaaattctacagaggttatgcaaatttatgtgtatactcacatatgtgcacatttgtgtgcatgtgtgtgcacatacacatatagagatgggatgagtgcagaggcaataacaaaccaggaacagtggtgggaatacatgttattttctttatatgtttctttagaagtgattagtagtcagacttattaggtgttgtatacactttttagactaatttattgaataaaaacaaaagccatttttaacaatggaacaattggaatttgttgttttctatagtaaaagctgtctatcttatcattcattcagccctcattctttgacatctgtatcaaacccgtatgctgtatggttaagccaactaatggacagtacatccttcaataaggaggaagtctaaaacacatagcttccaacttgctttaaaccagatcttgttggtgtgaagccactgtatagttatttttatttatttattcatttaaaaggatttccaagctggggttttggttacttattaaaacctacagagacaaacatgtgtttgaaattaattgtgttattccagatttttcttataccattacatcatgctctttcccaatctggcttcctgaattttcttcttaaagttacatgatttttagtctcattctcaagagacttggaaatgtaaattgagttattcaggcaaaacactgaatttcaagacattgttagaagccagcttcccattatatagaaagctttttttttttttcagtgtaggcatttttgctcagtttttagaagatttagaatgtaatacttgaatagccaaatactgatttcttaatcctatctattcatgtacattaattcctatgatgatgtttgttaggtttacaatcttggctggtcttggtaaggtagattaaaatattataggttttagactctcacagcagtaatgtccaccgtttttctccctagtgttaattttttttaatactaagaaattgtattcttagatattcgggaatgcaaattttatactgtagcactatatatttcggtctttggatagacaatattttggcttatttttttcaattcatctttagaaacatatatatgtttctaaacatatatgtttctaaacacatatatatatgtttctaaacacatatatatgtttctaaacacacatatatatgtttctaaacacatatatatgtttctaaacacatatatatgtttctaaacacatatatatgtttctaaacacatatatatgtttagaaacatatatatataaagataaagttttgctcttgttgcccaggctggagtgcaatggtgcaacctcggctcactgcaacctccacctcccgggttcaagtgattctcctgcctcagcctcccgagcagctgggattgcaggcaactgccatcacacccagctaattttttgtatttgtagtacagatggggtttcaccatgttggccaggctagtctcaaactcctgacctcaggtgatccacctatcttggcttccctaagtgctgggattacaggcgtgagccactgcgcccagccaaaacttttacatctttatgttgacataaaattctaaactatgtaagcaagcttcactttttttataaggatttagaaatgaacaaaatgggtacacaaagaacagattctttatttaacaaacattaattcattgaacaaatattgaagtgtatactttgtatcagttatcatgtcaatcatactagaagaaataagttccaattgtgtcaattggatgttctaactgttcttaacttctatgattcataagtttataactccctaataaatctttacatataattacgttggagtatcacaataatgaataataccattttgcttatataagctttgtgaatgtgaaacaaaaagcaacaacagcattgaagttagaaactcttgaaataattttctacaaaaatttatcctttttaaaaaaactaactttttaagctaagcagagttcggcctggttagtacttggatgtgagaccacctgggaatactgcgtgctataggctttaataaaacagaaagaaaaccctaacttaaaatatatatgtaagttcttaaaaagcatatcttgccataatttatgaaaacccttatatatataatttttattgtttttcagccacataataccagtctaaaaaagcacatgtagaatatttatatgtagtatatatatacattcaactaccttgcatatccagtctcatgaaaaacaaatcaaaagggaaagagaagtatagaattttcagtgtagttaagccacactgctttccctgattttgaaaaatcacttaagacataggttttacttgtttccttggccagggtatgatggattacctgtttcacaaccatctcagtaactaacaactgccaactacagaaccgtattgttctaccaaaggaaaaccatcatgagaagataagatgtttttcccctaccccattgaaacttctaaattacctataaaattgtcataatgtattagtaattggaaaattctgaatgatttttgtttatagtcttaaaatatatggatgaaaaaagaagaaacagttttggcaaaacaagctcagaattcttgatgaagctgttccttggagtcaaagggagtgtgatgccattgccactcaaggttctccttcgtaatctctagcagataatctataaatcccaatgacctataagagcaagacaaggactgcaggtgctcaggcaccatgatatcattagcaataatcaatgcatggctgtgttttctcactaatacatgggtagagtaccaaattattgagcaatactagatctctcttttatcgagctcattagtcttggaagaattcattaatcttttaagcttagaagaaaaatgtaacctaggatttggcagaacgatcaatgagacatacgtgagagagtgtgtgtgttcaagaggaaggtaaggagaattgaaagttttagcattggatttagcataggatttaagtggacccatctgtatttggggatgagggggaggtcatacacggggctgccaacatgggtggagacagaaaacaaataactctgaaaattgtgtgtgtgtgtgtgtgtgtgtgtgtgtgtgtgtgtgtgtatttctgtaacagtttagggttttaatttttttccagaaaccctaatcaacataattaactttctagcctcagatctaattggtcactacatcctgtcatggccaccaccaaattatatcttatttacttccttcttttatgcctactgccggaaacttatttcaaagatacctgtattttcatctgaactgttgtaataacctactgactggcttctctattattttcccgtgttcatcacttatattgacttccttatttaaaagcagtccagatctattcattgcctacccatgaaatccaaactttttggcatgaatttgaaacaataataattattattatcatttattaagaaacttacattgctagacataaaacatgagtatctccaactcccaaactgagctttgaagatagggtattgttatgtcttgctttgcagcagaagaccttgatatacagaaagattaaagatctttccaagttcaaggagctggtgtaagagacggaactaaaattcaaaacatgtgctgtgggtcgggcgcggtggctcacgcctgtaatcccagcactttgggaggctgaggcgggcggatcacaaggtcaggagatcgagaccatcctggctaatacagtgaaaccccgtctccactaaaaatacaaaaaaattagccgggcgtggtggcgggtgcctgtagtcccagctacttgggaggctgaggcgggagaatggcgtgaacctaggaggcggagcttggagtgagccgagatcgtgccactgccctccagcctgagcaacagagcaagactctgtctcaaaaaacaaaacaacaacatcaacaacaaaaaaacaaaaacatgtgctgtgactgcagagttcgggcattttccattacacctggttctgtttaaacctgacccatttcacctttatagattcagcaactaccagtctcaccttctcgtacatcttatacatatttagctttacccacccgccatgatttaaatctctcatactttttcccatcctcatcctgttggtcatgcccttcctgctgttgtttccttgatctttagtaattttcatttagataacatctactaatctctccaggttctgtgcaaatgtctcttcttctctgaagtctcttttaacctattgagttttccccttacccatgcaatatttccagagcatgtgatacatacttctattgctgcaccaatctcatttttgtagttatttatttgtgtatccataagtcaccatgactgcttgaaaacagagcacttttcttcttactttgttgtttatgacacagtgattgtcccatcaaacatgctcatacatattgaatgagtgaattctctacccatctcaaaccaatgcgttatggcaatggcacacaccattagtttttgtaagtaacttttgaaagttaagccaaaagtatcttcatgttaattaatagtgcaattttgcacgtgttggaatagttgagaattggttattcttaagatttatttcctgcccaaacaccacagctccatatttcacgattttccaatataacttatcatcttggctgtaaagaataccttaattttggccttaggtaggatagatatgtttgattggactttctctgactgattaggttaatttgtcagctggactcacggttcttctttagttttcttctattctacacttatgataactctgtgtttggatatttctttgtttattacagatattaaacttgtaaatttaatgattctctgtaatttttcagagcccatcagcccaggtgtctttccacatactgatgtagtaactgtgagtgcctttaaagctcttgtatctaaaccatagctctgttatggttagcctctgcttcattcatttaaaacctattttgtgtagtcactatttgcaaagtgtttagctaagataaaccacgtactttccctgttcttgagaaattcatagtgtatcctttggtttatgatctagcctaggactcaattagaacattaattttgaaaagttaaaggagacctctttggagattatgcgtttgttttagttgtgctattagtgagtttaatcatataattttgctcaaacaaatttcttaagggtctactacgggcctgcagagggggaccaagggctcagaataaattgatgtagtggttacagatgctggcactggattaaacctggatgtgactcctggcttcccccatacttgctgtgtgatgccctgcaagttacagtaactatctgagttttctctttgacatatgaaaaatgtaaataatagtatttcccatataggtatttggtgacaattaaatgagataattaaaataagcataggacattatatgacctttgctaaacgtccaatttttgttgtttaattattgagttttcaataaatatttgccaaataaaaaacttaaggaaaataaacactgaagttattgtcatgactttcatgtatatctccattcttgaagttttgacagagttataaaaattgaactccgagttttggctcaagaaacctctgttaatctgatatgcataaatcttgaattaaggtttcctttactactgttactattcctactgataatatctttttatagcatttatattttaatgtatatttcccattacctcctaaaatccttagagcaatccctgtgagggctggtattattttcctttatagatgaatagactaacatgtgcagggattaagagtcttgatctacgccatttggctcataaatggccagctcagtcctggaactcccaggtgtcctactcctgtacttcttgcctctcttccctaaattttggttagttgaaaagtggacaattatcatcttctggaatcttctgtatgtaatgtaatatagttacagtgtgtttatatagagtggaatataaggagatggagattactggcctaaggatatgtatagatataaatggaatgtgcacacacattttaaatgcatgctaagtggaacatggaagtttttcatattgactcaaagtgtggtttatttgaagacattcaattataaatgtcaagtcaacttgcattcaagtaaattattatgtccctactcctaaaatttttaatacaaagtcatctggccaatgcttatctcttcagactcataccccgtcatttgttctttttttcagaatcaccatatgattcagctgtatagaagtattgtggtgaatacttgtttcatacttctgtcttattatattccctctatcagtgtactccctgccccttctgcaactcttgtttatcctgggaaatgctggatgatctttgaagatagcaaatgcttgccccctctgtgataccatctttcaactctgtagattgaacattttctggcacttatagcactttaactgtcctatcacattaaacaatgttgatctaagtcaatctgggattccttagctctagtacaaaacctggtacaaatgtggaaacaattaatatttgaattgggctaaaaaactaggatacatgtttctttgggaatttgctgaaggaaaattagaagtaaaaaaattgagcaactttctaactgttttctttcaactccaagtgttcattcaatctgcacatgttcctgaacacctatgaagtctcttctcctaaccagggatccagcagtaaatagaacatataacaatcctaccctcatggaaaatgttttctaatgtaaagagatatacagtaagtaagataaatatatgaaatatcttacatggtgataaatgttttagagaaagataaagcaggaaggtagaatatacaatactgagaggaacttgcagttttaaataggatgggcaaggaagactctgctgaataggtgatatttgagaaagaggggaaggagataaaggattgaggtattaggatgtctcagggaagagcatcccaaatgtaacagcaaatgcaaacaacaagagaaatgaacacgtatgtcatgttcaaagaagagctcagaggccagagtggctggagcacagtaaagaatggaggagaaaaagaagacaagttcataaaaatccataaaaatcatgtaatgtcttgtaagttaaaagattgatagttaatatgagtaaaatgggatgtgaatggaaggttttgaaaaaggcttaatgtcatctaacttagtattttgaaaggataactctggcttttatattgagaatgaaatgaaagagggttggcacagaagattgaggataggaacaagggaaagaacagggagaccagttatgaatccattgaaatagttcaggccagaaatgatgatgacttggtttatgatggtagcagtagagataatgacaggtggtgggttgtgaatatattttgaagataaagataagagaatttcctaagagagcatatatatgtgaaagagtcaagtatgaatccaagatttttgttttaagcttttgagaggatagagttgccatttactgagatgggaaaaactgcagaaggaacagataagggggaaggtcaggaattcagtttttgacaaattaattttgagatatgtttagtcatcaaagtgaagtttccaaataggcagtttgtcattaaatctggggttcaaggaatcattccaggaaagatgaaatttaatgctatgggcctggattaggttacccaggaagtgagtataaacagaggagagaagagatccaaagactgaatcttggggcatttccacattaagaggcttgggagatgaaaaggaactggttaaagagcctaaaaagagagtgaacagtgaggtgaaaggaagacaaggatagaagtcaagaagaagttagggatcactggcaaacttcttctgtaaagtgccagatagtaaatattttaggcttcataggccaaaaggtctctgttggaagaatacaactctgctcttttagcaggaaaacagctatagatatcaggtaagcaaatgaacatggttatgttctgttacaactttacttaaaaatgaggcagcagacttgatttgatccataggctataatttgctgattcctgttcaagaaaccaaacaaataaactgtttccaggaggaaagaattattgattgtatcaacttctgcttatttgtcaaaggtgaaactgaggaattgaccattagatttaacagcttggtagctgtattagtccattctcacactgttataaagaaatacctgagactgggtaatttacaaagaaaaaaggtttaattggttcacagttctgcaggctgtacaggaagcatagcagcttctgcttctggggaggcctcaggaagcttataatcatggcagaaggcaagggcaaacaaggttgtcttacatggccagagcaggagcaagagagagagtggggaggagccacacacttttaaacaaccagatctcataagaactcactcactatacagtaccaagaggggatggtgctaacccattcatgagaactctgccccatgatccagtcaacttccaccaggcccgacctccaacaccgggggttacaattgaacatgagatttatgtgaggacacagatccaaaccatatcagcagcctttagtgaccttgatgagtagtttcaaaaggtgttgagaggaaaggcaaaattgaaagagggatttgggttaagagagaattaaggagagaaataagaggtaagaacaagtcagcactttgggaggccaaggcaggtggatcacaaggtcaggagttcaaggccagcctggccaacatggtgaaaccctgtctctactaaaaatacaaaaattagctgtgcatggtgatgcgtgcctgtaatcccagctactctggaggctgaggcaggagaattgctcgaaccaggacccggggggtggaggttgcagtgagccgaggtcacgccattgcactccagcctggggctacagagtgagactctgtctcaaaaaagaggtaagagaacaagtgttaaaaagtgaacgcgtttcagtttcacatttgaggggaacaaagaaatggagctgaaactgtaagtgggaaatacggtcaagagaggatgtttttaagatgggaaaataatagcgtagaatacacacaggaatgacccagaagagaggaagaaattggtgatgcaggagagagtggagctaattgctggagccatgtccttgagtaggtgagagggaatgagatctagagcacacagggtggggtccgtcatcggaacaaagactggtgatccacagtgttggtcaccaacgcaggcccatgggaagatatgttgacatgaggctagggagcaactgtttactgattacttcaattttctcagataaatgagaaacaaggtcattgactgagagtggggaaggaggtgttggaggtgtgaggaaaggggagagaataaaatagccattcagactggaggttctcaaacgttgctacatactaaaatgacctcagagagcatttaaaaattccaaaggccagattgtaaccaagacaactttactcagaattttggggtgatgccttgctttagtactttttaaagattccccaatattcaggtaaatttgagattgagtaagattactgagtcatactaggagccaacttgaatctagtgttcatgaattcaaaatgtgactagtcagattatgtgttttcctccagaagtttccatagcatgagagtgaacagtgaatgagtggagagttggtggtaaccggggtttaagatttatcaagtgggcaccagatttgagagggagcagagcaatttaaagatgtattcaaaaaagtgtttacaatacactgtagagtttatgcttgataaaaagagaagtgatgccacgaagggcataaggaatagtgaaaagccagtagaatgaatgcattggagggcctggtaatatcaaagtgttgttggaatggggtactagatggaatcatctggagacttagaaggtggaggtcagaaagtgtgatgtttataactgagtttctaacaacatctatcgtatgaccacagaaccaagtggccaaggcagggtggaggacaaggtctctggagtcaaaaagttcagtgaattactagggcaagatggtgagagaattgttttcaacagacatttaaagtaccagaagttatgacaagcatcatatgttggagagggtaacagttaggcaggagctaaaatcttcaggtagtgagggaatgataccacccatacttagatagctcctcattttcctactttcacagatactgattccatctttagacattttgaacaatgcaacaatgttaattttcttatactttgttcaatatactttcatgtgtagtcaggtactagcgttttcctttttgccccgttttattctggttattagtaattcactagtttctaaagctaattgtatcatcattgctttttacacttgaaatatccagtcactatttgtgcagagccaattcaatttttcttcttgaaagaatataactcttagctacaagaatggtccagcaatggtaatagaattattctccatggagaatacctttttgcttctctagctctcccttttaacattagccttaatctgatagcaaaatcagcagtcctaaaacaaaaggaaaaataatgatgtttctgaaaagagagagtcagaagaattaccagcacactgaatatgtatttcagtctcttgtgtaacaagtttgttgttgtgatggttgttttttgttttccctttggcaatggcaatgtattctggggaaaaaatgcagtatgttgattttttaaaaagcctattaaaaatttccaaagataaaaatgcctgaagcccttaatctaccacatgaaattgtaaatgatccccagtggtggagttctctgtgatgcaagttcatcatagttgactgatggatattttcagatcattcctgaagttgtagtgcatttgaacaatgagtattgtaggtatagtgtagaaatgttcatctttctatgactgagatggcagagccttttagctaagactcagtgtgatttattacctctatctacatcaatcaccaaacatgcaaatcatcttgactctcaggagagccatgactcattcactgatatagaatgtttctccgtcacttggctggagctctcttctctcacctccagtgttttacacagtctgtttcacaaatgtgaacaaactgatttctctgccatcccagttttctcatctcttcaaattgatggttttttccagcacatctttactgattaagctagatcatattcccactccattaaatcttactgaccattcttacctgctcatatttatatatcaagtcaaacgtctgttaacgtgtgaagtttattataatcagtctgtgttctctgtttaaattatcctacctcatttttatattaatttcttacataattcttttgtcaaacatgtataacttggagttgaaatagccttgtgtaaatcttgaatcttactccccgcaccttctgccacattgtccatttatgatgcttgtaattagtttgtagatttgactttttaagtgaaatattccagagcaagagttttctgtcaagagggagtttgcagttaggttgaggacaaatgcatatatgggtcacctggctaatttttttttattttgtacagcatatacattccttatttctagcctacttccacaaacaagtctgttaaggctcaagggtcaagtatctcaaatctgataaaatattatgcttaggtcagacacggttgctcacacctgtaatcccagcactttgggaggtcaaagcaggaggatctcttgagcgcaagagtttgagtccagtctgggcaacatagcaagatcatgtctctactaaaaattaaaaaaaattagttgggcatggtggtgcatgcctgtagtcccagctactcaggagactgaggcaggaggatcacttgagcctgggagattgagagtgccgtgaactatggttgtgccactgcactccagcctgagggacagagtgagaccctgtctcaaaaaaaaaaaaaaaaaaaaaaaaaaaaaaaaaaaaaaggaaagaaagaaagaaaagaaaaaaattctgcttagtcccatgctgtaggtagaatgactctggcttttaatggcctgccttgataagaggtcaggtgcactttctcacacatcatgccatgtccctcaaaggaggactccttattaacattgatactaaataactgataagctaatcatggagtttaacttaatacacctgaaaacgatcctaaaatgatctaaaaatctcctgggtttttttcttttcacagagaaggaaattgaaacagtcctctttcaggacccctgaaccaatattttttctattatgccatactacctctaaaataattgtttgctaatagccagctatatgcaaagaaatatattaaggcattaaaaatgtttgaagatatgatttattcctcaaggcccttaacatccctttggcaagataatgcaaactacctgtgcctctcttacacttcttagcaagatatctgtattttgtgatggtctatattgtgttttcttctcttctcctcccagccttgtcttcctgtttaccatctgaatgtggtaaaaatgcagatctacctttcttcccaatgctgaaatagggcctggctcatagttggcattcacggcagttaggagaaggactgaagagaagcctgcactttctcgtttttgtacatgctctgcacaaatcctgaagtatcctaactcaacccctaattatccccagctctttaagccctacttatctccctttaacctttgcctgcctcactgttcataccccctctcccatcgctgcttttgggtttgcatctacctcctgtccctgttttatcctattgtatttatgcatatgagtattaaaatcttaaaatataccagtaccttaaataagaactgagggataaagcagatatccctccaatttgagggtactttttttctattttattctccagaactgatcagtgccacaaaatatgatgagagagcaaggtgtctgttttctctttcagtttcattgttctaaagacaacactttcagtgtaggtgctgtgtatccattgcctgtttgaatttacagttgttttccagtggtgctgcctaactctttgctaatatctatatttgacattaggtcatctgggcagcttgctgtaatcatctgtgagaaagctcctctggaacccaccaatgggcactagaatcaaaactttggttcagtcttataatttcctcatttataatgtggggataattatagtaccttccttgtggagttcttgtgaggattaactgagtcattgaatgtaaagcacttagaatacgggaagcactcagtaaatattgttcatatggcgctcttcagtagccaaaatataacaccacactatttgcatttagtacctttctgttgtggaagcttctattcaaacaagggtatgtatttcatttatttttaacgttttgcttttgagaaagcttgagatatatttcatagttgcctacaggcaaagggagacaccaataaattgaattctgcatcctggatcataaggtaagtgccgaatctgaccacaggatcagtgcttctgccactaaacccgagtatcatcaaccttactggttctttgcttagatactcttgtccaaagttcttaaacgtatcagcaataccatcatgcatctttcttttattattatttttatttaaataaaaagcctacagcacccggtattcccaggcactctcccattcaagtactaaccaggcccaaccctgcttagcttctgagatcagatgagaccagccatgttcagagtggtatggccatagactcatgaatcattcttaactagagagcaatacattttagctaggaaaactcctgcattcaactataatttcatataatgtaaatatgttttaactatattaaataacttctccaaatatgaaacacacatatatatcatttggtctagatggatccttgactgtaatttactttgctgaagtgtccatctctctatccacatttggattatttaaattacttggagagccaaggtggctcccagactaaaatttccccaattgtccttccactgctacttgttcatgtaggaaatttctccatcctgtacacagacatcagagtactctactccaaagaggccctaggatttttatctcttcccctttcccagtccttctgacaactctccctccactgtttaaagcagtattaaaattatccaaatgttcatcattgcctctttctactttcaatattcctctagcagtgccactaatctaaagcatatgctgatttctcttccctcatgaattatgatttataatggattagcatgagcctaggaacaatgtacttcctcttgtcccagacatgtttagagctttccaatttacgctaacattggagtttgtcatgggggcatttttgcccatctatttttattatattttagtcaatactgtgttatatttccatatcatattattctgatataaacaaaaatcacaaggtaaaatacaagtattcattattttcttagtatttatcttatccactgagtagctttgactatacttaaaaaaattctcagcttatttaatagattaaaaattataatctgtaatgaattaattggaaataaccaattaatatagtgagggaatgaaagtatgtcacaaaaatctttctgaaaatgtttcaacgacataagtacaaacaactctgagaagtacaaacaactacagagaaggcataacaaatatgtcatgattgtcaatattttaaattcaccacttcaggtaggacaaaggatgttaaaatatttttctttgaatatttaatatcactaataggaccaaaaacattggaatagcatgtgtgtgacataagctcaaagttctagagcagtgctattcaatagaattttctgcagtaatggaaattttcaatatctgcactttccaatatggaagcaactagctacatgtggccattgagcaccagaaatgtggttagtgtaactgacctgatgctgaattttaaattgtctataaattttattttaattaaattataaatttaatgataaatagctacatggggctatttgtctgcaatattggatgaacagtaaaactttagagacttccaggcttctgttaagactgtaattcacacaaggctgggtcatcttgtggtcactattaggccagtgtcacactacaaagcaacacaaatcctacattaaaacaaccacataaaacgacctataagaaactaccacatcacactgaaaaataattttgatatttactgttttgcaagcgtgtcaaaatatttaaggatccttttcacacatctttctccttgaaaacctctcactatgcttcttcagtgctttcttcttgtttctcctccaaatattttccccaaacttacctatatatctcaggcatccttcctttctctcatcctcatctcttctctacaccttttaagatctgtctctttatccattatccccacacatcaacaggtccctgaccatgcacactaaacacaaaatcctcatccccagagaagagacttgctatccgtcacaagaataaatatttgtaaaggctaaattgggggctatatattagaatcatttctagatgtcacccttttttcatcctctaggcaagattatttctaatacgaatttcatgaggcctctagagtttaagaaaaaagctaatgcttattgaatgctttgagtagtaggagcacctcaaggcaataagaacatctcaaggtctcttccacctctttgatctgatgaaaaattgaataataaatataaactgggtatgatacaaaccaatgagcaaatcactttttatgtaaaagtaattaacaggggaaaagatttaaaaaggatgcccttcatcttccctagattgggagcttatcctttagactttaggttttgttcatttgggatacagtcaacaaatatttgttgagccttgactgagtgttaggcagttttaaaattattttatttgtattggtaataaaaacatggtggtccttgcccatatagagcttacaaatgttaaaggaggcagagagaaaacaagaaaatctataacctaaatataaaattatcaattgtgatcactgtaattaagaaattgatggggttgaataatagaatagcaggatgggaatgccatactaacgcatggccattagaaactaagtgatcctacataacacatgtgcacagagatgttctttatggtttcatagatttgatgttagtgtaacccatccttttacatgttatatgttgccatccttaaatggtctttggtaaaccacatctgaatttttgattagcaaatgtgaaataaagacttcagcttattccgtgtaggtgctgaataccaattaacaattcagtatgaataacatttccatctttacctaacgagcacattttttttttttttttttttgagacggagtctcgctctgtcgcccaggctggagtgcattggcgcgatctcggctcactacaagctccgcctcccgggttcacgccattctcctgcctcagcctcccgagtagctgggactacaggcgcccgccacctcgcccggctaattttttgtatttttagtagagacggggtttcactgtgttagccaggatggtctcgatctcctgaccttgtgatccgcctgcctcggcctcccagagtgctgggattacaggcgtgagccaccgcgcccggcccctaacgagcacattttttaaaaggttgtccattttatgaaaatgagtagaaatcgaaaaatgcagtgctgataatgctaagaaggatagactcatggagattattatgcatattgtattagcatcaggtggctgtaaatgcattagatataagctggtagatggtgggctacatgaggaagaaaaataaaatcaaagaagacataaaacttgctgacactacaacaacctcaaagttgtgcctaaaagatgagatttaatcgagtatttttaaaaactagatgctagatcttatggaatagaaacttgtttcctatcatgtaagtctattaaaatttttcccattaagaatttatttaaaaattcgtaactgcattatgtagaaattacatggaatatgtcttatactttgtcttttccccaaaagtgttatttcttcccattttatacctaatagagtagaggttaagtaaatggaggaacataatagaactagaaagttgcatagataggattaaaatgtagaatgttttggcttcaaagtctctgttctttctagttcatgacttctttataaaaatatatttatcagtgtttttggttggatcatcacaaaagtgggttcttccttcacttgtgtagacagaaataaagagtgaaattataacatacaagggagtaatttgaaacatgctcatttttcttgctgttgtcgaaaatgagtattttatattgttttctttttaaaacacaatttgctcccctgcacagaaaaatatacccgtttttctttagaaatttactaaatttttaatttgctaatcccaagggaaggattattttcttaggattaagtatagtcaattggtattatgatgttgggaagtaaagtgcagaattctattaaggacttagtgatttggatttgtcaaagaagagccactccgtgatgtaatttgcatggtcatatatatatgcaaagttctgtttcagcttggagactttatctttgaattttcactgagaagatattggcttattcctattttagaatctgtttagccatgactctggacacacatgtatagaaagagtaactcctttgtacatgtgcttttgaaatattgcctatgatcggtgcctccttagggaaagtgagttttttgttaagagtctgaaagtctatttaggaaagttgttttcaaagagtgtcctgaaggttacttggtctgacttaacagcaaagtcaatttaacagtagtctgccttgcagaatcctggatctatcagagattgagttctccatgctgtgtgggaaaattatactggctgattttgggagaagttactgtgggaacacattttggcacatttctgctgaagccagaaacctgaatgctttgttctttgtgaggtatcaaaaataaaaattcctgaaattctgacatcctgcctgctcccttatctgggttaaatgctgtggtaaacttctcttttggttgaaatatttaaaaaggaaagcaatacatatgaacagacacatatttatacacacacacacacatacacacacacacttgcatttctttacttgaactatcttgttgaatcctaattactaaactcacatactgcttcttcccagggaatatagaatattactgttatcaagatacgccacacctatcctcattggcgacctaccccctcaattctccttgctggtttattggattaaaatagagaagcagaaatcttatgtaggaggaatatgttgacaaatggtgggttttgtcttgataatttcaccaaatatgtgaattgactttgtcagtcattaaagtaagtgtgctgaatgccctctgtgtgtgtatcaggataagtggtctaatcaagttcaaatgttctgtgtctatttggctcagcttaattaaaattcagccctgcttttgagcaagccacagtgggttggcagaccttcaaagggctatattgcagcaaacaataaaagtgataaaggcacacaatagcaatcaatacaatgcaaatgcccctgttactcaaaaatccagtggaaagtgattgcttgaaacatgcttatccacttctcatcataaaattaaagtttttgcatcactttatttgtaagtttgcctacactctccttgtcaatgggcttgctttttttttaactacgaatggagtgaaagaaaatgatagtaagataaatcagctcaatacaaatcaaatactgtttaaatttttacagcttttgttttatttgttacacatatgggtgaaaacttactcaaaggatttttacctgtatgaggaagacagccgtaattcatcctccattcatttgtagtggaggtggtatattcttggtgatcatcctttttttttcttccagtccactgtttttggctggctgccatggtcccagattttctcacaaactgccatctggcattcttgctgtccctcacatatagctttgtcaggacctcctccaagcaggctggagaatttcacagcttgggggcatgggagtatacacgaagttgcagccacttcagggttgatttctcacctacaacccacatatctgtcactgctagatgtttagtggaaagagctgctagggcactggagattaggggacctggaaagaagtacccactcacctctgatgagctgtatttttagtcactctgtatttgaagaatagagatttttaaaacctgatctctgtattttacataatcatcgtggaacatcactgtgggtaaattattatgaaagatacttctagaaattcaagatggagatattgatattacaatatctcttatagcacacatgattgttgtatcatctcaaagttttcaatgaatgcttttatctgtaagcattcattgtaagactgaatctgtatatataattccacaatgtaactaaaatataagagaaggaaagtttcacatctcatccaagttaggtacatgaggccaccaattgcagaactctagaagtatttttgttacagtttttcaacccagtgaaacactatctcttctgtgtgtatgctttaagtttcattttggcttctaggctttaatcaagcactgagataattattataaaggtatgcttcaccattgtattaactacatcactgacttcaatagctgaaagagaggcactgggatagcgccatcacaactgttcacaaaattctggccagtggaacagctagtcacaaggccaaggttttgtgaactgtgtctatggctgtatctcagtacatctcttatcttctgcagtggaagccaatgcttctcacttcttttatatttcatccattacctacttattgcccttaaatcatcctaaactttgattgttttgttattctgttaaaaccataaatggcagaaaataaatttgaaaactaattattaacatcagtaacatgctctcttaacatgctgaagaatatcatactttcaagtgagagcagccagatcaagtgttaatttttgttttagatgccatgttaagataatagcttttagaaaagacgtacacctctattgatacactgacgcatatacaaggttcaatgaaattcctactgtagagtattgactgtgacatttatattttgtgtcaaacaattatatagattctgaatgtctacgaagcaaaattgtaaacacaactaacatcacttctttcttagataatttaatcaagatttccctgtgaacataaaatatagaatagttagtggttaatatttttgggaaatttccatcatagtataataaatatttggggaagacaaacctatacttgtaaagaataaaattttcttaaaaagtgtcatgaatatattgctcaaatttattctaatatagtttatgatagaaaaattatttctaggtagttatgttaaatagttacgaaaaatgccaatgaatgtcaggttaaacaagtttgcagtactttcaagacatggagtaatttggtaaattattgtattttaacaacagatgtattttctgatttttttttatgttctgaattttaatgtgcagaacttacactatagtaaccaagcaaaaatctcaaagggtattctttttccaaagccaaaaacaaattaaaaattagatggaccagtggcccccaggtcggcacccctactctccaattgaacagttacttcattcctaagtgcatgtgaccataatctgctttgagcattatattcaaactttatcagtctttgtttcagtctgtccaacttctgagcccaatcctccagccttcctttgagaacatatctagaataagcttaccttgtattacatctcagaagtttcttaaaactaaatcggggatagtatcattggtaagtaagctttcgttgatctggataggagatatctgcctgaaatgtgaattaatctgaaatccttagacatactaaatagttctctatttcagtgaaacagacaagtattcaccgattcttttcagtttgttatctgaagcttaagtttcctacttagttttttcctgttgctcacttttgacctataactaagaatgaggccgaagatatataccatcaggttgccaaaggagaaacaaagtaggtaggttctggggccagccactctgccagtgaccgtctgttgagatctttctatatatagagtcaaccaactgcaaatatatatgagaccaggatgtctccagtatagaatcaaaatgccagatttgagcatcctgtgtggctcacccaacaatgatggtatccatatgttagatggttttattttgtactgctttcatataaactcttcggaggcctttgaatagggatttttttcttctataattttaaatacctcaatgccaatgagatatgaaactcatagctataacttctcctacaattagggacaacaatttaaatttggaaaagtagatgactaaacaaatgtatatgaacatatacatcttcaaatataaatgctttcttaatggaggcttgctcatagaaatcagaaatgtatagtttgtttgctgttgtatcaacctgcatttgactatgattctgttctaaatgtaagtcttgtctcaatttttgaatttgttatggagtcttttaaagagacaggaacatatcaatagaagaaacagattctactgtgtgtatacttgtgtttgtgtatgagagcattcacaaaatattcatacttttaaactaactcccacagaaaaatttaaaactaaaatcacttaaaacatatgattggcaagagcttcaacaacctgagaactctatgcttatcagatgaaagaagaagcagcattatgaaaatgtatctggataccataagataatttcagagtacatcaggtgaaaacagtgagaggggctctttgttcatctgaccttatattttataaaaactcaaccttcgattccatgataaatagaatatcaaaatcccataatgtcagatatgtatctcatctttgatcttctgaaatgttatgtatgtcaagttaaaaaatcttgaactttgatggtaataataacatgcaaatattttgatcaaaactggttactttgcaaagaccgaaatgatattgaagtacttgttttttcaagagtcatatagagacataaatatatttggatagcataaaacttaggaacaaattattgttaatgagagttctgagatagaattttatatttagatttaatacttttaaaataacatttttcaaaatgcaaattgaaatattatatggatgcataccatattatgcacaggtagcgtttatttaacttttgtttcacaattatttattgaatgtctttttttgtgggagatgctatagtaggcactagtaattatgtgaataataaaatagatgcaatccctgacattgtggacttactttcgagtttggtgctataaaacttggttctctttcagtcaaatctaggttgaattattggcttcagtttttactgactgaatccatttgaatttcaataccttatgagaaagctatggcttagatagaatataaaacttggtagtcaataatggaactaggaaataaagccaagcttgcctgactctcaattcaataatttccccgttattctagattagataataaatgtataagtgtgaatttaaaactgcaaagtatgggctgggtgcggtggctcacacctgtaatcctagcactttgggaggccaaggtggtggattacctgaagtcaggagtttgagaccagcctggccaacatggtgaaaccccatctctactaaaactacaaaaattagctgggcatggtggcacatgcctgtaatcccagctacttgggatgctgaggcaggagaattgcttgagcctgggagacggaggttgcagtgagctgagatcatgccactgtactccagcctggctgacagaacgagactctgtctcaaaaaaaaaaaagaaaaaaaaaaaaaaagaagaaaaaaaaaagaaaactgccaagtatggtagaaataacaattggctttataatagctatttaattttatttaatattccttggcaattttatttatataattaaccaatattcattgagtgcctactatttggcaaacatagtttgagatcttggggatattttcaggaacaagaaaataagtcccacttctcagagtactgaagttttagcatgaaaatatagacaataaacaaatacttgagaaaatgtttagtgctaaatgctatggtaaaaagtaaatcagggaaactagatgctcaggaaatctttcccaagtggacctgaatgactaaaagagccaaccatgctaacatgtggggaagaatgtttgagaaagaaggaaaatctagtgcaaagccctgagaatggaatgaggttggtatgatcaaaggtccaagagaaatcaagtgtggctagagcactagcttttaaaatgtgattaccagatcagcaacctcatcatccaagtatttatcagtattctaggcatgttaatttccttgatttgaaaattatgctgtgattcggtaagaccttaacattcagcgaaattgcgagtaaagggtatatggcaggatttcattgtcctattttttgcaattttttgacaaatttgaaaatatttgcaaatgaaaatttaaaaaagaaatgagcaattatacagcaaaaatgaaaggttttaagcagtgcaaccagtggaatactgtgatctagtttgggttttaagaaaaatattattgctatatgatataaaaaatgggttagaagagggaatttaatgcaagcgcaatgaccggtgaaggagctgttgccattgtccagaggagacatgatggtggctggcactggggtggcggcagtagagatgagctgtgaacaagtcgatccaagataatataatttgaagatacaattggcaaggcttactgatggattgattgtgagaaagagttaacagaaatagaaaagtcaaggatgcttaggttttagaccagagccactggcttgatgctagtgatatttatttattgagaaggcaaagattgaagtaggaggttgtcaaataatggcacttgattaatttttacaagtaaattattaaaggaaatctaaacggacaatttgcattatctttgagtatttgtgattattagctggtagtgacgaatttaacttgatgaatgccatattgtctgtaaataaattaactcacttgagtgttctcatatttttcccgattttttagttgaatgcagctttagaacattaaattgtgccatatattaaataaaataattaaacaataccaacaagcactcttaatttgctcttctaaattttatatccttatgtagtttattattttattcaacaaatacttgtggagtggctactttgtaccaggtactcttttcatcactggaaatataacactgaacaaataggctgaaatctctgccctgatagagctttcattctggtacattctagaatgaggcattttaagaaaaaaaaaagtatgatatgtgggtgaaatagacagtttaaacaagaagtaaaatgactattaagccagttaataccaaggatatggaccaaattgaagccaataaggagcattgataatatgagaaaggaagggtttgggtctggagggggttttaacttaaaataaggtcatttggaaagacctctttgattaagagttaagggatggagttacaaagtgctaagaagagaggtcataaaagtgggggaataggcagatataggaagctttgtatgcttatttcaaagacgaccctgtgattgccggaatgactggaaggatggcattgccatttatcgaaatggagaagacagccgaaagagtgggtctggattgtgggcatgtttgggaggtcattttggacctgataaatttgatatgccctttagacttccaagtagagattccagtggctggtaggatctaagagatcatagatcacatgagaggcccatacctctgaatagcaaatgttgtatcaaattaagaagttatatttcagggttttttgtgtttgttgttgttgccaaggaattgatatacaggaataagttcctgataggtttaaatgcagtgaagagtgattttctcaattctcgtgagaatttggatcagaataattttatttcaatgaaaaatctgaaatatcaaatgcagcttaattgcattgacattattaaaagaatgaggacttaagcatatggcaaatttaattaaaatattactcttatagaagagtgatcatagtagaggacttttttctttcttaaagcaaattatatgccttcagcagtacttatttttacaaaatgcagaagactgtatttaagatgatttctagttcatgttattatgtggtgaaataaggaaatgcatgaagctgtgttatgttagtttgggttatcttcgaagcctttgattgggaattgactactaaacactgtaaataatatataagtactaagttctgaatgtgaatgtgatcttacatagtcatcaagccattatgtgtcctttgttttcctatcaaatgtagggggcaataatgtcagctattatatatttattttaaaaaatattttgaaaatgagaacaaggctatagatatacctataaatgtgaatatattttcaattcttcaataaaatatgttttaaaataagaaaacctgttctttttctcatcttcactaatctctttttagcaggaaagattattttttgtttgcaaataacaaggcttaggcattaagtaagcgctagggagaggaacaatagatctaccctagaacagattgaggaatcatacttaaaagacccatatattaacttggaaataagaggtagaagaaaaggaggaaaattaggagaaattactttgctagagattgttttgcattgatcatcaaatgataaaaatgtcttctttgaggttttcatttaggatctctgaactaatattcatattattgctgtagaggtattataaattcccagtcattagcataaggatttagtgacagatctgaggttctccaaaaacacctcaatgccaagcaaatgattctgctattagtcttcttaatgcacctggcaatttcctgtctttctactttgatcttctttctcttctcaggtttgcaacattaagaaaggggtagtggcaaaaagaaagaatgtcaacttagaaggctaactttgggggaaatcagtatagccgaggcatcccccaaaagcttcctttgcgttaatgcaaacttccacacaatatttaccaacttctatgaaccagaaaaggctcattcttaaaaaaaaaaaagacagctttattgagatataatttacatactatataatttacccatgcaaaatttaagatgcagtggattacaggatattcacggtgttgtgcaacctttaccaaaattaattttagaacattttcatcattccaaaaagaaaccccatgcccattagcagacagtcttcattttcctccaaatacaacccctcccttcctcagtcctgggcaactaccagtcgactttctgtctttatggatatgcttagtctggacagttaatataaatgaaatccagtcatatgtgtcctttgtgactggcttctttcatgtaatgtaatgtttttaaggttcacccatgttatggcatctatcggtacttcatttcttttgatttccacacatcgtccattatatggatttagaacattttatttatccactaatcatttgatgatcatttgggtagtttctattttgggctattacgaataatgttgccataaaattttttgtacaagtctttgtatgggcacttcttttgggtatgttcctaggaatggaattcctgggtcatatgataattctatgtttaatcttttgaggtactgccagaatgttttctaaagtggctgcactgttaacattccaaacagcagtgtattagggttctgatttctctgttgatctccaccaacaattgttattttgtgtgtgtgtgtgtgtgtgatacaatacactgaacataaaatgtaccattttacgtgtacaattaagtggccttaagtacattcacaacgttgtgcaaccatcaccattatctagttccagagctttttcacaatctgattgtagccgtcataggatgtgtgatatggtaactcattgtgattatgatttgcatttccctgattgctgataattctgagcatctttttgtgtgattattggccatttgtgtatttttaaagaaatatatattcaaatctgttgccaatttttaaactggcttttaaaattattgaattataatagtgaaaagactcattcttaagttaacaatgaatgtattacatgaaaaactcaaccaccccatggtttcagtttaaatgtattttccagggatcatggacttacccagtgcgcagataggacatctttatgacatcagaacattgatgtcaagtgcctattggttcagggtagtgtggaagaagttgtacaaaagcaggcacttttatacccttctctctgagaacattcatctctaaaaaacatacatgaaaaaactgccaaaaacctgatgcatttgtggtgtaatattaatttattggatatgaacttgttttgttgtaaactaccagagtgctttgaagaggaattttattaaatcatattcttaagaaaagtattaaatcagaaggtgcacatatggatatgcttattagtaagataactctatgttggtgatattcagtgtatagttttccagagctgaagtgagttttctgtttccacagtttaaatgaaatgtgtttcaaaatgacacttaggatatctgatggagatgttgtcccctgtcatgtttatcatttaatcttatatggcctcaaaaagagaaaatcatctttttggcatactggcatacttaatttatgcagcatactatataaatcctaaagggaggactgagccaagccagagaatggaataacctactttatttgcaaatggataaccatagacatgtccagttattattaagataaacaggaaatgatgacaaaaccaagatcttggctatgttaacaaatttcagtttctcagtctatttctgaaaatgttgagttccttccaagatcccatgttccccccacccccacaaccagatttattccaggcaatagtaaatacacctggtattcaagggaaaatattcacatattcacttttaaagccagttttgaaggagtctccaagacattgaagggaaccagatggtgtgcagaccattctacaaaggtttatgattagtttggctaaagcagctggtctctgcaatgaaagagttgtcatggcagaaaaatccccttttccctcagtgcagctgggcttgtccagggacgacttttcccaggcaagtgttctctctccattgggtgtttgcaaagtctgttgtacttagagaagttaaaccatttctgttgaaccaagttgacaaaaaacacaaataagccaatgttatttatttattttttttagctcaggatggtttaattgccttaaaaaaaaaagttttcacctctgagtgggccttttctgtccagtattagaaataacaactgagactattcaggaaaaaaaaaatggcactcttccaaaagagaaagtgaacttcaacacaattctcagattcaaaaggactgcaaaggaggattatttctgccagctttggtcatttgacagctacaattctccttcttcaatatgtcatcacaaatctctctcaacatattaatgggaatcctgcatttaattctttcatgtttatggagagggaggtggggtggagagggagactgagagagaactttcaccttctatatgtgataatatgtttaaatgtaattaactgttctgcttttgccgttaaaatgttattttgcattcccatcgtattgattttaaattgaaactcaatgcttttgcaaagacagtcttggggttataaaatgataggttttattgcaaagagaggaatatttatctgaacagatacatgagtgtttccataaagaatgggcctattttactttatcagcaactaaggggaaggttaatggctatgatgtatcttttctgttgtgtgtgaaacatgcagtgttcttgctgttgagatttatggtgtggaggacaaagcaggtgctattccaagccttctttcaacagcggagtataaactagggcctgaacttatctgtcaaaaagtaagttaaaataacgttagagaaagcctagaatttcacacttttccataccttcctgtctctagctcaggaatttaggcagggtgattaatgaccactgttatttgtgagctttccaagtccctacagacataatgaacttgacttttcagccacgtagaaggaaacaggctgttagagctctacaacatgacatgttcataattatgagctctctgcaattgggaagaaagaggaagaaaagagaataatcttctcatgtcccatagtctcaacttcaaacatcctctactccctctctttcttctttccccatcttcttcccgcctacacacacactcacacacacagaatgtatctatacttttattaatccagaaacaaagtctgactctacttaatcttgcctcttatttttccttcatatcaagcaagcaaatcatgcttactgatttctttgtcagaatatcgtatggatttgtccttccctctgttctattcaccctgtcgtcttgtgtttatgctagcccaatccctgagttaatttaggctccaggcactgtatgctttttgaggtaatacaacctcttcattttcctgtgtcttttattttaaccccagcagtttattttcttgcttttcaaaatcttttttattctgaccccacctccaaagattgtatatgctccctctttttgttatcgctaatgtaaatatctcttatccttttgaagttcaacattcatttccatcaagatgtactttaaatgcatcttcttgtataatccttttcagaccagcttcacctggtaaggtccattctgataaactgcttacaatgtttttaccccgtaatactaatcatatcttagactacttacttaaataaaatacaacttcttgcgcataggtatttgttctaaggatagttgctttgttatctatatagtcagtattcaatgccttttcaaatataattcaacaaggcctgttttcaacctcaaagaagtgaatgaagagtcactaactttaaagttccagcaatcccacagcattccccggctcctccagagtacctgtggaaattagattccttgtaagccactggtaattttaagagtctgctgctcttaaggaaagagtctgctgcttgctacaagatagcagaaattagtgtgttggttagttctgatcctgaaaaccttgcctttatcaaagacagaacatttcctgaatctcccgatgatatagtaaagtagtggggagaaattaatctccatcctccgccaatgtttttaccggatactgcatggcatccttcctattatggagtgttattttgactagaaaaaggattaggtggcaccatgggagaaaggcatagtctggttgaagcttatacgaattttcatttacatcctttctttttgtcttgcaaattactattctttttctctctcatttccaccctagaagtcccttagatgctctctttattctccattgctctctgatgctcttttattgaattctatgctccttgaatacaggtcttatgtcttgtttacctttgtattattacagttatctctgtgccttccacacaacaggtaatcaataacaatttgcttaatggaattgagtaattttagaagactagtctatattatagactctgataatttccttttattctacaaaaaagattttctatcccaatttttcttaccagtatcataccactcacaatacagcatgctgctattccatcagcccagagaatgtgtatgaacacagctactcaggtattccttatttttttcttttgaactaatcttaaagacactgattatatctctcttatgaagagcaattatacaattttgtggtagttctctttttacaagtttatcttcttagagaagtataactcttttttttttttttccaaaaaggagactatttctcagtatcctggggacatagcatgatgtgtgataaatagttattgctcttttttttttttcagagtgtgatcttcaggtgatcttttcatgctttttccatcctttcttcatattgtctttgacttgtcatagtttctgcctggcacagtgcctcctaaattcatctattactctcacctttctttccacttttctcatgtgagaaatacacatttatcttcatttaccctggaaggttttctccttaacaacagtgtcacacatgacatactatacattgcatgctctacaaaataaaacataacctatgagagaacaaattcataagttttattgtaatcaaaatatttttttgaaaaatcttacatacagtattaatttttcagttttctctgatacaaaagacaccctcacttaatgagaaaaaaagtcttagaatacgagagctggaaagtgtctttgggagattacttggcacataaatatgatgcatagaaggtaggaaattactgcataattacacaagtaatcagtgacacagtgtctagatagcccaagtcttctagtataattataaggccacatatccgtcatggtgactcatgtctttattcacactgaccctgtttttaattgtgtggattttcacagaggaaaaaaaatggtggtctttgtagagctggaatgagtgaatactttctggtagatacattcatttttcacatttaaatataatcttagtggattttagtttttactaaactacttaggaaaataaggttaaataagtatattttttaaagatttgaccttctaaaagttcatttaaaagaaagaaaaaatattttaattgatggaaaatgagcaaatttattcaaagtgacattagttgcaaattcattctgagatcatcagatattaaagcaatgcatttagaaacgttattcttcatattaccaaactgaagcaatttaaatgtctatcaatagtagaatggataagaaattgtggtaaattcacacaatgaagaactttttttttttttttttttaacggagtctggcttcgttgcccaggctggagtgcagtggtgtgatctcagctcactgcaacctcccccgccgagttcaagcaattctcctgcctcagcctcccgagtagctgggattacaggtgcatgccactatgtccggctaatttttttttgtatctttttagtagaaacggggtttcaccatgttggccatgctgctctcgaactcctgaccttgtgatctgcccaccttagcctcccaaagtgttggtattacaggcatgagccaccatgccaggccccaagaactattttatcatgaaaatgatagaacaaaactacatgctataacatggatgaagcttataatcataatcaaaagaagttagacccaaaggaatacttattatataaatctatttttataaagttataaagttcaaatctgtgagattagaaatcaaggtggtaattactgctggaaggagggaaggccagtgttttggatgaggcaggaaaggtgcttctaagtactggtaatatttcttgacctattgatggttacacaggcctgttcatgttgtgataattcagtaagcttgggatttatatacttttctatatgtatgtttttttaaagccaaaattaaaaaaaaaaagactaaaggggaaatttattgaataccattagcttttaaaatgtatttttgtttttacttaagagttttaaaaagtagtcatattttaaatttacatattgttgggaaaattctgccaatggtaggataaaacaatagatttcaattgaaatattgaaagcaacttgtgttggtaaaagatgagaagtgaaggtggaagactgattaaaactaccaaaaatatcatagtgataacacttttatttttctttttttgtgggggtggggatagtaccattataaaaatacaaacataagctgcttttgtacatcaccaaataattcattgaaatttaaggaaatcaaccagttatgtgtgtacacacacacacacacacacacacacgatctcatagagtgaagggttaattggaatactgactgagtgcaatgtacaagaaaatgtacacactgaatacaaacaagggaaaaaaatcaactttgcctaggagaataataaatataattataggaaggaggggggacagggtaggtgttaaaaaggagtttcctgggaaaataaggaagtgaagaaaggcattccaggcataaaatatgcttgctatgtgcaaaacaacagtgggaaatagcatagactcttccatgtacatactgcaagtgggtatgtgatggtggagctacagttggaaaggtaggtaggggtcgtatcatctagcccgatttactagagtttaactttatttactcatgaataggtagatcttgacagattttaatgaggggagggacatcaggtgccaagtacctacaaacatttaaacaagggaagggttttatggttgcagtgattaggacacgtttgaggaatatttagacaattaagttagtggaacttatatttttataggatgtaaatgaaggggcacagggaagccaccgaaggtgatttctgagattctgttttgcataacttggtacatgatatgccacagacataaaggggaaatgctttcaaagagatctgtgtttttctcaaattttacccaatatatttgcataaagctcaatgtagattggaactatggcaatttgattcagttccacagcttaagtaagtgttattttgttcagttaattgaaaatgaaactatacctgacaggaagctgattacttatatgctaatgtgacagtattatagatcataggacttataacacctattaatttggtaaatgggaaaaacaaaactgtatactgtgaaataagaatttacgttatgtatataagaaatagttgatttaggctgggtgtggtggctcacacctgtaatcccagcactttgggcagccaaggcagctggatcacctgaagtcaggagtttgagaccaacccggccaacatggcagaaccccgtctctactaaaactacaaaaattagccagatgtggtggtgtgtacctgtcgtcccagctacttgggaaactgaggcaggagaatcacttgaacccaggaggcagaggttgcagtaagcccaaatcgcaccactacattccagcactatactccagcctaggccacagagtgagactgtctagaaaaaaaaaagatgaagatacagttgatttaataaatggttatgatgaatgcatattatcatacttgcaagtaaaaatgcatatgcttataaaatatttttgaacagatattttaaaatcatagcaggttttagaaatcaaatttatggaaaacgtactagtttcatgtgtatactctaacaaagtagaaagagacaaaaatgtagtttgagatcctctgcaaatgccaaaatttagccagagtaggtaaaggacttgacagatgaaatgcactctgtctcttacactgagtttatacggagaaaagtaattttcgtaggcagtgaacacataaggaaactggtccaagtcttatgaatgtgaacattagtagaaaataagttatctttgagtatttagtagaaacaccaggaatactgcatagagggaagaaataatccaggaggtactactaataaacacatttttaattttagttcacatatttgggagaattcttacaaatttcatcggctatataccaaacctgaagaaaatattcctaatcaaattctgtggtaagccaggcacagtgtctcacacctgtaatcccagtgctttgggaggctgaggtggaaggaccacttgagccccggagtttgaggctgttttgaggcttgattgtgccactgccctccagctgggtgacagagtgagaccctgtctcaaaaattaaaaagtaaaacaaatcctgtggtggccactcctcatgatagtgacaggtacagacagtcttgttaatctgtggaaacactgaagtgagccaaatcatgttgtttaatggttcccatttggcattttgagcttgtttaagggtatagcaaatagagctataaatagtgcattgaactatgaattaatatggtctgtctgaaatcaatggaattttcaagccctttctgttaatatagagaaaaccaacttaaaaattatgactagcatgcagttaagaaacttggcaggccaaacatcttagaactaattaaacaaaagtgatacatttactcacatgatctactaattcattattattggtacgttagatgtttttcaaaaaaatactgttgtaaaaatttccctcaggtttgacaatgataaggagtgttgtgaaactactgtgattaaagcaccaaaggtacaatgggtcattttatatatacagcattccgttaagtgaagttgaatgcataatgactatattagcatagaatatatgagattagaattaggttttttttcctctgatttgaaattattggaaatcaaatagtgacaagaatgagtatattttccttcaaggcccttgaaaaacaagtcttctgtgtcacgttttatcggttcttttaaaaagagtaaacttttagcagcaagaaagatgtttgaacattattcgagtagctgccacttttaaaacctattgactagggaaaaatgaccccaatttttccccattatggtttgtctgtgtttgcgagtaaagacgtgtcttaattaaaatgttttaaatatgtacctaaaattaatatgagaaagtcataataaaaggccagatactctttagcatggttcttaaccatcaaactttcacttctggttctaaaattatacacctagaataaaatgaacatgtaaaaatattcatgtgtcttgacattggccttctgataaatctaatttgctaatataaaatcttgtaaaaagactataatctaccaaatgaatttactacaatatactcttctaaatagatcttacttataaacatatatgtgcaaaaagagagagaaaaggtttaatttatagtcttaaaaccaatatgctggctatcttagtgtatctccccagatctacatccaccttccagaacatgctctatgccatgggagggggatctgtaaagaatgcatcaatgggcttcctgtcctcctgccagctgggtgtggccagtgaggaacaccagaaaattaatgaaagggggagaattgggtggaggggtctttgttcttcttgttacatttttgtaagtgattcttgaggtgaactggagaacagatttaccacaccttcatcccagcactttgggaggctgaggcgggcgatcacctgaggtcaggagttcgagaccagcctggccaacatggtaaaaccctgtctctgctaaacatacaaaaattagccgggcatggtggcaggtgcctgtaatcccagctacttgggaggctgaggcaggagaatcacctgaacctgtaagagagaggttgcagtgagctgagatggcgccattgcactccaacatgggcaacaagagcaaaacgccgtctggaaaaaaaaaaaaaaaatcccacacctcctgtcagaaagccctctttatccatcttgccctcaatctctgggttctggtatccgttccatcctttagctttgtcttgcccacatttgtgtgtgtttatatatatgtgtgtgtgtgtgtgtgtgtgtgtgtgtgtgtgtgtgtgtgtgtgttattaaatattcctcaaatttcccaactcaagtatgctgtttgtttcctggaaacaggaagatatctagaatctacttctaactggctttgaaaatctggcagtgacagctgggggctcaattttgtatactttaaactttaaatttatatcatttatatatttataaaatgcatatattcattcattgttaatagtaataaaatatatagcaagcatttgggaggcagttttaaaagaaggccattaattttgctgctttagaaaatgttttatgtaaggtgtttcaaaatttggaatttgactctgcatgtagcaattggtatgtgttttactaaagaattatactctacctgtaaaagttcttttaggtaaagacctggaaattatattcaacatttgtgaattgtacactctttaatgcagtcaggattacaggcaaattttctagtagagtaaaaatatacatgaattgtaaaagtaataagaaaggaaatttgaattttgctatagttgttagagagaaggagttagatgatttttattcctgttgccagtaatactaagataaaatgattagagtcacatacacgttatatatgaaaacttataggaggtatgaagaccagaattgtttaggagtttataatctgaggacttatatgatgttctttaacattttttatgctgagaaagaatattattaaacaatgagttaagtcagaacataatgtgacagttaaatgtctgttaaaaaatacatttttgaaggcagaacttctggttatggtagaatatagagatcagcaaaccctttccccaaaaaagtaaaaataaagctggataacattgataaaaccatgagttcagttttttggaaattggccagaatcataaagtaatctggagagatttcatggctttgtagtataaattacaattattctaaaatatttaatctgaaggctatcatgagattttaaaatggaggggacatgctaagtaaaaaatgacaacaggtgattaagcaaaagtgaaaaatattaattttagtatatgattccagcaagtatgtttggactgttgaactattatgaatatttacctatcattatcatcttttaaaatgtctactcactagaacatctcactaattatgtatttctttatttctccccaatagttgtgctttgatagtttttgcaaatttatttaatcatactttatttgaatgtattacattcatattttattttttaacgcagacatttgatatattcagaatggtagaaaattaaatgtacttttttagtattattattatttgagacagcttctcactctgttgcccaggcggaagtgctgtggcacaatctcagctcactacaatctctcccttctgggttcaagcgagtctcctgcctcagcctcctgagtagctgagattacaggtgtgcagcaccaggcccggataattttttttttttttttattgagacggagtctcactctatcgcccaggctggagtgcagtggcgtgatctcggctcactgcaagctccgcctcccgggttcacaccattctcctgcctcagcctcccgagtagggtagctgggactacaggcgcccgccaccacgcttggctatttttttgtatttttagtagagatggagtttcaccgtgtgttagccaagatggtctcgatctcctgacctcgtgatctgcccgcctcggcctcccaaagtgttgggattacaggcgtgagccaccgcgcgtggcccgggccagataatttttgtacctttattttttgaatttgttaattagcttgatttaatcattttataacataaacatatatcataatattacattgtacccaacaaatacataaaattatttttcaattaaaagtacagttttttaaaatgtcaatttttctttttcaatgattcttttatttattcactttatttttttcagctcttgttttagattcatgtgtacatgtgcaggttttttacctgggtatattgtatgatgctgcagcttggagtaagaatgatctcatcactcaggtactgagcattgtacccaatagttagtttcaacccttacttcccttcctccctccccccacaatagtccccagtttctattctttccatctttatgctcatgagtacctaatgtttagctcccacttaaaagtgagaacatgctgtttttggctttctgttcctgcattagtttgcttaggataatggcttccagctgcatccatgttgctgcaatggtcatgatttcatactacatagccacaaaaaagaatgaaatcatgtcctctgcagcaacgtagatgtggctggaagccattagccaaagcaaactaatgcaggaacaaaaaagcaaataccgcatgttctcacttgtaagtggttgctaaacattgggtacacatagacaaaaagatgggaacaataaacacgagctccttcttgagggggtagggtggtaggaggatgagagtaaaaaacctgtctattgggtactatgctcactacctaggtgataaaatcatttgtacaccaaatcccagtggcacacaatttactcatgtaacaaacctgcacatgtaccccatgaaccaaaagtaaaagttggaaaaaaaagaaattacctatacataaagtttgaggtcttacatttaaatctctaatccatcttgagttaattttcatatatggtgaaagctaagggtccagtttctttcttttgcatatggttggccagctgtcccaacaccattggttgaatgggggtcctttctcttttatttatgccgactttgttgatgatcagattgctgtaggcatgtgactttatttctgagttttctattctgttccattggtctgtgtgtctctttttgtaccagtaccgtgctgttttgattactgtagccttgtagtatggtttcaaatcaggtaaagtgatgtgtctggctttgttctttttccttagttttgctttggctattcaggctctttttggttccatataaattctggaatagttttttctcattcagtgaaaagtgacattgttcatttgataggaatagcattgaatctatacattgctttgggcagtatggccattttaacaatattgattcttccaatccatgagtatgggatgtttttccatttgtttgtatcatctatgatattttacagcagtgttttgtagttctccttgtaaagatattttacctccttggttagatgtattcttaggtatttttatttatgtgtagctatagtaaatgggattgcattcttgatttggctctcagtttgaatgatattggtgtatagaaatgctacaaatttttgtacattgcttttgtatactgaagctttactgaagtcatttatcagtttcaggggccttttggcagagtcttctaggtagaggaccatatcatcagtgaaagagacagtttgacttcttcttttcctatttgaatgcctttattttgatctcttgccttgttgctctggctagcacttccagtactatgctgaacaggtgtggtaggagtgggcatccttgtcttgttctagttctcaaggcaaatggttccagcttttgacagtttagtatgatgttgactgtaggtttgtcatagatgtctcattattttgaagtatgttcctttgatgcctggtttccggagggtttttatcatgaagggatgttgaatttcatcgaaagctttttccatgtctcttgagatgatcatatggctttggtttttaattctgcttatacattcatatttttaaagtcacaaacatatagagttgcagttattaacatgatctctaatttttgtaaataaaattcaaatatcgattttagtgattgatgtaatctctaaataagatctaatgtgtattcaaaaaataaataaataatttgcaagtatttagtaatgtgtagatggtggaggggagtgtcatattgtaattaagagctgatcccttgggcttaaactgccagatcatgccaaagactggctttgtcacttattagttttgtgactatgggaaacttacttgtctcctcagcttcttcaccttttagattgattcagttttagaacctacttacatagggttgttgtaggtacttctatgatataatacatattaccaacttagaatacaagcagacacatggtaagcactcaaaaattgttagttgttcttatttttatattttccttcattataagctgttacttgtgagagggaagaaaaaaatctacttttatcattgtttagaatagtcaacttatgttccagttcttataaaatgacctcaccatatatcgtatatattgcacagtgaaaagatgcttctgtcttaataaatatacagatagcccatagggaccaactctttgtgcggatataaaatagtacagccacaatagaaaacagtctcttaaggcagttcctggaaaagttaaaaatgaacttaccatataacttagccattcaagacctatgtattgacccaagagaaacgaaagcatatgtctatccagagttgtacatgaatgaacatagcagctttgttcttaatagataaaaactagaagcaacccaaatatttatggaggtgaattgatgttttaaatggtggtttaactatagaatggaatataactcagtaataaaaaggaattaactattgttagcctgcgacagcatgtatgaatctcatgctgagtgaaagaagccaaaccaaaagagaatgcacattgtgtgattccatgtgtatgaaattctagaaactgcaaactaatctgtagtgacaaacaacagatcggtggttgcctaaagacagtgaaggtaaagtttgaagagacagattactaaggagcatgaggaaacttttaggtgtgatggatatattccttattttgattgtagcgatgatttcctgggtgtatacataagctaaaacttataaaattctacctattaaatatgtgtggcatttacatttgtatgtcaattataagtctacaaagctatttttaaaaatacatttctctcataaactaaataaatgcagaaatttaacattttggatgttgtattattgcatgttttaaataatgaattcaattggagttttctcattaaaatctaaagttgagtttaggttcacagtcaaatgatgtcctataatctataaaagttattattgcacagtgataaattggaaaccagagagaccgacattatataatatttcagttgagtgtgatgtgtctgttatgtacagattttggcaccacagtgcatggaaatatatacaaagagtcttcaaaaagttcatggaaaatgcatattatggaaaagcagttcagagaaatcaaattttgttgaaccaaaataaactcatactaacatttaaaaacacgtctagatagcatctagtttgaggtactaagatggataagtcatcagtttaaaaagaggccctggcggggtgaggtggctcacgcctgtaatcccagcactttgggaggctgaggcgggtagatcgcctgaggtcaggagttcaagaccagcctggccaacatagtgaaaccctgactctactaaaaatacaaaaaattagctgggcatggtggcggccatctgtaatcccagttactagagaggctgaggcaggagaatcacttgaacccaggaggcagaggttgcagtgagccgagatcatgccattgaactccagcctgggcaacaagagcgaagctgtgtctcaaaaaaaaatcagatttatggtgatgcttgagaggaagaatggtgaaattattgatgttttgcacaacatttatggggacaataccccaaagaaatcaacagtttacaaatggaaaactcattttgagaagggatgagacaatggagaagatgatgctcgctgcagcagactgtccacacagagcagaaaattaatcttttttatgccctgattcaagaggactgaccattcacagcagaaacaatagtgaacaccatagacatctcaattgcttcagcttacacaattctgactgaaaaattaaggttgagcaaactttccacttgataggtgccaaaaccattgaacccagattagtggagacaagagaagagctttcaatggaaaatttaaacaagtgggaccaagatcttaaagcatttcattaaagaattgtaacaggaaatgacatacaactttaacagtatgatcctgcagacttagcacaatcaaagcaaaggctaccaagagctgaaactggtcctgtcaaagcaaaagcatatgaaacaaacatgtgagaaaagttcaacatcactgatcattagagaaatgcaaatcaaaaccacaatgagataccatctcacaccagtcaggatggctattattaaaaagttaaaaaaaaaaaaaacaatagatgctagcaaggttatggaaaaaaaggaatgcttttacactgttggtgaaagtgtaaattagttcaaccactatggaagacagtgttgagaatcctcaaagacctagaggaagaaatgccatttaaccaagcaattgcattactgggtatatatccaaaagaatataaatcatcctgttataaagacacatgcctgtgtatattcattgcagcgctattcaccatagcaaagacatggaatcaatataaatgcccatcagtgatagactggataaagaaaatatggtacatatacaccatggaatactatgcagccatgaaaaggaatgagatcatgtcctttgctgggacatagagttggaaaccattatcctcagcaaactaatgcaggagcagaaaaccaaacaccacacgttcttacttgtaagtgggagctgaatgatgagaacacatggacacatggtggggaacgacacacactagggcctgttggaggtggatggtgggggagggagagcatcaagaagaatagctaatggatactgggcttaatacctaggtgatgggatgatctgtgcagcaaaccaccatggcacacagtttacctatgtaacaaacctgcacatcctgcacatgtacccctgaacttaaaagttgaaggaaaaaaaaaagcaaaagcagattagtcgagagaaaaggtcatagcaacaatttttgggtatgctcaaggcattttgcttgttaactttctggagggccaaagaacaataacagctgcttattatgagagtgtttaaagaaatttagctaaagctttaacagaaaaacatccagaaaacctgcaccagagaggccttttccaccacaacaatgctcctgctcattcctcacatcaaacaagggtaattttgtagatgtagaagttttgatggaaaatcattaggtatgcgccttacagtcctgcttcggcctcttcttactttttttgttttctaatcttaaaaagtctttaaagagtattcattggcctggttaaattccgagcatcttcagttttttaggagtaaactaaatggtatcattgtttacaaaaatgtcttaaacctattttgaaaaataaaatttatatttttaaatttttatcttttatttctatttttctaactttttgaagtcccctagggtgtgtgtgtgcacacatgtatatttgtgtatatatactcttaacccccacatgtacatccatgctgcatcctattgggggaggcagtttgtgaaagcattatccaagaatggtttagttgcccttgattttatatatagtgatccagtcataaaactgtagtttatgtgtataattacaggaagacaattcatttgaagagaggcatatgcacacagttatttcaagaagccattttttatttatgaattttcaggtcaaattttttaataacctaagcaacctttggtaggatgttttaacagaattctaaatattctatattgtagtcccccaaacagtgaaattttcaggaatgtaatactttgtcattatgttagctcatctatgtaaaataggctacatttattccaaaacgagaatactttgaaacttctaatgcttagatatttaaatgtggtgattatgctctcatgaatatttaaatctttggagtcagacatagttgctgctagtgccaatcaaatctaggatgaccaaagaaacactgctttcatgaataagtaatctttctccccatgagttttctgaatagtctaagaactcatgtgggaatagggagagcactgttagaatgacattttatctaaaaaagggagcaaccacgggagcagatgtagtatattataatctgcttgacctgttcacaatgatttgtgagttctgaactctaaaggaaatgctttgtttgattctaaactatagctaacaatgttggatcagtgtatgaataactgaagtatttattattctcaggaagtacatattggtcatccaatatgaattctaaaataatttaatgattgctattattttaactctataatggtaataataataatcttcctacatttcaaaggtcagctttacattaaaactttcgctctgaaatttcatattggccatattactctgtttaaaaacattttctaaatatcacagtgaattatatagaattctgtttaaaatttgaattatacagatactatattgatggtagatgccatgagtaagttgaaatatatattattagaagaatatgtcacaacagaataattaaaagtgagtactaagaaataccttatattagacttaagcctccctggataccaaaaaccttagtgtctatttggggaattcctgagatttcaacatagagcattagccagtgtatttgcaaggccactcaaattcactctcatagaaaggacaagaaatattttattcagaaagaagttcatctcggtaactcaagccaagtgaatcaaaagtctaatgttctttgggggcaaaatttctctattgtactcagaaaaaaaaagtcaaggtagtaattgttactgtctaaagaaagtcattgaaataacaggacattctgaagtttgtacttttacaattccttaactttatacatgcttaattaaaagttaataaatatttaccaaacaccttgtttgtgtgctggggaaagaggtatacatatatgtgtacaacagttcttcatttctcaagcattttttagtgggtagagaaagtggtcattagacatatacagaactgataataatacacagtagattgtgataagtgctaatatcatttaatattcattagtttaataaatacagctcagttctgttgctaggaagatcaaaatggctaatgcatggtctctggtctcaaactcacagagtagtgtgggaggtaagcagatacaatacagaatgataaagcctgcactagaaggttcacatgaaacatagaggcagacgcatctcattctctttgtgaaaaggtggcaagtcctgaagaacttctagtggctttggctaatatatagcttatagttacaaagtaagcagtatgacacagggaataatttaatatgtgaggcattattacatagttcctctttcaaggaaacatagctgtttagtccaatgggatcatatgggcaaaaatatcataaattaatatatataatcttcttaaaattccatatgttactctagaacagcctttgtaagccctttacagtaattaagaattttaaaccttattgtaaatatagtagatttgaactctaggcagcataagaagttttatatgtatattcatacagaaaaggaacaaaatgtacattgtgaatgattggttctttcggcataccaatgtgtcacttactgtggatattttcatgccagatattcagaaaagtttgtgtgtgtgtaggtttctatagtatcagtatagtaattctgtaatatagttcaaattataagtatatttttatataatttactgtgatatttaaacttttttaatatttaggatatacaagttcagatttcttacatgcatatattgtgcagtggtgaagtccacgcagagtaaaacatatatacacatggacataaacagatatatatgtatttacaataggtccacaagttatattttcctagagtaatatgttcattttacaggaaccaataataaataggaaaacaagcaaaagtactacattatacttttctttaaaaattgagattgtagattacatttaatagtaaaccaataactcactttttcctttattctgaacattggtatcagaaaagtatgacttctgtaacactgactagattatatgattcgacgtgaatctgttagaagcaaagagaatgatgaaaaagctataatatttagttacacatggtcattttaagaagagaaaaagcatggaaggaacattctgattgactggtgaaccactaccacgtattacgtgttgcctcaatgaattaaccgagagtggatttgtgtgctcacaatctgcttctgtagaataagaatgaacgtggagtctttacctgcttatagtaagcgtttatctctcaaaaacctttaatcatctgaatatcactaatgcaaaaacaggacccaggtaaatcggagaaaatagttcattctttgagcctttaggaaccagaaatttctgtagcaacaagagactttcttttataaggttttaatacctctgatttatttttcattgcaacagaggtttacaaagccacgcttggaggctttgtcaggattttgtagagtgtcagcatagtcatggtggatgttgcagttgcactgaaggtaccttaactttatgcaggaaaagaaacttaagtgtaactaaaaagctaaattttaaagtgaatcttaatctatgtggtaaggacaaccaccactacattcatagaatggacagaattgatgtttgaagaaatttagtactcacagaaatttggagtttttctgacataatatttgtaagatctgtacctatcatcatggcaaggatagcgagtatgtagctcattttaaaaatagttgatatacatttaaaatattttagattcccctttcttctaaatatattgctgttgattgttcaggttagtaatttgccttgactgtcactgtttttcagtttctctattaaaaattgtctgaatctatgtggatatatcatttattattgattgttccataataaaagaatctcgatttgtaggatcatggaaataactgaatttgaagcatttataatttacctggttctccatatccaattcatgattatcacctttgtattgatattttctgatgaaaacaaattcactgtgtgccaatttctacatttccactctcattgttttactcttttgctctagcaattgatctatgtcttttgtttcattgcctcacagactaaaccagtctctagtattaactccagtaatatttaaggtccttcaattaatcattccttaatgggtttacatattaattaatctgttgatgtattcatgcatgcatttgcaaatataatttgaagccctaccattttctaggaattctgcgagaacctagggaatagataggactacattgattttgtcatcatgggattctggaaacattcaggaggagcatctcatctctagcctagggtgtcagaaagaacttgagtaatcaaggattgggtcttaaaggacaagtgaacatgtgcaggtgagaacattctaaaatgaagggacttgaacaaaagcaaagccatgttaaacagcttgtacttcatctgtaggtagatcagtaaccactcaggggttttaatcagggaaatgatcttctcagatttggcttcatatgaatctctctatttgccttatgtcacagcatatattaggagatcatcagagtagtccagacaagcaggaatgaagataagcatttggaatctagaaatgattacattaaaacaggcctagacacaaaccaccacattttttgccagaaaggcatagaaacaaattgtattagtgcttgccaggttctgggaggagttggagatggagaatgactgctaatgggtataagatttctgtatagtctgttctcatgctgctatatggacatacccgagattgggtaatttctaaaggaaagcagtataactgacctcaggaaacttacaatcatggcagaagggacagcaaacacgtctttcctcacaagacagtaagagagagaagattgagtgcccagtgaaggggcaagctcctcataaaaccatcagatctcgtgacacctaactcactatcacaagaacaggatgagggaaaccacatccatgattcaattatctccaacggatccctcccatgacccgtggggattatggggactacaattcaagatgagatttgggtggggacatagccaatccacatcaatttctttttggaatgatgaaaatgttctggaattagatagtggtgagggttgcacaacattttgaatatattccaaattaataaatggttcacattttgaatatattcaaaattaataaatggttcactttcaaagggcaaattttatggtgtgtgagttatatctcaagaaaactgttattaaaaaaagaacactgcatttagtgatgaacgaacaatagagcgagatggaggtacctaagaaaactcccaaggttcttgctttggtgactgggtagatgactgtgttatcaacaagatggagatcaccaaaaaaggagacattgtggggtgacaatggggataaaattgaggtagttggtgttgatttatttttaattgtgtttaaggtctgtataacatccaattgtacttgaactggtgtttggtctacgccatagatacaaatctggtaaatcttatcccagaaagtgaatggctccccaaatttttctgcctttacatattccagaagtacaacataatcttattaatagcatctccctttgcatgccagtgattctcattcaaggagtggagcatgtcagaatctgccatgtacaagactgtagttcaaaaaggccagcttatcagagatgctgacatattccatagggaatttttgtcaaatctttctatatcctccattggaaattattgatatacatgatggctaaatccatgagttcaggtgtcatcacctacagctttatgtcaagtgaggagaacgttgaagggctcaaagaagtaaaagcagtatttgaaagctcacataaagaacgaacgaatgaataacaactgcaggaaagattcttggcagataatagtttcaaaattagtatttattgagcaaatgcattaataagtgaatgagtgtgttttccagaaaccgaagaatttcaagaataataaactattttaaaatcaagatatgaatctaataagacaaaaacaggtatgtccattgtacagttatgctctgcatgatgttttggtaaatgacagaccaaatttaccctggtggtcccataagattctaatactgtatttttaccatattttttctatgtttagctatgtttacatatacaaatacttaccattgtgttacagttgcctacagtattcagtacagtgatatgctgtacaagtttgtggcttaagagcaataggctatctcacagagcctaggtatgtagtaggctatgccctgtcgcattgtgtaagtattctctgtgatattcacatgacgatgaaatcacctaacgatgcttttctcagagcatatcctcatcgttcagtgatgcattactgtatttggtgaccatagtaggttgactatagtagtacagggatgactaggaaagtaggaggaggagatgagaaggcgatgggtatgaactatgctcttaagaaatgtggataaaggagagggactgagaacataggagggctctagaggaaagaagatagatttaatgctacttttcgcatataaagtcattcttctcctaaataaaagtttctatgattttgttcaggaatcatatttaaccagttttcaattttcctatgaaaccagaattaaactgcacctaatttctgatcattttctttcttaatttgtgtaatttagaaataggtatgacgggccaggtgcggtggctcacgcctgtaatcccagcactttgggaggccgaggcaggcggatcacgaggtcaggagatcgagaccatcctggccaacatggtgaaaccctatctctactgaaaatgcaaaaattagctgggcgtggtggcacacacctgtagtcccaggctgaggcaggagaatcacttgaacccgggaggtggagtttgcaataagccgagatggcgccactgcactccagcctggcaacagagcaagactccgtctcaaggaaaaaaaaaaaaaaaaaaaaaaaaagaacaaagaaataggtatgacatcatcccttcaaaatgtcatctttctccacattccatcttacccatttataggaggttaaattcatgtgtcattttttagtagaatttactgataaaagctggccctttagtggtatcaggtctgtgactgatatgtcacaagttgatgatgactttcccattgttaataattctacagctgtctatcttattcatcctggtccttattcttggtacagctcttctttaaatcacagaagtaaaagttccatatgtatttattataaaagatatgcatatggatactttaaaacgttttattgttccctgtttaagcacagtaatttctactagaatttttgtcatagaaagataaatcttctccctttgctactttctgctttcatcttctttgattcttccttggatcctgcccttttctccgttattttaaatttttaatctgctatttattcactgtcttcgtctatgcctaaaagcagggacttttaggactgttgcaaaacagcagtaaatcttatttaagtgtttcatgtatgttttcagcttcccttttcttcctttcaggatgaagaattccagaattatgtctgcaactgttattttcttgacatacactcactctttaactcattgccttcaacgctcactacactgtgcttttgaaatgcagtcatctccttattattatctattaatattttatacatcttcattctctttaaactcccagcaaaagtagagaaaaggttaattacccctttctgcactttttggattccctttttggacttttcagctcccgattttttctccgtattccatttgcaccttcaccagctccttcagcaagtcctcttcattctccctctcttccaatgtctatgtgtctgaagctacagctttttccttctgcacctttcttccagttgaatttcgccccaaccctcatgagagtcctctattctcaaggcacctgtcaccacctcggtgtgaccaatttttccatgtatatccttttcttctctggtaggccttacctactctctcccacttttgcctggatacatttacttatcattcctatggtaaatttaactttgatatgccaaaaactatatttgatagaaaagtatatttcttgcttgaaagagagattgcttccattcaagtcataatgtgtaccataaaaatatcaaatatggaaatcaggtgatcagaatatagaaacaatgaaaagtagatattgagaaaataacttttaagttccaaatattacctaaatagtcttgaaatgcaaatgtgtcataatgataagttttactttatttgtttttggttatcagagtcttaaataatgggtgattagcttagaagtcccattctgaaattcattaaaaaataaaatatttctctgaaaaggacttatgcctaaagctgccgtcattctttctcatctggcaccccaagcttcatttgattccctgtttccttattgagcataatttaatgcaacaatcttgcttaaataagtattacaagatccaatagattaactttaactctttatcaccaatctataggcttcatagaaatattaaacaactattgattttaatgtataacattgtcataattcttgttatttagaaacaagatccaatctccagtaaaccactcactgcagcccacacttgttagcataatcaatttatcacacttgttttataaagttgtaagagaaccccacagaagggtgttactaaaaattacagctgatgtaagcttttcacttcatgccaaaaggagggcagttgacgctaccatgaaataaactctactgcagcctctttaatcatttgtcaagatgtattatgtccttgtcaatatcaagggaggtaaacactgtcattaatctgcaagtgaggaaataagtaaccacgtcaatgttcaagtgcctggctgttaatgcaaattcatctttattccatctttctccctctttcattttatgatgttgttcctttttcataaaatgtgcagttacattgtaatgtttagaaaatatacataatgcattattaggatgttggccattgtgaaatttgctgggtgtgcttagcaagacaggcactgacaatgcagtagttaagctgagccagcatagattagtctaaagagaacataccagctataaatttaacaaactgttcattttctaaagtgattgctttatgcatctgcaaatagggaataacagaacattcaactctattttttccctaggcaaataaaaaacttagatcttgaaaagctttctttagaaactttaaatagttattttaattttagatgctgtcactgatgtgttatgcaaaagagggatgttacttacagtggatatgaaatggaattgcagttttagcatctattatttgacttgaattgccacttatgtcttgataccttcctatggggaatctatggcttatctgtatcgattagataaatatttaaagtaaagctgaatatagcagtgttttatatccaccagattacgctacaaaatctagtggcattagattttttctttataggatttttaattgaaaccaacacattggcaatataccttgtttatctagcatagttaccctcaatgaattagcaaatcagaagcttaactgagaaaatagtgaaactctaggagatataaaggctgaataaccaaataacaaatcactacttattgagtttatgcctgtgtaagatagtgtactgtcatttcatgtaatttatcaaagagcactatgaagtatttattatcatgcagacaaattaaatgactttctcaaaccacacagataagaagtcatagatcttagatttgaacccgtgtgactagatgaaaaatctcagctattgtgcaatgggtcacactacttctcagagcaattttacctaggaaaatcttcttatattttactttgaaagatgtccggtgtgtttacttaagttatttaagtaccctaattagggataagatatccaccttcctaaagtcccatatttatttttttagaggaccaacaggtaattcttttataaggaatgtgatagattgaatcacgtagtgattaacaacacagattttagccaccaattgcattttttcaaattatgactctgacatttccagtgtgtgatgttaggcaagttacttaaccactctgtgcctcagtttaattacctataaaataggcaaaattacattgggttattgtgaaaattaaatgtaatgataaatttaaagtaattgaaaaaaggtctgcaataaggtaactgcttacttagcagctatatcttatcatttaaagaagcaatgtctttggctcacatatttgttaacatgaatgggaataaatatccgatttagttccttaatgtctttaatgtcagtatctattatccagtcttgtccatccaaagctttctggctcactcttgctcagtctgtcatttttctacagcattatcatgatataattcatatagctacaattcacttatttaaaatgtataattcaaaggttctaatatatttacagggttgtgcaaccatcaccacaatctaaatttagaacctttttgttccatttaaaagaaacaccatacttgttagtagtcactcctcatttctctcctccctctctgcccagccctaggcaaccactaatccagtttctgtttctataggtttgcctatactggatatttcatataaatgaaattatgcaacatgtggtttttgtggctggcttctttcacttaaagtaacagtttcaaattttatgcctgtgatagcatgtttcagcacgtgtttattatccttgccaaaaaatattgcattgcatgtatataatattttatttagtcttcagttaacattcatttaggtggtttccattttgtggccattgtgaataatgctgaatgaacgttaatgtccaagtgtggacgtatgttatcatttttcttgggcgtgtaactaggagtgaaattgttgagtcaatagccttgattatgttttacttggaggaccacatagcctcctagttgggcttccagtttctggcctagcttagcctgtgaatgtttgtacactgctgccagggagatctttgtagatcttaaatatgattgtgttcatctcatgttcatggcctttagtggttcttctgttgttttgggaataaattatagataccttaacttgacatgcattatttaatcattaaatacttattgggttcctactatattctaggcactcttctagatacttgagtatccttgaaatccttgaaatcatgtcacattggaataaattattactaaaatcagaatcaaatttttgtagaatctttgatttaaaaatacactccttctttagcctatttttcactacaccacggtgcctaggattaaagataaatatggtaagataattacgttgctttccatgttgcattattggcaggttattctaaattatggaataatagcgatgtgttgtgtttgcctgtctctttacagagatgcttattttatgtgaatttccaacatccctgagagaggatcatggcaaattactcacttccatcttacacctagaaatgttgagactaaatacgtaaataaagtacagtgtttgctctactaaaggtgataaatatctgttgaagttaagtccaaccatactaggaagtccctggaaaatttatgaactaatttttagtttttgcctttactaagggaaagaaaagcaagaagtgggcaaatgaaagctgagatgactgcaatctcatcaggacctagtatcctggatgcttttacatcctctctcgtgtttttatttgaaaccaactctataatgttgttgataactgtattactttaaataaattaaatgctaggtagtgtgactactgatttgatttgatttgattatcagaaaccatgataacttctgttctgtaacaaattctaaaagccattaatccaaagcaagatttgttttcaaagctcatccaaatttgcagtagtgcaattttaatataaatgtagttattcacacaccagggccagttgggtggtggggggtgaggggaggaagagcattaggacaaatagctgatgcatgcacggcttaaaacctagatgatgggttgataggtgcagcaaaccaccatggcacacaacctgtgtaacaaatctacacattctgcacttgtattctggaacttaaagtaaaagaaaagaaaattaaaatagaaagtgtagttattatagcataaatatttcatcaaatatcctgtattttcagagaaatttgatcatatatgaatattttatttatcacctattcttatttttaggtgagataatggcacaatggttatgttttcaaaatgcatccttaatttttagaaataataactgaaatagtttatggaagatacacataaggatttgtatcaaaataatgtagggagggataaataggagtagagatgaaacaagattggccatagttttagtttttgtaatagactttatcttttagagcagttttaggttcttagcttaattgaatggaaggaacagagatttcctatatattctccaccccatctatacacagcctccccctacaatttacatcctctaccagagtggtacagttgttgaaattgatgaacctacatcaatacatcattatcattcagagtccatagtttacattagagtcactcttagtgttgtacattctgtgggtttggacaaatgtgtaatgagctgtatctaccattatggtatcatacagaatagtttcactctcccaaaaatcctctgtgctctacctatccatccttccttcccactaattcctggcaaccacaaacctttttactatgtccataaatgttccctttctagaatgtcacatatttagaatcatacagtatgtagacttttcaaataattagcttttttcacttagtatcatacatttatgttttttccacgtcttttcttggcttgatagctcatttgtttttgacatgaataatattccactttctggttgtaccacagtttattcattcgtctatggaaggacatcttggttgcatccaagtttttgcaattatgaataaagatacaatcaacatccatgtgaggtttttatgaagacctaaattttcagctccttcgggtaaaaaccaaggagcacagttgttggattgcatggtaagagtatatatatttttgtgaaaaactgccaaactgtcttccaaagtggctattccattttgtattcccaccagcaattaattagagttcctgttgctttacaagcttaccagtatatggtgttgtcagtggtttggattttggccattctaatagttgtgtagtgctatctccttgttgttttaatttgcacttctctgatgacatgtaatgtgaagcaactttccagaaacttatttaccatctatatatcttctttggtaacatgtctgttaaggtctttactgcgtttttaaattggattatttgtttttccattgttgagttttaagatttctttttgtgtgtgtgtgtgtgtgtgtgtgtgtatattatatatatataaatgtacttttaattgaaaaaattgtatgtgtttatcatgtacaatatgatgttttcaaatatgtatccatagtggaatggctcagtcaagctaattaacatgtgaattacctgacataccattttttgcaatgaaaacacttaaagtctattcttgtagcaatttttaagaatacaatacattgttactaactgtaatccctattttaaacaatagatcgcttggacttattccccctttctaacttaaattttgtgtcctttgactcccctcctcctgccagccctggtaggcaccattttacgccctactgttttttttgtttgttttttttttttttttttgagacggagtcttgctcactaggctggagtgcagtggcacagtcttgactcacagcaatctctgcctcccaggttcaagtgattctcctgcttcagcctcccaagtagctgggactacaggcacacgccaccatgcccagctaatttttgtatttttagtagagacggggtttcaccatgttggccaggatggtctcgatctcttgacctcgtgatccacccgcctcagcctcccaaagtgctaggattacagatgtgagccaccgtgccaggcctttgtgccctacttctatgaattcagtgtttttagattttacatatgagtgagatcgttggcatatttgtatttctgtcgctgatttttttcacttaacacaataacacaatatcctccagttttatacctggggtctattctagttctgggaattttctgagcctagagctgctggggtcagcctggcagtaaggtctgttcaaacaactagtccaaaaggtaagcctggatcttagaggtgcaagatctcatctggcactggggtgtgccgggaggtgcagtccatgagtactggcctagtctaggatagtgggtgtattcatccattctcatactgatataaagaactgcccaaggccgagtaatttataaaggaaaggggtttgattgactcacagttccacattgctgggaaggccttgggaaacttacgatcatggtggaaggcaaaggggcagcaaggcaccttcttcacaaggtggcaagaaggagaagtgccagcaggggaaatgctagatgcttatgaaaccatcacatttcatgagaactcacttactactgcaagaacagcatgggagaaaccacccccatgatccagtcacttcccaccagccctcccacgacatgtggggatggaagctataattcaagatgagatttgggtggggacacagccaaaccatatcagtggggtcatgtttatcactgggttttactggggtaggccaagtgttgtggtctaaggcaaaatccagtgctcacttccttaattttcctccaagtagaaggtatctctcttcacagtgctgcctgggattgggggagggctcacacaggtaatgtaaaactgcccttcctactcttttccatacatcttttctcatttttatgctacacccaggtgctataatctctcaactgatttctttagctcttgtgaaggtgattttgcttgtggatagttgtgaaaattgatgtttctgcagagagatgagtgctggaaagtcctattctatggtcttgctgatgtccatctttgtgtattttgcatgacagtcttttatcagatatgtcttttgcaaatattttctcccatttttcactggtcttttcattctcttgacattatcttttgcagaacaaaaaggtttgattataaagtccatcttatcaattctttctttgataaatattgcctctagtgttttatttacaaagtcatcacctaacctaaggtcacctagattttatcttgttatcttctagtagtcttttaattttgtgtcttacatatcaatctatgacccattttgagttcattttcatgaatggtataaagtctttatcgagattctttttttttttttttggcttgtggatgtccaattgttccaacaccattggttgaaaaggctatctttttttcattgtattgcctttgcccctttgtcaaagatctgtcaactatatttatatgggatctatttctggaatatttatttcagtccattgatctatttgtctattttttttcactagtgccacactgtcttgattatcatagctttagaatatatctcagaattgaataaagtcagtcctctgaatttgttctttttcattactaagttggctattttgagtcctttgcctctccgtataaactttagaatcagtttcctgatattcacaaaataacttgctgggattttgattggaatttcattgaatccattgatcaagggggaaagaatggacactttaacaatattgagttttcatgtaatgaacacagtatgtatttctatttatttggttcttcttttgtaggttattttctgaacctgactaatgggtacataggtatttgttttactcctttacctgtgtattttttacctttttatgttttgcctgtatatgttttaccttttacaagataaaaggctaaaatattttatatttttgcctttgtgatactagttttttggcaaggatggggtaaaaagtaaaataggacattgacatttcgaattttgaatttcaaatctcctatcagggaaattgaataaatatgttgaacatggtagtttggcaataaagggctttggcaaagagggcagattcggtgtaatgatagttctattgagatctagaaatactcctatttgaagagtgaaaaagtgctaccaggtgttcagaagaaaagaaatgttaatgagaaggccaaagataaggtgaatcttatatcaaagtactaaagagaatgaaagtgggattcagttccttctgggtgataagactgtcttaaattatttctcaattatgacatcatatttcccccccatttcttcatcttgcataactttgtgtttaaatgagagtttttaaaatgtgtttaaagctagtaatgtatttgactttgattttgcaaggataacacttcccaatatcctttttgagctcatagaatttgttcatgttcttttaaatctcctgattattagtggtttacttttgatgaaggtgatagcatattcttcatgaaataactatcaagcttagtgttaagataatttaggaaactaaagcagaattataacttcttgatttttatgatagtgtcccttggatgtgtaaattaaattacttattttcatttctaatttttgctaaccatttcagaaaagtggttcagcacaatcgttgccaattctacttcaaatcaagaaatctttaagcatccttaaaagctaccataacaggcctatggcactgtgtgtctttaggagattgatttcttttgtgggtattctgtttacttaatgacataaagaatgagtgagggagaaggcaaaatattctcccaggaagatggagaagagtggtcattgtggattagttaggcttttagtaaaaacaacattgtaatgaccttgtgatttttatgaaaccacttataacttggtcttaatttacaaataagttcctttaagtttgcatcaaaagtacagagctctttcttgttattcttaacaaggtttgatacacagcatttcctcatggataatttgtgggtttaaaaaattgaaatgctattattggtaactatcttggtcattgttgcaagatgatttctatagtgggagcatcctttcatacaatcatacggatccttttacggtttttctggttataatatcagtaaaaagtaccacttggccacaagtgacttttgtttatacgttgaatgaaggaagaaattatttctaggtgtgcaacatggagaatatttaaagttctcggaatgtaagtttcttcatatgtcaaagaaggtgataatacctaattttaaatgatgttgaaaaggttgacatataacttatggaagtactacctacgtacccacctacctacttacctacctacttatctatctgtttttatgtctatctgtcatgcttagcatagtaactggcagattgtaggcagttaggaaatgttagttgtcttctcactcatcatatcatgtacttttaaagggatggttttcacatctgtgcaggttgtctactgtaccactttagagggcaatgttcatgtagcaaatattatgaatggcaccactggaattctgtagtatgcaacttgaaaaactaaacatagtgtctgtatatttttaaccctctatgttggtgattctccaaaagggagcaattaaactcttgcatcagaatcacctggagatgatttctaaaaatgcagcttcttctgttcatttccagatctacctaagcagaatccgttgagatggaacatacagatctgtattttttaaagctgctgaagtcattattttgctaacagctatcttataatatgattcatatatcatacaattcacctattttgcccaggtcattcttaagcatgctgaaccattgctctcttgattgtctttgtgagaaaaaaaaaaggtgtcccctggtcttttctttctctgcgattcttcatggatcaataacaaattcttgcacatattgtattgtacatatttcttctataactttcatcacattccttcattcttagtgcttaatctccattttttcttctagcttgcatgcatgcatgagcgtgcgctcacgtgggcatgcacacacacacacacacacacacacacatacagagacacaaaggcttagagtcaaattgaactgagtttgaattgcgggtctgccacttactgtttatggaaccatgggcaagttaccctttcttgattaactgaaaaatgaagcccctaataccaattttataaggttgtatgagaataaaatggaataaaatgtgagatgcttattatactgtgtgacaaataaggctaataatatgttttcattaggtcgtatgagaataaaatgtaagttgcttagtatattatgtgggacatataaaaatatgttagctataattaaatgagagctataattaaattgaagacagtaatatgtactcccttatattccttgaagttcctaattttaataaatttatcaatttattgattacttactaaatacaagatactgtgcctgatgcagtatggaatataaatataaatattatatgagctctgccctgaaggactttgccgtttatagtacacagataaccaaatacaataaatatttcatgatggaataatagaacaaatgctagagtggattttcacaaaaaaatattgtcagaacacagaagagaaaaaaattttatttgagacaagcactgaatcagatttcacaaagagggtagaatttggtctgggactttaagggtggttgaaacatgtctatggagaaagggaaatggggtttggctgagatatggatacacggtggagagtttgggagggtataggcgagatgggagagtcttgatcttagaggataacacacgacaactcaaagtctttgaatgacattctttaagctattagaaaccactcaagacttttaagtaaggcagtgacatccgctgttccatatctaggaaaagttgttttagtggtatgtggaatagtttcaaggagtcagggataggaaatgaaaacaccatttatagggttcttcggaatattagcaggattgtaaaacagaggttaggcaaagaaggtgcaaaaccatctttcaaaattctggacatgtaagatattttaaagctcccaaaagtgaagttttgtgcaaaagttaggtgttgagctagggcagtaccaatgagaatgaaaagaaaagggaaaagcaagaaatgggacacacacacacacacacacacacaaacatttgagagataattggatgaaataatggccatgccacataaaaagaaattatagtacctgccataataacataaatttattccaaataaatcaaatgagtctaacttggaaaccacatcagtcatttatattattgtctaaaaccttttttgacaaaagtgaacacacatgtcaaaaatgttgatacttctcacttcagaacttagtccattttcacatttattcaagtctttatgtcgcaagtattttatttgtatgtagatttttagatatttatgattattttattttctaatgctgatataagtgaaatttattggtttgtcttaatattctgattttgtaaccgagttctctatttagttctaagtgtttttcagttcatatttgatatttttcagacaatcatctttacatgactgctttaccttttatttttcttgtgttataatattagccaggacttctaaagcaatattaactaatatttgtaaaaatctggctacttgtttttaacttaagctttcgaccactgagcaggctgttttaaataatcttcatttgataaagaatggattcctctactcttagttggttctgaatcatcaagatagacactgaattttatcaagtgctttcaatagacttttaatatttttaacatgaaatgtgcctttttcatgtcgttttctggagtaacatttatactagttttacaaaataagttaggaattcatctttttagtgctttgcagtaattttattggctttagaatctttcatttctggaaactttccaagtgtttattggtaaaattattgaagcctggggcttttcttagaggaacttcttcaccagtgtttttaattcccaatatgtattttaaaaatcctagaataaatccatgcaaagtatttaattcttttttttttttttctttattgagacagagtcttgctctgtctgccagactggagtgcagtggcgggatctcgcctcactgcaagctctgcctcctgggttcacaccattctcctgcttcagccccctgagtagctgggactacaggtgcctgccaccacgcccggctaattttttgtattttgtttgtttgtttttagtagagacagggtttcatcgtgttagctacccacagtagctgggactgctaattttttgtatttgtttgtttgtttgtttgtttttagtaggacggggtttcaccgtgttagccaggtcgatctcctgaccttgtgatctgcccgcctcggcctcccaaagtgctgggattacaggcttgagccactgattatcaatttgcctttccaatgttaaatctccaataatttttaaaggaagtattgttatagtgagagacagacacctatgacacatccatggagcagaataatgaatgcaaaaacagcaatgaatttagatccaaatgtaacatattaaaaagatttcatttcaaataagggcaaaaatagtttatttttcaaatgatgtttgtaattatgataccatttagaaagaaaaaagttaggtacctactatatagcatacacctaagttaactttaggcgggttaaaaatgttaatgtaggaaggcagaaggcggagaattgcttgaacccaggagtcagagctgcaatgagccaggatcgcaccactgcactccagcttgggtgacagagcgagactccttcttaaaaaaaaaatgttaatataaaaataaagttgcaaaagtactagagaaaatgttacatgaacattaatatagcattggagtgaaaaaaatgctttaaagttataaaccataaaggaagaaaggcatactggaaaatgactaatgaatttaactatatcataacatttaaaggttgttcttaaatatttgaactactacccaagaatgcccaaagcccgtggtggaaattctaatttttattgtgatatgtttgtcatatttaaatgataggtttttgttttaacattccaaaatgcagctcccttttctgcctttgactgccttctatagaaattcccccagctgccaggccaaatttctcatccagattcaggtactcttattgactatccaatagggcattgatgctgccaagttcgcattaactctcttattagcttcgagaagacttgagacagaagctatcaacacttcttcattggcatctatgtggctgtgaaagatggtcacattttagtcaaaagacataatcctgtccagttatatttgaagagaatcatagctaaagaacacatgccatcttccactcctgtttttacagtgttcacaaatataaaatagttactaacttcttatactctttccacctgtaacataaagatggaattctgcagaaattgagaaagagggcaaaaacgcggattttctgagataatttaaaacagttaagaatctgcagccaataagaatttaactcacaaaggcagagcaattgaaactgtttccggccatcagtacacaaatagcaagccaagcttcataattctgtgtttaaatgcaagagttatttaaaacaatttggttttagtttattttcttacatctcttaattactgctggaaaatattgtcaaggttgggaagttcttttaatcaaagtctagaatattaaattttagaatctatagaggtagaaacatcacaaccatttatttacttttatctttgaataagcattgggaattatgattcctttagttttcttacctgcaaaaacctgtatgttcttcatctaattcaccaaaagtctattattctcaaaattctattattttgagaaataatagaatcaatacaggtcaatttttaaaatgtgtgcaggactcagaaccattaatgtgctaatgtgcattctgatgttccaaggggcattcataacatccagcctgtcctataaatttgaacctagaaccctttttgcatgcaatatctattgagttctgttgggaatattgtattactcgaaacataattttgaaagtgctactataagagcttttagaatatgtggtgttaaaagctgtacattatgttaaaatagctcttgctattaatacatctaaataatatttgttgaggacattcccttgaaggccctgtgctaaatggctttgtaactaaacttctgttctgcttcagtgttatactgtggattatatctgatgttcatgtatgaacataaatatgaccagttaaagcaatttcttgccagctaaaagaggatgttttatgtctgattatttaattcaaaaagcaattcactagtcttacctccttatttgccattgtacatgtggttaataagtaaaatctgaattcctaacaatgtcttttagattaatatgttttggttattgacacttcatacatttttgatatggtcaaagttagttcctagatagggaggagcaggatttttctcctcttgcttaactggtttctaatttcttgtgagattcctttatgtgagtttcaccatactaaaaatggaattattttaaaaaattataaaatagagtccccttctctattttaacaatcaatgtacctctgaatcaactggttattcccgtgatctgtgaagtagttaccgtgcttttcaaattgtatttcatgtgtgttcaaaatgaaggataatgactcacattataataaatagtatgacatttatgacccacaaggaggaggagtgtacaaatgaactttaagggttttaccttgaagatttgtgagatacaaaggcacagtttttctaaaacaggaatatacctcagctgtcaggaagaactagaaattatagttctgccttattgggatatagcatgagtccagtgacccctgttctcattgttcatctatctccaacacttcttgttaagaagacacaattaggtcagttttcaatgatccaatatggaacacctctgacaaacgaggtttcaaatcaaggtatctcagacagttggcctcctagcgccctgtcatccctttggcttatgcccaaattcagcccagagccaattagtggatcacagcctctagaatggcttcactctgctcacactcaacaagatccagacagagctgctatgcaaaaaaaaaaatgttcacagggtcctttcgcagaggggcaatggtttaggtactttgagacttcatggcgcatcaagtacacacatgttgaagtaatgcaagtgagaaattttgctgacaactgatggaaagtaacatttaaatctagagctctacctttgtgggcagcctgagacaaccctagattaaacattttaatttttctatttactgtttgtaggtttctgtaattcactgagcctgttctaatatgtacaggtagatatttgcacctagaaagcatgcatcttggatatttatcatatataaagaaaaaactatatatacagccatttaaatatgctacaaatagtaatagaacactaataaatatgtacatgaaatgagtatgtgtttatccttaaattagtggtttggttttcaacattgttttattccttgacactgtccccatgacccatcatgttctgatcactaatattctctttgaccaaaccatgcttctggagtgggggccattggtactagtcttcatgtgtggggacaaagggacagagttttaaaatatactgttgagactttttccagattagagttaatttagctaatgtcatcaagaccaatagttgttaggttaaagtggggaatcattaaaaaattgcacacttgaagtaaacattttacttaaaatatacaagtacattcatttattaaccttttcttctagggtcaagaccttttccttaaatattggattccttagtgggcttctaattctttcttaaaaaaaaactctacccatgatgcatcatctacaatttccaatttcagtttctctaaaggagagcaaaagcataacggtaactctaaagcaatatgcatatagaaaacttatttatttttttacttatccccgtctttaagaattgactcatccacacctaatttaacagcagttgttttagtgactcattttaacccattcttttcaaacgttttgtcttacttttaatagatacaacctttttttgcactcacattttgttcttttgttcaatttgtaattgcataattacattacatattaaactagtatacatagattctggaataaacatgccagactactattaagtagacaactcactggtcaaggaagcatacagaatgctgagggaacaaacatggcctttaatccagcaagtctgttataaaaaaaaagctcactctcaaagcctccttctggagttcataataaatgcttcccagggaggcagtcctctgctctgctttcctacttcttttcttctttgaaggtttccactttaaatcaggcaatactgtctgttgaatactgtctttctcctgaatgaattgttttcttcttcctgtaaaaacggaattcaggatagttttagccctttggtgtgccctatttattgagaaggacattttctgttatgcccagaagtttaggagccttgcatggctcgggcaagactgaagaagcagctcacttcagcctgtttctctactttgtcccctttgtgctctagcttttcactagtggaaatcgcccactctatcacaaatgttttcagaggctacaatccaacttaaggaggataagctatgagcaacttgaactataataatacatgaacatcttgaactataatagatttagaggaagtccaagaagtaacaatcctcaaaaaaaaaaaaaaaaaaaaaaatcctgaggcagtctaatggcaactggccaaagaccaaatcaagatattaaagttgcctgatttagcatccctcaggagatatgcttccaccataccctatatgcaaacaacaacaacaaaaatagagccataaatccccatcctaattgtacaacaaaatcatctgtggaatttttaaaatgcagatatctgggtcctctctaacaattatcaaattgagaccttccagatcaggggcctagatttaaaaaaatgaaaaacattatgggttattacaacggtcagttacatttgaaaagtcagtttaataaagacatgaaatatatttgtactgttggaaaagtgagtttctaagtgatattttcctccttacatatggatgttccttttagtctatgatagcttctaccttaaaacacaccttctgatgtgaatctgcatggggaaaaaagtggtcggctcagtgaatgggtgacaggcaagcagcctctcctgggaggttctttgctgtttcctctggacccaaaagagtcctcttgcttaaaccagctgcttctcaaaacattaaactgcacaaggatcatctggggatagagtgttattaaaagtagatgttgtttcagtaggtctgagatggggcttgaaattttgcatttccaatgagctctttgtgctgctccagagaccacattgtgtagccagggtttaagccacattaatccaccagttttcaccagctgcaactaattgagtgtcaaaatttaggtctacattgtctcttttccatttacaacttctaaactttattaaaatccatgaattattactctaaaaaggaaaaaaataaataaaaagaaacccttttcactttaaacaaagagataatgtgtaaggtgtgttcacgctttatggtgtaggttttttgcctgtgaagaccaggaagtgggtcggctcctaatcaagatcagatcaggtgattccataatggaactaaccacctacagtttccccaccaggctcatgtcagtaaatgccagtgacttctttgtttcaggtttatttgctaactgtagatgttgcagatgattggttagtgtgaaagcacaaacatggtgaaaataaagaggacattttacctttcttctaatatattatatttggtgtagcatttctagtttaataggaattgtcctcttttatagtggaatgagttttggactgaattctaaccaagagtgtatgaatccttcttaatgatagctgtgttatcatgtttcctcatagagcataaatattttagcaaatgttgttactgagtttgtcttcaagcagcccagtgaatgtctgcacccttgagtattaaggaaaaactcattcttttcacttataaaaaggcatatgatgtagagaacattggaagcctatctcaaatcttaatctgctttccctgagatcccatgggacgtatctgcaggcaggggggtggaatttactctcaactttattgctgctatctggtactctttgtctgcatgtagccaccaacttttatttatgagtatttgctggacctcatgctaggtccactgatacagcttacagacttgagaaagatatcctgcctctaaggagcttatagtctagtttatctcaatttatacaatttatacaagcaaccgagcagaaaattttacagttaaacgatgatgtgttgttttaaagtactttcaagattcattgtcagtttgtcttcatttgcatttctggtaacaaagacagaaacagtatagactaggcaataagtaagtgacagtgtgctgaaggagaaaatgatgacaaagaagatggagttgagatgatgggaattctaataacccatataccgtgtattagttctttatttcttctacaaacatttactgaacacctacttaggttcagccaaaaagatgacagttttatgataacagtatgtttccagtacagtataattgttgtcacaatgagctgttcactaaagcacggacattctgtcatctcatctgtaaaaagtagataataatatcctccttatcgaaaatcaatgagctggaacaagtgatttctagttttccttctatgcagtaatagctaagagggggagaaaggaaatgagaacaaatatgagcccgagtttacaatgtcttcctgggacagtatcagaaatgaaacctaatttgtagtgtctctgataaaacatgagcttcatcttctccttcttcccccaaaagatatcaattttcattttaccagtttacccctactagctggagctcagaacataggcccacatgcctatttctgccatgagcagaacaactatatttagatattccagattgttcttattccatagaggcccaatgaatttggtaactaagactgaatggaacttggtatctcatcagtgcctctcaaagatttcctttcacttgtttcttcaggaagacaactactagttggacacataaaagttttaactgtggctaggccccactcttctctagttcccattggaactagaaactgttgtaagaatgactccaaggaacattaaagacattttcagattgactttgaaggcacatataagtgtgttcaatgactttgtaatttggggaagactcttaaactccctattagcagattatcatatataacatatgaatagacctgtttgaggatgtaatgagctcatgcatataaaataactagtaaagtgacctgtacattttcagccctcattgtaagcgtaattatattatattattcatcttttgtaggaaaagttttattgaattggagaacaacagaagacaaaagcgttcctcctttccctttctagatttgtatatattacagaacacacataaaaatggacatttctctgcagattatcttactgttatgtataaaaataataaattggctctctgcctatggagcagacattcttttgtttctttacttctctaataaacttgctttcactttaccatagatagcaatagtaataagtcatggagaaaattaataactacttggactttctacgaaaatgtagggaaagtgtatatagatttttaattgatgttttgattccaaacaaaagaaaaaacttcttacaaatcatttaatttaaagctaaaaattgccttagatcacacatctgtcctggttgtactaggaaaattgatataaatattctcatggctgtcacacacctgttcttcctaaggcagttccatctgaggcatgatattaaaaggaatcagaggtgctcaccaagcaacataacacccttgactaagacaccaacattgtgatgatgtgtgaaatacttacatttctctatggctgccatagtaccttatattggcttcagatctttttatgtttgtgatctctttatccatgaaatctagtttatttgcccccttttgaaaatccatcccctatcctcatttttaattcatccattcttcttcctattcagagtaacctacctctcttaccaagggtgtggccagatgtgatctttttttttcagggccttaaatccagcaaattatgtcttgaaataatgacacgtcataaagtcacttaactttttttccgagtccaccagttctttttaacgtttttcactgtctaataaagggtctaaagccctgactggaatccatgcatggaggtgtcaaagcttaccactgttataaaaatatttccccctacatggcatgtcttcatttgggcatgaatcatgaattcatcccatgcgttctcctttatttcatgaacacccaactgtgtcagaatgccaatgaccttcattggcttggctaatctatggatctgaaccctcctgtaatccattaaaagaataatagcaaattgaaagtgaatgtaaagatacccaatgggaccataaaactaactattcaatgtgacgtgctttggcttaatagggcttttatttatttaatttcgagctccccttggtttctgacagggttagtggaggaaacaaacccagacatcttgtaagctgtcaagctgatactcatctcaggggagcttagagggtatcatgttttaagttttatttttctggagcttggaatatgtctgctgacagacggctcccctgggttatagcaatgcaaggctgttgagacaattgaataagctgaattagacaaaggatttttattacaataacaaccagatggaactttgaaggaaatttttttttaaggtcttagaagttctgttacagaaatcatttaaaacatatttatgggctgggcgtggtggcttatgcctgtaatcctagcactttgggaggccaaggcaggtggatcacttgaggtcaggagttcaaaaccagcctggccaacacggtgaaacccacctctactaaaaatacaaaattagccgagtatggttgcaggtgcctataattccagatactcaggaggctcaggcaggagaatcacttgaacctgggaggtggtggttacagtgagccaagatcgcgccactacactccagcctaggcaacagagtgagactccgtctctaaacaaataaataaataaataaataaaaagatatttatgatgatttttcctattataaggttaaaaaaaacaacataaagatctcattgctctgttttttttaatccctaatgattaatatgtggccagttacagagactcttccagccaacccgtgacatatacacattaataatgttcttttgtatttgcagatcttatttcttcagagtaatggaaaatcctgcccagtactgttctattaatcttcataacgaatgctagggggctaggtgggcggcatttggtgttatccacatgtaatagattttttaaaaatggggcaatgaaaacaaaataagtcttgaaacttgttaacacccacagtggaagtttagcagtggaaatgaactaatattaccagaagacctcttattctctattgcttttcatgattagctagtacatttattatttttctcatgaatgacaagattgcctgtaatgtatttgacatgtggtagttttccaatctccggcaggctgtgtgcatgggtgtgtgtgtatgtgattaataaatacttaaatattttttatatagggattgttttgccctctagaggcagctcaatagaaggagcattcaatgttagtgattgaaaaatggtagatgaaacttggacaggaaaactcgagaggtccaaggtaccttatttagctactgctgtcacggtggatcataatgcagtgggacagtcaggactcaaagcctttcctataaccacatacgatggatattgagcacaatacagaagcaaaagatttgttttaacttggatacttcaactgcaagcgtctctgggcctgatatccagttcagaattcactgtactttttatttcactatcggctttccaaaatatggtaactaaatgagtaaatgaaaacatggcaatacaaaccaacacaagttcttttgctgacagagcatgcaattgccaagtaaaaatattgttctttattaggtttcttttcatcgtacatgtacatattcatttggaaacacatttttttgagacataatcttgctctgtcacccaggctggagtgcagtggtacaatcatagctcactgtagcctcaatttcctaggctcgagggatcctcctgcctcagcctttcaagtaactagaactacaggcatgggcacttgccgggctaattttttaaaattattttttgtaaagactgggtcacctcagccttccaaagagctgggaagagctgggcatataggcaggcatgagccaccatgcccagtctacaaacacattttaaaaccataggccttctagttttttgttgttgttgtttaggttggcttttgacatgctacttattgcatactagtctgtcatgttcctaaattccagttactcctgtagccatttttaaagattattttttaaatttttcttcctcctcctccacctcctcctcctcctccttcttcctcctcctcctcctccttcttcctcctcctcctcctcctcctccttcttctcctccttcttcctcctcctcctccttcttcttcttgcttctttttcttcttcctcttcttctcctcctcctcctcctcctccttctttttcttcaggcatggccttgctctgccactcaggctggagagcaggggtgcaattatggttcactgcagcctcaacctccatagctcaatcaatcctcttgtctcagcttcctgagttgctgggactataggcatgtgtcaccacaactagctaattaaaaaaaaaaaaattctttttagagacgatggggccttactatgttacccagactggtgttgaactcctagcctcaagcgatcttcctgcattggcctcccaaagccctgggattgcagggttcccaagtggccatatcattggatttgtcttcagagtgatgtacttgtgaaacatggatatgaacagggatagagggcaatagcaacacatgtttattaagcactcattgtatgccaggctaagcactttgtcacagagagcctatttaatcctcagaagaataatccaatgaatcactctattttctaggtgtcaaaaccaagtcttaaataagccaagtaacttacccagaatcatatagccacagaaccgagatttgaattcatacattatgacagagtcagataagctagccatcctgcccctacctccagttccagaatcagtgattggctttggtcttactcagcactgtcagttacagaaattggtgtcatcagattatctgtctgcctaccacctctggagcatggcaattacagcatcattgatttcgattgtcctaaaatggaggaaaacttgctgctggcaaaaggaagacccataatcattcatcagctcaataggcttgaatggctaaagtgctcacagccatcttcctgtctcactaattgctgccatttaaagataaagggggaagaaactaccctttacttcagtttacaaaacccaccgaagttaagatataccaaaggatgtatccaagaacccagaacttctggatggaaggttctggaattgaatcctcatgccctgcagtataacctccatacacccacatggcttgggcctcttagttttgcttggctgctactacttttaagtaaaaaaataaaaattggttatgcagttttcagaatgtctttcatttcaaatacattcttaatccatcaaaagggacattctaaataaagacttgtctctacatgatgtgttaatgaagaatggcaggggcaagtaaaacaaaacaaaaagctatgtagtgaggttctttcaagccaaaccacagctgtttgaagaatgacaatatgatatcatgcaactgccactatccctcattaattgattttacagatttttaggtattcactgatgtgtcttgtacttatggctgaaaatgcacactaacaatctgtagcaatgttacaacacagatagcatattgtcaaatgctgccatggatgaaaacttctcatttgctgtggatctgttaagataaacctcttgagaattacagatacatttattattggcattttcaaaatggcaaagacatctgttgctaaaagtctctgactggaaaggatttgggaccaagggtaaggttagctaacacttcttaaactagacaagtatgaacagtgaacatctgaaactacctgtgaccacagagcccaagtaatgtttaatggaggcatacatctttaaccattcaatataaattcaacctttttttttttttgagatggagtctcacactgtcgcctgcattggagtacagtggtgtgatctcagctcactgcaacctctgcctcctgggttcaagcgatcctcctgcctcagcctcctaaattcaacctttttttaaagttttcctcattaactgaattgggcacttccccccctataatctcttacataatttgttttaattcttttgacgtatgcattacataccacccttgtattggaactatgtatgtatctctttttcattcactcccctttccttccctgtcccattccttaagagaactgttatcttccatgagggaagcactcctgcaacttttacgtgtatgtgtgtttgtcaccatcttctaccacgtattaatgtcacatattaatgtgccagcccatattagtgtctcattctatgaatgaatgaataaattaatgaagaatgaattatgtatgtaatgtagttcaacttactacataacaccaagtaaactaaaccatccaagataagtttttgaatcaaagccaccatcctactaataaatatggtttcttttgtataaaggtgctagaattcctagccaaatattttattagtgttctatgccaaaacttccattcatcaatgacttatttcaatgataattacttcaagtctctgagtgtaggtatcagatgttgaatattagtatcctggtgctcaaggagtctttcacaggcttttacatatgcttctccatgtgattccaattttagcatacaaatcttttatttactatcaacctacttagtctacttgttgagaaaaaagtgttcatcatatttcttgattctgcatatcttatcaattgcaatttttctgctctattaatgtttagatagagaggaaaattagggaaggacaccaatcctgtgtgtaagacaaaactggaagtcattcacaaatacaatatgcatcaaatgttttcttctgagtggttctatattggttctaaatataatagtaccagcttatatgaaaagcatgagggattggcctcaccagtttttatcaaatgtaagatgctattaatttcaagatgcatcactcttttatgaaccacaaaggaagaaaagaaatgctgccaaattaacaatgatgttgttgatcataagttatatcttgatttcagagatattaaaatgggtttagaatgtatgtcttagaatagacgaaatatagtatttgttcagtaagtatggagtgcattctcaatgctctattactttcaacattgatatgcttcttttacaaatggtgaagatatgatagggtgtttgtgacacatgcttttctagcaatctgtctaaaacctagcatgcattgcaagacatgtcactgcaactctgcatgtgctaccacagctttccagaaggtaacatgcatcccacaaagcttccaaatttcttttcagaccgttttattggcctgatggcaagctaactcaaagcagtttgccatacacagaacacattcaccaaccttggtataatgttccctccgcttctttctaacaagtcacattttgccttttaaggttatccatcatccagtgttttaaagcattttgctttcaatgaggtggcacaaaaaaccatatttttacaatagccctaagttttaatggcaggcaaagagaatatgactacatatctcagcagacaattagagtaaggagggtgaggtaagaagagtggtgcaatggaaccgtgaagatagggagccctgaccctttcattttctgttccgtacatatttgaccttcagtcctgcaattgcagaaaacaaactgcccaatcttacccatgggacattttgtaattactttcttgtctcttctcttatgggtgcattgactagcacatagtacttctgctactgatagctcatatttatctagcactcattatgtgcctgacagtattctgtttcacatatattaattaaactgattaactttttaaaataaactttttattttgaattaattttagttttacaaaaacattgcaaagataatacagagttctcatacattttttatccaattttgctaaatgcaatgttaacgtattatacaactgtggtacattcgttaaaactaagaaattaatattgataaattactgtaaactaaactccagacttcatttggatttcaccagcttctccactaatgttctttttctatttcaggatccaatccctgttggatccatattgcatttaattgtcatatctccttcacctctttggatctgtgagagtttctcagtctttccttgttttccatgactatcacactatttttttcagagatggagtctcattgtgttccccaggctggatttgaattcctgggctcaagcaatcttcctgccacagtgtccctagtggctccaactataggcatacaccacacccggcatgactatcacacttttgaagattaccgattgagtattgcataggatatcctttcatttgagtttgcctgctgttcttccgatgattggactttggttatgggtaactcatccacttttcacaacagcctataagacggtactattatgattctcttttatagatgaggcactgagggagagaacagttgagtaatttgaaggcctgggtgcttgaatccagagggtctggttatagacctaaagctcataatcactatgttattattgagttataatttctaaatttgaatcttgacacactacatactaactcatatttattggtatcagatcactcaactgtgaagcaggaatgatcattttacttacctcatatggcaatgcttagcacagtatctcggtcacaccaaatttctggaagatgttagctgttagttttacttaactgtttgccattatttttcaggaagctggccatgttaattttctgaactgcacaatcacaattttgtgaaccttaaggtgttctgaaattacgggctcgttgattctgccctttgtcttgcttctcaaagaaggtgtgctggcactccatttaagtgctttatttgtcaggagaaagtgctcatttgaatctgaaaagcaatccatgtacaaaggaagaaaacttggaaaccctgatagtctctgcatgtttgagaatcaatgaaaaaagtaatgccactttccacatgtgcttttagaattctaggaatagatcagtctcaggttatactacaggaataatatctttaaataacaccatagaaaaacattccaaaattgtttggtagtggactgtgtctacacagatacttatacatgttttttggaaggtcatattatgacatatagcaatatcagaatttctacaccaatagcattaaatgataatccctctctgtcaaaccggaacatgtgttgtaggtaagcatgtacataacagtgtcgatatctttgcctgaagtaagaatattgagggaaaataaaagcgttatgagatgtgttcctttcattttaaaaaatgaaaaaattactccaaaatggtgttatggactcaacattgattctcctggtttccaatcccacacaggttgagttcttactacaacaaggcattttccttggtgccatgtcctagatcatacttttctgtttaatgcagaattttcttccaggaggctagaatgcttggaaaagtgtttgtcatatgtcggaaagtgagcattttctcttatgaaaactattcgtgcttttatgtaaaagtattgaaaaggaaacttcacaaaccataagaaaatacctgaagaggagatagaaagcaatccggctggggatcacgtagcaagtgtcttcattgggcagggtagaaaccttggctaccttttgctgctttccaactctgaaatcctaagtttctctgatgttaagttacctggttgtaattataaagtgcttatcattcagacgtatgtgaaatacttggaagtcagacttcctgccagtgtttaacactttggaaggatcaataagtaggctttattcagatattccaaatggccaccttcttggtgtcatgtgacgctatgtctgtggcctataatacatgtagttgtgattaattgacttttgtccagcatcctgtattttcggctctcttttagcggtggcaagcaatggaaaacattatttctttgctcagatttctcactatatgtgtaaaaaggtgatattgtgattccatgtttccaaatgagtgagactctatggacaccttccatatattccctccatatcaggagtaaagaaaggtatgtcccaatttaaatgggaatttagcacctctattaaatttttcacacagcttccattctgtatttttatgaactataccaaatcaaacatatttatctttttgttcagagaaatgaacatgaactccttatttctgttaaacctgcttttcttgcagtcttcactgtgtcgaggatgtctattccatcccactagttactcctagggaaaatcttggggtttaactccttcctctcacacctcacaccctaaccatcaacaaatcctcttagctttacctccacagtatgtccagaattcagtcatttctcgtacctctcttacaagcacccagttaaagccaccatcttcacatttaaaattccctgtgttagcaattttgaggtatacaatacattattactaactatagtcacctggttgtgtaatagatcaccagaatgtattctttctgtctaactgaaattttgtaccctttgaccaacatttccccttttcctaccctcccccacccacctcagcctctggtaaccaccactctactcttatcttgtctgaatttgaattttcagattacacgtgtaagtgagatcattcaatatttatcttttaaaaaaattttttttgagatggagtcttgctctgttgcccaggctggaatgcaatggcatgatctcagctcactgcaaccgccgcctcccgggttcaagcgattctcctgcctcagcctcctgagtagctgggattacaggcacctgccaccacgcccggctaatttttgtattttttagtagagacagggtttctccatgttgtttaatttttattttagttcagggatacatgtgcaggtttcttatatagataaacttgtgtcatgggggtttgttgtacagattgttttgtcacccaggtattaagcccactacccattagttattttttctgatcctctccctgcttctatcctccaccctctgataggccccagtgtgtgttgttcccctttatgtgctcatgggttctcatcatttagctcccacttataagtgagaacatgtggtatttggttttctgttcctctgttagtttgctaaggataatggcctccagctccatccatgttcctgaaaaggacatgatttgttctttttttatggctgcatagtattccacgttgtataagtaccacattttatttatccagtctaccattgatgggcatttaggttgattccacatctttgctattgtaaatagtgctgcagtgaacatacacatacatatgtctttatgatagaaggatttatattcccttggatatatacccagtagtaggattgctgggtcaattagtagttctgtttttagttctttgaggaatcaccacactgctttccacaatggatgaactaatttacactcctaccaacagtatataagtgttcctttttctctgcaaccttgccagcacctgttatttttaataaataacagcacctgttgagtttttaataatagccattccgactagtgtgagatcagttgcttttggaattttcatcatgaaatctttgcccgttcctctgtccagaatggtattgcctaggttgtcttccaggaatttatagtttggggttttacatttaagtctttaatccatcttgagttgatttttgtatatggtgtaaggaaggggtccagtttcagtcttctgcatatggctagtcagttatcttagcaccatttattgaatagaaagtccttttttccattgcttgttttcttcaactttgtcgaatatcagataattgtaggagtgcagctttatttctgagctggtatttatctttctgtgcctggcttatttgacctaggataatgtcctctagattcatccatgttgttgcaaatggcagattttcattcttttttaaggctggatagtagtagttcattatgtatgtataccacatttgttattcattcatctgttaatggacgctaatgttgtttccaaatcttatcatgtctctctccatctcccttagatcaaaattcaaattctgtgtaacatatagaaagacttgccccctttacctgactgagagcatcacctctacttctctcttccccctctacaccagctataccacccacctcactgtgtttcaatatactattgttctcctgctcagaagctttgaaattgctattccctctttttgaaatgttcttctccaaggtattcattttcagagtttgctccctcactttattcagtctcatcagagaggcctttcttgactatccgaaaccaaataccgctgcctcccacttacccctcagtctccttattacgctttgtctgcatatcgcttaccaccacctgttaaaagataaagctgagctcattaaacatttaaagattttatttgagcagactgattcataaattaggcagcaccaaatcacaagctgtatgggctccaccaagaaggtgtgagaggaaaatttttgtaaggtgttctaggaagcaagacaaagaaaatatttgatttattgaagtggaaagtccctagttagaaattagttggcagtttcagattaagttaaatgtttacactgaattgggttttggtttgtctacataggaacccagggcactggagccatctcagcctagtggcctcccaaattattttttttcgacacacgtgacatactattttattttctgtctttatccattacaacgtaagttccatgagagcaggaatgtatctgttccttttgttgccttatcttcaaaatgtagaatagtacacaatacttaataggacattaataaatacttgttgaacaaatggaagaatgactaaatgtgattgaaaggcagactagtagtaaattggactaggtcaaatacatgtgcagaccagtgttcaatagtatgtagcatagtttatatttacacatattcaatatttagcctttcaaaatgttttccagttacctaaatataagtatttagcattataggtggaaatctgtcaaattattttaactcataccacatttgagaaactgtgtggaacctttactattcctcagttttgtttttctataaatataatatatatttccttttcctactgaatgttcccctcagtgcaatttttttccagctattttacttgtagttttgatgtcttgctttgtttttacctatgaagtctaatgaaagtccagataagagcctataattctatccatataattcagtaacttccagaacatgttttatctgtcagactatggttcacattatcgtaggtgtaatgcaaagtttagagctgaaaatgtagccacgttcctaattcttgctctagttatcaatgtcaaatgcactatcaataggacttgaaaaacatactcagtaatattggatgggtactgacattctctcaaattatagtattgagtgcgctatactaaaaatagtaaaaataacatggcttagacaagtgagaaaacaaagctatgtcctactttattttgagaagcaaaatacaattttcctgtttgttttttctttttctcaaaacaactaaaatttgtaggaggataatgtttaaaatttgttcacatggttaaaattagaaaaataaataaactgacatgaaacatacattaaatttaaagattcattgttttgtataaacacagtgtatagcttataagtcattatgctattagattgactttttaacttacgagaaattggcattctaatttagatgcatgtatatgacttcccatgtctattttaggatagatttaatcataaaatgatttaccttgggcaaattacaataaactcacttgagtaattaatcgaggtgtttcaaggagttaatttagttcacgtaaataagaacgttgtttcaaggaatcatttaccactctgtattgccatttggcctagactttttccattttacatccagaagacaaactgttgataaactatttgttatttttttgctaaaaattgatacctttagtatagatagtactgtatcagaaaccatagaaactgatgctttaatatggacatgaactcattagacatagaattttggtcagtctctagttagaatcattgcttctatttattttcaagtttgtacctgaggataattaatattattgaaaatgggttaatttgcaactgaccttgaatcacaaagtggtaggaaaggagatctcttgttttatttatttatttattaacaataaggatttgggcattgtcatatgcattcttctgtagcttacaattaccacaacacttcacatcaataatatactggtgctgatttagtttaaatctttcatatacgtgtttattgtaaatttctttgagtaatgctgggcactgatattaacagaggattaactttatggcacattttaatagaatgcacaatattacttccaccaaattttcttcttttctttgtgaactgttattcattttcagacatgaagaaagtatttctttatcttattttattttatgttccagggtatatgtgtaggatgtgcaggtttgttccataggtaaacatgtgccatgctggtttgctctacctatcgacctatcccctaggtcttaaacccatcatgcattaactatttttcctgatgctcatttcttagtagacatggcacttcaaccattctgaagcttaaaaattatttgttattttaagcccgtaagagcattttaaaatctgatacatctgagcagaaacttttggtttttagtttttttataaattaaatgaaattaacacattaactatttcaagcaaataagatccacttacataaatgaccatgttagtttgagaagttatagcttactgatctgaaaacattaattgaacctccaaaattatacccgtggggtaatttctatcctcgcagcggtgtgcactttaggacaattaaagtgccaaaggaatctcattttatttcttggttattatgtctaggtaaactgatggctcatttttaagatctgtttagtatccaatgattaaaataaaaatgatgacctcatcatgatattcacatagcacatttatccatttctcttttgatttatagcttatttttacctaatgcagtttactcaagtctcctgggcttatacattttttagtctttgataatctatactaatggaccacaagggtagcaatataatctaatgaagtggttaacccagagtcttgggagtgaactattgtggtttgaagcagatcatgtttgtttggcctactttttttttttctttttttttcttttttttgagacagagtttcgctcgtcacccaggatggagtgcaatggcacaatctcggctcactgcaacctcggcctcctgggttcaagtgattctcctgcctcagcctccttagtagctgagattacaggcacctgccaccatgcctggctaattttttgtatttttaatagagatggggtttcaccatgttggccaggctggtctcgaactcttgaccccaggtgatccgcccgcctcggcctcccaaagtgctgggattacaggcatgagccaccgtgcgcggcctgtttagcctacttttatgactgattcacatttattaaatagctcctagctggatggatcattcagaatggcatagatctgagtagagacttggagactattagcagagctagcttctaggaatagaagtagaagtcaaatatttaaaataatcaccgtgaatcaacatttggtattacctgatcattctcaaaaccctgttccctatttaagctttgatagaattatatgttaaatattcagatacgttatgtaaatgacgaccaggacttagaagttgtttattattaccttcctttatgtggctactaagtatttctgtccatgaaaaatgactgaaatcataatgttaaaaataggaaagaggccgggcgcagtggctcacgcttataatcccagcactttgggaggctgaggtgggcggatcacaaagtcaggagatcgagaccatcctggcctacatggtgaaacccccccgtctctaccaaaaatacaaaaattagctgggcgtggtggcacacacctgtagtcccagctactcgggaggctatggcaggagaatcacttgaacccgggaggcggaggttgcagtgagctgagatcacaccactgtactccagcctagcgacagagtgagattccatcttaaaataaaaaaaaggggaagaaaatacacttacacccattcccaggtaaaatgtcacatctctgtttgaaatgctcatttgcatgaatacattatgaattgcagttccaatatatacatttctgaatatggaaacctcaataatattttctctttgtgttttatatttagtactaaaaaagtgatttgtggctaatataacattcaattaaaattaacatttatcctaggggcattccaggtactacagtctgtctcattcattagagcattttgtacttatctgcagagcatctctcctcagaagagaatctgctgaatttttgcatcttatccagcatcaatcactttgattaggatctcactccatgaaccaggcagcttctcttccacagcagttccatatgtctcctacagctgttctactttctaagtggaacgtgactctcttcagctcatagtttgtgtccccatcaaaaaagactgtcaatagctcctttattcttttgatttgctgtactctcttatggcttggaatatgacttatagtcagtattgaattaggatatgttcgattaagagaaattgtgtccatgaatgttttgataagtgaaatatttacatcaaagctcatgctaagaaactatttgaagagcaaagacagagcagaaactttgcttgtgaaggaatttctccagggaaattttcaccgtgcaactcggtggtggaaggctgccataattttggtttatgttaatagaggttaagttgatttttattattttctttggttggtttataatcagcaaattttatcttggaaagtagatttttttttgcccaggtactatgtttgtgtgttagactatggaaagccagaacaactattatacattgactgcaaagataacagaattttgtgtgtgtgtttgaaacttcctttcaacctcaacacccgaaatgtttgctgcaataccttttctatatgaaaaccatagaataaatagaatggaagtaaaactaattcagaataaaagaaactatcatttctacaaatggcaacctcatttatttacacctaaaactatagttttcatagggcttaatgtgaaaagataaaagaagtgaaaaggtccttgagaaaataatagagtattacctgaagcttgctgagcaaacatttttggggaatgacaaaaaaagcttttgaacatgaacttctgggatttcaactgaatgatcaagcatgaagaaacttgattatcctgattaaagaataatgctgggaagtctttgcataatttgataatatttttagtatgagctgatgtctttaaccaaaatagctaccaaaattttagaaaacactatcacaccatgcatgttgtgaatgaaatttttatttactcacttgttgatttgggagagctatatgaacaattattatcaccaatagtattcatggtcttttttaaaaaaagactaacaggtcaaagaaaaggggtttaatggattcccaattttagtatgttgtacccttgagtatcagatgtctctgttcttagcaactttccttgcttgtggaaatctagaaatggtttactcaatgtcagttgatcatgttgttttatctgaaaggcaaaaacactaggatactttcaacttcccatagagaattacacattcaaactaaagtctagttgttcaaatggaaaaatcgagaggcagacaaattaatgtaattatagacttggtagggtgttgcaaatgaataagaaactggcaatttgagtagttaagaaccattgtatattttattatagctgtaatgttttgagttcataaagccatattgaagtaggaatacacacatacactcatttttagtaagcacaatagaagtaagtcatttcattatcattttagggctgattcttacactttttagcccacaattccgtaagttgtctaattcgactgatacagaccagttctagctaccaaaatattatgtgcacaaaactccctttcattctatttttctgatcacaatatccatgcccacaatatagctaattagttaagtgtgggaggaaggcttttgttagaattcttactccaatggattaatcattggaaatcctcaaattgcctgaagttgttagcatattttaaaatcaccagataaatacctaactagaacatcagataatacatgacaattagaattattctagcgagctgtagtcacatctgaaagttaccatattcttgctcctcaaacaccttaaatttaaactctgatgaaatccatctgtaccttctctaatatctccccagatagtcatgaggagtaaataacatactacaaaatgttaaaatatttcaaatacaaagttctatagaaatgttacacagtgctattatcactatttctcaattaaatgtacattttaatattaaatgttactgctaaaattattttgatagtagttatttataaacattcactattagtaatagccaactattatgtatggttactttcacttaggatgaaataaaaaatattggcttatttatatatttcagagtatgttctagattcctataatggggttctaatggggctaaatatgtcaaattcttataatatatattaaatgtgtgactacagcagtgccttttaatgtgggtcttcttttagtatctgaagaaagctaaccaaattttccattgtaaccaccaatatcatatttttaatattagaatataatacttaacaaatacaatagttaaatgtttatttaatactaactaaacattgaacaataattcttaaagagattcacaaactataaaacactataccagactataaggtgcttttactaatcaatttggaaaccataacacctgtctgatgagcatgcttattttaaaatgaacagatgcagggtgtgataatataccagattaaagttatgagtgaatagatttccttgtaattacaagtcatatagtgaaggtatcgatgctatatatatttctgtcaatgaagaaactgtataatttgaagtgttttaattttggggggatgggggacggagttttgctcttgttgcccatgctggagtgcagtggcacgatctcagctcactgcaacctccacctcctaggttcaagtgtttctccagcctcagcctcccaggtagctggtattacaggtgcccaccaccaggcccggctaatttttgtatttttagtggagacagggtttcaccattttggccaggctgctctcaaactcctgacctcaggtcatccgcccacctcggtctcccaaagtgccgggattataggcgtgagccaccgctcctggccacgtgttttacatcttatttataaactagcctttggaaaatgggtaagaactgtagtgctttttgttggtaatactgtgtagttgttctttagttgtcatttcaaaaccaaagctaaactgtttacaaggaaataaaaacttaacctgtgcacaaatttagcattatggatttacatactaccaagtactagaactttttcagtctcaaaaactaagcccttttgaaatttagctatttaatatcaggaattctgaaaacaagggatatgggatgtaaggagaaaattattcctattctatagactttgttatgtatgttttaaaatgtaattaatatcaacgtaatattgtatctttcagacactgacttccatttcctgattggttataggtaatttgaagatttttcactataccagtagagatacaaagtaaaacacaggtatagtctcctagaaaattaaataaaataacccttgagtagacttgtaaggtgacatagaaccagatatgcctgtcttctgttttgctaaaaagaccttgtttccaagtgttattgaaaagtgtcataatgaaatcagaatttaatgttatttgccctggcaaaatcatgtgtaatggtaatcataaatcagttaaggagtaatacaagatgttatgcaaataagcactaaagtttcacaccaggtaaatggctgccttcgtgagtcagtggtgaaatggtaaggttctagaatatggatattgcaatggacattaaaagcaaaatgcgtagagacattttcttaaagtagtaattaatggtacatggaggtgtgcttaatgtgaaggaataataaaagcaataaaatttcaaacaataagcattcatactgatttgatttgtgcttgtataattctctttacaactctatcatatatgttcatctatttattacattttggatgttactgcattcttgtcttagtttattaagcttcccttttaatatttgcctttattttaccctcttctcatattatgatttccttgatcctagcttcttttttcaagtccatgcatcttagtatttcatggctggcatcaggaagttttctaaaattttgtctggttttcatggaaaaaattgcaaagtctcatttattttctaagcttcaagacaagtgtatccatatggattcagaaaatttctataggcaacttctattgttcttttcactgagccttaaattagaagagctgtatgtagacttagtgttaagtacaattattgatgtactgaccttcttctcttatttttcttcataagtggagattgatatacataatctatacctattcccagtaccgacttagcctttacccagcactgctttcctgatggatgtggagttttctccaaataaaactaccatatcttgtaaccatattaaaaagtagaagcattctgtatttatattttaacttaaatatttattataaaaaattctaaatatatacaaaatagagaatgataagtgaagattcatctacctattagcaaatttcaataattataagcattttaccaacctttgtacctattttctatgtaggtgtaatacatggaagtctatatcctcactatgcactgttgtagactcttctctcaacacttctgcttttcctgaagtgcctagctatctgagcatacaatagggctaccaatccatttttgttctccaactatatttttatctgtgatttataatatctgaatgaaagcaggaagagacaagatagaaaggaggaaaaggaaaaaataaaaactataaataagagtgtagtagtttaaaggaaccagggaagtaaatgcctgatttgtggttagtgcagtgctgtatactagagtgaagaaaccttacactcttgacaatatcctggtaattcctgttgagagggcaaaacacgcgtagtccagaactgcatttctttaactgaatcatccccaaaaacttaaggtcgtggaaattctctctaaattttggtgtctggttctgacatatttttaaaattcagtgcttccccaacacctgtaatatgtatattttaacaggtagttggacatggtatttcaggctttcctatttttttcctatgtaaatatgaaagttactctatgggcctatttccctgaaatgttggacccactaacacaatcagactttctacaaactgccacactgattctttgccttcaggtacacctatagaaagatgagtgtgtggggatggcatagacccaaccagcagcaagagggagtcattatttcctacccaagagtagggcagagagaaagaagacacatttgctcagccattaagcataaaccaatgaatgccagactctttatgatcttgccagtcaggattgatccatcctttcatttagaggaggattgagcaagaggtggaaacacacgctagacatatttttctagtataggtcattacaaggaaataccaagatgaagaagacagttcttcctaacaacctctgccatgaaataattactgaccaaatatatttgggaatatgattatgctgaaagggccacatgaagtccttgtttttttattatttacagatttgactattttttttttctattctaatactgtgcttcctgatgctctattataaagaacagaggggattgggaagctggggttcaagccaaagaataaatccatgatgtattttaaagaagttggtagaagaaaagagaacaagtagatttttttgttgttgttttttgtttttgtttttgtttttgtttttgttttgttttgtttctttgagatggagtctcgctctgtcgtccaggctggagtgcagtggcgcgatctcggctcacggcaacctccacctcccgggttcacgccattctcctgcctcagcctcccgagtagctgggactacaggcgcccgccaccacacctggctaattttttatatttttagtagagatggggtttcattgtgttagccaggatggtctcaatctcctgacctcctgttccacctgccttggcctcccacaatgccgggattacaggcgtgagccattgcgcccggccgagaacaaataaatatttatagagtttggtgtagtaatatttttacttactctttcttattctctttattatttgctcctgaggatatgagttaccatctaactagcatcatttccttaagccaatatatctttgttcccttccacctcatttgttttgttgttgtcaaaaatgttatgtaatacataagttataggtcccaaaataaagttatatacatgttgttttatacagttgactttgaaatcaggtgaaggaaattgcctttatacttttttttttttaatatttacataattacctttactccttgtttttctgcaaggattttgcttatggttactttcagtttttgtttgtgtggggatgtctttacttcatcttcatttttaaaagataactttactacatataagattcttggttgatgattttgtttctttcagtactttgagtatgctatcccactgtgatcaccattgtttctgctgagaagtgagctgttggtagttcccttaaagttattgaagttcccttgtaactgataaattgtttttctcttgttgagttaaagattttctctttgtatttggctcttagcatttttcctacaatgtgttaggatgtggatctctttgtgtttattatacttgtagtttgttgagcttcttggttgtgtagattatttttcatcaaatttgaaaagctttcagccgtatttttatgtttctcttcactttctgtccttctgttctgatatgctcattacgtgcatgttgtgtgcttaatggttgcccaactttctgtgaggctctgttaagtttttccattctttttcctctctgttcttctgattgcataatttctattgatttatttcaggtttgctgattctttcttctgtcatttcaaacctactcttgagcccttctagcaaattgttatttcagctattataatttttaactccagaatttcatttggttcttttaaataatttctgcttcttcatcaaaaactccatttgatatagcattgccatcataatttcctttacttctttaaatatggtctcctttattattttgaacatgcttatatggctgctttggattatttgtattaatatattaaacctgacatttggcctctttcacagtcaatttatgttgcttggtttgtttcccgtatatggggaacacttttttctttctttgtgtgtcttttttcttattgaaaaatggacattttagatactttattatagcaactgtggatactgatatcccctaatctggagattgcttttgttgttgtttgcttgttcatttattctgttacataactggactattttagttaaatgtattttcctgacagtatgaagcttgcaatgtccttcctcagaggaggcaaatttgggcatgtgcatagtcactctgggatgacagtggttttaggaagattctctttgactgtatctttccctgatctctctgttaagctgtcttcctctgctggtattagaccaagtttttgtactacattatttgcctgcttattgttttggataatacgttggggtataaattgctccacattctgatccagttaaactcaagcccctttggaagccaattttgctccaaagttcagggcaaggccactggcctacttctcttgaagtgacacctgtgctttatgagcagggtgttgaatagagtctgtagcctctggccttctcagcttatctccctcagcatagaacctctgccctaggaacaagataaggtgagggcagtagaagtgggaggagcacctccagtattctcagcatgcctcacaggagctgaagcccctgccctatgtgcaggaattgggtggaggaggggagctccaattctctcaaatgcactcactagaaatttagcctctgtaacatagagcttcagggcatgacaaatgctggtagcctgctgctcttcagggagagagtcgtctttgtctgggagctggggagagtgttaagtcccacttttttggccacacctgtccagattggagcttccattctgcggtgcagagtggggaggaaggatgtagaccatgtgtaaacgccacagactctccttgttcttactgagatttggtagagtttcttcatttgctgcttgcccttagggaaccttatggagacttgaaatggttgttattgtttgtttgtttgtttttaataattgtcagtaattattgttgtttccttgggagttggactacagagctcatcatactgctgttctggaagtgaaagtactccatgctgtattttaaaggccttctgggatccctgttgcataaagattaaattaagtgttaaatgccactgtacgtttcatgatactagcaagaaaaataaaacaggattttccaaatatccttgattcagactgagaaatagcaaactctcaaaacaaaacattaatgtgttggtgaaatgtgcaaaatgctagcttctcaatcatctttggatgcggaattgcttaagcgaaatgaagaaaaatattccctcattgttaagctacaactgtttcatcattggagtgttccacgaaacagcctatttcataccagttaagggcctagctagaatttcaaatgaatgcaaataagaacgtttgtaatgcaagttgcaaggtgggaggaacaactgtttatgtaattttcctctcttttcaactttcacagagcattgcataatgttagaatcagactgcttgtattttaatcctggcttcatcactaagagatgtaggcttttgaccagttaatctaggtttcagtttcccattaaaaaatagaagtagtacaggacctacttgtaggtttattataaggagcataaataattgatcacttgggtaaagtgttaagcaattccccaatgtataaataataaatttaagatggtaataaaattaaaaaatcacaaaagcattaaataaatattatctctttagcagcttggcataatcagtagaaatttgagttctacaaaacttattgctgaatgaggtatagatttggatattagacaagaattttttaatggtccttatattcattggttttaatttagtgggtttccttaagcttaatgtatctctagtatgatcatctccacaagaatagataatactttttattaaatgctagcttagtccacaaaactttgttttattaaagtagataaattaagcaatgaaactattgatacaagatgtctttatatctttcactccaatcagttacatagctttaaaactcagaattatttttgtgtacatccactgtgtagtacctgaagtgagatgaacttttatgctatgctttttttctatttggtattcattgagtagcttttaaccaatctccttcttctattatacgagttgctctactgggcttttgggatgcagaaatgagtgagaagtggtttcttcagccaaaaccagatagccatttaagcacacaaataggatacatttttagaggtactattggagagatacctacaaggcgttgcagaaacacaaaaaacaaagagtccctggaggtatagggaaaagcttcaaagaggacacgaaggtgaagtcatttgagattgattatataacctagtgaagaattttccaggtacagagagatgcaggaagaccatttctggcacagggaacagcagatacaagagcatgaaataattaaagtactgtgttgttcaagagatgctgaaaagttcagatatttggaaagttcagtgaatgggatgcggaaggataacggaataggatagaaggggcaggttgaagccagatgtaaagaacttttatgccttttttaagagttcaggcttcattctttaggcaaaggcaagccagaaaggattttaaccagtaggagtgacatggtcagttaggtctttagaacaataactctggcttcattgtgaatgattgaagggcatggtgcttatatttccattgtaatagtctaggtcagagtaagtcagagctgaattaaaaatagctggatacaaaacagcttttctcttccatgcaatagtgtgtttcctccctaagccccactctctcccagcgaatacagttagtcttgttttatgaaaccagttaagttattaagattcaagcacccagctttctttgcttagctagctcaggtaaattgctttaatgatgtccatactgtaagggaagcatattctaatatgggaaaaatggatcagatgtctttgaaattatcctttttagtgcaatgaggaaattgaagtgcatagtgaaatgttttgaaatgttgttaataatgatattatctactaccgacatgctgtaatatccatttaaaagaaataaagttaattttgtatttttctgctctaacaatgaggaaaaatggtaaatatttgggaacgtaatcgaatgtggaggttgtcataaagtgagttatttttttccaaaggactgtaatgggaaaaatacataagtgcatacatatggaaatgacttgatttggtagttgagatttatatgtgacttttaaaaatgatttccagttgctattcctaatccattattttgttgtcttgagctgcagattgttgtctaggtcactaaatggcacactaaacacatttgctcaccatgcccctgtttcttcagatcttttcctatagaacacacacacacacacacacacacacacacacacacacacacccctccccttcacagtttttatattttcagagaaatctatgcatgatcttctgtcatgcaatcctatcaaacatccaattcttttaaacagctaattttttatttcttacttttgttcccaagatgtaaggcacttgtaagattgttctcctttcctgaatattagcaacaacagccccaccagccgttgcagattctgccatcaagttaacacatggggtgtgtagatttacaagtaggaatgaaattatattagagataatagctcttacattgctcaagaatagatcaccccatgaccacctggtcctatatcagttcatttctcttataattcaggaattagttaatgtttttggattgcacgggatgtgaaacatgcctagaagctttgccttatatgggaatctcttaaaatttatgaattcttatatcaaggaaatttttaaaaatgcttaatattacaaaacacaattctgttctttatattatcatatttgcttaaaacctttaggatccaaagaagtgtttttcattttgacatcctactttggttttaattgtcatgagcactagaatgatatgtattgcttccaaactgagtagattctattcgctagcttatgctgtacttagcgagccgtcatttgtcttaactgtatgaaccttagagtgtttataatttacttagaagcagcagatatcagcgccctaattaacaccttcaccattcctctcctggtacttgagaagttggcggcactacaaatggaacagaggctctgaaactaaacacggacctgacacaggatggacatcaattgtctttcatggccttgaggttcttccaattttattttgtgcaataattcccctggatcctgatttctatctcccagtgccatgttttcccacattgttcattgcccaaacctgatacatcatgcaccaaaattaggaagttgacacaagtctggatctcctagtatacgtaatgtggaatgaagatttgattagtaaagggaagtaaagatatgcaaaaaccacagaattattaatattttttcctgtacacttctatagtctggcaaaaaaaggtttggaaatttctaaagatagtagaaaatggactataaatgacttgtatacagaaaaaaagtgtttcaaaatattgattcatgaggttaataatagcttaatattaaagcatttatttgtgtcttttcttacatatctaaccatattgcacaaaaaacagggtcctagaattctatacagaatattacatatctatatcagacatgatcagaaatcagtatcagtacataaaatatactttatattacttaaatggaagaatttaaaatgatattaccatgtaattgaacagatttgaggtgcctgaagattgaaaaagaaataattattttcagatcttgagaaattctacaaggtaatcctgttgaagtcttcatcataagtgagttttccatttgtattattagtgtttgtattttttgttgtgagaaagcgatcctgattctgcttattttaacaaagacgagaataaatatatcagaaggtcattgggtcaggcaaagagttgtttgtttttcaacataggccacaaggatgaacaggaaaaggacatttctagaatgtactgttacagttttatgaaagtaattcaagcaaacaaaacagcaaaaagacatagctgccatttctcagtgttctagggaccaaagaatgtacttacagtgctaggatgtctgcatctttccagctctcacaactaaaataattcaagtatttatgccattattttaaattttgttattactgcccttgcctagatcttcattttcactcaattgaaatagtatgggaaattcctaagtgggatgcaaaccttcagtctttccaacaggattgtaataatctcctggctggactgtactgagtttatcttcttatcccctatagtatctagcacagagaaggaaagtgtgtgggaaatgcaaccacgccccttttcttcctttatgacagatggttttaatagattctagcattcttttcctcacaagtctcagcataacatgctgatttatcagagttggcacatgtcataaaatctacttaccatttctgaactgataatacttagtaggcctaaataaatgtttatcgaactaaagtattgcacatacccagaaatggaactgggaggataagtgaaaagaaattcttaaagaattatttcatagtttttctatttctattcctaaagctccccttttgtttccattgccttcagcggcaatggaagacttacaagagacaagtgctaggtctcatcaacttgagagtctgttcattattagtctcttctttgctcccagctgacttatatttaaatatatggcttccatccaatgattcccagcagggccattaaataaagtatgtattatggacaaaaaatggcaaaaatgtacttggctcagggacacacctttctccagtgacttggattcctttactcattaaggaaaaaaaaaaaatggttctatcgactcgtcattgttgttttatatcagcatgtcttaaccataggaggaaaaaggcagttacagttttaataatgaatcttaaattactggcacttcactcataaatgaagaaaggacagtataatattttattctcagaaacttttctcatctcccctttcctgggtcgtgaggtcaactaattttgattttatctgctctaaactcatcctaatcctataacttagtcacgttggttttaatatttgaagattgttttgtttcttgagattttcctacttctctctaaaattgcatctggggcatggagaaatggctttcatgacattgtgtagttgagaggaaatggatcccctcacctcctgctggttcttgggggattggtgacaggatttatctatgggatggtctttagcatatgctaattgaagttgacacttggtaaaattcatagtctaaattatctcagcttggttaaggcctcagaaagatccctagcttgttcatccactctaaactctaaactctgagagtgtctgctttgcctttcatctttctcctggtacaggctatccctttatttcaaggttgctagaccttcttttagaccttctttacagtggggtcagtggctaatctgcaaaacccgaggaaggcctgggagggcaaactagaccatctctctggctaatcatgccagtctgcttcataagctctgcgttttcacacaagactgtgctttcacagtcaccctgcacagcagccttgtgctagtgttcaaaatggcaacagaaacgtcctatttcctacaatttatggaacatatttcctcctctccactaaagcatgagggagggaagtggagatatgtatctccctcacctatatctgcctccagtccttttcctgtgagccttgaggaaaaagaaataaatcatattcttaagttttcaaaaatcttaatcatattacattatcagtagataatagaaattatagaaattttattaaactttttctttgtggtatctataaccttaatctcttcactctcactaaatcttcaatctgttatgtttgatgtattgcaatagtttttaacttgcttcttgcctccttttctctttccactccaggctattttgcatcctgttgccagactattcttcagctctctcgctttgattacaccgtttttcattaagacatttagaattttgtctcatcatttatctattattctttttcaatcatatgcctgctgagtcctaagactcttttcttcttattataatttctttactacattacccctaaatttgttccttcctcgtttctttatcatattaccttgtaatgataagacatccatatactgtctgattcttcaaagcctagctttagaccctcttgggtgaacctgactcactccataactagagtatttagtctgtagaacatatcttgatatgacattatgagtttgagtaggtattctctcttttcttcatatttatctttcccactaactcttttatttttttaaaaataatcttcccaacaacccttcagtgtgggtgttgatatctgcaaattacagacaagaaaactgaggttcagaaaagtgaagtcacctgcctaaagccacaaaactagttgatttttggagctgtgattcagatccaaatctggtttcagttttaagttcctcactggattaggctgcctcttcttaacagaaggggttttacagtatattttgagggatacttcacaaataaggtgatgtttgagggggcaatttattgattactaaatgctgaacacagtatatcatgttatcctttcaacaactctgagagttaggtgctaccaacagtctcgatttttcagttatggaaggtgagtgatagagggaatgcaggggctaaataatgaattgaacacaaggccctaatcatcatactgctctacttcccacttattgaactcaattctacacatcagacccttctcaatctagtttctgggctctggaggttgtggcgatggatggcctagcatttcctaggatctaagccctgggcatagcctgcttccaacattgggagcatagagatgagtcaggaaagcctgaccatggcctaactcatttttaagcatcttaaacaaagaatagtgtttagtatttgtccacggttattataatgtctaataggtggtacagagcactaaatatttacttcattatacaaaatctaataggacttaaaaaataaaagcacgtactgcaaaacacaggtttgaacaataagaatattgcttttttgctgttctttagacttcttttccatgttttcattaataagcatgtattattcttataatttacatctgtgttagttcaacaatactgtaatttaattacattgtgatccaaacaattagactgtgacattttatttaccaaacattactaagtctgcagttaatcataaagcagtatttctggtgttcatctccaaacattttatctacattattaacttagaatatttgcaacatgctgcttctcaactgtgactatgattattcacttatatttgtatttcatcattaaaaagaagccctcattttctcattattaggtcttaaactgaatcaacctgacatgaatataaaaaaattagagtagtttaaaacagttggttcatcagagatttgaactgaggtaaacaaaattaggtagattctgtaaataatcaaggcattttattttaattaatggccttgttacagttctgtttcaaaaactgaaggatttggatattacacccccttaggttttatatacatataatgacaacgttggtttggatgacgtctttgttctttctagctgttacattacattctgtagttatctgaactgcttgccagactgtttagggaaatgcatgtatcacagttaggggggattcacaaatggtaggtttctctgcaaaattgagacatatttagagtagaaaacactttgcctcttggaaatagaagtatagggtaatctctttttgtttgtaggccagaagtttctgtggactataaatagaaacagctcacagctaggatggagaaagctagagaaatgtacctatttgattgaaagggatagctaatgtactcaaaaattgctcttgagaaagagcaatgacacattcattctgaaggactacttaattgcccactcttggaacaagttggtcttcagctctaaactaaactgaagattttgaaaatgatagaaaaatagtgcagcaaatgttaaatttatgaaataggcttgcaattttctcatcaaacttagaccaaccttaacgatattgtaagagtaatatattctcaaggataaaatgttctctagttcaacttctacatagaaaatgagtttaaatgagccagtcgtcttaatatttggatacaatggtcattttgaaatatgtgaaatgtgttccactattattagaaaggaaaaaaaataaatatgcttatctttgatttgggcaatacccaggactgattcatagaaaaaaatctaatatatttatacataggagtgctttctctctacttgtacctacaataaaaaggtcgtcgtttgctttttaaaaattattttcactggagtatacttgaaactgtacatctcaaatgttttaacaaatatacctaaatattaaaattactaagtaattttgtccattgaaaaatgtggctactgcatatataataagacatagtttcttctcaaaagtgcctaataagactaaagagagtgaatcaatggaattatttatttgttaaaatcatgttaaatgtcttaaaggtgttattctttctttcctaattttcaaaagaaaatactttgtcttctttcatactcattgtttctaactctttctaacttttagtaattgtcaataacacttatattacttaaaatcttttccttaatttatcttcttctacccttctatccaactcttctttattaaaaacatgtcttcaggataccacaggagaaaaggtcagaaaaagaaaagggagttttagtgtatacctacctccaaacagtcattattactgtcaaggcataaagccatatgttgcatatgacaaattctgtatttctactggggtgcattgtactgtattttcataacatatgccaggcaacttctatgtatttcaggtcactaagtatacttttcaacaagacaaggaaactttctccctcccatcccttctgaaatctttatttggagatctagctctaagttttatgttttcctggtggtctttcgattcattccattccattccattccattcattcattcattcattcaaaaacattattattcacataccataggtcataaacctcattacttatgggaaatacgaaaatacttaccattctgtcttctctcttctttgaggcttgttctcatgaaataagacagatctatctatctgtctgtctgtctgtctgtctgtctatctatctatctatctatctatctatctaaacaatgaagtgatagattaagtatatgaaaggaaaatgaaaagcaaagaaaaaaggaaaaaggcctctgctagttgcgttgtggatttggaaaaacttcatggatgagatgatcctaaaagattactctgggtattccatgcagctaaaggtcgagggccaaggtggctgtaatagtccaagtaatgtggaaagaatttgggtgtgaaaagacttgccaggaagttttgactccagaaagattctaaaataaattggtaattataaagatgataatgtatggcctcgaaggccatgttcaggaatttggactgtgtacagacagattgtggaaagctattgcacgattttgggcagttacacaataaggttattctattggggagtacacagatttggctgggtgaaaaaggctagcagagaaaaaggccattttgaaagctgttggaaatagtcctgtgagaaataataagaaaacctatcaaataggccaggcacggtggctcacgcttgtaatcccagcactttgggaggccaaggtgagcagatcatgaggtcaggagttcaagaccagcctggtcagcatggtgaaaccccatctctactaaaaatacaaaaattacctgggcatggtggtgtgcacctgtaatcccagctactcaggaggctgaggtcggagaatcgcttaaacccaggaggcagaggttgcagtgagccgagattgtgccactgcactccagcctgggcaacagaaaaagactctgtctcaaaaagaaaaaaaaaaaaaagaaaaagaaaaccgaaaacctaccaaataagtggagataaaataaagaataagaagcataccagactatagtgagagcatatgaaagccaatttgatggttgaaggagaaaacattcagtattagaacaatcacaagacacggcaaatctaggggggaatactgtttagttagaggcatgttgcctttgaagtgcctgagttgagaaacattggacatttagaaagtgagggtggtggtcataaatctgggagtcccagagaggtagactgatccatgggattgtctaagttgggagtgggaagagagcatcttgataaagaagaaaagccacgctacaagactagagaaaatcaacataaagaacaacaggcggcccagcacggtggctcgtgcctgtaatcccagcactttgggaggccgaggcaggcggatcacctgaggtcgggaccagcctagctaacatggtgaaactccgtgtctactaaaaatacaaaaaaattagcccagtgtggtagcgcacgcctgtaatcccagctactcgggaagctgaggcaagagaatcacttgaacctgggaggtggaggttgcattgaggcaagatcgtgccattgcactcctttgcactccagcctgggcaacaagaacaaaattccatctcaaacaaaacaaaacaaaaaaaacaaaaacaaaaacaaaaaacaaaaagcaaagagagaggtttgtcaatcacagtttaaaaaattaaggcaactgggataagcaactaatatttcagccatttgagaatgactctatctcttcgtacacttgcaaatagaattgtaatcacatgagatttcaaccagataaatttggttacccagaaaaaaatgaggtcatgacatagatttgaaggccaacaaaaattacataatcagtgctccgtaaattagctattacgtaggtggatgcacattttgtttcatgtccatgaagattcgaagcgttaagttattttactcatgataacaatctacttcctatcgaaatttcatggagagataatagatcagtatttattctatactgagtatagaccatgaagattaaaaatagctcatgaataagggaaagggaaactctatatgtgggattttatgtaattatggtaacaattccttggagatattgtggtctgttatgtaaatatgtgtaattatgataatttcaaaaaccatgttatttactcagtagtttaacagctccttcacaaagcagtcactttcagaactcaggaggggtatagcaatactttccataaaaatgaggtaaacttaacatctcatgtgaatttaaaatatatttttataagaaagacatcagaatttaagggtatatttaccccatttttactttcacacaataaagtactgctgtagcacagatcattattacccaagttcagggatgacatacacaaagattattattgataaataatcagaatgaattggtagtatttgcatagatttttctggaccatagttgtttttacctgttgtttgagggcctattatggggggcatatttaatatatgagtgctataactagaaattcaaactgtcagagggaaggaaaccatccatctacccattcattaaatgaatatttattcaaggccaagatgtgctaaatgtgggactgaattttgggaccaaaatcttaaatgatgcatatgtcctactattacatgctgtctaacaggcagaggtaatcaggtaaataagtcagtgaaataacatcattggagtcttcacatttcacttttccgggggacaccattcccattgttgtgaaatgcaaagaccctgagtgttctaggtgttataatagaaagaaaagtagggtacaaaaggggaacaattttatatggtagagctaaggtcacttaggatgatccaagttttaatgtctccactagacagccagagtaataggtgaatgtgtgtgtgattaagaaaaatcatccattgccactcattgatatgtaagggacaagcagaggaggggaagcactatcagaggagaatgagaaggaatagttaaggcagaaaagaaaaaaagtgaaaagtacatttttttctgaatgtaagattccagaaggcagtcggtaaaagttccaagagatccacggaagtcaagtaaaatgagagggaagagtccattggatttgaaaattaagtcatgagcaacttcacttagagcatgttcagtaaagacatacaaataaataaaagtgactttgatgataacttttggttggcaacaccaacaaaccaattttgaataattcctccaagaaccgtcatagtgaaggaaaacggagtggtgttcctattctaggaaaggtttttgtttgttctattttggttttgttcttggattttttttagttttagtttcctgtggtattaaaacatgtttatataaagtaaagggggctgggcacagtgtctcacccctgtaatcccagcacttttaggaggcggagacagaaggattacttgagcccgggagttcaagacaagcctgggcgacaaagtgagaccccatctctacaaaaaattagttgaccgtggtggtgcatgcctgtgatcccaagtacatgcgaggctgaggtgggaggatcacttgagcccggaagattgaggttgcagtgagccgtatttgtgccactgcactccagcatgagtgacagaacaagaccccgtctcaaataaataaataaataaacaaaaataaaaacaaaaaaataaaaaagggaagaatggttatatatggtaaaccaggactcctcaagaaagggagaaattagattcagaccaaagaaggagtaagtggctttaatctatgaacaagataaagggttcatccttatctgaagcaggaaagaggaagggaaagagagaaggatggattctaatataaatacatgcagaaagttcttaaccatatttttcacttagaatcacaaaaaaaagacatataaaacaaagtcactaaagaacataataatgtgcttatattacactgaaatgatactctactttcctctaattattattcttccaagcaaatacttttttttttttttttgacacagtatctcactctgtcatccaggctggagggcagtggcgtgattttggctcgctgcaacctcccactcctgggctcaagcaatcctcccacctcagcgtttgtagtggctgggactacaggagcccattaccacatccagctattttttttaaatattttttctttctttctttctttctttctttctttctttctttctttctttctttctttctttctttctttctttctctctctctctctctctctctctctttcttttcttttcttttcttttcttttcttttcttttctttctttttttttgatggagttttgctcttgttgcccaggctggagtgcagtggtgcaatctaggctcactgcaacctctgcttcccgggttcaagcgattctcctgcctcggcctcctgagtagctgggattacaggcatgtgccaccacacctggctaatttttgcgtatttttagtagagatgggatttctccatgttggtcaggctggtcttgaactcccgacctcaggtgatccacccgcctcggccccccaaagtgctaggattataggcgtgagccaccgtgcccagacacacacccagctaatttttgtatgttttgtagagatggggttttgccatgttgccctggctggcctcaaactcctgggctcaagcgatctgcccacctcagcctcccaaagtactgggattacaggcatgagccaccacgcccagcctcaaatacttttttgacccgaatatcctgcctaattgtgtaagagttaatctatattgtccaaagtaccagtaaggtttttcttcttaggcaaggatgttagaaacatattaggtttttctgatcaatatggctcactttttaagaggaaattgttaatatttttgagtcattgactgcctttgtgctgtttcagagaatgtacaagagtgcggcaataaaaaatggcatacgtattgaaaatattattgctctggttttcagttatttagctcaggttttagaagtttcatctgcctggaaatattttcaaacatccatctatattattgccatgtgagtagtggatctagtgtgacattgcctcttctactggcaatgatatggcataactctagtttgaggagtcaaaataggaggtagcagatctattgtgaatatccaaagtgcagactgcctgttcataacaaattctcttatgaaattatacctttgtaagagcttccataatatatatcttatagagaaactcccaaatggaatttctctaacagactttgccaaactttgatttcttggttaccgggctatagttaatgtgttcataatagcatattgctaacacaaccattaacatgacccttgaaaaataaaatttgatttcacaatgtcacagccgtacatggaattttgaaactaagtcttcttataaaatcattttgagaggtagtttatttctaagtgaaggttacttgtaaataatggtataaccattagcttttgacttttaccacaatattgttggctagtcataatgttcccattcataaaggataactgtgtaatcatttgttattcagatgttgtgccaaaaatccaaaataacatttattcttatttctaaaagtatcagaacatttacaatgaagctgcagttgttttttggtttttgagtgaaatatacaaccaataaacaggataggattacagtatattctgataaaaagctaatttggggcaaatgagccatattacagttgttacctatcacttgattgaaaccaaatcattatctagctttggataaccatgcaccttaaattgaaaattctacaacccattctatggcatacttctgaaaggctctggagtttctctagatgaaatcaaacacccaaagaacatgaaattttggtcagttttcttttacgtgcacatgaaatcatgttctgtcaagtgtgaagattgcggcaggtgttatgagtcagcacacagcataagcaaagctgtatgattgtctacctaatgttctcacgatgatgtttctgcatagttatggaaataaatgtctgtctgaatttttagagcttcatcaccacttatctgaggctaaggtaaatccaaggaggatgtaacatctttttctttacatttttgactatatatatatatttcttttaaaagttagcaattaagccatttctatgtgcctaacacagtgctaaatccttgatagctgtggaaaaatagctgtcataaatcactgtccttgtatttgtggatgctggtatataattttctgtagaaaggtttctgatttgtatttactttcatggaaatcagtgacaggaaactggaaagtatgtagggggtggaaagatcatttgagaatgatgcaaatattgtttgaaaaacttgtatttatatttgtatgctctggagatgcatatatccaaatttaacctcatgaaaattccaggaactaaaaccttgaagaccagaagatgcataatctccttaacaaacaggcttgtttcacatcagcaagctatgatattaaaagggtcagcctatctcaatttgattgaccaaattagaaacctatttaggatgcaattataatgcataagagatcactgtgctctaataaatcctgaaacacatttcatggccagcaccaaggtaaggggctgcccaagttaaatatagaaacatgtactgtgaagggtcagaagtttgcttcttggcatgcttttattcagcactccatgattatgcagtagtggccagtgtggtgtggactttgaggacttgccttaccaccaactagccaagtgagcttggaaagaccccttgaactgttctgttactgcaatgatctatgagacaatagatttgaactaaatcattcctaatagtcttaatgaatagcagtttcattagtttagtaatgggataatactaaagaaaataaaaaccccaacctttgttaggtacatagagtatagtaaagtgattcagataaaggttatatacagagaacaaactaagaattttttttaagaagtaattgacaaaaattgtgtgaaggcaaagagagctaccagtataaaaaccattccaggtagtgtttgtgtcttcagagagaaagaaaagagaccagacaggtctggttaggatattgttggggaataggtagccaagcaactgcatgaaaagccaccaaagggagccttcttcaaagggatgggcgcatcactgagataatccctggcttagcctttgacaggcttgcatctcagcattcacttctgtttgagctattatgtgctgacttcagcatgggagcaatgaaattggggcatgactacacatttcattaccgactcccaagccctgggaaaataatacttttttaaaaaccctgtacctaccatctaataaggtaatagtcaagttgtcttattagattattcattaatgaaacaaatctgtgatgaaacagacttcagatgaatatagctgtaatttttttatcaatgacataaaactgacctgctaaaacagtatagcaactggtaaaatagtttattaaattcttttaaaatatgaccagttacattatatagaaataactggactgtggtccctaaaaaaagagaaatctgcttaggaaaaatgtaattaaaggcgacaaaagaattggactgtcttactcaatgtaaaacttttaaatcaatcttattattttaggagattcatacatgaggactgttgcttttgtattagcttaacaagcacccagggagtcctcctaatagttaagtttatagaattaaaagaagtagggctaatgtgggcttattttcctaatgtgcaacattatttggtattccaaaaaaagtacgtgatcatttattcttttctttgacagagtttcagtcttgtcgcccaggctggagtgcagtggtgccatcttggctcactgcaacctctgcctccccgcttcaagcgattctcctgcctcagcctcccgagtagctgggattacaggcacctgccaccatacctggctaattttttgtatttttagtagagacggggtttcgccatgttgggcaggctggtcccgaactcctgacctcaggtgatccacctgcctcggcctcccaaagtgctgggattacaggtgtgagccactgcgcccagccgcatttattcttttaataagcatatattgaaattccactcaaattaaagggatacatatgtaaataaggactctgcactgagaaggttaactttagtggtgatccaatagaattctattagaatagactaatggatttatataatgatagtacataataataaaactaacaaatatataataaagtataatattatattctagagaatttggaggaattttatctagataagccagatatattttggtcagttgtgagaaagagtgaaattaaaagtaaacagctgggaatagtgcatattaaaaagctgtagcaacagtagtggtgataatggtgatgactgtgatcatgagaaaaagaaaagaagatagaggaggaggaaaaggagaggaatgctagctaaccctgtagatcttactgtgtgctagacatttttctaagagggtttttatatatgaacgagttaatcctcacagcaatcttttgaagtatatgctattattggtcccattttacagttagggaaactcagatacagaggatttagcttgcccaagatcacatagtaagtgtataattgcttttaaaatcagagcatacccattaaatataaaggtaaatattccagagaaagtctgaaaatgttgacagtttatatcactcaaatatctaccgtagccaaatagaaatgtgtataaaatagggcataagaaggagtggtgggcacgatagcaaattggagagcatggatgataaactggagagctacagcccagctaaacatggctagtgaactacaattgttgtggcccgctagaaatgctgtctccgtgttatcagatcatccaagtttggaaaggatctgaaatctggattcataagtgaaacctccaggttattaaatatttggcatttaattaatttttaagataaaatgttagtgggcttgagaaaacacatcagtcactgtgtttgatatatcctgagagccaccagttcatcattccatcattatacagaggcatttattgacttttcccaaatgtctaataatctgaactcagaacgaaatatgtagtagctaaaagtcactttccctcaataataaatattgcttatagcttagtgggttgatttcagtgctaagatattcatttgaagaataaacacaggaacatgtgaaaatcaaagtctagcaacctattttcagtttgttgctttagcttttcagctccaacattgtgagcatccctacgtttagtctgaataacttctcatggactgtggctgtcttattttatgtctctaataccagattatgaaaatcacagaaaaaaggaaaaaatattatttccaaagagtaagttatgaagccatgttagaaacccatatgacaatatgaatttcttttatctgtcaatctcaaggtagaattcctcatatttctgataatgccaaataccatgaaatgtctcaaaaaagacttgactttatataccagttgtttgtcttgctgcctcacttcttcctttcttttctttctcccttttatctgcacccaagttatttctattctgtgttttattggttcttaatatattattatccttgatctctagtcctatcataacttcattttttgtaccaaatgttgctttgtaacatagagaacttaaatgccaatcacctattaacaagctaataaatgtcctggctagaagtgtcataaatggtgaagggtcttgacacaataccatgtgaggattacttaaatagattagggaaataaataatatgtagggaaaatataatagctatgctgaaatatttggaagattggcaatgaagaagctatagtgtttggctagtttgaaaatttattctgacttggaacgtgtggaagctatgagaggtagagtttagtttaacaagtgaaaatatctcttcataaagagattaacctaaaaagtataatggatacctcaaaaaatagtatgttatagagaaagttccagaattgtcaggcagaaatagttaacctctgaatctgtgctctgtctccagaaatctagacagaagctattaagtaatattatcatttaagatgatttttatgacatgacagaggacattatttaaaaattttttttttttttttttttttgagacggagccttgctctgtcgccaggctggagtgcagtggcacaatctcggctcactgcaacctacgcctcctgggttcaagcgattttcctgcctcagcctcccaagtagcttggaccacaggcgcatgccaccatacccagctaatttttgtatttttagtagagacggggtttcaccatgttggccaggctggtctggatctcttgacctcgtgatctgcccgcctcggcctcccaaagtgctgtgattacaggcatgagccaccgtgcctggccagccagaggacattattttatcgacagcaactacaaacattgaaagagactacaacataaactgttattattagagaccaagggtttgttgctagataagaatatgaataaataccatattctcttgtattgagcttgtttttcaataagtcactgaacaacaataattaagcaatgaagccaatacatctagagaaaaaatttaagaaaacatcacaatgtttcaataactatttccatctatacatatttcacacattataaaataatcagttatatcacatggttttatttttaagttcaaaaagtcttcataggctgagctcaatggctcacacctgtaatcctagaacttgggaggccaaggccaaggcaggtgtgcttgagcccaggagttgagaccggcctgggcaacatggcaaaaccccgtctctacaaaaaatacaaaaattaaggcatggtagcatgtgcctgtagccccagctattcaggaggctgaagtggaagggtcacttgagccccatggatgttgaggctgcagtgagccatgattgtgccacttcacactaacctgggtgacagaacgagatcctgtctcaacaacaacaacaaatgtcttcatagcactttctccctactcgagtcttccataaagctgttgaaacacatgcacattatatctgttttttagcactctatctggtaatagtttgtcaaatacgtgctggactcactattttaacccatatttaacccaaggttgtggcaattatcaaagaaaatcaagcaacattactgaacaaaaaaatattttctatgttgaattatgtagttaatgttccatcttctctttgctttcctatccaggtctagctttaggtacattacaaagtgaactgggaagaaaatgctgacatttaagtggttcttgttgcatgtttacattaagaaataataaggccgggcgtggtggctcatgcctgtaatcccagcactttgggaggccaaggagggcaaatcacctgaggtcaagagttcaagaccagcctggccaacatggtgaaaccctgtctctactaaaaatacaaaaattagccgggcatggtggtatgtgcctgtaatcccagctacttgggaggctgagccaggagaattgcttgaacccaggaggcggaggttgcagtgagccgacatgcgccattgtactccagcatgggcaagagtgacactccttctcaaaaaaaaaaaaaaaaaaaaaaagaaaagaaaaatgcactactgtagaatatcttaataattgtcttcagaataagtagattttaaataactacgaactaacacatagtgctttgcaagtgaagtggaaataaattcttaaacaattatatttaatgcaaaaaagaattataaaaaatccctataaagaaaataatgtagactgcattataatcttagtctgtggccctgaaaattttagtcactaccattagtctctacagacttaaccatgtcatgcttcagtgttcgccagttgtcaagaaaaaaatgtttcctggagaaaatgagaacagtcctacctttaagcaaattgattttgatgccttttgtcctagaaatgcacttgtactttattaatgttcttatgtggatcattttgttttgctggtgattttttcaggtaattctgcatgagggagacagcagtaaagaggggagtagtaaagagggaagatgtagaaaaaacactgctggatttagggtagacatagcttgaattactcaaaagcatattccccttcagctttattgagatatgattgatgaataaaaaagtatacatttatggtgcactacatgatgattttatatgcatatacattgcaaaatggttactaccatcaagctaattaacatactcatcaccttacatagttaacttttttttggtggagaggacatgtaagatctactctttttttgtagtctacagtttataattatacaaaacagtgttaactgtagtcatcatgctgtccatcagaattcaagaacttatttatcatataaccgaaagtttgtaccctttgatatttcactgtcttttttcagcatgtttttaatatgtttgtacctttttttttatttcatattttgtgattcctcttcaatctctttgcttttactctacaggtttggcttaggggaagtgtggagatgttggtcaaaagtgtattttgatttaagtttgaaatctttccctctattttccttatggtcgtcgttcgtttttctacatgaaagcagagaaatatgaatatatatatatatatatatatatatatatatatatatgtgcatacacagacacacatgtatatgaatgacacttttttgcattccctgttttgcccaaagctgatagtgaactgttatgttagaatatgagatgaaacatctgattcaggtcagcatgctcaaaacaaattgtagggcttcatttcctgaagtctttttcttattcatttcatcccagagaaatagaagccctctcatagcttaaatttgaagcctaggtgtcaacagaaccggtcactatgaaagtacaactgtaattaagtggtctgcaggtcatctcaacattactgcattgtataatgttctggggtgcatatctcaagctctttatttctgtttcttccctacacctatgtcagctttttcactgtgcaataataactcctatttatcagtaaaatagatgttttaaaacatgatattcttaaagctagtttgacaacttaaaaatagggaaatatgttaaacagatatgtttttaaattttccgtacgtttccttttatttgcctactccccactattgtagattatttaaaactgccctctgtccaaattgtatccttttggagaaagcattttaagtaggagaatccattaaacgcttttttctaaagctcaaactgagaggaaaacttttacatttaattaatgagaattcagctctttaaaagtttgatgacttttcaaacttatataatctgattccatctctggggaggaaaaaagacattttggttttattaaagaagaaatgaccaaaaacattgaccacacgtttgctgttaaagataaccgtacttaattcaacagaaatgggtttttcaccgagtctaaatgacctgcagcattatagaattggctgccattctctctcagtcagaaatcaggctgtggaaagccagaactcttctctacatctagtacaaagattgtgcttagggtttaaataaaatgaaaagaataaggtggaaaattagaatatgttgaaggttgaaagatttgattctgtgacttttacataactcaggaaggaaataacccaattcctctccacatttagtgaaaaagcaactcaaaaccatagaggctgagaactttctctgcatggcttttcaaacgatttatataaagatgttggagaaattcacaaagacctggataatgttggaaaatcttgtgttttgaagacaggacagagctgtatgatgcaacaatgccatctattggcttccaaggaatggcactgaccacagctagtttgtagtgtctggaaaaggaagagattatcagtttggaacatgtgaatataaacttattaatgaactagatgctatctttcgtattctttactcctgaatgtggaactatacatgatgcatataccacacacatataaacataatgcatagagatatgctcacctgcatcttcaacaatcctctccttgatgctagaagatgagcttgccttatcatcatactgatacagtagctgggttttgtcttcctgtggactagtagttgtcatacaagaggatgtgtttttaccagaactctttattcagggtgttactcatgtcttagtctcccctgctctgctaatcccaactgttactgtaatttctaagcacactcagacaaaaacgtacaggactggggcttctctcagttgagccaaatcaattctacttccagatattgcaatccagagtttgatagagaatttttggctgctttgaggaaagaataaaacatttgattgtgactgtcttagtttccttgtttgccctttaagttcattaaaagatacgtcctataagagtcagttgtgaaacctgtgcaatcatttgaaatgagagtatagatttaaaaataaatacatgcctgatatttacatgtgatttagaaaatatacagggagtacacatattatttcaaataatattaatactaagaggctcagaagtgccataacctaaaaacaataaagacatcaaaattgtttccctaaaatggaactagaagttaataaagcaatagttccaaaaactttttgtttttaaatattgagaaaatacaaaacaataaggattttgttgggcaataaattgggaggcattttcccctgattttcttaaagatggtcaaaaaaagtaaaataaaataataggttcccaaaattcttccattgtatgtagtttttaggttgatggttgcacatgtgtagtatagtttttgaacaaccattgcaaataaaaaatctgtgctaaaaataacctttttatttaataactcccttctcattttcatcaatttgatcacttgctttaattcatgggggttctaggtggcacttcaactgactgctactgattagtaatttaactaattgattgtcaaattgtaattattgctatgcagcataagtgtttacttgaggatagtaaggagtagccaagtctttcttatttaaaacacttacactaataagactctagtcaaacaaacatatttatttgaatactgtggctcatttgaaagcagaattaagttataaaacaataacccattgtattgtttctgctttctgagtaaaaacaaaatagcacactgtttcccaaacttaagtgcttctaggcccaccttgtctatgtctgccatgtctgattactaactgtggtttatacacaatatatttccttaagttgactctcattttttactgaaatatattttcaaaggaaattttatatcactttcataaatgaaaaaaactagaatatctataaatagtaaacaaccatttaaaaattgatcataatactactgttttaattaatataataaaccattattacatctaattgatttatcaaaaatgaaataacttcttcaggattaaaaaaatatatgtcatcagtcagcaataatgacatgtttggcttaatttaagttaaggaaaggttcttggttaacaggaagtttctatttttagttctaatgatgactagcagtgagaatcacaatttgcatatgtaagttttgaaaaaaataaacatcatttaactagttattgtgatagtgttggacactgaaatcaatcctggcaacatgttgtgagtgactttgactcagcaaatctttgtgtcaagaggccatttgaagcttctgctctttagaatgggctacgttatttaatagaatctatattaaccagtcattactgccatgttgcttggaaactgcaaagatgttatatcaagttacttagccatcttttcataaattttcattaaaatatgactgccaaacaagatcaatcaggtgaccttgatatattaggcttttctcatattgctataaagaaatacctgagactgggcaatttataaagaaaaatggttcaattggctcacaattccacaggctgtacaggaagcataaggctggcatctgcttggcttctggggaagcctcaggaaacttacaatcatggtggaaggtaaaggggtagcaggcagttcacatggccagagcaggaggaggggggtgggagataccagttacttttaaatgaccagaatctcaagagagctcactcaccatcactagaacagcatcaaaggggaaatctgcctccatgatccagtcacctcccaccaggcattggagattataattcgacatgagatttggtggggacatagatccaaaccgtatcactttgttattggtagttgtttgtgggttgaaagcatgaatgatagaaagacatgttctcaggatgcaggctgggataaagtagaagaacacgttctataaaggaacacttattatgtgttaggtactatgctaaatatgttacattaattatcatctcatttaatcctcactacaaccttcctaggtaggcattatttctactcctactttgcagctagggaactgagatcagacaaggtgaagtgatttgattagtctcttaagttaaacttactgccttggtgagcaatggtaaggtattagatgctacaggtctgctgcatacccaaaatcctgaactttggctccaggcctggtctgtgggtcccaagaaaccaaagtgtaggcgagcctagccctgagggatcattcccaggtttctcctcaacccttcttgcccagcctttccctggaaacccaatagcagagagcataatcaagaatgtataaatgtgattataaggagccagagcaagaaatatttcttttttcttccttactgtctacctcacctggtttaatattccctaccacctcattctcacagtctatgcacctatactttagtctgggtacccctaaaaaattatttcttgtaccatgagtgtgcatgcccccctttgggatcactgacgattaaaaccagttccaaatttacaagcctcttgggatatgtttgactcccatataaatgtagctattttatatatttttgtgtatatatgcccattttaatatatgatgaaaatgagttctctaaaaatgttaaaatatgtaatgcatttctgaaatttacaatgagtgcctttcaattcactatggcattgttataaggcggatttttagttgtatcgtagttgataacatattggttttcttttaaatttctagattttttgttttacttaaagaaacatctattggctgggcatggtggctcacgcctgtaatccctgcactttgggaggctgaggtgggtggatcaactgaggtcaggagtttgagaccagcctggccaacatgatgaaactctatctctacttaaaaaaaaaaaaaaaaaaaatcagccgggcagggcatggtggcaggtacctgtaatcatagctactcgggaggctgaggcaggggaatggcttgaacccaggaggcggaggttgcagtgagctgagattgcaccactgcactccagccttggtgacaagagtgaaactccatctcaaaaaaaaaaaaaaaaaaaaaaaaaaaaaagaaacatctatttaatagaaaacacacctaaaaactaaaaaaaaaaaaaaaaagaaaacaactactgatctcactgcctggtattaactacttttaagatttttgtgtatatctttctccatttacattgatttttaatttcagttaagtgagaattccatctcttttttatagctttcactttaggagtaatttactttagttgagaatttcacattcatgtatcttaaagtcctttctctttttggattatattattattttatttttagtatagacaaagtattcttgcttccccaacaagatatggaaattcatatattttgacaaaatatgatgctattttccatgtaaaggacagatatgttttctttgatttctttttctcatagacttgtttatcatttctcttgctctaaattttagaaaggtgttgtttttgccttcctgttaggcttcacctgaacagttatagtgatggtgtggaaggcaattcttactatattagtcatttgatggtagtctgcaacttcaggggctctgtcttaatagttttacattgctataattcagtggctttgaggtctagcttaatacccaaattactaatatatttaggattgttgaaactgcaaatgttcaagctttacctcaaacagtccacaagatattccctaggcttcagggtttgagaatcctctaaatgaacaaagcccattaatccatgctgtatcatagtgactgacacatggtaaactcaataaatttatctattttaagttaatagaattctggcaagattatctgttcattgcatgtataacatggtgaccttaatcttttgggtagaaataaatcagctatcacttatgattttctcaaggaataatggtaccttttcaaaaggataggttttatatactatgagatgtcctgatataatttgaattcatggcaatactgcatttgcctttttttttttttttaccatctttcaagagggctgcctagagataagaatttaagggccatgtgttgtatttttgctagtaccttgaaagaagtttttgctttgtttttaatggcaatacaaataaaatccaaaaatcctggacacatatgataagttcagttgtttatttgaaaagtaaatgcctcacatgccttgctcataccactttaaaatgggattgattgataaacacaaactctaactctcttacattaaagagtatcaacactctgaatttttaattatctttgataatccccatgaacatttttaggactcacacgtaaaatagtcaagtctatttcaagttatgtcagacaatgctttttaatatactgttcagtgcagcaccctaccaaaaactagtcctgtggttgctttatctaattgtgccttggtaagggatttgttaagagtggggaaaaaatacccccagaaatgctttaattaaacagcttcaaatacagccattgttcttacaacagaattgtgtaagtcttctccctgaagagaaatattgctgtagccaatatagctatacaattagtctatgtatattaatgtaaatataatttcattataaaaatgcttactcgtacagaatctaatttttatctgattattttttcaaacactggccagtcccatgagtgaaaatacctataatgtaaggtcagttgccaattataaaaaacattgtttagatggaaacccagggtattcacccaatgtggttattacttgtgcttacataatgaaatttgatcagcttgttttaaaataatctatttaggtcctagtattcacaatatctcttcccagaaataaagacttccttgaagaaagtaaatgatttgaactggaaaaacatgtaagaaatttaaaaaaattaaatatatatttattttaatatatgtatgaagaaagtttttcaagatgttatgatgaaattgattttctttgaggtccaaaatggcctttacatgaggtataggactaagattttagtaaaaagcacgtaccttggtcatcacagaattgttgggaatcattcagagaccatgtagaaatgtttcccagggtgagaaagactgaaccctagactaatattggctctgccaaaaataaaataaaataattttttaaaaattaaagaacttatggagggcacaccctttcattctgtgatttccacgtcaagaggtctcagtggagcatacatctgaaacaaatcatttaagctataaatttagtcactaagatcatctttagatccaacattgatatgttaatttatgaaatcaaaaagtaatatactttatagcttcctcctaaatcttagaaggtactggaacacccatactttgaccattcttttacgttcactaaatttcctaagagtgtcatggaaacagaagaggaatagaaaatctatcaggtaaccctgccctacctggcaaatttttgtgttgtagttgcttttgtttaacatttcttttatcagttaattatacgctgatagagattttagatggactcttggaactccaagaaaaaagaggttctgattcagatgctcttggaaatatagacacatttgagtgtcttaaaagcatacacgagacaaggtctattttccaaaggtgcagagcaagtactgaagcttctccacttgaaaacaacagtataaaaactaccattaaggccatttgttcatttgcccaaagtatccaaggagttgtttaagctttcagccccttatgcatttccatcaaatatgaatatgtgttgctccttctagtagttaagaccagtgacacccatttcttccttgatggtctatattttattgggtatttaattacagagcaatcaactacactgaaaaaaaaataacttgattcagttaagttcttaccccacaatgctcacaggctttactgattatacaccacctcttatgtgcaattgtctttggactaatcagatgtgatgggcttaatgttgtttttaaaccctaacaaatctggtcataggcaaagcaaacctgctaaagatgaagggactagatttaaatgaccttgctgacttccagacccttcttttgatcgtgggcagaatggatatgctcttgttgtggaatataactatgtatggatttataaaagtttgtcaaatgaaagttgaaagttctatattcactttacccaatttactagaaagggaaccaattttctcgttaattacaggctgttagaaaggcgtaatgaaatttcacaactgtccaactggtgcttgatgagaagattactatctatggatgagggttatgtctacagttctttaatctttcctttctttctttttttcctctatagtgtctcctctgtttctcccaaacatctgctctattccttttgatgtcctgttagtcatccccattccatgccactaccactgctctccttttacacttcctttcttctgtcttgtgtcttctacttactcattgcatcccctgaattgttgttgttgttgttattgctgtagtttaaacacatattgacctccatggttaccctgttcaccttttgtgtcaattcatcattttacaattattataatgtatcattttatttatttggaaataatatttatttggaaaaatgtatttatttggaaataaatgtttcatttccaagtttcatattagagcttggatactcaacttgtggtccttggaccagcagctgcaacatcacctagggacttgttagaaatgcaaaacctcagcctctaccctaggccttgagtcagaatctgaaattcaaaaagttactgaggtcactggtgtgcacctgagagtttgagaagcactgtgttggaatacattctcattaacagaagaatttacaaaatagtgttagttatttggtatttaatgaggaaaatggtaaaagatgtttagtcctttttttctcattacattggaagcatatgaggatgcagacatccttcttaactatttaataatgttttaaaaactttaatgtatggccgggtgcagaggctcacgcctgtaatcccagcactttgggaggctgaggctggtggatcatctgaggtcaggagtttgacaccagcctggccaacatggtgaaaccctgtctctactaaaaatgcaaaaaattagctgggcatggtggtgggcgcctgtaatcccagctactcgggaggctgagacaggagaatcgtttgaacccgggaggcagaggttgcagtgacccaagatcacgccattgcaccctagcctgggtgacaagagtgaaactgcgtctcaaacaaaacaaaacaaaacaaaacaatctttaacgtatgatggtattagctgtcatttaaagaagatttttaatcagtaggtcttgcaaacgttacgatttatcacatgtatacagtcaaaagacacaggtaaaaataaacttcaattatttcctttgaagtctgaaggccataaattatattatattgatgtttggttgataaatcaattatgtttgattattaataatactattataggtagtgtttgtggaaaatttactatttgacaaacagtgtacaaaacactttataaaagttaacttatttggtccttacaataacattactaaatttcaaaattacaactttcattttcagaataggaatctgaaggcaagtttcatagcttaaatagtgggcagaactgagatttaaacccaagtctgtctcatgctacaactgcagtttgtaaatcccatgtgttattacctccgttagtcgataatgtacagtttagttcatcagctatgctagtgatagaaaacaatgataccataacagcagcaaattataggcatttgtaaacttttcagaatgaaagttggtagttcttttaataatctcactggaataaataatctcccttcattttagtctttttatgttagacacgttttctccataatttctaagaccttcaaaacattgcaattatatattattaattattaatagcttttatttggtaactttgtaattatatttatatgagtttctctcctcagtattatgtattaggccgggcgtggtggctcatgcctgtaatcctagcacttagggaggccgaggcgggcagatcatgaggtcaggagatcaagaccatcctggccaacatggtgaaaccccgtctctattaaaaatacaaaaattagctgggtgtggtggcatgcgcttgtaatgccagctacttgggaggctgaggcaggagaatcacttgaacccgggaggtggaggttgcagtgagccaagatcgtgccactgccctccagcctggctacagagtgagactccatctccaaaaaataaataaataaaaactttagacaaatttaatattccaggattaattgagcaaataatgatttacaaatcagacagccctcagaaccaacagaggttcagaaatctccacttcacaatgtggacaggcagcctttatggacagaaaacagaagagctgtaaagagaccacttgatgagttacagtctggagcttgcctcccttgaacatggtatgatcagttggctacctgtgattgactgaagttcacctactagctactttgattggctgagactcagctagttgttatgaaagtctactcctgtggtagactttcagttagtttacatactaagttatattgtagtttgttacataaggactcaagtacagaggcatgcttaagtcaaatttagtttaacatgtggtagttagacccttagtttcagagtccaactcttcgggttctgatctgggctttagcatttattagatgggtgaccttagacatattagccttctctacttcaaatatctattagccttctgtacttcaaatatctcattgttaaaatgaggatataaaaaaggcacttatctcacagttttgttgtcaggtttaagttagataacttatgtaaattgcttaacacattgccttacaaaaattaaacactcaataaatagtaactattactattatattttgaaatattgacaatagagattttatcacatgcatccttttatatgtgaatgttggtatacaatgggtagttttgggaatgtgtataactgtaagcatgggcaacctatcagtaacttaaactgataatggcttattttatcatataaaaagaaatccaaactggggtttttgaaggaataaataaaattaacaaacctttagccagactaactaagaaaaagaggggaaacccaaataaataaaataagagatgaaagaggagacattacaaccgataccgcagaaattcaaatgaccattagaggctactatgagcaactatatgccaattacttggaaaatctggaagaaatagacaaattcctagacacatacaacttaccaagattaagtcatgaagaaattcaaaacctgaacagaccaataacaagtaatgagatcgaagctgtaataacaatcttccagcaaagtgcagcttcggactcagtggcttcactgctgaattttaccaaacatttaaagaagaactaatactaatcctagtcaaactcttccccaaaatagaggatgaggaaatacttccaaactcactctacgaggccagtattaccctgacaccgaaaccagacaaagacacatcaaaaaaagaaaactataggccaatatcccagataaacattggtgcaaaaatcctcatcaaaatatgagcagacataattcagcaacacattaaaaagatcattcatcagctgggcgcggtggctcatgcctgtaatcccagcactttgggaggccgagacgggaggatcacttgaggtcaggagttccagaccagcctggccaacacggtgaaactccgtctctgctaaaaatacgaaaaatgagctgggtatggtggcggacacctgtaatcccagctactcaggaggctgaggcaggagaattgcttgaacccgggaggcggaggttgcagtgagctgagatcgtgccattgcactccagcctgggcaacaagaacgaaactctctcgaaaaaataaataattaaaaaatatcatttatcatgaccaagtggaatttatcccagggatgtgaggatggttcaacataggcaaatcaatcagtgtggtaaatcatatcaaccgaatgaaggaaaaaaacataggatcatttcaattgatgcttaaaaagcatttgataaaattcaacatcccttcatgattaaaaaaaaacacccttaaaaaaaactgggtatagatggaacgtacttcaacacaatgaaagccatggatgacaaacccacagctagtatcatagtgaatagaaaaaattgaaagcctttcctctaagatctggaacatgacaaagatgcccactttcaccactgctattcagtgtagtactggaagtcctagctagaggagtcagacaagagaaagaaataaaaagtatccaatttggaaagagagaagttaaactggccaggcacggtggctcacgcctataatcccaccactttgggaggctgaggcgggcggatcacctgaggtcaggagtttgagaccagcctgaccaacatggagaaaccctgtctctactaaaaatacagaattagctgggcatggtggctcatgcctgtgatcccagctactcaggaggcggaggcaggagaatcgcttgaacccaggaggcagaggttgcagtgagccaagatcatgcctttgcactccagcctgggcaacaaaagcaaaactccatctcaaaaaaaaaaaaaaagtaaaattatccttgtttgtagatgatatgatcttatatttggaaaacactaacgactccacaaaaaatattagaactgataaacaaattcagtaaagttgcaggttacaaaatcaacatacaaaaatcggtagcatttctatatgccaacaatgaataatctgaaaaaagaaatcaagaaagtaatcccatttacaatagctacaaataaaataaaatacctaggaattaaccaaagaagaaaaaggtctctacaataaaaactataaaacgttgaataaagacattgatgaagacacaaaaaatggaaagatattccatgttcatggattggaagaatcaatattgttaaaatatccacactatccaaagcaatctacagattcaatgcaattcctatcaaaataccaacaacattcttcacagaaatagaaaaagcaatccaagaatttatatggaaccaaaaaatacccagaatagccaaagctatcctgagtgaaaagaataaacctggaagaagcacattaccgagcccacgttatgctacaggccactgtaatcaaaacagcatggtactggcctagaaatagaaacatagaccaatgaaagagcatagagaacccagaaacaaatctatacatctacagtgaacttatcttccacaaaggtgccaagaacatacattgagtaaaaaaccatctcttcaataagtggtggtgggcaaactggatatccatatgcagaagaatgaatctagacctctatctcgaccatttacaaaagcaaaatcaaaatggattaaagacttaagtctaagacctgaaactatgaaactaccagaagaaaacactggggaaactctctaggacattggactgggcaaagatttttagagtaataccccacaagcacaggcaaccaaagcaaaaatagacaagtgggatcacatcaagttaaaaagcttctgcacaacaaaggatacattcagaaaagagaagacacagccccaagaatgaaagaaaatattagccaactatccatgtgacaaggcgttaataaccacaatatacaaggagctccaacaattctatgggaaaaaattaataatcaaattttaaaatgggcaaaagatctgaacagacacttctcaaaagaagacaagtaaatggtaaataggtctatgaaaaggtactcaacatcactgatcatcagagaaatgcaaatcaaaactacaatgagatatcatcccaccccagttaaaatgggttttatccaaaagacaggcaataacaaatgctggttaggatgtggggaaaagggaacccttgtacactgttggtgggaatgtaaattagtacaaccactatggagaatagttttgtggttcctcgaaaaactaaaaatagaactaccatatgatcttgccagccccctgcaaggtatatacccaaaagaaaggaaatcagtgtattgaagtgatatctgcactctcgtgtttgattactgcactactcacaatggcaaagatttggaagcaacctgtgttcatcaacagatgactgaataaagaaaatgtggtacatatacacaatggagtactattcagccataaaaagaatgagaccctatcttttgcaacaacatagatgtaactggaggtaattatgttaagtgaaatgagccaggcacagaaatagaaacattgcatgttctcacttatttgtgggagctaaaaattaaaacaattgaactcagggagatagagagtagaatgatggttaccagatatgagaaagggtaaattgggagggggagtgggagtggttaatgggtacaaaatttagttaaatcaaatgaataagatctagtatttgatagcacaacaggctgactacactaagcaataatttattgtacatttaaaaataactaaaagaatataattggattgcttctaacacaaaggataaatgcttgaggtgatagatatctcatttactatgatgtgattgtcaggtattacatgcctgtatcaatacatctcatgtaccccataaaaatatacacctactatgtacccacaaaaaaaaatttaagaaaaaatctaaaggcaggcatatgagaactgatgtgccactaagcattaaggtttctttcatttttctgccccgctatcttttaatttgtaagtttcatcctcatgttcacagaatggctgcagtaagctggatattacattcatatttcaggaagatatgggggagaagagcaaaaggggaaatacaaaaacctgggaatgatggggaatgctatctgagtctgtccatgctaaaaaatccttcctggttttcctatgaaaagatttctgcttccatcatcttggcaaaaacctggctaggtagctacccctggctgcgggaaagtctaggatggtaagtattttagttttctattctctatataaaggaagacattggaattgaatggctttggggtaattgattcataatatctactatagtactcattaatcagtcagcagccagtcaatgaaccaaagaaaaaagtcaatatgaaaccctttaaatgaagcatatcaaacctttttaaacaaaatgaaattcatgtatatttaaatatgatgatccctcttacccagtattttgccactaaagtgttagaagtaaggaatgaaactttacacagataatttattttggcagcattgctatggtgctaggaaaaaaattgtccctagaacagaccctgaaaacaactgctcatagcaaatactcataggtgtttctgctgctacagataatcacagaagttgccagaaattaaaatgtgcaaaggataaatacaaatctttctcctttgcaatgttggagagatcttgcttcttttttaacctccataattttgttgccctgttttgcagcatctttgcaatgtttctgggacagctcagtcatcaccatctcaatctcattcaccacagaacaagtgcttgtcaattgtaaatgtgtaatctcaggaaattcttgcctgctctcttcatctctggccatttgtcctccaacccatccattcatagtgctgttataagcttcccaccccagggttagtaatcttccagggctctgtttcatccagaaagccatcaatgggctgtacctgctgcagggggatctttcactttccacacccttacagcctcacatttatgaaagtcttctccaaaaaatcttccttattctattttgaaggaaataccttctacctagaatatgtttcattaatcctcaaggcaagatataattcttccatcaacttgacttgaactaaactgacaccatgctaattttttctttccattctttcctcattgtcaatatgtttttactgattccttgcttcattcattgattcatctggcaaatactttttgagcatagaatatgtgcgagaacttttgtgaaagataggatttatagagatcaagaaaatttagggcatgttctcaagggggtcacaagcttttgaggaggaatgattctacgtttatattgggatagcctctggtgttttggaagtcttgagctgtaaccgaccaacctttcattctccctttccatcacccctttgccaaacacacataccttgctatgaaaaattcttaagggcaacagggattcattctttccttttcttttggctttacatcccgttctacaaggactcagtgggattctaaaaaaaaaattattttttctaaaatattctggaaaaatatttggaataaaattgagatggagtgagataaggatattttcttgacttgtgagaaaaataacacaaccaaacatcatacaatgtgattcaatgaagattcatgaaaaaaatacaatttcaaacttcagaaattaaaaataatagacctaataatatttccctttgtatgtatgtggcatgatgttgttatattacttggtagcagagtggaaatttgagcataatctaggttgagagaaaaggtcattattcttagttctgtgtttttccaatatactgtgttcttcaaaatataccaaaaattataaatcagtaataattgatactttgtacagatttttttattttatattttcttgtttctcttgcaatatcttttctttgattttttgtttgtttgtttgaaacacgtatttgccactgttcaactcttacacctacattctcttttgcttactgaggggaaatgggccccataaaataggtgtaactcagtatctcagttcatgttcaaacatgtataaagatgacctctttttctattcttgagcaaaaactaaatgctcatgatatattcttttatgtaaaatctagttattcaagttaagttctaaatgaatttttcttcatcttatttaagagtaagtactttttttcttccatagtactaggtaatcgttttcagtgatctgaaatacttacgaagaagttaggatctttgcaactgtttgaatctcaaattattatttgttctctgttggctgtaagagctcactcattggaattacaaaaccctttctctttatagctgaaagcgtttaatgtatgcaaacttacatttggcttgagaacatttttaaaaataaacttttcaaattggaatgttcttactgaattcaggcttttatgatgctgtttgatttggcatatgttcctcctgatatctgcattgaaaacactttgcatttgagagacttttcctgccttattgggacatttcaactcaatttatagttatcagtaggaaaagaaagaaaacatttccatccaaaagaggtttcagtaggatttagcagtaagtgctttaaaaagaacaacagcagcaagcttgaacctttgcccattaaaaaaaatatatcaaaaacaaagaaacattacaagattctctttccctttttaaaggatccacagaaggaaggttcttcctagtctatttgaaaatatatcagacttactcaagagactttttttgtctattttacctgatccacttacattcagaatcagtctgaatttattacacaatgttacgtttactgctaaaatgctggtcgttggttcaatacttggatccttcagagagagcacatatccatcaggatgcatttggctttacgtaatagtcaatttttggaagtttagaccatgaagatgactactctttacttaacagaagtctggggtaggtgttgctgtggttggaaaggtgcatgtatgataggtggacagctccctgtttctttataaatggcacatacctggagaactagcacataggtagctcaataaacagaatgttaccaggacccccagaaactccctttttattctgttttggttctcactctccaaaggcaatcagcgttcagagttctgacaatgtaagttatttttcctatttttgtaccttttataaatgcaattatgcatgatatactcctttgtgtcaggcttcttttcttcaacattatgcttgtgagatttactcacactgtggcttgtagttgtagatagttcattctcattactgtatagtgttacagtgtcagaaatatgcaccaatttatatgtctattctactgcttgaggagtttccagtttatggctattacaaataatgttacaatgagcattttgtttttgtttgtttgtttgtttttttgagacggagtttcactcttcttgcccgggctggaatgcaatggcatgatctcggctcactgcaacctccgcctcccaggttcaagcgattctcctgccttagcctcctgagtagctgggattacaggcatgcgccaccatgcccggctaattttgtatttttagtagagatggggtttctccatgttggtcaggctggtctcgaactccagacctcaggtgatctgcctgcctcagcctcccaaagtgctgggattacaggagtgagccaccacgcccagcctatacaatgagcatttttgtatatgagcatttagtatacgtctttgagtaaatacaaacatacaattcggcttgatatatatctaagaaaggaattactgagtcatagggcatacatatgttgagcttcaatgacgctgaagagaaaataacacaagcaaacattatgcaatgtgattcaatgaagattcatgaaaaaaatgcatttcaaacttcagaaattaaaaataatagaccagttttccagagtaagacatctttttttttcattcttagatcatattttgcgttttgtaaatgcgtttcccaatcagcagggaaaaaaatataatatgcaaactaaagcatgtatacaatgaattgcatttagtttaaaacaaaagatttgaaaaacgtaggaggagagagttatatttgtattagttcacaaaagaacatattcaaaaaaaagcaaataattgtattttgagtgtatcatagagttaaaaaggatggagtcaggctttttgaaaattgacttgttttccttctccccttttaaagaagataggttattgaggaaaaataaatttttgtcatttcagagagtacctgttcttttttttttttttttgtagaaaataaaacccacctataaaacatgaagattaagcttggggtagctcaagggaaatgactcaaaccatccaaacacttgttttttcttttttcagtttttctaatgtaaagttaaatcattaaataaaattttggtagctatatttaagtctcccttattttattttttagtaatattaaattattttaggacgcctgattttgtggtaagaaacatcaaaggtcttgatataatttttgaccgatgggctttgaatcaaccaattctagcctgtgggtagaggacagagcactgctgtctcttgcatattaacctttatggggctgctggagttgtggacattgagtatatagtgctagtttgtactcggattgatttattttcaaattttcaaaagaatatctaagttcaatgatattcttttagtttatctctcactgtcaaaaagtctcctccaatgtcattttaagtgagaaagttaaatgatattttgaaacactggcttggggaaaactgcagttcagtttgcttcaatgagaaggaaaaataatttccaatattagattacagtgaaaagaaatataaaagagagttttactggaaggtctgccttttatccttttaacgtttcatggaactagaataagaatatcccattttgtctaagatgtacctttaagcaactttttaagcctcaaggcacttatcttatacattgtgctcttcagctgtattaccagaagtcttttgtttaaaaaagcctttggtaaaattcttcaaatatgaatttaagcctgaacaacaacaacaaaaaggtacttaacattgctgcctttctttatgtaatgatcaagtcctcccatgttctcctttatatcagtaagccattttcttgaatccctttctaaaatgaggttaaagaaaaatgtgacataaatcctatatgtatgttctgatttttaaagggtctttatctttacttttactggttcgaatatagaaattatctcctcccgtttccttctcctcaattagctgccaatggtctggaatttaacgattttacctcatgtgattctatttgtttgtaatcctatattcaacattgtactgaagtctgttaaacattgataagccggtttttatgcagcaggtcctcagagagcattgcactaaaatgctgcaaagactgggattaggtttacgtattgtaaggtggtttcgagacgttttcctagtgtctgttctttcaaaggtgccaaatcaagttggccttgatttaatattgcgaaaattgtaatgctgagctgacttggagcttcacgtacttcaaaacgagtttttccgggggtgatttaacaaacagttctaattttttgagtgctgccgaatgtaacgcacatatgggacattattgtgtagtttctgtgagacgctgaactctttgccaaaaacttaagtttctttcattgctattcaagttataccttcttctgttatctcttgccaggattccaacagcctcagctgatactggtttcatttagtaaggagagtggcattggattgtatttcttctgatttttacaaaataaaaatcctcctgcatcccatagataaccactattagcatttgggattatatctttttcatatgtttcctataggtagatataaattttgaaaaaaaaggtattttgtttgaaagattcttttgtaactcactttaaaaattttttattatgtaatcatatatataaaagaatatatatgcatatatgatacaaagaataataaaatgaacacctgtgtaaacaccacctaccttacagaatagtaccaatgttttgaacccccatgtgtctctaccaaatgttcatcttttccctatcttgcaaagataactgcgcttctgaattttgtatttgtcattctcttcctttaaaaaaactgtttcactaaatacatacgtgttcctaaataatatattgttagtttgggtgtgtttttgaactcgatataaatgtgataatgcatataatcttttctgactcgtttataattccacattttctccgaggtgcctccacactgatgagtacactggtagttccattgttttgactgctatttagtattgtatgatataaacatatggtgctttttacttaagttcttgttgatggtgggtggcttgatctcaacttttgcactgacaagcaatcgtcttatgaaaattcctgtatacgtctcctggtgcacatgagcaagaatttcttcagggccagtgactagggatgagactgttgggttattagataaatgcagtcaaacttcaaggcgatgccatattattttccaaaatgattcacaaataacgctaagatgtcattgtgtcaaagtttctacactttcctcgatccttaatattgttctaaagccttcataaaatactatctcattgaatttacatttccctgatagtgatgttgcacatcattttataagaggtaactatctgtccctcctgttctgtattataattttcatcagcttttatattgttaaatattttctccctgtttgtaggttgtattttcacttttcttttttttttttttttttttttgagacggcgtctcactctgtcacccaggctggagtacagtggcgccatcttggcttactgcaacctccatctctcaggttcaagcgattctctcacctctgccccccgagtagctgggactacaggcaggcaccaccacgcccggctaatttttgtatttttagtagagatggggtttcaccatgttggccaggctggtctagaactcctcaaagtgatccgcctgcctcggcctcccaaagtgatgggattataggtgtgagccatggcacctggccatattttcactttattaatagtataatttgaagattagaagttcttaattttaaatattatcaaatttattgttaatatttgccttaacggttagtgatttgagtctcatttaaaggattatttcctaccctaagatcatacaaatattctccaatattttcttctgtaatgttaatacattttctgtttatctttataatctaccaggaattgagtctttgaatggtgtgagtgatttgatttcttttttttttttttcaataggaacagtcaggttttccatcactgcatattgaagagtctattcttcccctactgaactgcagtaactaccctggtcctgtatcacatgtattagaatagaaccagctgctataataaatattcgccaaatgtcagtgacccaatacagtgtgactggttttagtcaatgctttcctccacttgcttatttaatgacccaaggtccttctctttcatgtctgaccattcactaggacattatagtctactgcagccagctggcagatggaagaagaaagggtagagaaggcatgtcaactttggtttttttttttttttttttttcctgaggtggagtcttgctctgttccccaggctggagggcagtggcgagatctcagctcactgcaacctccgccccccaggttcaagcagttctctgggcctcagtctcctgagtagctacgattacaagcgtgtgccaccacgctgccaccatgcccagctagttttttgtatttttagtagagacggggtttcaccatgttggccaggctggtctcgaactcctgacctcgtgaacctcccacctcggcctcccaaagtgctgggattacaggcgtgagccaccgtgcccagtcagcatgtcaacttcttaaacaccttgtttagcaagtgattatatcacaaccgttcataatccattggtgaaaactagtcatttagccctatgtaaatgaaaagattgctgggaaatgttccctgatggaaagcagcttctcagaagcatctctatctacagtgtgggataatatgaatttggggtgtttagctagctgtctcaattatatcaagttttcgtatatgcactggtctttgtctggtagggctagtccctcctctttattgatcttcttcaagtgtgtctcagctattctttgtcccttttcaagtatcacaaagaaaaaagtcactgtttgaattgggaagctctgaatctacagggcagtctggaaataatatatttacataatgaggctacttacccattagcagtgtacctctctgtttacttacatggtctgaaatgtctttcagtatactttacagtcttattcaaaaggtcttatatcacttttgttggatttattcctagagattctgcttttttgctactattataacctgccttttctaaacttccctttcatgtctgccaatacatagacatgaaattgatttttgtatgtaaattttgtatcttgacatcttggtttggtttgttattaattccagtaatttgtgttcagaacttttggagggggcttgtatgcagatgatcatattatatatgaataatgataagtttttatttctcttctaatttttatcttttatttgcttgtctaactgaaaagcagtgataggcatctttgatttgttccttattttagagggaattattttgacatttcatcatcatatatagtttgctctagtttttttgtaatgcattatatcttctttaatacattgcgtgattctgtttgccaatatcttctttagaattttccatttatgttcacaagtataatattagtttatgattttctgttcttatactgttctgtgcttagttttggtatcaagattattctagcttcattttggagttgaaattttcccattttctgtttcctaagaatttcttatgagtttggaatcatctgtttttcaaaagtatagtagaactcacccataaaaccatttgaggctgctgttttctttaagaggacattttaacgctaattttgattttctaatagttaaagagcttttcagttttctcagctcttcttagatcagtgttgataaattctgtgtttcaaaaaatgtgtttgatttattttagctttcaagtttatgggcatacttccttcatggcttttaaatctcttgtgagaatatatgcacacctcttccctttattgatgtcttctttccttttgtcctgatcaatttttcaagtaatttaaaattttgtctcttcaaatattgtctctttaaatattggatattttgaagttctatattgatttctgcccatttatttttttttctgctgctttattagtatttgtttggtttttcttttgttggtttgtttgtttttttgagacggagtttcactcttgttggccaggctggagtgcagtggtgtgatctctgggctcactgcaacctctgccttctgatttcaagcaattctcctgcctcagccgcccgagtagctgggattacaggcatctgccaccacacctggctaatttttgtatttttagtagagatggggtttcaccatgttggtcaggctggtctcaaactcctgaccttgtgattcgcccgcctctacctcccaaagtgctgggattagaagcatgagccactgagtccagcctatttgtttttccaattaagtgtttattatgtgtatttatgttaactttctactataaatattacgaatttttaaaattattccttaaaggacctcaaatattttgctcatttacttctactatgtttacatttccattatgatttcttcttttacccatgaattatttggaactgtatttttaaattttcaaatgtattttcaggttatctgtgttatttctgtctaatttgattatattgtatggtatcaattttttaaaattctgagaatgttttattgcacagtgcatgacagctttctgcaactgtttcatatgtgcttaagaagaatgtgttgagtacacatttggaaacgtgatttttgcaggttcattaaatcaggcttgttgattgggttaatgggatcttccacatgcatgtgttgaaatgacccactaagctcccagatttgattagttaccttgtagttctgtctgtctagtttcccctatatatgcggaggctgttttctgaactcatttaaagtttggaataattttattcaccaggaggattgacctttttattgttatgtagtcttttgtctgatatattattatataatttatatgttagctttcttttagtttgtattttcctggcatatctttagctcgtatcctcaagttttctgttctcggtgtttatatgtctctctctcccttataaaaagtctattgctggatttaaaaaatctgtaactccacagatatcctgtctgaccacttttgcctttcatatagggcttttagttcactcatattttcatgtatatttattacaattacttttatacttgaacttatttatagcattatattttctgatgttgactttctttgtctttgctcctctttttccttctttactgccttctttttgagtggttgagttttatattcttactctaattttccttcttccattttggaatttgtgcactctttctattattttaggtgttactcttaaaattttactatgggttatttagcaaattaaagaataatcaatggtttagtttttctttccagataaattaagaacctttatgaataataacttctctctcattgtacccgttctcattatccagtgtttagttctattttgtatactttaatcttcaatattacatattatagctatagttttatataattaattttatttaaatgtattcacatgtttaccacactctttgtataccatttccaaaatgcttgggtaagaattgatactttgtccaatagcaagggggggattatggacatttttcatctgaggaaagacatgatcaaaatgatactttaggaagattaatctgatgcagtcaaaaaagaatggagggaggaggagatgataagtagaaacacaaattaaaggctatgacccgggaacttggtacaatgatttgaactagaggggtggtaaaggagaaaaggagtaagaacaggaagtaaaagtcactgtgaaagaggaatacacagaaattaacaagtggtttgcttgaagtattgaagaaaacaaaaataagaatgagatttttgaaccaaggttactgaaatattggtgaaatattagcaagtaggaagtcagagaaaagagctgctttcaggagaaagataaagaaatgcccatggcatataccaatgatacactcagcacagaggtctacatacaacagagtacttgtaaatacaatagggtacttgagagaagttaagactggggaaataggtgttatagtggtaagcatatatgggtcattagtggagaaaaatatcgaagagagtgaatgatgtcaaataaaagtgctttgtgtaatgttggacagagatatacccccaaagaaaatgttcaaattttgaaagcccaacaagagtcagcactggagatacagaagtcaagtcagggagaatctgcttttgtggaatatcatctatatgtggtactgagatagatatttcatatatattacctgatataactatcaaatgaggaggtggtatggtaccagtggaggagaatcattcaaaaagaacaaggtgttcagcagtgtcaaacgatgcagaagcactaagatgagaatgagaattaaagaagatgtaattgtgtgattaggatgtgattgaaacgtttgcagataatgagttcccagggaaagagacagaaacaaaactgtaaggacttgatatggaaatgaatcctgtgccagtgaacactgaaatgcaaacaagacttaataattcagtgacaagggattgtagcaaggctcagagaagatgcttctgatttaaaatagaatagctaagttatgtgacgaccatactgtctatacataatagacactaaatttatttgttgaatgaaaagctaagtgttcagagtttgaaaaataggaaccagagggaaggacaaataagcaattgaaagttactgaattgataagttctgtgatttaaaaattccagcaatatctgtaagaaacacaacttcgtggaattctacagataaagcacaagctttggactttttgtgatttcttttctgtacgtgtttttaaatgtacagcaagtgtaggaagataagcgttgataaaacattacttgagaaatgttaatttgctattaataacaattgacatttaccattttaaaggccaaagagaggtgaattttgataaaagataggttcttacttggaaacgtgtatgcaagtacactgaagaggtcttcttaatatagcattttataactcatctcaaatgttagcagccctgtttttcattcgtttccaaaactcatcaaccccagtcataataccagccacttaatacagatcccataagtctgtcatgtgttgtttacttaaatgtgactgtttctgatgacttttaaagtccccaaagcagttttgtccacgttaattttgctctgtatctcagcattcattgcagtacctattgaaagtgatttcactagcataagataaaaatttgatgacacatttaataggcttactctcaaacaacggattgactcaaatattatcaacaatgcaaggtgggctcttatgccaagatgtgttcggtttttcaaattttaatctaacgcctgaaatttgtgttgcataaatgtttgtcttattctgtgtataacatatttgcatatgtatatttgtgttctgtataagtacagaatagttaaaatgtgttctctctatgcttacataaatgtagcagtgagatattgataatagcaataatagctacatttattgattgttaagtgcgaagctctgataaaaatgttttataggtatcattgtacaaatcattcaaataaacttctgtggaacatacaatggttattcctattttacagaatggggtgaataaagggacacagagaagttaaaataatttactcgtggttacagagccaggaagttctagagctagatttctaacccatgcatgctcactctattgtgtacccagtaatcaactggatatactgtgattttatattaatcaaaatgcaaagatgcagaagttgtgagaaaattccctatctctagccatttattttcctgaataaaaatacatctataaatttccccttatctgatgacatcttaaggaaatggtcatgtaagccaagaatatatattatagtttactactaagttgttagaacaagctaggcaccagtttatatagtctagaacaatatactcaagtactgatgcttattatgcccaggtggtagtggcattatttgagaggttatgttttgtgtgaaatttctactttaaaaaaaatgaatttgttttgacaaaaaatataaaatgggcaagagattttgaaacaagtttacctagatttgcaacaatatatgttagaaactgtttgctttgattatacacacatatatgatatcctaacatgtatgaagcaattctttagttgatagtgacttatcttaaaaatgtataatccaagaatcatggagcattgtatttagaatttaagagtatacattttaacaaaacacataagaatataatttttatacaaaacgaccaaaactgagtctttaggatcatagtttaaaaaatgcaatatatgttctcataaatatatgtaaatatgtatcatatatagtaaatatatagttacataaaatacatatatttacatagatgtaaggatgtataaaatgtacccttaaacatgtttaaataataaaagaacacataaacattatacctacatttattttattctatattctataattctccaaaagtgggaaccattttcttacaattacttatggacccaaattcctcaaaattaaaagatcatttcattggcacacttacaagagacttagctgacaggggtagtttttaaaatcaaattaagtggactccagtttcagattcatcagttaaggagcttagaaattaccactcaattcttaacaagtaaaaagctgaacaaattgaaaatcaacaacttttctcagatctgtcagacaactgaggtcacagggcaaaaagctgcccccaaaattgcagaaacagattgatggatacaaagaatcacaattttctgagcagaaacctccaagggaactagttccagggtacaaaaacctgtaattgacgaatctttggaggctaagtgtggaccaagtctgagagttaaaaactacaggacagcccagtcataaatcatagtagggggctgatgcttttgtgagttttaccttcaggagccttaccaagtcctaatagtgagcatcagagaaaaatccctggtgcatccatcaaggaaagggggaaaatacagattttgaattatacacaagataattctgttgttagcaaagtctgcccttaggagaaactatttttccagaccctagccttatggggtttaatcagagcctaacctacctggaaggaattgaaataattcaacttcagctccttctagtattctacaggggcatagggaaataacaaattccaccccgctctggccatcctgcccacccaaagagggaaagaaaacaactcagactcacttgtgaagctaacagtctaatcacacagacttacccaagatagtttcttttgctgtgcagaagctctttagtttagttcggtcctacttgtcaatttttgtttttggtgtacttgcttttcaggactttgtcataaattcttgcccaaggcagatgtctgcaatggtgtttcttaggttttctgctagaattattatagcttagagacttacatttaagtctttaattcatctcgagttattttttatatatggtgaaagacaggggttcagtttcattcttctgcatatgactagccagttatcccagcaccattgattaaataaggagtcctttccccattgcttatttttgctgatttggtctaagatcagatggctgtagatgtgtgactttatttctgggttctgtattctgttccattggtttatatgttgggttttgtactggtaccatgctgttttggttactgtagccttgtagtatagtttgaagttaggtaatgtgattcctctgattttgttcttttcacttcagatgactttggctattgaggctattttttgggttccgtatgaattttagagtagtttttttttctaaaattgtttcaaatctctacaatgtcttccagaagctagaaccagaggaactagttcttaactcattctatgaggccaacattaccttaattacaaaattagtcaaagacattacttgacaagaaaaatgcaatccaatttctctcaagaacatagacgcaaaaatcctcaactaaatattacaaatgaatccaataatgtataaatagcatcatgcatcatggccaagtgggatttatcccagttatgcaaaactggctcaacactcaaaacttaattaatgtaatctaaaatatcaatggactgaagaagaataatcactttatcttatcaatagaggcagaaaaagcatgtgacacatcccaaaaccctttcatgataagaagtctcagcaagtagggataaaagaaaacttcctcaactcgataaagaacatctacaaaatacctacagctaaggtcatagttaatggtgagaaacaccaagctttcctgctaagatcaggaacaagacaaggatgactccactcaccactgcttttcaacatcatactggaagtcttagctaatgcaataaaacaacaaaaaaagaaaataaaaggtacagatgctccttgatttatgacaaggttacatctgcaaaaacccctgatcagtagaaaatattgttaagtcaaaagtgcatttttcaacttaccatatttttcacttattgatgtgcttatccagatgtaacactatcttaagttgaggagtgtactgaatgtgtatcccttttgcaacatgataaggctgaaaaattgcaagtcaaaccactgtaagttgtagactatctatatagacagggaaagaagaaatagaattgtctttgttttcagatagtatcattgactatgcagaaaaccctaaagaattgacaaaacagcagcagcaacaataacaaaaaaacacctggaacatttccctctgatcctagacagaaaaggttctccacctttaggtccttaaggactcatgtgattcagttgagaccactcagataatccacaataatctcctcatctcaaattcttaaccttaatcacgtctgcaaagtcccttttaccatgtaaatttgcatgttcacaggttgccaggattagaacatgaacattttcgcaaagggctttgttttgccttctatatccagtcaattacttccagttaaaaaacttatttatgttatataacacttgatatttgccaggtgttatgctaggtgatatttaatattttaaaatatctgtgaaattagtgatatcagccttagaaacatagatggaggggttggtcaccactcattatttaatgtaagtaacttatctttgtgtttttatgtaattattctctgaaatactcttattcaacaagcaagagtattcatccagcattaggaaaatattttatctttaaatttaactagaactataacgttttagaagtaggccatcactatttaaactcttaaaaagtcatagttaattaacaccctcatatgggtctttgattatcgctataataaaatctccatttatagataagagcaatgtgcatcacatgtaatgtaaacctgtattaatagattagatgaaatattattttctaactgtaagagttaattactctgaacaattccacaataaatagtcatagaaattgatttgggatatatacatctctctctctctttctctctctctctcacacacacacacacacacacacacacacacacacacactcgccccccccacccccaccccacccacacacacttctttctttgcttcttgcctggctgtaaatcggctatttttccatatcccatcatgagcctaaagggaaacatttgtatatttcaggctcctaggaaagcattttgaaaattcatttaacaaaattgggcaatatcaatgacttcaaaattagcaatggcagaaaagaagtagtaattaatagcagcggaaggattaaaatgtgttaagattaagttaaacatgtcgttgaatcactgtaagagactgctgattgcagagcctcttagtgtttgatattactctgacttgatgctgtggaattatatttctgaaataaatagttcttagttctgaggttatgctaaaggacatgttcaggaagagctttcctttcttactgcctagtcatacccttaggcaaagaagcagtaattttgaagggacaatgtaaaatagaagaataggcaatcttggatatgtgtagtttcacatttcatgtttatagatgtaaaagtattatgttaattatagaatagcacgttttatttatttatttatttatttatttatttatttattttttgagatggagtctcattctgttgctcaggctggagtgcagtggcgcaacctcagctcactgcaatctctgcctcctggtttcaagcaattctcctgcctcagcctcccaagtagctggaactacaagtgcctgcccccacacccagctaatttttgtacttttagtagagtcggggtttcaccatggtggccaggctggtctcgaactcctgacctcaagtgatccacccgcctcagcctcccaaagtgttgggattacacccggcccaatagcacattttaaagtgaatttatgttcaggtaacatgaatagaaagatttcttgaagtttcaaccagcttctgaaactttgtaaacagattaaataaaatttgatgattaaaatatattcagttaatacatatgaaaagattcaactgtaaaatatgactaaggcttcccgctaataaatggcattatgacgaaatctgtagtaaactgtgggcaatgtatatggatatgattttaaaatcatgagaaagctcattactgttggctatgtcattatagcatgatttttttccttataatatgccaatcaagagtaactatgttatgttaaaaggagaaaatgtggtgttttaaaagtgataaacctgatgtatttaaaaattttttgagatttcctctggagctgcactgcccaatatggtagccactggccccatgtggctgttgagcacttgaagtgtggctagtagactgagacatgttgttagtgtgaacacacactacgtttcaaagacttcatatcaaacagtaaaatactttattattaattttaatattgattacatgttgaaatggtaatattttagatagattgtgttaaatatgcatattattaaaattaaatttagggtttttttcacctagtttaatgtggctactagagcatcttaaaattatacatggggttcacatttgtggtctgcatcttatttgtgatggacactgttgttctaaactttcctaattactgagacatttcccttcatcactttttgggatgcagttttcatttataagttaatggtaaaactgcacaagtaacggaaatatacttaaaagatcaaaatatgaaatttagcactttcaaaattcctcatttaatgcttgagtcaatccttggaaaataattgatccagaggatatttacaaatagtccatcatcaaaaataaagaggggcatagaaggtactagagctctatgtataaaatcctgccctctggcctattctattatactcagaagagtctgtgtcactaatatatagtaattatcgtcggaaattatttgctatattaggattccctatggaaaagtgaattgattgaaaagatttagcaaagagttaactatcaactttggtttttaaataacatgtgaaagctaacttactctaatcactctgtggccataaaaaaggctctgcctccaacctccagaatctacatccaacaagaagtcttggtgaaaaggattggcaaaaagactgcaggttctggcaagggtttgtaagtggaccaacgaattggcatttgaaattgttagtcttataaaatgaatcattgagactggaaggtcaatgtaattggcaagccatgtgtcacctttttcttgggagaaaaacacatcatttccataaaaaagtatagagcatataaaagaataagaaagtaatgataaaacagaacttacagtgacattaaacagaaaggtatttatggtaatggatttggtactgaataataattaggctaataggataaattgctcacaaatggtacatttgggcaggaatagtgtattgttcactaatgtatctacaaaactgaatctaatgcccagcattttgtggaagggaaaaatgaattaacgactaatgtcatatatacataaactagctatcaacaagacaagctagggattagagaagacagggaaagaggaagtaatgctgatgcctctaaacatgaccaagatttattcttcactccttttagtgttttcaacgttaattcctgtagtgttctcttgccttctcaaaccagacttatttttaaagcagcttaggctgagtagcatatttttataaaatggtcctctgcgccatttctaagaatcataggtcaaattagtcaggctgctgttctaacactgataattatatccacctcctaccaaaatctgtagttaattggtagaaattcaagctttgtagattttagttgttaaaagcgtcacatggagaaagtacaaaggctgtcctaagtaaatgactttaagattgatttttgaagccttttctttactcaaaaaaagtaatggccagcttaacaaatgcctccagatgaattgcttgttgtgttcatcattattatattacacattcccctggaaactgcagatgataagggtgcattttattctgaatgttgtgtaaggcacactgcattttgaaagagttcagtgatgttaggataaatgtgtatgagaaatacgtttgaatagattcagtaagtctattcactagtccctttttcaccatttgctgtttggaatcaagtttgggatgttccatgcatggtcatcttactttagggtatagaacatcaggagtttaagaaactggggtttttgttttgactgccatcattttgctgtgtattacttgacaaggaatagaaggggaggcagggattagatcaagcaaagaagtacccagtaagaaagacctttcaacaatgtataaagaatttattttaaataaatttctgaaatggttaaaaaaaaaaggcagagatgagttaggtgaggtgagtcaagcaaggtggctgagggtttagattttggaaagtcacaacataaccttttacaactgaaatacatcatctgtaccatgcggataattgcatttatgtcttggtggtgttggaagaattaaagggtataatatatttaattcacttaatagagtgcctgacatatattaaattttcaaattgttgttagagtggctgcttcaaagaatagctaattttacagtatggtatcatggacacagactgtcaaaagccaacagaataatttcaaattcaactttttttccacatatggctttgtgagttgagtgcatactttagtcaaaaatatgttttcacagagtgataatttctaggggtgattaaaagtttgattataaccactcttgggtttcataatctaaaaacattttcagaaagtctgtgattaatttttcccatttaaaattttattctcaataatgtgcagtattaaatagaatttcacaaggcatcttgggagttacgctctcacatattaaactacacagaaaaagttatatgtcatagctggtcaagaactcagagcaaaatgaaaagataagcagatagtgcaatgtggttcatggtccttaaaagaccttttaatgtggttggttattttctaatgaatgcaagtaacacattgaatgcccacctatgaacagaaccgaaattaacaatttagaaatgtgaaagtgacataaacttttactttcaccatttttcacagggtcatttgttggtaaaattatctcctgtacttgcttcttgtcttactacatcagtcacctgtgaatttaaattagaggcattttgaaaatataattagtaagtcattgcttggatctattgagtagtaaatttatatttttatagtacctcagatatagtgtgaaactttgaataattcatttctcacatgaaataggcacattacaaatatccagcaagttgtaattctgggtaagagtccttcaaagaatgaagaacaacagttaagctgtacctttggtcatgcatggcaatatgtaattactatctgcaggtcctcaagatcaacttaatctctagtatgtaagtcaaatgcctgttgaactgtacagtataatacatggataaacaatccaaatgactcattttataagtaggtaccactttttataaacagagcgttttataacaacctgctgttggtggtggtggtggtggttttgttctcctcctgtttcttattctttattattgtcatcatctatacttactagatacaggaaaaatgcttttacaaaaatgacccaattcagtggtgctgaaactctagagacatcagaatcacctggatggcatgtcaaaacacgatgcatggtgcttgcctcagaatttttgattcagcagacataatgtggaaccttaggatctgcatacatagcaagtacccagatgatgctgatgctgctggtccagggaccacactttgagaatccctgctcttgtaaatgcttctttgtttcctgatctagcccttcttctatcattttaatgctaattatgcccaaaagtatagtagtactgctctttgcgtctttgcacaccaatctctgtggacaatctcatccacacgtgtggctactcacaaatataaatcaccagccctaatctccttttgagtgtcagactaatatatcaactgcctacagcacacctccacgtggaaatcccacaggatctttaaatttaatatggctggctgggtgccgtggctcacgcctgtaatcccagcactttgggagtccgaggcgggtggatcatgaggtcaggagttcaagaccagcttggttaagatggtgaaaccccatctctactgaaagtacaaaaaaataaaattagccaggcatggtggcgggcgcctgtaatcccagctactcaagaggttgaggcagagaattgctcgaacccgggaggcagaggttgcagtgagctgagattgtgccactgcactccagtctgggagacagagtgagactcgatctaaaaaaaaaaaaaaaatattaacatggccaaattggatctcttaagtcaacccccatgaagattgtttcaatcaagaattgtcgcattttcatgaggagcatatttttatggtcttaaaggatccccccacaaattacttattagttgcataggaaaaataataactatacattgaggaaattgaagaacatcttggacaaggtgatcaaaaatatcatcaccaaggaggggcaaatgagcatcatgtaatgccctaagatacattacctcattgctcttaaagcatgacccaatacattacctcattgctctttaagcatgacccaaacccatggcctaccatgcaagtctcctcctttcccagcctcacttctcctcaattcacacctcacagtcagctttacagttttaccaatacacctgagtattgaagaacgtgccatattctctcttgctttagggtctttattcctgctatttcctttgcttggctcgccttgcctcctccccaagcaccttctgtctctttgactagtgaaaacccatggtccttcaagactaaaattaatattatcttttcagagaaaacttccatgctgattcccctttcatgagtggtttaacagctctgtcctgcttggggcctcctagcacttaccacagtttattataatttcttacttgcttctctgtttcctggcttgcctctgagttctgaaaggtgggaattgtgttattcaccattgtttcctcagttcttagaatactgttaattaagatacagttccttaatgaatggatggatggatggatggatagaaaaaattgaaaatgtcatgcattttaataaacacattaagtgtttatttttatttggtagaaaactgatggaggaaatgaacaataatgtttagttttatatttggtgctgagtcctggataaagacaattgaatatgtttggtgttcatctaatttgcaattcaaaaccaccacgtgtagggaccttttctgccttactatttaaaatagtttacaaaattttgagaaaacgtagttttaattttacctagaatctttttttttttttttttttttgagatggagtttcactcttgttgcccaggctggagtgcaatggcaccatctaggctcaccgcgacctccgcctcctgggttgaagaaattctcctgcctcagcctgccaagtagctgggattacaggcatgtgccaccacgcctggctaattttgtatttttagtagagacagggtttctccatgttggtcaggctggtctcaaactcccgacctcaggtgatccccctgcctcggcctcccaaagttctgggattacaggcatgagccaccacgccagcctacatagaatcattttacatcagtgttttagatatgaatatttactaatctattatatttgatagcaaccataaatgcttaaactcacaattttttgtttttatgtgtgggaaaatttaaaaaacaaagactaaaaggatatgtataacaaaattttatctctatattgtgagattaatcttctctttgtattttttaacttttctaaattaatgtgaattaactgtatatgcagaaataatgtaaattttttttttttttttttttttttgagacggagtctcgctctgtcacccaggctggagtgcagtggcgcgatctcggctcactgcaagctccacctcctgggttcacgccattctgctgcctcagcctcccaagtagctgggactacaggcacctgccaccacgtccagctaattttttgtatttttagtagagacggggttttgctgtgttagtcaggatggtctcaatctcctgacctcatgatccgcccgcctcggcctcccaaagtgctgggattacaggcgtgagccactgcgcccggccaatagtgtaaaatttttacatagccaatgtttgctatgaatgtggttttctaaagaaccctcatattttctatatttatttgaaagggaagattttgggtttttcaatcgttttctgaccaactatcattacatttttggctgtaaagtgaattgatacacaaaagtcttggaagcaatttactacccacccctagctctggtattcttacgagggatgatacaaagacactaccttttctacaagctcttgtgtttacaagcataagagaaaaacaatatgtttaaggtattaattacccagaattcagcagtacattcctttgatttttgtatacaaatgctaacatatcacgaaggggaaagtgttcactgttttgtattggcatttaaaaactttttatgtatcatttataattgtgagagtaaatctgtagttggcttcttaaaaattcttgattacattggttctttatccacttatttatgttgatccgatgacaaagagttgttaataagtcaagacattttaacttacttattgacaagctaactaagaaaatagccaaaatagaggtattacaaatttcttattcaactcagcatgttcactgttcacttagccaaacattctccaactgaagaactccaaactagtttactcttcatatgactatattgagcattaccttactttaaattgtgccacttaatagtgaagttcggtgactatttcagcattatgatggatcctcttggactaagatacaaaatttacagttaaatttggtatttgccatcataaatggcccagattagctggtccttcccctatcactggagaggagtaatagtagctggaacccagaaacccagtgggtactagtttcctttctctatcccactttactcccctttatctcctttgcttacttcaagttttaaaaattacttacctggctaaccatgttttaaaatacattttattctgaaaatgtgaaagcattcataatacggattttttaggtcaaacttgccacattggtgatagttggggattgcggctgatttgtcagatgtatcttaccattggagtctgtgataattaagagcagtgttggactgtggtcatgtcagacactgcggagaagaaaaccgtgttttacatgcatattcagctgctgcatgatgtgttactgcatttcacattacatatagtagcccagtgccaactcactgcagtaaatctcagtgctaggctcttgccatttgtcatagtaacagaaaaacatgtgcagttttccattttattgaatgaatttgaattcatagaggacatcagattgtgctcactctctagtttatatgcctgtgtgtgtgtgtatatatatatatatatgctggcaatacaaataagctgaccatcccaggcagactaatcgaagatcttgtctaatattttggaattgtgattatttctatttctctttaccttaacttagggtacttcatctgatcaccacccctctaaagtatagaggggggtatttttggctcttgttctcattaatttaaaagttctcaatttttttgcagaggaaaggaaaacctacctgttggctgttttgacctatccatttaaccagtaatgcaccacagttagcacttctgggactaatctggccctccaaccttgaatagggtttacatggcattgccttaaggatatgtagtctttctattcctctaaatcagtggctctcaaatttgacaggtgtcagtcacctagggaacttggtaaaaatacaaaaccctgattcttactccagtgagtctggccaattctgatatgcactaaagtttgagaaccactgctctagacactaaaacaaatcaaaacaaaaagacagatgatctgaccaaggtagaaatgcagacagcattgagttgtccaattggcctgctatccccgtgccccaggctacttttactgaactctctcctgctttatggctttacttgaaggcgacgttataagaaacagccctcccagtatctgtgaactgcaaatcacagatctctcaaaatggaatgctttctgtaagtctgatgtcaaaattcatttgggggtaaatttaagaaaatatattattccttgtagtgtaaatatttatgtgtttaagtgcagaaatgttaatacgcttaactctagggtgctgccctaaagcctgctagggttttttcaaaatatttgaaatgcatactgaattagcttccaaaatccaaaaaaagtccactttaataaacatcttagtcccaaagatttcagattataattataaacaatgtgcttattaatacagtcatatgccacataatgacattttggtcaatgatggaccacatatttgactgtggtctcataagattataacagagctgaaaaatgcctattgcctaatgacatcatattttctataatgtcatagtgtaacacattaccttttctatgtttagatacacaaataattaccattgtgttacagttgcctatagtattcagtacagtcagatgcagtactggtttgtagcctagaaacaaataggctgtaccatatagcctaggtgtgtagtaggctctaccatctaggtttgtgtaagtaggctctgtgatgtttgtacaacagtgaagttgcctaaggacgcatttctcagaatgtatccctgtcattaagtgatgcacgattgtggtgtgcttctggagaaatggcttatttttatcttgtggacattgaaaatgacttggcagaccatactgtaaagctctaagccaggcttttgtcttcccttgatcaggagctctgtgacgttattctacctttatctttttttcttggtatcttcctacctttttattggtattattattatccattataatgattttgctgagtgcatttactcgttggctttttagatttttttgaatgtgtataaactaattgcttcttcatttagttggatatatagggtgataaaaatagataaatatattacttgttctggggcattgtctgggggagatttagcatagttgtcctcagttgtctctttctttcatgccataataaaataacctctattgtgaggataatttttcaaaaggacttagtgtaatgagcatacatttttggctaggtcagatttctaatagttggcagcccaggtattagcaacctcatattctacttccctgaataagaagtctctaggagtatctatctaccaaaaccactcaaatccctacaatccaaagaattccaggcttttaagttatgtttctgattctaatcattatttattcagtaaatggttgtataaaagtgacacaccctcaactgcaatttcagtttccctgggggaaacaaggaccctgaagggaaaacttgtacatagtgttgctttcttgctccagatcactggctcagagcatgaaagaagtgaaataacaaaccactgagtttcccctcaggtcttaaactatcagcctggatagcaaacaatttttattgcaaatttgagtagttactatgctttaggtttttttttggattaatgcagtttattttagagctgttctgagtttatacaaaaattgcaccaaaagtacagagagttcctatacacaccttcattctccatcccacagttttccctattaatagcatcttgcatttgtgtggtaaatttgttacaattgatggacagttgtaatacaatatattgacatattattgttaactaaatccatagtttatgctggggttcactttttgtgttgtacaattctatgcattttgacaagtacatgatgtcatgtgtcaccattacagtatcatacagaatagttttattgccttaaaaatttcctgtactccacttgtttatccctccttctcccaacccctaacccttggcaaccagtgatctttttactgtctccatagttttgcctctcaagaatgtcatatagttagaatcataaagtatgtagccttttcagattggcttatttcacttagtgatatgcatttcaatttccttcatgtatttttgtgacttaatagctcatttctttttgctactgaataatattccatggtaaggacttaccacagtttatttattcattaacctgttgaaaaatggcttaaacttttggtcgtttccaccttttggaaaatataaataaagctgctataaatatttgtgtgcaggtttttttgtggctgtgttttcaactcatttaaataaatactttggagtgtgacagctggatcttatgggaagaatatatttagttttgttagaaactataaaactctcttccgaagtgactgtaccatatttgtttcacaccagcaatgaataagggtccctgttggtctatatcctgtctgccagcatttggagttgtcagtgttcaggattttacccaatctaatgtgtgccatgctttatttttaacatttaacaaatagaaaatttgtgctcatggcatttgtttcttccaattactaatgaatagcatcatggttaaatgggatcattaccctgcttctttttccacccaccttagcttcctccagagttcactgttatctcttctctcagcaggtctgtggttggctattcttgtcttaccagtttgctgttattcctgcactcagtttctgttcttgtatgtgcctctctagtgtctagcataaatccctcaggactcaaaaagtggtattaatatgtcagtgagtcctattctgattccatttttcccaaatgagcctcctctttcaggctcctttggtaaagttcttctaattccttgggtctattacctactttttatattgttatagagaatgtcaaacatattcaaatacataaagaatgatatactggactaacgtatacctatcacacagtcccagccaccaacaacccatggccaatagtgctccatcctctcccatttactttttctaaatgttgtattattttgaaacaaatatcagatatcatattattttacatattcatgtgaccaaagatatagagcaatgacttctttttctaacaaacacatagcattattatcacacctaaaataacagcaatcatttattatcatcaaatatctaaataatgatctcattaaagttaagatccaataatgtccatgtgctttgactggttgatgcatattttaagtctcttttaatctatgggctctccctctattgtttgccctgccaacccccacaatttatttattgaataatcaaaattatcctgtaaagtttatcttataatctgatatttttactgattgtatttccgagatgtagtttaacataatctctgtattctgtattgcctgtaaataagtagaacctccatacaggtttgacttattttgatgtgactactataacttaattttttgttttgtattaatgccagttcattactggttctctcctaagctaatcttagagggcataccagtgtatcaattcatgcttattctgaaatctttaataaagttgtaaatgaattatacaataaatttcacagtgtcaggaatctaattaatgaaatagctagattagaaccctggaccccagacttttacatacaatttcctttccctgtaagcactatgttagcctcatgatagtagcatgcctctttgtaacttttaaatatcctgcagcagcaaattgagaaacacatttgcagaacattccctttactgtgtaatgtggttcttagtagagaatttatttatttatttattttgagacagggtttcactcccgtcacccaggctggagtgcagtggtgtgctcttggctcactacaacttccatctcccatgctcaagcgatcctcctgcctcagcctcccaagtaactgggactacaggcacacacgccaccacgcctggctaatttttgtatttttagtagagatggggtttcgccatgttggccaggctggtctcaaactcctgacctcaagtgatctgcctgccttggccttccaaagtgctggcattacaggcatgagccactgtgctcagccattaagtcttacatttgtatacaactttaaattatctacgtaatgtcactgcatagtcatatagcttggtagttaagcatttgaactcttttttttttttttttttttgagacagagttttgctcttgttgcctaggctggagtacaatggcacaatcttggctcaccacaacctccgcctcccaggttcaagtgattctcctgcctcagcctccccagtagctgggattataggcatgcaccaccatgcctggctaattttgtatttttagtagagacggggtttcttcatgttggtcaggctggtcttgatctcctgacctcaggtgatcagcctgcctcagcctcccaaagggctgggattacaggcgtgagctaacactcccggctgcatttgaactctttattctaatgtctaaataggactcactatttagggtactcactgtgtgatcttttttattattattacttcatagagacaaggtcttgctctgttgcccattctggagtgtagtagtgtgattgtaactcattgcaactttcaactcctggcctcaagcgatcctcccaccttagcctcccaaagtgttgagataacaggtgtgacgcactgcacccagcctcactgtgtgatcttgaataagttactgagcctagtttctctgcctgccagatgagacttttactagtaacaaccttatgaatttgctttgattattcagtatggataatgtatggatgatgcttagtacaatgcctgggatataatagcaaatgttcaatatagtttggaactataggcagagagaagtgttattatgagaaaactgaggcagtgatagggttggggcattggcctaatattacatagctgacatgtactttcacataagagcctgtcttttgtgtgagaactgactctgtaagtgtctctactgttatgaaggcaggaacctacttaggtactaggctatgtgaaagaagctggtgattagttgaatctaaagttggtgatgcactcacattgccaactacacacagtcataaaatccattagcctattttagacggcttactgcttaccttggcctcagctaccttactgcttaccttggcctcagctaccttggcctcagctactgcttaccttggcctcaggatatttaaagactaagattgtttcagtttgtttaaaaaattacacacacacacttgcgctcacacacacacacacacacacacacacacagtgggagagtatttttgccaaaacgtatgaaataattttctcctcttcacagatattgaaatggtgatttgttttatacatattccacacaaggtatatatatgtaagggataatttttttgtggtgaaatttaagtaacggaaataacatccactattatttgggtaaaaattacaaaagcacttcatagagacttttttccttagtgtatgaaccacatttatcaggtggtacaatagctgaattaagttgaaattgttctaaaatatgcttgagattttcgtctttcttcaagttgtcctgaataggtagacagatacctgaaaataggaataaaacctaaacctctactttaaaatgaggatattttacctttaaatgtctatttcacttgatgaatatttaacctttttgttagttgacctatctaaaatcttaagttacttgaaaaatatattttcttgtctgtggcttcttaaatggtgcacatgtggttagcaagcaacagctattggcttgccaaagctaaaagttaaaatataagatgataaagttgatgtaatatgtgaccttttataagtcactttcccatttgaaattaaatgtgccagatttgacaaacttaatatattgaataggttaccctaatatttttgttgacttttagcaagaacactataaagcaactataaagtgttatttattttagcttttctaaataaaaatcactgaagcaattttaatttgtacatataactcttccttaaaatttaaatacctgttttacttcatgtgcttccatgccttatttcattaaattttcaaacacgtatagaaagccacatctacaagctatcagatttccctgagattactatattaaaacatacactgaatcagactccatttcttccaacgctgattcagcactttaaaaataatctttgattttatattaaaataacttatcaccctttactgcatgatatcagaatgacactagttatttcactacaaaaaaatgtcagtgatcaaatcttgctggtccacaaataactctccacttgctaatttgcattttagcatcaactgtaaatatgtagataaaagaactgacagttgacagctaggtataacttatatatatttcatacagtaactcaataataccagattaatatttaaaaacattagtaggccgggcatggtggctcatgccggtaatcccggcactttgggaggccgaggtgggtggattacttgaggtcaggagttcgagaccagcctggccaacatggtgaaaccccatctctactaaaaattaaaaaaaaaaaaaaattagcaggacttggtaatgcgtgcctgtaatcccaattactcgggaggctgtggcaggagaatcgcttgaacccgggaggcggagcttgcagtgagctgagatcccgccactgcactccaggctgggtgacagagcgagactccatctaaaaaaaaaaaaaaaaaagaaagaaaacaaacaatgaaagacattaacaggagtatggcagaataaagaaatgtcaaaatatcatcctttaatctttaatgttataatttgtgtttgaattatgaaggatatattgaataataacaaatagaagtatttcaggaagcatagaggtgctgtttaaacacaatatgaaagtaatgagaatcattttccaacacggcattggatccagtctcatgacagtgtaaagaaactgtgggaaaagtgctctgtattttccaggtgaacctggttgcccatctcttgcaaccagctacagaaggtcagccagtagcactggatttccatggtcactcatttctccattctacttgtagtctgtgtagtgagaggaaaacaaatgtgtcccaaaaacttggtttcacatgagaagttcttcaaataattttcacctttagaaaaaaaatttatggagcatgatgatagtcaggagggaagaatggcagtttggaaggtaaggcaagaagaataatcttgagagtttctaatgagaaaaataatggaaaagggtaaaaaaaaaatagagcagctatgttaaagtataatattataattattgaatagaactcaataatatataattctgagcactctttttttcttctgactttatcatacaattttatctttagcctacctttaccttaatttgtatattcttagccttaggttattgaatagatttttataaaccatttgttttagtcagcttttgcttagtaaaaatacaataatatacaatccccaaatatcagtgccttttaacagcattgatttacttctctctcattttacatgtggcagctctctatggttctgtgtatcttcttcattcttgagtccagaataaataaataacttctctctggggcaaggcatagggaaaagagcaatggcagaaacatgcaatagatttttaaaattgtatttgagtataatttgaaaaaataatataatttaccctaccaacaaaatccattctggaataagatgtcatatagtaacataaaatttatattaatgtatgtaaaagaataatattaaggttgaaacttaaagaaccatttagtgtcttagtcaattttgtgttgctataaaggaatccctgagagtggataatttataaagaaaagaggtttatttcgctcatggttctgcaggttgtacaagaagcatggagccagcatctgctcctggttagggcctcaggaagcatccactcatggtagaaggtgcaagggagcaaacataatatggtgagagagaaggaaagagagatgggagggaggtgccagacttttttaaacaaccagatctcacaggaactaggactagaattcactccatcctgggagcattctccaagccatttatgaggaatccactcccatgacccaaacacctctcactaggccacacctctaatattggagatcaattttcaagatgagatttgacggggacaaatacccaaactatatgaaatggttagcatcattttcacttattaaaattttatcaaacatctacgatacagatgataccaggaagaagcaaagatgaataaatacctgtactctacatttaaaattctctggattcagtgaggaatatagcaaaatatataaaaccaatatagatgcatccactgatgagtgctttcttgaggattaaaagaggtgctaataagcagaaactgtgaatgaaactgtcaaccactgatacctagaaaccttaggatagtttctgtgtaagaatctgttaaattatctcagtccattcagactattatagcaaaatactctaaattggatagcttatgaagaaaggcaatttattgctcacagtcctggaggctgagaagtccaagatcaagtcaccatcagattcagtgtgtggtgagggctcgttctctgcttcacagagggcaccatcttgctgagtcctcacatggtggaagggcttcatcagcctcttttataagggcactaattccatcgatgaaggtgtagcctttatgacctaattacctgctaaacaccccatctcttaatactgttacattggtgattaggtttcaacatatgagttttgagaggacacagtcagaccatagcagatgaggataataataaagatattaatagtaataataactatctgtcttatgcatttactatatatcaagtactttagaaacctcattgtactctcacaatgaatttttgacataaattcaattattattctcattgtacagatgagaatataaaggcacagacacatattgaaagactatttataaagcttgtagtacctgagtggattaatggtgtttatattcagtttgtaaaacaaaactattatgagattatatatatatatatatgaatgaaaagtttccatgcctgttttcttgcaatattgattgtgaatgttaccgcagcctaagctcataaagcattttcttaacagaagcaatcacaggctatttgcaaagccatctcaataaaacttacaaacatgagtcctaagggtagaatcaattggtgagatgctacatttctttgtttgaattattggggaaaataaaacagtatgaaccattgatggtgttttgaaaaatatttttacactctattacttttattcttacccttaatatgtagttctatcattattttccatagaattaatctccactcttacatatattctttatgtaaatgagaaataaaatttcaaaggggaaaaatgtaagtagccaaaaatttctacataatgctttattaatgagcaaaattggggcattttatcttctgggtgagaaatgtaatattcaggaaaagtgtggtataattaatcatagtttatgtatttattactctagggttctttttgtaaatgttccatagttctttagcagtgaactcttctctaagttgcaaacagtacacctctattgtcaaaaaaggaccaatttctttgtttgcagcatattgtcaatatcaaatatgcatgctgaaagacagcagactatcaatagctagtaaattcacaaaaccattgggtgatatgctaatatttcacaagacaaacagtgaagggagaatattgtagtaatatttgcaaacaatattttctttagttttgtatttaaaatatgtcatttttttcttactcttgtgtgacttctttttcagtcagaacagaaaccttaaaatagataacctttgatttttatatttattccatttttctctgacagagtatggatgaatagcatgaaactagtcaaaattgctaagggaattaatttatctacaaaccttgttcaatcttattatttaaaaataacttttattaagataaaaattactaaaaatagattagactcttatgatgcacttagaaggacagaagatcatttctctgatagtcttgcctcaagttacaacctgattctaataaggagaatgcattagacaaacccaaattgagttacatgctacaaaatggctgaccagtactctgaaaagtttctaggtcaggaaagagaaagactgtagaactgtcacagtttggaggagactaagaagacatggcaactaatgcaatgtgggaacaactggaccttgaatcagaaaagaaccctagtggacaaactggttttgaaatttgaatacgtactatagatcagttcatcatattgtatcgacgttaatttcctcattttaataattgttctagggtttggaaaatgttaacattatggcaacctacctgaaggatgtgcagtaattattttctattcttgcatgttttctgtaaatctaaaattatttcaagatgttagagaatttttttttttttggagacacagtcttgctcttgctctgttgcccaggctggagtgcagtggcactatcttggctcactgcaacctccacctcccgggttcaagcaattcttgtgcctcagcctcccaagtagctgggattacagatgtgtgccaccacacctgactaatttttgtatttttagtagagacagggtttcaccatgttggccaggctggtctcctgacctcaagtgatctgcctgcctcgacctcccaaagtgctgggattacaggtgagccaccgcgcctggccaaaatgtcaaagaaatatttttaacttcgggagcaaagaagaactccaatctctggaatcagaaaaaataaaatattatttttatttgaggttatttaaacctcccatggagtatattaatatctgcaaactgagtgcctgctacgcaaggctacaaggtgctgtatgagacggaaacatggagacaatttattttttttattattttatgatgacatttattaagcttctaaaattatgtaacaaaatgaaagacatggacaatcacactttttgatatgataagaaaagagattatttgaatctgggacacagtgttccagaatttagaagatccatacaaagtgttgaggagaatctgattctaatttagggtttagggggaacaaagatacagtagttcccccttaaccatagttttgctttctatggtttcagttacctgtggtcagccacagttcaaaaacattaaacagaaaattccagaaccaaacggtgcacgattctgagtagtgtgatgaaatctcgtgcagtctccctctgtcctgtccaggacatgaatcatccctttgtccagcagatccatgttgtatatgctacccacccatttagtcacttagtagcaggctaggttatcagatcaactgtcatggtatcgcatgacagtaatccttattttacttagtaattgttccacagcacaagagtagtgatgatggcatattgttataattgttctattttattattcgttgttaatatcttactgtgcctaatttacaaattaagccttatcacaggtatgtatgtataggagaaaatgtattatagatcaggtttggtgctaaccacaggttcaggcattcactggggatcttggaatgtattcccgtcagataagagggaactacgatatgtcgatacaacagtggttgaactattgagtcatgcttggagctcttgagtatgaatatcaggaaataagcctggaattaatccaattgtggccaatttttaatgccatattagggcacttaaccttcattgtgtagtcagtcttaagtgatcaaataaaccacacaattggttctatggttcacaaagttaatggcgatatcaagtgaaaattggagtgaggcaagatgggtttccaggagaccagagaggcaacaagggctatataccttaagagcaatttacaaaagattaaaggagggcagtggcaatggggatgagaacaaataaaaaatagcaaaaaataatatattgaacttattgtaattatgtcaagctactgttatctttaaaggtaggaaaataaagatcttggctgggtgcggtggctcacacttgtaatcccagcactttgggaggccgaggcaggtggatcacctgaggtcaggagttcgagaccaacctggccgacatggtgaaaccccaactctactaaaaatacagtaattagctgggtgtgatggtgggtgcctgtaatcccagctacttgggaggctgaggcaggagaatcgcttgaacctgagagacagagattgcagtgagccgagatcacaccattgcattccagcctgggcgacaagaatgaaactcagtctcaaaaaaaaaaaaaaaaaaaaaaggaaagatctgaataaataatctcctttccttaatataaattttaatgattacaattacaactaattgatgagactggccagaggagtaaggcatgttgatcttcttttttttttttttgagatggagtcttgctctgttgcccaggctggagtgcagtggttcaatctcagctcacttcaacctccgcctcccgggttcaaggaattctcctgcctcagcctcctgaggagctgggattacaggcgcgcaccaccatgcctggcttatttttttgtatttttagtagagacagggtttcactatgttcaccaggctagtcttgaactcctgacttcaagtgatctgcccgccttgacctcctaaagtgctgggattacaggcatgagccaccatgcccggcctgatcttatttttaaagagtgtaaatgtaatctaattataaatttaaactttagagagaatgttgagagatacggacataataataaaaaaaacctgagccggataattgtgcttgtctgaaatgagctaatgaaataattttgttcatatcctttgggggtatttctgaaaatcagtaaagactatgcacagccattttatgtttttacaatagtgccattaatgatgccttatgagtgaagaaagttggatgattgggtgtaaaagatgtaaggttaatgggaaaacttccctagtccacaaatcatcttattatccagtctgtaattctttgttccatgccaaaaatctatatttcgtcaagtaataatagatgctttcaggcaaacagccttatatgttgaaatgcaaatgattacttttaccccgtctcctatgcttctccttaaacactgaagtgagtcagaagaaagaactcttaccctttctatttacactcactgctttggtggtatcactgaatctcatggctttaaataccatttgtcttctgatgattaccaaatactaatctccagctcagacctttctctccaacacgagacaggccactggactttcaataggtagctcaacctcatcctcacgtggtggaaagctctggattgtcccccaaaactatttatctcatcattcttttcccatctcagttaattgcatcgtcattcttctagttactcggcacaaaaactttaatgtaattcttgactcatatctctctcacccatcatttgattcatcagaaaatcctattgtctgtaccttcaaatcatttccaaaatctgaccacttctcaccagctccaacgctagcatcctggtcagagccacatttcactttgcttattgcaagagcaccctaactgacttccaacttctgccttgcttcccatcaattcactcttaactctgctgctggagtaattctgttaaaacagagattagtatgtgtcacttatttgctcaaaaacctccaaagacctctactttcactgtgagaaaaggccagaatacaaaattacaagggtccgtaaggccccagaaagacttgacctggcctgacctcatctaccgctacctttccctcttgctcactcttgcttattttcagcaacacaaggcttcttcccttttcacaatcactgcaggaacactcctgcctctgagactcagaccttgctctttcctctagctgaactgctcttccaaatgccttttttgttcactccttcaccttcttcaggtcttgacttgaaacaccctataaatagggcatttccaggccactctaaaattgcaaacttacctccattccttgcaccctttccctccttacagctgttatcaccatgtaatttactatagtttttgcttacttgttttttatctcttacgcaaccatcccattagaaagtaaactctattaaggcaagaatttttgttttttcaggactctacactaaatctcataattataagacaatatttggtgactaattttaataggaaatattgcctagagtaagtccagattttcttcttaatttaatcattaggcaaaatattttgagcaccttttatgtacttgattagaacataagggcataatgcattttaggatgtctgagattattggggagtaggcatgaaaacaagtattaatggtccattgttacaagaaaaagagtgaaatctgggctgatgctctctagtttgagcaggaaaatatctcatagcctctaaccttacttaaattctgccagctctggcctgtagaagcagtgaggcaaaatgacccactggaagaagctacttcttttgcagaagcaacctaactctgagaagaaaaaaattaagcctatcatcttcagttctacttgagatcttaattataaaataaactcagatttctatttccagttcagatggtttggtataagatgggccataatccctgaaaagtggcaattccaaggaagtttggcacaagtcttaatatgcttattcaggctgaagttccagcagttccttcccataagcagacctgctagagtgtggaagacacataatgtaaatacgttaggagcaattgttgtttctttcattttcttctgaatcagtccacagcccaaggattctgtgaagtaacaaaattggctgttacagattatagccacattcccatcttaatagcagcagttgaaatttcttgggcatttcaaggtagagatttatgttttatttgcagttcatgattattctgattcaaatatctgtaaatataaagggagggggagaatgctaacacaaaaaatattgtacccagttaaactttatgtctgtattaataaagcagtctttgatttagaattcttagtccctttcttttagaggattgaggttagggtatgtgggtttgtgtatgttttgtcaccaaggttggggtgatattaccacagtgaccagaactataaccaaattcccatttatactagtgatggttgtatcctgtctaccagagaggggaaaaatgctttgacaaattcatcattgttatgttttcttgccacagtttattctcttctgcattctgtggaagttcttttggccctgtggcttcctcaatcataagctaccacatacaaagactattttttcaaagaagccaattagttttttactaatcatacgaacttagaaaaatagatattaaatattactgataaataacacagccttgtcagaaatctctcaaagtgtgtgatcattgtctatagagtagaactttttaggggcaatacagtactgtttttatattcaatgaagataagttagattaaaaatgtaagatatctttttgtgaattgccacatggtagaattttgtaagaggtttttataatgctattcaattacttctccatggaagaattttgctcacagagaaagagagacagtgtgtgtgtatacacaaacatatataaatgtacatatatctgcatgcattatatatgcatatattgtatgtgtatgtaaagtatgtatagacatacaaatacagtcatatatacatacatatatagtctatacataatagctatatgtgatatactctctagatgttataaaagcttttcaaatttcaacttattggatttgttttggtgagtgttcaggtttattggtggaagaattatgagtttataaatcactgattagtcctctattctcacaagagtaaaagaatattttaatgatacatagtcaccaagggattgcacattttcaaatgaactcactgttactgcccctgttgtcaagatggtatctccctctttctcctcggcaaaaacaccatgaatcaatttatttagagtgaaaacaaacgtcaatcattaggtgaagatgctttttctcaatatctaaatggtttaaaattgaatttctcacgtaactgcccatttaaagactcaaacatggttctttgtttttgaggaatattctttataaagtctctgaaaacacttttactctcttagcaagataccttctttacttggcaacaaaaaccacattgaaacaatcgtattcccttttgtcagcctgagccagctgaaatctttggagttatcaacctctgccaacaacttgaagtagcggttgcacaatggataactgagatgtagtttattccaagctaatgattttctgaagctttcgggatggttatatttatactgacagatacagacctaactttcccataaaaagaacagactgtgttcaacgtacccagataataccagcctcttttttgtataatcctttaatttcagatgcttatagctgcttcagtcctgtcaataccagcactctgaagtcttgccctgcttgataatcatttgtctctgtaatttctttatcattgctttacttagggacaacacaaataatctatttagaccagaagagaccaactttctttcttctttatgatcaaaatattttgtagactccctacaaaataattatgataattgtagtagccattgggtaagaaatgcataatgacaaaaatctagttttaattcagtcgtgctaagcatatactctgctttattacatcagctacatatgtttaaaaatactaatatatattatttatctagtctgcatttggacttgcctaatcctttcaactagaatgccctctcaaagatccgtatcttgaagcacgagaaccaatagtttgaaacaactgatataaagtggataacatcaggtgtccaatgacctaccacatttgacactgaaaatattttccaaagaaatacagagtatgaaaataagaaagaactactctatcactcattgtcccatcgtctgatggccctgttgactcattgtacaccaagggccttttgaagtagggaaatacatgtgaccaatagagatagaacaataagacaatttcagatttgaaagaaacctgagcaaccacggagcccaaccctctctttttctccagtaatccaaagaggtcaagtagcttgttaagggcacccaagaagttgatggcaaagccaggcctaaacctggattatacaaacttgaaactatcttgaaatgtagtaagcactatcgcagtgttgggtaatacccttacactcaatcccagaagattgagttcagaagatgaagatgtggaggctgaaattataaccctggggattcgttgattgtgatgtactttatgcaggtttagaggcaaaaacacatggcttggcatcagaagtggaaaggaaagtagagtgttgtagaatgagtgctggatttgaggtcagaagacctcttttaattcccggtactgtcaccgattagatgtgacctatggcataacccttaaatatccttgacctcctctgtttccttttatgttaaaatgggaataataatgcatgctttgaccatcatttagaaaggttgagagaatcaaaatcagtatcagaaaatgcttttttaatctgtgcagagcttgaggtaacaaagcagtatacctcaataaatatcgttgcattcctctatgccaggcttcgtgcaaggcactgggaatagagcactgaataaaatagaaatgatcatagtttaaggaattttcattctagaaaataattacttaaatgtggctctatgtaacttaccaggagctttcttatccgttgttcctcttgagctttgcaacagtactaggcagacaggatagataagtaatgataataacaaaacaacaataatagcagcagcagcagcagctaacatttctattatttcaatgtaaaaaaagaatttcagattgtttaaatacagaaatgtggtggagtagaaagaaggccaagatggggacaaggggaaccatgaccccaaaagcaaataaagcatctgagcattcctttctgtttggttatgaacatctgagggtacataatcataatgagctcctttcagtaaatacaagatgggtgtttccatcttgatattataaattaagaaacaaggctgggcgcggtggctcactcctgtaatcccagcactttgggaggctgaggagggcagatcacgaggtcaggagtttgagaccagcctgaccaacatggtgaaaccccgtctctactaaaaatacaaaacttagctgggcgtgttggtgcatgcctgtaatcccagctactcaggaggccgaggcaggagaatcgcttgaaaccgggaggcggaggttgcagtgagctgagatcgtgccactgcactctagcctgggtgacagagcaagactccatctcaaaaaaaaaaaaaaagaaaaaaaaagaaacaaaagcacaatatgatcgtgtgacctgccctagatgctaaacctaatgagcagagaagcaagcaaagattgattccaggatttcctggctccaaagcctaggttatctccattgtatcaggctccttccaccacatctggatgttgactacatccagaacatgaaacaaaagcttcagtgctaaaaacaaacaaacaaacaagcaaaccaaactatcacattaagaagcaagtcaccaactgatcattttctgattttgctgtttccatggatggttccaaaatcctacctaactcatcaagcttaaatcaaagttgactcatccttacttgtcatcccatgtaaaataagttgccaattcctatctgtttcactttcaaaatgtttttaatcctgctgcttctgtgtagttttgaactggatagttctaataattgttgccaaagttccatactagcatctctggcttggactccttacatgctgaatccaactctcttagtttgcatcccctcactggcagatcctgagacaaggctttaagtgctggtagtttatttggagcatgaccccccaaacacaacagtctgggaatgaagtgagatgggaaaaggaagctgaccaataaaaggtgtgttatcaagaaagttacaactgtacatagctggaacttagtcctaacagagaaccctaggaaacaggatagagcatctgacttggagttattctaactgaggatcaaaagagcatcatttatagactggttcccattggttattggtttaggctacccccaagaactttttggtgttgaactcttcctgcgtgtagtgcaagtgagaagagaatgcttctgcagccagggaaatccctcagatgaaaggacttagatatgaaagttggaagtcagagttcagagaaaagatactggccaggggagtttatctgggtcactgtatttgctctgccagcctatatattatttctaaattaatcttcttagtgtacatctgtattagtccattttcatgctgctatgaagaaatacccaagattggttaatttataaagaaaaagaggtttgatggactcacagttccacatggctggggaggcctcacaatcatggcggaaggcaaaagaggagcaaagtcacgtcttacatggtggcaggcaggagagcatgtgcaggggaactgccctttataaagccaccagatctcatgagacttattcactatcatgagaccaacatgggattaaacccatccccatgattcaactacctcccaccaggcccctcccatgcataacatgggattatggaaactacaattaaagatgagatttgagtggggacacagccaaaccatatcaacatctttgctggagaaagctactctagctattaggctactcagagtatgccttgtgactttcatccttcatgcctttctcatattgtctccttttcttgattattgttttcagtcttaccctactccccgtcccacatagtcaaatgttacctatttatgaagactcacactgtgggcatttgtgattacatattatttttaattacattataacttgatgtaatccactagcacagtgttctaaatataatagaggcctaatggatgtttttggactcattgtctgacaacataacaacttgtgattgtctgaaaatgtaacaacttgtgattgtctgaaaatgtaacagcctgtgaactcttcgttgttcaaagaaaacagaaaaattccaaatatgtaactctttgaaattatgtcaatgtagatttgtttcaaatgttaatatatagtaaccagggaataatagcaatgaatttgttcagttacgatatttggtacttccaaatagcttcccatgatgaggataagataactaataattcttacagtaaaatattctttgattgggttgtttcctattgctgctataataaattaacataaacttagtggcttaaacaacccaaatttattatcttacagttctggaagtcagaattccaaaatggattttactaagctaaagttaaggtgtcatcatggctgcattcttttctggagactctgggagagaatctgttttcttgccttctttggcttctagagactgtctacatttcttatctcttggccctcttccatcgtcaaagctagcagtagccagttgaatctcacagagcatccctttgacattaactcttctgcctccttttctcatatttaatacccttgcgattacactgggctcatctggataaccctggcttatctctgtatcataaagtcagctaactagtagtcctaattatatctgctacgttaactcccctttgccttataaggtaatatattcgcaggttcaggagattaggacacagatgtctttgggaggccattattctgcctaccacaattgatatgtcccactcttccctcctaatttaataagacaatcctatactggtttacccttatctcgtaaaatattcaagatgtagtacagatgttcttgatgctagatgttgaattatgattttaacaaatggaggcttgtgtctcataatgtatatttcgttttgaaatagaaaagttgacttagaaaattagacttccatgtgtacacataatagttctgctacttgagatccagcgattagcctacttctagcattttcaaaataaacttgtcatttgtgtcattatcatagctgattagaaagtaaattatttgtattgaccacattgagaaaattaccatttagcttatggaactctttgtcatagagtgtggatattatatttgtacttgattctaatagtggttagggacattagaaggatatggagctcatcattcaactaagtccttacaaaataattcaatctctgttttagaagtttatcataatattagtacataaactgaacacaagaaggaatttataccatagaaaaattagagagaaaacttagaaaccatctcctacgagctctttgcttttcttgcgaagtggctgctatcaacagaaagagccgttgttaggctttgcatgttctggagtgacatctattagagaaggtttatcatctttgaccactttgcacttcctctcccaacaaagccttacaagcatgtgtttcctagagtggccacttggatcttcatcttccagtaatgttcatgatttgggtattcctagttctctctatccaaaatggccagttggtatcttcttaacccagttgtgcattttaaaatattttgtgggccaggtgcggtggttcactcctgtaatcccagcactttgggaggccgaggcgggtggatcacctgagatcaggagttcgagaccagcctggccaacatggtgaaacctggtctctactaacaataaaaaaattagctgggcatggtggcgcatgcctgtaatcccagttactcaggaggctgaggcaagagaatcacctgaacccaggaggcggaggttgcagtgagccaagatcatgccattgcactccagcctgagtgacagagtgagactgtctcaaaaaaaaaaaaattgtggagtccaaactgttactagttaatctggaaaattaatctataaaaagttcctaataatttatactattttttcttcctgtcacaatataaaaaataaacattacctgttgtaatctgaatatgtgattgtaaaatgattaagcccgatttttcaaccaaagagattatgacttaaagtgtttattatgaagttcgtggtaaatgaagaaccagaatgtataaaggtgattcagctataaataaaatttaattttgtgttaataaaagtaaaattagggaattatgaaaagatattttcaaatacaaagatgcatttaatattcacacaatattgatacttagtacccccatttaactaattaagaaattaagactagtaatgattaagtaactttcccacaattacttagctggctagagtctaacatggtatctttttctttctttctgtcttttttttttttttcttgagacagagtttcgctcttgttgcccaggctggattgcaatggcatgatcttggctcactgcaacctccgcctcctgggctcaagtgattctcctgcctcagcctcccaagtagctgggattacaggcacacgccaccacatgccaccacgcctggctaatttttttagtggagacggggtttcatcatattggtcaggctggtctcaaactcatgacctcaggtaatccacccgcctcagcctcccaaagtgctgggattacgggcatgagccaccatgcctggtgaaacaaacgtggtatctttttcataagaggaactcaaacattctattgagttgaaatacattgaatgaggcatcctttgttttttgcactgaataagctctggtgagagctctattgttgtctttaaataagtctattcttctaggactggctaaaagcccacttaaatgggagccctcaggtacactcattgtcttcattaacttcctttgttagaaacaccattcattcaacaatatatccaccaaaaatattcagaagtggatgacctttcttatgctgatttttgaattgtagaaaattgcggagattcttactaagttttgggatagaactctctctcactggtctttcctttaaatataaaatagaaccttgaatatggtaatttcaaatatgcatgcttttaagtgaattgtaagtttcttgcaaacagggattttgttacagtctacctttattctaacaagataatagtagctaccatttcagggcgtgtatgtcattaactgcttcataacacatgatttgacttttgcttttatatttctaacatttataagcagtacaatgtaatagtcacacataaatactttataatatttatcaataattaaaaataaattaatacaggaatctaataatttatagtatatgaatttagaattcattatttatattataataaatatacatttgtaattcattattacattatttatttattgcatctaccctcttgacactatttcaaagtgtgcataagtattgcactttggctttgagaaatctaaactaagaaaagataagcaaattttccaagggctcttagctagcatttgacaaaggaaaaattctaaccctggtctgtctgactccaaagatggattttattcctttttagtgtgctacattgcttgcaattttccatgagcctagcaaagtgtatcctgttggattgaagcatattttcgagtggagatactgtggtaaatgagatggaaggagaagatggtaactgggacacctactgaggtgtgttcttagaaccaaagacttcgacttaaactctatcatagatcacagttggtattagattcacttagaagaatataaaacacaaatgaacattatgtgtccttcctccttgagaatagtcatcacacaaatctatgtagcagttcccacagccatctgggtagttatctttagcgattcctttcccccatgtctcacatcatggaatacgaatcacattgtgtaggtgtagaaatcacctgggcgtaaaaacctcattccccagtagccagtatctcttatatcaaatctgtagtcacagcccctgaaaacatgctcagttgcaagtcatcacactcagggaagtgcaaagatatgacatccagatcaggcatctatacttcatttatagtttcttctagttcatgtgaaacttaccaatcaggactcatttttatcatagccagtatgaccttgtaacacatttgacataccacgtttatctgtcttcaggggatcagaactaaaaagttaccaaagatccaattttaacacaggtcgaagggttttgatagccttttacccaaaataattacagaatggatttcttgaaaagtagttttgaggattttgttctatttttaaggatgggaggatttggatatgacctcaacagttggtggctgagaaagagtggagaaaaagatccttggagttaaagagataagagaacagagaggctagaatgttagacagagcccctttgtatatgttgaaataagcaaaatgtggacatgtgggtaggtgaatgggacagtgatccaggctctaaaactcttactaaatgagagaaaatgacagggagatctgtagataactatagctttgagggaagatgggtgatggtggctgatggcacaacctcaaatgagttccttttattgaaagaagacaattcatttggaagaagtaattgggagcaagggaaacacctactctatctctaggccctaatttttctcatgataattcattgaagtgctgtaaaatatccaaacaaagtaattcagtaataagggaaaaaacttaaaaatatacacacaaatttataaatgtcatgtgtatatatttgtcctcaatacaatttctcctgatcagttgtgtgtaactaggatgtgtaataaatgaacacaaggacaaacacactgcagatatttaccctaaatatctcagtgtattttaatacatggaatattattgtgctgctttgttagtggggtataatttaggggggatctttcttgatagcatagcagaaattgatctgaatcctaaatactccatttattagctgtatgactttgggcaaattagtttactcagcctcagattcatttctcaagaaattagcccaccagtatgacttacctcttaggattatagttaagattatatgagataaagcacatgaagattttagctcagtgactagtgtagtaaatgcttaataaagctattattgtcattgtaattacattaaatcacattaaaaaatttagttcccctattaaatcatatgaagagtttaaagaaagtcaacggggtaatgtgttcagtttcttttttaaataaaaagtatgcaatattataatgattagagtcccatgtagtagaaggaagagaataaaggactgaaattataagactatttgtgcccttgattttaatttcttaccttgagtccttttgttatttagaatgaccccaagggaatcattccttatttgattagcagtgctacactttaaagagcattacttcccccttatctcactcccattccaaagaccactagggtataaccgttgcaaacatttgtactttgtctaactacaggaaaacataggaaagggtaccttgcattccaaactcaattttaaatcactggtaatggttttgactggctaatgcaatgggaacacctccaatatatgttggccagtattaatcttagcatagaaaatattcacttttaatttgatggtcattttttttctttttttggaggcagagtctcgctctatcccccaggctggagtgcagtggcacgatctccctcactgcaacctctgcctaccgggttcaagtgatactcaagtcttagcctcccctgagtagctgagattgcaggcacctgccaccatgcctggctaaatttttatatttttagtagagatgagattttgccatgttgaacaggctggtctcgaactcctgacctcaggttatctgcccgactcggcctcccaaagtgctgggattacaggcgtgagccaccactgcacctgggctggtgctgatatttagcaatactgccatctgtggtgttcatagaaacaaaaaaaatcctccaaatactgcttaaaggagtctcatcacacttgacacacatcttttaaaaatttgtgtttttctattgctctttcatctcaaagaggcctatagcagagaatgagtagcacgttgcgctgtctttggggtcctggataaacaacctctttcttttcttttttcttttcttttctctctctctctctctctctccccccccctccctccctctccctctctctctctctctctctttcctttctttctttgtttctttccttcctcttctttttttttgagatggagtttccctcttgttgcccaggctggagtgcaatggcgtgatctcggctcactgcaacctctgcctcttcatttcttcatctgtaacaagagaataaaaatgacttcttcacagatttatataaataatattttaactaagtaattcattttgaaatgtttatagaatgccatttacagataaggtagaaatagagtccttcctaaaagtctgttttagataattaatcactaaaattataattggagttgtcataatcaattatgtagcattgtttcaatgatgttaacattgctctttttcactggataaattgttatgtggcatgtcatcattctaatattcagtttacatgacacttcttctttaactctcctctgcagatattcaatctagagtttgtggcacagtatacataatttttggcagatgatagctaagtgcattgtataaaagatacattatttaccagatcaaaggtcaatgtgttcataatttaatatgccgagggtcatacagtccagaaatgtctgtgaatttctgaagtgacacacatttttgatagaaaactgccattttgtaatggatagcacatcaattggatagcccagcattcttttcagatttacatgtcaagttcatcagtgaggccctacataaatctactctaggattaatttccagatttcatctttaactgtatcacaattctttttttttgagacaaagtttcgctcttgttgcccaggctggagtgcaatggcgcgatcctctgcctcccaggttcaagtgattctcctgccttagcctcccgagtagctgggattacaggcaagagccaccacatctggataattttgtatttttaggagagatggggtttctccatgttggtcaggctggtcttgaactcccgacctcaggtgatctgcctacctcagcctcccaaaatgctgggattataggtgtgagccacagcacccagcctcttttcttcttaaataagtctttctcaaggaaattttcacaatattgctcttgggactcaatgtccttatgtggtaggacactacgttttctgaaaaattgcttattaatctggtatatgtgaactatgcaaattatgttttctattttagtctttagatgcagtagttttactattttagttttctcagatatattcacagcaaaagtactatcattgtagagtagtttcacttagcagtgaaagtaactctgctatgatgtggacactgcttctcatttttcttaataaatattatgtttgttatttttataaaatttgttcattagatatggagttttattccaatttaatgatgatagatgggttttatttttatttaattttactgttgtgttctatgaaagtatcttctttaaaatattgtgtaaagatgtcttaattttactaaaacgatagtaataataatatagatgatactactactaataaaactactattttctgaatatgtacaattgccaagcatgatttatgatttacataggatgccaaatttccattatatatcttcaaatttatatgttcattggtttgttcatctatgccacaaatgttaatggagtacctactaagtgccaacaactatgccatcaaccatgaatcagtcacttaacaagatagatataatcccttccttcagaaagcttgtagtctgggagaaaatttaacagttaaacaagacattgaaaaaagtgtgggccgggttgggtggctcatgcctgtcatcccagcactttgggaggccaaggcgggtagatcgcctgaggtcaggagttcgagaccagcctggccaacatggtgaaaccctgtctctactaaaaatacagaaattagccaggcaggcgtggtggtgcatgcctgtaatcccaggtacttgggaggctgaggcaggagaatcgcttgagcccgggaggcggaggttgcagtgagcagagaagattgtaccactgccctccagcctgggtgcaaagcgagactctgtctcaaaaaaaaaaaaaagtgtgataactgttttgatacagcaagtggatggatggaagaagctctatgagtatacagcagggatacatggcctgggaggaaaaagggctgaccatccattgaaaggtttaattaggtcagtgaagttgctcaagtacagctataaaatgaggcaatcaattactggtgatgcaggagagaaagtgatgtatggagaactttctgaactatagtaagaaatgtaatctgtattctaagggcatacttaattactgaaatagtgtattcaaaataggtatcataatcaaggaaacaatcttaaatcatcatgttccaattgcttgatgattattgaagctaacgtattaggaatagatgtattagctaatgtattaggaatagatgtttcctactgctgagttgaaataacgaacccacttgaactttcgcagacacctctaggtttaccttttatttaataagtaaataaaaatgttcatgttttctataatactttgcatcagctttcccttaatcttggaaacatttatttgactgaagaaattaagcactctcacctgcataaaatattcttctgtatgctatagtggagccagttgtaaagatttagttcagttaataaatatctgttgagatgctggcaaggctgtggagaaataacaacgcttttacactgttggtgggagtgtaaattagttcaaccattgtggaagacagtgtggcgattccttaaggatctagaaccagaaataccatttgacacagcaatcccattactgggtatatacccaaaggattataaatcattctactataaagacacatgcacatgtatgtgtattgcagcactattcacaatagcaaagacttggaactaacccaaatatgcatcaatgatagactggataaagaaaatgtggcacatatacactatggaatactatgcagccataaaaaagaatgagttcatgtcctttgcagggaaatggatgaagctggaagccatcatccttagcaaactaacacaggagcagaaaaccaaacaccacatgttctcactcataagtgggagttgaacaatgagaacacatggacacagggaggggaacatcacacacgggggcctgtctggggttaggagacaaggggagggagagcattaggacaaatagctaatgcatgtgggcttaaaacctagatgatgggttgataggtgcagcataccaccatgtcacatgtatacctatgtaacaaacctgcacgttctgcacatgtatcccagaacttcaagtaaaataataaataaataaataaataaatatctgtttaatttctgcagaagaccataaatatacttggtgtgtcaggcagtgatctgtaagtatttttgttcatgcaatcacaccaatcaaaattttgagcaaataccccaatatgtgtatatttttctaataacaaataatacatatattactatattaatatatagtatacattaatacctaaataaaatagagaattgaaataatggaatacaaataaatttttaaacagctgtaaatatttttctcatggctcaatcgaggaaatcttaaatatcgcccagggagtaggagcttattttgcataccatcacaatggggaaaagaaaaatgaatacactgttatgtctaccttcaaggaggcagcaatatggtaatagaaaagttcacaggggccaggcatggtggctcacgcctgtaatcccagcactttgggaggccagggcaggtggatcatgaggtcaggatttcgagaccagcctgaccaacatggtaaaaccccatatctactaaaaatacaaaaaattagccaggcatggtggtgggcgcctgtaatcccagctactcgggaggctgaggcaggagaatcacttgaacctgggaggcggaggttgcagtgagccgagatcacgccactgtactgcagcctgggcgacagagcaagactccgtctcaaaaaaaaaaaaaagaaagaaagaagaaaagttcactaaagctaaatgctgtgccctgtggtattagaagttagagctgttgtggttcaaagtcaggaagatattttcagggcaaatttacttgtaagttggggccaaagaaaggaaggtaatagggaacaaaggctggaaatacagcatgatggttctttagagcaatgcttctcccagtgtaatgtgtctttgaatcagctagaaatctgagctgcggcctgggagtctgcatttctaacaagctcctaggtgctgctaatgttgctggtatacagaccacactttcagtgtcaaggctttaaaggactttctcatctaaaatgaggagtttgtgcttaaattgataggcagtaggcaatttggaaaggtgttccagctcagagcaacatgatcaagttgaactctaggcaaagtaatttagcagtaatttatagattggaggccaagactggaggcagagagataagtctagaggcaattacaggtgagaggtaataagacctctgaagtaggacatggcagtagacacagaaaagggacatggtagaagcagaatcaacctgagaagagagataacaaaggaacacaggtataatatatagaacaaattaaaacgaagactagagaaactaatgagaaatgtgtcctttactgttcatctagtaatttggaaatttgaattttcatatatttaaatacatatgcataaatgatattttcagctaaccaccagaaaatttctggtagaaaatatcacaaaataaaactggctttgaatatgtttgtctttttccttgatccttatttccagaaagaaatacatgtcctggaagtatatgtccatagaggtccaataaatctcaatgattgtaaatagagctttattcatattgagcaaatgtttcctgttcacttgcctctaggtgaaaaacataaatgtctttatacaaatctctgaaatgtttgaagcataaggaaggtgaaagtggcaaggagacatgtattttcattataggctctgaatatccatagctgttttctgctatttagccacttcttcctttgtgacctgactttggacggcacacattatcaatcaggaagaccattatgttccttttacttgtacttgtcaatgtctggctgctcctactgcaagataagctccttgagagccaagactgtgtactattcattttgtatccccagatcccagtgcagatgctgaataattgacttataaataaatgtgtaaatgatcccagaaccaagcacagatatgaacacaaaaaaaattcctttggagtgaacgaatgaattaataagtaggcaagtgaaagaatgaatgttgacttagcccttagaatggccattgacaggttctgtttttttattactagataagcaccaaccttattctactcaaagtatgtgatcaatatttcactcattcatgtccacatactataagaagccttcacattatatagtgactttgaaatcaaagtctaagtctaaattttattataggagaaaaatgtgtgtgttgtgcattgtggtttagtataaatataagtcagattccttgacatcaaatcagttcaccattttttcactcacagactttttcgtcatccttttaagcctcccattttttctttttttaaaaaatgatttcattatactccattattgtgtatgtgtgtgtgtgtatgtgtatctgtgtatgtgtgtctaagtcaaaaactaacctcttctatgggtattttgttactatcctctgtaatataatgtgggaatctttgtccgtgagcataaacagggtgagtgcaggaatctagccatcagttctttctgtactatgcatgcacagcgtctaacttgtgcttgtaatttgtgattacgtcttcaggatacatagttttaaactaggccgagtgcggtggctcacgcttgtaatcccagcactttagggggccgaggcgggtggatcacctgaggtcaggagtttgagaacagcctggccaatgaggtgaaacctcatctctactaaaaatacaaaaattagctgggcgtggtggtgggcacctgtaattccagctacttgggaggctgaggcaggagaatcgcttgaacctaggaggtagaggttgcagtcagcggagatcgcgccattacactccaacctgggcagcaagagcaaaacttcatctcaaaacagaataaagtaaaataaatgaaaaaaataaaattaaactaacagctaactcacagtcttctgctaaaaaagtgtcatacattcagattgtttactctatcaggttagttactcatgctgctatactgtttccaaactcttaggattctagcacattgttttagtttaattttcactgttcctttaaatgtttatttaattcattttctaaaatcacagatatgagcagagccttggagaccatctagtagaatccttccgtggaatagatattaaaataaaaactcatattggttaagttactttacaaaggacatatagctggttattgaaaaaagtggagtaaaaatgaaaatctcccaaatccctaggacagtgatttctcttacgctgtgctatatcactaaaagattttatagtttccctttggccatcagagaagctatgtttaatgtcaagcctgattcatagttaacatcatatcttttgggagcctagatatgataaaagcaaaagagctacaggcattttgaagaagcacttcctacacactactatataccttgaatttgtactggaattgtttgataccctctcagtttattgatactccaaaagaccgaatttctaggtttgttttctaagctttgtcaataagggtagtatttagtcatgcaacactttagctcaaaatattatcattacacattgtctatatgtaaaaataactttgcatatgcatatagattttccagttccattcagcatgaggcatcaactctttgtagtcttttttatataaacacacaaaaattagtttatgacttgtgctatcatgtgttcatgctggaagacggtcagatgtatgtagaatatagcttctgttagtgctcatagtctggtggttcacaggaaaatgaagaataacacaaggaagtgcatgtaattattttaataacttcattcttgcaaataacagaatgaatgaaacaatgttttgcacaacctattttatttgattttcaaaggaagtcatcatgcaatagtccattgactttaattctacctgcttactgtcataaagtaatcttcatggcttgaacaatccagagcctgtgaaatctcccttgaatctctgcatctctccatttccaacaccatcagcctactcgaagtgacaatcttctgaacaattgaaactgcattcactcttgcctggtttgtttactcatcattcaggcctattttttaatgtgtaaaattttaaattttttgtttaaaaatgcaagtatgatcaagctgctctctgacttaaaaccatttggtaacttcctgttggtcttaataacttcccattgctcccaaatccttaatgagaccaacatattttgcttacttttttctctttctcctcctatcttcaccccattcctctcatcttactctctcagcttctctcaccatgaaagtgcatgccttgactttttcatcccagggcctttgcacatgctgcttactccatttgcaaagtattgtctgtcaaatgacttgcaccacttcagccaattatctccttttcatgcgtgaatttccagattcaatgtcacttccttaggaaagctttttcttcaaagactgggttagaattccctgtcacataccttctaacacctaacaccgtgcagtcctgcttcacagcaataatcatagatataatgtggaatttattgattttgttgaatttattgttaaattttatgctaaataaggccgtatgttctttgttcacttcctccatgagaaccttgcatcttgttttgaacacggtgaattctcagtaagtatttcctatcatttcaaattttttgtgcctattttattttttacataatatattggtagaatattacaggtatataatttatatagtgataaatgtagagagagaatatgtactcccttcccattccgcttccccttccccttcccttcccttcttcctttccttccctccctcctttcctcacttcctcctttccttcttatttttttctgtaacctaataatattgtataatcaaaaagtctggagacttctgcttgttttttacttaatacgtattttccttctatttaataaaaggagactggcctgtcttttaaattgcattttatggcctaaatttctactatatgattcaaaaattgctctgccatagtttgtgagaagacactatgttattttacttcctaaagaaagggtagtgaacaaaataataaaagctttatattaaagacaataaagttgatagtgttgtgaaatcatgttactcttattttcggtctgttttctttccagatctctttcctgatctatggtatatatgccagaagccataaatacttaatacagggtgaataaaagacattttaaattaagcatgcccccccaccaacattatcaagagtaaaatgaaatagaccaataaatcggcttacttactggccaacacctaaattgattattagatgtaatggtacaaatttgtataaatatcacacttccctctaatctttttaaatgaaatatgcaggaaggattgtcaaatggaagtactatactaaaaagcgattatcaccatggtaatgttggcttgcttttctgttccttttaatttggttaccctctttattgttaaattttttaaaaagttttctacttttacattttttatttatacttaacacataataatttaaatattggggtacaatatgatgtttcagtgcatgtatacatagtatgaggataaaatcagggtaattatatacaccaatttagacatttatcatttctttttggtgacagcattcaaaatcttcacttctatctgtcttgaaatatatattacattgttatttgctatagtcaccctagtgtgtaatagaatagcaaaacttattctttcctgtctaactaattttgtaccaattgactaataacctttcccaagaaccccctcccacataccctcaccaatgtttgctaactactattctactctctacttatataaaatcaacttttttaggttccacataggagtgagatcatgcagtgtttttctttctgaacctggcttatttcatttaacataatatcctccaggttcatccatgttgttgaaataacaagatttcattctgttttatggctgaatagtattcaattgtatatatatatatatacacacacaattgtatatatatattcatatatacaattgtatatttatattcatatatatacatctattgtatatgtattgtatatgtattgtatatatattgtatatatattcatatgtacaattgtatatatatattcatatgtacaattgtatatatatattcatatgtacaattgtatatatatattcatatgtacaattgtatatatatattcatatgtacaattgtatatatatattcatatgtacaattgtatatgtatattcatatgtacaattgtatatgtatattcatatgtacaattgtatatatatattcatatgtacaattgtatatatattcatatgtacaattgtatatatatattcatatgtacaattgtatatatattcatatgtacaattgtatatatattttcatatatatgaatatatatgataaatgtgatatattaataaatgtgatatatatcacattttcttcatttgtaaatgggcatttatgttgattctatatcttggctactgtgaatagtgctgcaataaacatgggtgtgcatatgtctctttgacatactgatttcatttcctttggatatatatctagtaatgggattgctggatcatatggaagttctatttttatttttttgaggaaactccatactgttttccataatggctattctaatttacattcccaccaacaatatataaggtaaattctttaggcattgccttaacctatacagtcactgcctcactatagaagttattttactctgattttgtggcatcattgtgttttaaacaaaaagtgtcatctattatgataatattatggcagctgtatttattttcctgctttctgtaaattagggtctcaagacttccttaagtacaattatagccaaaatctcatatgaaaaaaatgacagaaacatgcatcagataaaaaaatataaaaatcttcagtgactccaaaaatatatggtcatttagttttaaaagcaatttcaaactacctggtaggatctaatttaatgattcttaccatgatttcttaaagagtattcatcgttgcctccccttaacttttaatgaaaataactaccaaatctctttgttatttggaaactaaataaataaactggatcattaacctgaaaatgttatcagtggtcccaaagtttcactaatggaattttacatatttaaattaagcaataaaggataagaaaatatgtaataaaataattagatttaatatctatatgtggttcatggaaaaatcaaatgttactttgaaactttgtccctataataatatttaattataaaatacacaatagaaattactcttgagaataatttttatgtacctgattgcatttcaatccacatttcccatggaacctgaagcaaataccttacaaaaaagtaaaaattctataaggaatgtactaaatttgtaccccagcattagtgatagaatagatgtctacacagattacaaataagtcaacaagttatttgataatgccaattcttagatgaaactaaaaccttttacattatctatattgttcccttttatatcaacaatgatctttttcctttacctagtcaagttgctagagaattcccctttcaattcatgtagaaatcactttctttataaatctgtgcccatctgaaaacagccaatacttcttggatttttctttattcattcttcacatgactttctttatctgaaggaaaaatagtagatataacctatgaatcttattattcatcaaaaagacagagaatgaacatgtctttagggattactatgaaaatttgacaaaaactatatatgaagatgaaggcgagtatttgagatgacttgcaacctgtttttctgtttctctttcttagtttagaaattcaatataactatgatttcagataatacaaaccttgtcagttttgttttatgaataggttggatgtctcctttactagaaaaatgggaaatatgtttagtgaatattcaacgtatatgtagaagtgattagtatattatttattgcaatttgagaaaccaaattgaaaagtcaccataaattatgaagaaaaatgcataacattccaacccctcgataaaatttctttgaagttaatatgaccatataataacttttggtgttagaaatatatattttatttttacttgaactccgataacttcagcaaaatgctgttaaaagtattctgtgcctccctccattattgtattagatgttttaagaacataacaatgtggtgattattaagagtgaataattatatttaatgaactatgaccatgatttgaattttatatggatggtggtttactttctgttactgaatgttgcacccagtgttgtgggattttgttttgttttgtttttgagatggagtctcactctgtcgcccaagctggagtacagtggcacgatctcggctcactgcaacctccacctcccaggttcaagcaattctcctgcctcagcctcccgagtagctgggattacagatgcccaccaccatgcccggctaatttttgtatctttagtagagacagggtttcaccatattggtcaggctggccttgaactcctgacctcaggtgattcagcctcccaaagtgctgggattacaggcgtgagccactgtgcccggtcataccaattgtttttaagtcatagggtaaaattgaaagggcacagacaccagaattaaaatgcaggtctgtgtgaatgacctgaactactctggtcctcaatttttttcacccataaaatcggtgttagatttcctactttcccaggaagtggtgaggatggtgttgtcattattgaataaattcaaacatgagtcatgtaccacagcatctaactaatataaaacgcttagttgatattaattctattgtctctatgtgagtatgattaaatgtaaaaaagtaacactttataaggcaaaagatatttctcaaaacaggctgaagataaagattatagctatagaattatcaagaattatgaaatatataaatagaagtaaagttagttaacatttgggagatacagtgttcaatcagtaatttattaggcatgcaaaattaaggctgtagacatagaaaaataattatctgagagcaaaactaaatatcatgtctatgtttctaaatgtcagtacaaatagcaaatggagggaaagaaaaaaaaaagggacattttgctttcagcataacactccatgcatttgaatgtttattgtggttttttaatgggtaaaatagggcttcttaactgagagaatgaatttgtgttcaaatagtggttttcaatttgttctaagcttcttaccaaattgaaaataatgacccattttgccaataataacctcaagatgtctttaataacccaaggtattttgaaccattaaactggcttgaccaaattctgcttagtagcacacatgcagtttctttcagcatcaagaaaattactacatttttcttttcaaaaggttaagttagctgtgaactgaagtttttctaatttaaaggttttttaatactctataggtatagctaaatctcagtaattgaatttgttcgtgaaagcaattgtatgatcctagaatacatatgtggttttcagttcattgcttatggcattggttctcaacgtgtggttccttgaacactagtagcatcacccaggaacctagagatgcaaatttctggtccctgttcaagacatagtgaatcagaaactcaggagttggagcccagcaacctatttttttaaatcaattttattgtatatatttgaggcttacaacgtaatgttttgggttacatatagacagttactctagtgaagcaaattaggaaagctattgtcttggtgtagcttgtttatatgtgacaagaaccacaaaaatctacttacttaacaaaaattgctaatacaatacaattaacatgccctccaggtgattctaatgcattctgaaaatctatcaagtccatatctggcatttaataccatacattagtgtttgcagcagggaagcaaaagttttgaggagagagccctcatcagataggtctaatgaagtttaatgagtcttgtgtgattaaacattgacaagccggaagactttggggaatcataataagaatcattcgagtcatgagagtctcattggataactttcttcagcaattcattaaacattggagaatcaggatgggaagaggaggcactgaaagaaaaactggtgaatttggcatgggatcatttatctgaccacaagctgagcagggagactgttgtcttttcatggatgtcatgtctcttacagaacagagaggtcttggacttgctgctaaacccacccaaggcaaccaaattatggttgtttttattccagtaaagtggtggttctcagatcccagtgtacttgataatcccctgcgtaattattttgaatacgtatgcctgagtcacttcctgagagattgtgatttaggaggtccaaggaacatacttacaaaacagtgctaatggattgtaggtaggcggatgattttattcagatgccttgtacaaaatcagtattatttttggattgaaaaacagctaataaaaaaataaacacttaaataaagtattatcaagaaagctgttttaggaatctccacatatgggaaatactttttggtgcaatttctagtatcactgatttaataaactaaaaataatatcagataattgtttatattgttaatgacaatgaatagatagctactctatggtttactagtgttctgcattatgaaaggaacagaaaattcatacctttgtggtccagcagctactctaagtaaagtctcattttgactgttctgtaagtactttccttatcattgctaatggtgattacagggccactctattattgtaagttagctcaagcaacctggaagctgaggctacttcaatgatcatttacaagttataagaggaaattggttgtgaagagatatcccgcaaattcagaattagcatggcatatgctacttccatagagtaagaggaaacctaaaaggtaaaatgtagaagacgcagatagggaaaagcaaaaataaagcataaaagaatatgaaactgtctggatgatatgtgtgaaactttgccaaaagatgactcaaaaatcttcaatataagccgcataatgcttccatatatgtattaaaaggtcaacataagcatatggatttataaaaatgaacaatcaacaagatgcttttttttttttgagacggagtttcactcttgttgcccaggctagagtgcaatggaacgatctcggctcactacaccctccacctcctgggttcaagggattctcctgcctcagcctcccgagtagctgggattacaggcatgagccagccaccatgccctgcgaattttgtatttctggtagagacggggtttctccatgttggtcaggctggtctcgaactcccaacctcaggtgatcagcctgcctcagcctcccaaagtgctgggattacaggtgtgagccaccacgcccgccacagtcaacaagtttaaagtagttgacagtgtattgatatgagatgatttgcatggaagtaggaagatgaatgtgcagaaaaattgctgattttcaagagacataatttcagacaaagatttactaaattgttctggcttggctgatggtaacccatcacttgtgccgtgactcggagccataaaggaaaatatatcaaatagaaaaatgaaatatattaaggtgttattgcaaaatgcatgtgatgtttaggttacattgtcttgcttatgaagacacagctaagtaatagtacatatcaaatgtaaacttcatggagagatgaccagtggttaatagttttatgtaatatttgttatcgcataaaacacagaaaattcagaagtagatttatagtaaaaaccaatggggtttaatgatataggaattgctattccagtaaagtacagaaaaaaaactctcattaaaaagcataaaggttgatttatttaaattgcggtgggtttgtttactaacttcagtggataaagttctatagtaagaaaaaggaggcacaaaaagatccaggagacctggcgtgctggctcacgcctgcaatcccagcaactttgggaggccaaggtgggtggatcacgaggtcaggggatcgacaccatactggctaacacagtgaaaccccgtctctactaaaaatacaaaaaattagccgggcgtggtggcgggcacctgtagtcccagctacttgggaggctgaggcaggggaatggcgtgaacccgggaggcggagcttgcagtgagctgagattgcggcactgcactccagcctgggcaacagtgtgagactccgtctcaaaaaaaaaaaaaaaaaaaaagagaaaaatagaaaaaaagaaaggatccaggagtcttaactttgtataccaagtaaaaacctcacgctcaaaatggatattggttgtcataatgtgtttaaaatactctagcataatctttaaagaaaaatgatggtcatccttttgttatagtgacaagtcactacttatttatgttttgaattgagatttgtttatttttttccactgccttattgcaaagcacttgtcacataaaatatatgctcaagggccttggaaagccaatgaagtgagttatacatgggctgagattaatcagtttattatttcttaagcttagtagctataagtaaaagtaaaatgcaattcagtatttgaaaatgccacatactgccctctggagttttccatgcagaagaagaaatagaaaaatgagaattgcgaggatttagaaacgacatggagtagcttttaaaaataagattccaagctgggtgtggtggctcacacttgtaatctcagcactttgggaggccgaggcgggaggatcatgaggtcaggaatttgagaccagcctggccaacatgacaaaaccccttctctaccaaaaatataaaaaattagccgagtgtggtggcactcacctgtaatcccagctactcgtgaggctgaggcaggagaattgcttgaacccaggaggtagaggttgcattgagccaagatcatgccactgcactccagcctgggcaacagagtgagactctgtctcaaaaaaaaaaaaaaaaaaaaaaaaagattccagtgtatattccatgtagaaatgggaaaatttacatttttcttgaaatagtatactgcccaatatgatgcttttatttactctagcttagtagtgctaaaactttagcctgcatcagaattagctagggagctggttatacacaacttgttaggcctcagccctggagtttctgataccgtaggtctggggtagagtttggtaatttgcttttttttttttttttttttctttttgatacggagtcttgctctgccgcccaggctgaagtgcagtggtgcgatctcggctcactacaagctccacctcccgggttcacgccattctcctgcctcagccgcctgagtagctgggaccacaggcgcccaccaccacgcctggctaatttttttttttttttgtatttttttagtagagacggggtttcaccgtgttagccaggatggtctcaatctcctgacctcatgatccatccacccatgtaggcctcccaaagtgggtacttcgcttttttgacaggtttctaggtgatgttgatgctgctggtctaggaaccacactttgagaacccttgtccgagtttctcataagcaaatttgaaacaaacaaaaaaagcaacttcaaaggaattcctcaactgttttataaatgcacttactatggatggttacctttagaaaatttacaaggaaaaatcttgaaattttatggggattgttgaaagaggaacatttgtttcattcgatttttttcctctctagcaacttaagggatccatacttacgtctgatggtcatttctggacttacaaagacaatacgatacaattctgtttgtggtgaatagactttctgtatgatgaatgggtattagtttgaaaatgtgtcccctttctgctgtattgtgcccccttccccactaaaatcctcaatgccatttaccaatcttttcctgaagatttcttgttattgacaagcagagggagattggaccgtgattcaaatgaggttgacaaaaaccagaaagcatttgatttcaagactctaaatttacccaacgttttgttctggggatttggatattttggttataatggtcgtgatacttcctgactcatcagtcttctcagcattctcatttcccttacaactcaattgaaggctggccccagaggaactggggatctgtcaagtagtgttcatctcccttctcctataaagggagatgactgtatagtcaactgagctgaattctgcttcagtggagaagaaacaaataagggagaagcagttctgcccattagaggacataccataatacattgttgatgatggagcaggggggatgcctttctttttctctgagaaagaacagaccagttttgctttaatcacttgttttattggctcattttgaagatgtattgaatcatctgatcattacattcacaattatactcttaatgaactattttttctcactgtagttacactgaacttctcccaaaaattcgattgctgtctccagctgaatagacctattttattttatgaaaaattggcacaaaatgcttctgttcttttctagggcagagtggttaatttcatttgaaatatacttggttttcttataagaatcactgtgtatacatataagtacatttgcataaaatacaacatttacaataaaagtattgtttaaggtactgtattgtttaaattaattttctattattatactttaagttctagggtacatgtgcacaacgtgcaggtttgttacataggtatacatgtgccatgttggtttgctgcacccatcaactcatcacttacattaggtatttctcctaatgctatccctcccccagcccccgaccccatgacaggcccggtgtgtgatgttcccctccctgtatccaagtgttctcattgttcagttcccacttatgagtgagaatatgtcgtgtttggttttctgtccttgtgatagtttgctcagaatgatggtttccagcttcatctatgtccctgcaaaggacatgaattcatccttttttatggctgcatagtattccatggtgtatatgtgccacattttcttaatccagtctatcattgatggacatttgagttggttccaagtctttgctattgtgaatagtgttgtaataaacgtacgtgtgcatgtgtctttatagtagcatgatttataatcctttgggtatatactcagtaatgggatggctgggtcaaatggtatttctagttctagatccctgaggaatcgccacactgtctttcacaatggttgaactaatttacacacccaccaacagtgtaaaagcattcctttttctccacatcctctccagcatctgttgttttctgacttttgaatgatcaccattctaactggtgtgaaatggtatctcattgtggttttgatttgcatttctgtgatgaccagtgatgatgagcattttgtcatgtgtctattggctgcataaatgtcttcttttgagaagtgtctgttcatatccttcgcccacttttggatggggttgtttgatttttttcttgaaaatttgttcaagttctttatagattctagatattagccctttgtcagataggtagattacaaaagttttctcccattctgtatgttgcctgttcactctgatggtagtttgttttgctgtgcagaagctctttagtttaattagatcccatttgtcaattttgccttttgttgccattgcttttggtgtttcagtcatgaagtccttgcccatgcctatgtcctgaatggtattgcctaggttttcttctagggtttttatggttttaggtctaacatttatgtctttaatccatcttgaattaatttttgtaaaaggtgtaaggaagggatccagtttcagctttctacatatggctagccagttttcccagcaccatttattaaatagggaatcctttccccattgcttgtttttgtcaggtttgtcaaagatcagatggttgtagatgtgtggaattatttctgagggctctgttctgttccattggtctatatctctgttttgataccagtaccatcctgttttggttactgtagccttgtagtatagtttgaagtcaggtagtgtgatgcctccagctttgttcttttggcttaggattgtcttggcaatgctggctcttttttggttccatatgaactttaaagtagttttttccaattctgtgaaggaagtcattggtagcttgatgggaatggcattgaatctataaattaccttgggcagtatggccattttcacgatattgattcttcctacccatgagcatggaatgttcttccatttgtttgtgtccccttttatttcattgagcagtggtttgtagttctccttgaagaggtccttcacatcccttgtaagttggattcctaggtattttattctctttgtagcaattgtgaatgggagttcactcatgatttggcaataaaaaatccttctcaaccagttcaagttttatatttgtgtattctaggatagctagtgtggtagttagaataatgactccccagagatgttcatgtgtttatagctggagctatgttacctagtatggcaaaaaaagaaaagactgtagatgtgattaaattaaatgttaggggatgggatatgatcctggattatctgggtgggcctggtgcagtcacaatggttcttataaagtctgactcagaaaaggaactctaagtaaagctttggtaatcaacattattactgaacgcatgctgagtttgaataggctctgctgtgacttttaatttttttgtacaaccccaaaacataagtgatattctcttattggttttgagtattgagtccttataagagtacatgaaaggacagttcctacctcactgctgactagaacagtggttctcaaattttagtttgcactggaattacctggagggcttgctaaaagacaaaagtatccgattcagaaagttgggtggggcacagaaatttgcatttctaagttttccaggtgtgggtttgtgaatgagtggaatgggtaatctactcgtgagcactactggcccagaagaaggtttcataatctttgaaggaaatgaaaaaaaaatctactttaggcttattgatcaaattaacaacaaatcaatctctctctctctctcaagatttcactaatccttgtatttcaggccctttgttgatcatctcattgaataagccatgttacattggatagcatcacatataaggatggttgtcagtgcaatgagaactactgtcaaaaaaaaaaattgaggaacaatgttttatataaagcacctctgaaaacctgcagatataacgaatatttattattaaatatttttaatcctttttcatccttttgagattagtaagactcaagtacttctctattttcaagaagaaactcattattattattattattattttttgagatggagttttgctgtcgttgcccaggctggagtgcaatggtgctgtcttggctaactgcaacctccacctcccgggttcaagcaattctcctgcctcaacctcccaagtagctgggattacaggcacccaccaccacacctggctgatttttgtatttttagtagagacggggtttcaccgtgttggccaggctggtctcaaactcctgacctcaggtgatctgcccaccttggcctcccgaaatggtgggattacagatgtgagccaccacatctggccagaaactcaattatttttgttttttgaaaaaatagtggaacctccattaggctattcccttaattccaaatcttgtgctctatcagttgatcctcatgacctaatccaaacataattcctttttcatactttgctacattgctaagaatgtaaacattacagtgacgttttagattcctgtatctttatctgtatgtacatgtgtgtgcaatacatgctcaagtatgtctgtgtatatatcaaattgtttctgtgaaacaaagaaacggaggggtggtgagagttgaattgattcttggaaaatgcatccatgcttttgtgtttccttcttttgataaatataattactttaaaataaaaccttctatattgtctttccactgtgtgaactatttaaaattcccaaagaaagagtttaaggaacatgtgatctgactgagttgctaacatgtgacctggaggagtttacctggcctcttttagtctcaattttctcatctgtagtgaaaacaataatagtctcatcctaggtttctgatgaggattatataatatagtacttggaaggtttttagcacaccatgtgttcattaataattacttattagtattctcagctatttaatactatattctcactactcctatttgcaaaatagcactgttaggtctccatggagctctgaataaatcttttgaccataagaacattatgattcagcatctaaacctataattttttacatgctaatagtctaggtattactgtttgaaatacattatgttaagcatctgacctcttccttgtactttgaataccttgatcatttcagctaaagttcactgatggggcaaactttagaaagaattaggtagaagcattcactgactaattcagtcaaggaacaattctagaattcctactatgtaccacatactcttttttagagatacagcagtgaaccaaacataccaaaaattatgcccctgtggtatttatattctagtggagtgattgctctcaaaattgcataaaataaaggatggcaattatatttatataactgctaattcaactttatccatgtttcagattttcaagaaatgctcctttttaaattatcataataaagcagatgcaactgaagaccatttacgttcatttttacaattcatctagactcataagcactaataataaataatctctaagtcattgaaatattgtcatttatagtaagtatgtatttggtctttttctccatttcttggcaaacaactgctaaagcccatggaatctccaaaatagtgtctttgtgtgtaataatgagatgactgatggctctggcctcttagatagctttaagatggagggcggttgccaggggaaccaaccatgttattagagagttggaacttttagccttgcccccccccaccccatgccttccctgacctctggtagaggagaagggctgaaggttgacttgatcactgatagccagtgatttaatcaatcatgcctatgtaatgaagccttcataaaaccccacaattcttatggaaacagaaaaactgaatctggcactctgctttactagactaactcctgggcttttccattctgtagcatccaaaggaaaaaataagttttgtgttggttgatttgcagacaggtgtgtagcactaatgactgcattccagaagtggcagagctaaggtgatttgattttctaaaatggtaaaaaagcctttgtaaaattgcaaagaaaacaaaccaaaatcttcctttggattgcacatagttgaattgctagagaaatcaattacattaaactttgaaaaaagattttacatgtttatattacgtggagttaaattacacgctcatgtacttagttttttttttttttcacctttgtcaatgtctaaagaggcatcccaaagtcacaaaaattgtgaaacattgttttgtcatttggtaacggccagcatatgacaaaacttgtaacatatgtgccctgtggtaggcacaataatggccttcccaaagacattcatatcctgatttttggaacctgtgaatatgttagcatacatggcaaaaggaactttgcagatatgattaaataaagatcttgagatggggagattgccctagattatccaggtggactcagtgtattcacagggtctttataagagggaggcaggagagttagagtcagagaggatgagatagaagcagaatttgaagtgatgcgggaccatgagacaaggaatataggcagcctttagaagctgaaaaaggcaaacagaagggattcttccttagagcctccagaaggaaagcattcctgcttacccattttagacttctcacttccagaaatataataaatttttgtagttttaaggcactaagttttggttacttgtttacagcagcaataggagattaattcatgtcccaagtacttaaggccagtattgtcttccaatgaatgtgacgtcaaaaaaagaaaccaaatatttctatactgtttcctgtggagatgtactactctgattttttccctcttctccatccctgcagatgctgactgagttcgctctgatcatctcccatctgaatcaatatagctttctagaattttcccattcttcaaacttgcatccctccaatccagccccccaccatttgattgttcaaacattttttgtcaaacctaaatcctgttatttctctgcctaagcatccttatggtctcctatgtttctgtggaataaagtgcaagcaggtgactttgactgacaaacccctccatgatctacatcttgattgccttttcagtcatctccctcatcacatactcatctctataccctgtggtacaaactgtcatccccagtacagatgagattattttcttgcctctggctctttgttcaaacttttcctactgaatgagatgccctcctctctcctcttcactcccattccctattttattttattttatttacttattttgaaacagaattttgctcatgttgcccaggccagagtgcaatggcacgatctcagctcactgcaacttctgcctcccgggttcaagcgattctcctgcctcagcctcccaagtagctgggattacaggcatgtgccaccaggcccagctgatttttgtatttttagtagaaatgggttttcaccatgttggtcaggccggtctcgaactcctgacctcagatgatctgcccttctcggccttccaaattggtgggattacaggagtgggccaccgtgtccagcccccctttttttaaaaacaaaacaaaactttttcttgtttttaggacgtttgctcaaagaagctttgtgttattcctctagttagaactgaccatgttcttctttaggaacccatttcaacgtgtatatacttctattataaaatatacacatatttctattataaaatatacaccgtcatcctgacttgtttgcgtttccatttctcatttctagcccatgagtgcctaggtggcaggaatgatgttttattagtctctgtgttcccagcaacgaatatagtatttcagagagtagtagggtgcctaataaaggcttgatgagtgaattaaattaaccagtgctcacctgaggacatatgacatttgatgaaaattatacattgatttcagctgtaagaaatgatatttaaattattatccagccaaggtttgttttcttcaacgcatcacttaacatgcccctgtagaatgccattgagccacttaaattatgtatttttgtatgtttgtttgttttcttttttgagacagagactatctctgtcgcccaggctggagcacagaggcttgatctgggctcactgcaacctctgcctcccggattcaagtgattctcctgcctcggactcctgagtagctgggcctacaggctcatgccaccacacatggctactttttgtatttttagtagagatggggtttcaccatgttggccaggctggtctcgaactcctgacctcaagtcatctgcctgcctcggcttcccaaagtgctaggattgcaagcatgagccaccgcacccacccacattatgtattcttcattgagactgtgttcctattcttttttccccggatttcttgatgagcattttgtgaaagcacaagtaaaataatgttctcaagtcaaaacaaattaaataaatcaattcctattagtacactggacttgtcatagaagacaattttgtgagtctatatgagatgtactgtgttgttcctaaagccatgatgatttctgttattccatagaagtctaataaagcattcacagagtaaattgtacagtgttaaaaacctgccatctttatcactttcagtaacaccttctaaatgatcgtgagtaatttgtgattttaaaaattatatttttaggtatcaaagcaataatgaaagctttttgtcaagtgaatcactaagtaaaagtttgcatttatcattcatgtaattacagaatattcaattgactggaaacattccttaacactttcttcttaaataagcatggtggtaaatttccaatgatgtctatattcttacgttttgttttttcacagaggatcttaatggcatgtattcctaacctgactttatattgctatatgactttggggaaattacttacccatgctaggcctctgcttctctaactctaaaatgagaataataatgttgataatttcaggaggttgttgtgaatatcaaatgaaaatgccagtaaagcacttaccgcaatgcctggctcaaagtaaacgcttgatcaagattagctataaatatcattactagttgtggatacctgtgctttatttgtttatgacataatgctcttcatttaggaggcactctatgagtgctgttgactccatgatactccaagtcataaaacataattaaactacaaacctggatgtcaaggtgatttacaatgtaacagagatatgataaatctacaactaattataaggaagtatatgattaattgcttgagaaggtcaaatgtgtaataggtttataaagaaagcagaaatgacatttttagctgggctcaggtatcatggtgtcacagcagcaaaaaaaaaaggctccatttaagcatttaagaatgggtctaattttgacaaaggaaataaagaggtattctaggcaaggggcagcaaatgactaagaagaaggaggagagtggaaatacttaaataaagcaaatagttttagttttacttcagtcaccctactattagtttgagaatttttattacctttatctctaaataaaactcactgttaataggtgtttacataacagcctgtaataagcttttaatatttgttttcatgttgatgtgtgaaggtttttttattcataaaaattatgacacatacaaaatatagtgttgctataaaaatgaatgatgatcataccaattttttaaacagctagatacatgcagcagagttgaaagcaaataacaaaaattctggtatgaaaaatgatgtaattggcctcataagtcttctttgtgaccaacttggacagttgctctggctgatacaattcgttttgctataatcaactattaggatgccagaaatgagtttgacaccttgagtacaatcctttagtccagttttgaaaaaggctaggaactctgcaatagtaaaaatattaaaaagtcagtttaggttgagaaacccttgatttaaaagacttttatttgcaacaatggcctagtagaaaggaaagaaagatagaatataagaaaaaggaggaggaaagacaagtatatttgtaatcttgttcccatagttgtggcattaagttaccacggttgcaggaaaaagaaaattcatctctaaactgatctaaggtaggactggagtgtcatatctttaatacatatttctgttattactaataattataatgataataataggtatttacttattgactagtatatgacagatattctatgtggtgtttgtgtacataatttataatgcaagagaaatttttaaaaaggtatgtacatttcataggtaaggaagtcaaggtttaatgaataagtgacaaaatcagcatttgaaattttttctgcagaaaagtaaataccacatattctcacttataagtgggagctgaattatgagaacacatgaacacatggaggggaacaccacacactcgagcctgttggagttgggggggagggagagcatcaggaagaatagctaatagatgttggtcttaatacctaggtgatgggatgatctgtgcagcaaaccaccatctacctatgtaacaaacctgcacatcctgcatatgtatccctgaacttaaaagttggaaatccaaaataaaaataaagaaacttgttctgtataacaacaaagtatttagccattcctctgttctagacttggtctagaagggtcttgcatgatgtttggcttataaattgaggagcaaatgaatattttatgaaaacatttactaatcctcagaatcttctgccaagaattatgacatgtgtaagacttgactctacttgaaagctaacaaggtagcttgccacaggttcatgaatactggcacaaaagacacagagtattgggacagaggcaaatggccttattactcatggcaataaaaactccccaaaccccaattctgagggtgtggcatgaaaaaggtcagatgacgcctgtttgtactgtgagttgcattataggataggaaccctgagtatagggaaggtaaatctttatactggacagtaagcatgcatgcccattgctctgaaaggagacactgtcttcatcttccaaggccgttcacaatgcaaacatcttttaaaacatcatctgcaccaaagtacctctacttgcaagacttaaaaaaatgtgagcaattcaagaagaattttctcctaacacctttcatttacacaaatgtattcttaggcacatggaaccaatctatcccgttttcaccccttactcccctatcctcatactcttctgctttaactgttatttagattccaccatgctgccataggagagactctagctgtaatacattcaaactgacattgaccagcctgaaactggaaggaaaccatatacttatttggcacaagggaacttggctaactctgaaaagctggtctaaactgccctctagagctctactctaccaattagtgccaaatctaaccaattacatgcagttcccatgcatattcctctctttgtaaatgaaaagtaagagctaagtaagcagtgggtcacccagcttctggctaaactagaatagcttgcttccccaggagcctgcaatacttacagcctcaaccatgtggttaaaatcattctccttccacagactactcctctgtgtctttacaatgaacttccatccctttaagcaatctctgcatgtctcttcctttgtgactctgagaaatttgactggcaggataggactatatttatcttcctaattttaaaagcatttaattaccaataattaccaccaatgtgattttttcccctagtgcacattaaaaattttgaatcccattttctgtaataatttaagttgatctggagggacagagagtaattaattatctataatttctcaaactgtaaatgccgaatttattgaagtgaaacaaatccagggtagaataaggctgaaataaataggattgcatgagaaagaaggatgcagcaaaattaaatattttttcaaaattgaaagagcttaaagctcttaagtactgtagttgggttaaaacatacactttttttttttttttttttgagatggagtcttgctctgttgcccagactagagtgcagtggcacaatctgggctcactgcaacctccgcctcctgggttcaagcgattctcctgcctcggcctcccaagtagctaggattgcaggtgcccgccaccatgcctggctaatttttttatttttagtagagatagggtttcactgtcttggccaggctggtctcgaactcctaacctcgtgatctaccagcttcggcctcaatgtgctgggattacaggtgtgagccaccacgcccgcccactattttaatcagtatgtcaggtcatgtctcctaaagccctttttaaacaaaaattgagtgtttattgcttgcaaaatgtttttactgtaatgagtttaatatacaactgtgagccataagaagggaacaattgagaattgtgttgtttttgttttttgtttttccactgtggttctttaataattggtatagtttagatagtacgtgttttttatttgccaaatatgtaaacgttcttatgagcttctttacagaacgtcttcagtgtgaataagaataaagcagaatataagatgtgtctgtgcattttgcaacgtattgccatttaaagggcatggattttggactcaatcacacttaagtgttataagctctgaatgtattaatgatatgattttggacaagatatttaacctctctgatactattttcattatctctaagctggtgataatatttatgttgcaaatctcttgtgagggcattatggaataaattataaagatatctaaatcagtgtctagaactctttaaatgttatcttcatttccccctctttttcctagtttttcttgttcccttatgttccctaattatcttaatatctaattcttcctgttatataagttctcagaagaattatatattcatataaagtaagtgttcacctgttttcagtaatttcattatctcccatttgagaaattagaattatttcattactgctggtaaatatgaaaagaacaagaagaagagggaaaatattatatattttcctacccaactttttcctaaagcttagcactaaaagctcaatttttatatatacgttcataaattacttgaatcattcaaaagttgtctgggataatgtgtgattcatattttatatctctactctggcactatcagatctgtatatcaggaaatgtactttgaaaactctagatctttataccacaaacacaaggcattactattgataataatataatccagttatgggccacacattgtatgaggcattagaagaagtatgacgtgaatggcatgttgggtcatggtttaagagataagtggtttagagcatggaccttgaagttaggcagatcttgtttcaatcctgactatcactcactgtttgaacttagacatatcatctaaactctccaagcctcagtttcctcatctctaagatgtgactaatacttactaccttacagtatcattgtaggatacgataatgtatgcaaagtgtgatgtatactgactagtacttaatgcaaatttaataaatggtaattattagtactattgctaataagacaagacatctgtccttatggactgtcagtgtagttgagaatagaggatcatacgctatttggtatcatatgaagccagatgtcctatttccaataatagaggttttttaaaaagtactaaatgggtataagaaagattaagtttcattggttgactctccaaatcgatttcagtagcaaccatattccttgcacggactatcaaactgtggtacctgctgcagagggattctactgatattaacttatgttggtgttaaggattagtcaaagttgttgtgaacatgacaaaatactaaaagcacttagcacagttgatgggatacaccagtaattttatagatgttgcccatttgtatattcttgtcaagaaccaattttgtaaggcagagcttacaaaagactgttccttgctgagaaggctgacagattcctggtaattgatgccgatgtgtgttgaaccataattatgaactataattagtactatcctccatagattagaatggtctttatggaaatccttttttcaattaagtactgtttatggcttatgccaatacattcagtattaagtcagaactcttccctgatgaaagcatgatgaatcttgcaatgacctttataaacttaataaaataacattaattttaaaatcttgtatccaactcaattatatactggtgtattgaggatctgttctctataactgaggtgaataatacgagaaaatcaaataatattgaccagttgacatgaaaaaatacttattttggaattggctgtattgatattatattctctgaaatgcgcatatatttcaccatgtctcaaataatagattgtatatagttaagaaacatttgtcattcaagcaaaaaatgagtttcatgtatttgcaatctaatatatataggtatatgtatatatttgtgtttgcactgatcaaacaaggttaaatgtggctttcttgcctatttatataactaattgtgatgtacattaattgaggtaatgatttaataattataaaaattaaataaataagcactacgtatataatgtaataaacagaaatcaaccttatcacttacttttcttttaagtgtattgggctattgttcctcatgttccatgaaacctagtccgcattttataaccctcggagtcactttcaggagaaaaaagaaaagccctcctctcagtgattaatgtggcctgtaataatcaaaactctgtacttattttaaagcagtggtttccttcttcatttccccccacctccccatcagtctggcccagcagcaagctaaaagcccagtcagaaaaggagatattatttgatttcttctttctttccctgccatgtactttgacaccttttgctgtatctttcaaaccaggttttggattccttatgattagagtgtggggagggaaaagaaataaagggggcagcagagtgttaacttaactggcattgtggtaatagtccacagggcgcttcagaggtagcaccgacctcccccatggagaaaccttctgcctgtggtttctttcactggataaaagtacctccatttcagcttactacagtctccgccctcatccccaggcatttagaagctcttttcacatccttctgctgaggcatgtggcccttacagagatttatcttggtcagggtctaagatgcgactaccccagctccttgtcgcacgtggcccacctctgttccattcatgctccaacaaaatttgagaccaactccaatgcaagagcaaactctcctttgctatggaactccccagctagccagtctactcagctatgtatcaggcagcagtctattctttcgttctccacaaaccgaagggtgaaggttttctcttgactcagagtgaaggggaaagtattccccacccctccaaaggggacacgactcgcaggcatatggacagttgactccaaaagctgtttcaacttcttacccctttatgcccttgtgtgtgggtagtcaagagccatggcagatagaaggtgtcttgttcttcaactgaaacttaaattttaaattgcattacataatttttcagtatttctctattatctttacaaaagaacatatacttactgaaaacaaggtatctggcatccctagtgtgcattttggtggccccaaaatttctttgcagtgaacacatttaatagatggagtgattatttaacagggaagcatttatttgaactcttaactgtttaatataaccaactagtttatttcttttacattgtaatgcactaaaagtaactataaactagaaaaccaaatctatatcattgaggaacaattctattctcaacattgaatgccattttaagattaatggttttggcttataataagaactaaatataattttaaaaagctattttcctatttatccatttatgatatcttccaaataaaatgtgattccactaaaattattgatgatattaccataaattcctaatataaaacagacaaaaaatatatgtagcaatctattttctttgactgttgtcataaaaactattggatatgtggcgtgtgtgaatatattatggttatgttcagaacttattatctaactttttctcatgaggaaaaatgattaggaagtatgttagtactaaccattaactagaacagttaatatgttaaatgttcataatattaacaatagcgttttaagcacataccttaaagaacagtttagatattagccaaagaatagtattattattattattggttgagtgttctatatttacattataggatttttattagatagcatgcttataaacattcttcatataaaatatagctaaaagttgagtgattgaagataactttattgttttttagtttataatttactttgctataataatctttcccatatgaatatcatattgattatcagattttccactttgaattttgtatttgttttttcaaattgtcagtgttgttaatattgacaagtagaaataggtaaattgaacaaccaagctacattagtatttcctactaattttttaaattgctagtgattaaattaaatgtcttatataacacaaattctcagaattcccatattaccatcttctaaaataaagttttctgttttttaatttataatattcatcaatagaaactgcatcagaaaatagcccatatattaactcttgcatttaagattttggcagaataaaagataaatagccttttaggaaaaaatgtaccctatttctcccccaatacatcgtagatctagggtaaaactactcttttatagaaaggcaaatcaattgaaatatagaattattctatagatatagtgtagtaaaagattagggcaggttggaggcgggtgtcatgataaaaatgtagaacaagggagtaattttatgatgatgaaatgaaacagcctatatcttggttgtcatagtggttccacaaaatgatacatataataaaattgtaaagaattaatacacacataggcaaataaattccaataaaaactggcaaaatctaaaatactatatgtagattgtaccaatgtcaatttcctagttttgatattgtactagggttacatgttacttatggagtaaactggataaagaggacaggagacttctctgtattatttttgcaacttcttgatctatatttatttcaagttaaacgttgaggaaagataacctcttgaatgttttagagtttcttccatttaaccaaagttgtgaattgtttttcctcaagagacctgtttttcacagtaaggttgcttaaaattagagaatggcctaggaaattaggtatatcattaatatcaaatatacttaagtaaattaaaagagcatttaaaaatcattggactgaaatactttgaatcaaattctgaaagagaaacattaccatatataaattaggcaaagattattatgattatttaacaaataaatttagccatgtaaatgctttgtttttttctcatgaacatcatttatattcatggcattgttagtaaaagctagtacctctgtttttatagattttcatttttttaaaacattaacacaaaaatgatttatacagtgtattaaaagatcagtcctctattgcactgttagcaagggctatctaaagcaaataggaccttgagatctaaatgtattgctgcattcatgtgtagatatctaatgtgtacccaccatgtgctagacactattacagaagctgtggtgtagcatttggggagaaaaagaaaacaaaccccttttcctcaaagacttttctttctgttctggggagatggaaaaacaaatacatgtgtttcaggtaaaaatatttaaaacgagatttggtctataaaaagttgtttaaaagacactggtatttaataaagacgaaggaattacttgggtatgaaatggtaattatatttattaatagagcccacaaatgtagtattagcatcatactcagcatttagagaattctcaggagtggagtcgatgcatatcttttttctcacatgccccacagttcctttaccagaggaaatgttccctatatataatttgaatgcattgtcattactttttttttttaacactgctccccttgaagtgggtcttccagtattggagatcaagttccacagtcacctcagtttataggtgagaaaacctatttgaagttaactcgccccaacccatttaatcagcaaatggcaaagatgaatttcagttctggtcctctgactccaagtccagaacactttcagggtaggaagaattatctcagaatatcttttcaaatagatctagcacaacactctcaacttcattttcccagagtcttatatattgatatgcttttcacagatatttactgagtactctgtatgtacatggtttctaggtgctgggggtgagaagagatatagtgaagaatgagacctaggttctgacgtcagtcctaaactgtgaagtagaaattctgtgtgtgcacaaatgattacagtattaatacaagggagaaagtggatcatgccatgagggaggcatagataaagtgctatggaagaccacagaaagatcaactgcttctatttccagacacccaggaaggtttcccaaaggaagtggcttttgttttaggctttgaattgggaggattgtggcaatggaactgaggctgtacttgggataagtacttttatctctccaatatagtaaattcaccaatatcgtccaaaagtttgttcatttatctaactaattactttttttttttttttttttggagacagagtctcactctgtcacccaggctggagtgcagtggcgccatctgggctcactgcaacctccgcctcccgggttcaagcgattctcctccctcagcctcccaagtagctgggattacagacatgcgctaccacgactggctaatttttgtatttttctgtagagacggggttttgccatgttggccaggctggtctcgagctcctgacctcaggtgatccacccgcctcggccttccaaagtgctgggattacaggcatgagccactgcacccggcctatctaacttcttaacctaaatccctgaaccttccaatttctgtagaaatttacactctgaagcagttaggtggattcctaaatttcctagatagtaatatgtctaaacaaattttcttcggtaatacttgacaatactaccccattatcaaaataacttgaagttagctgccaaaaagtccagatttatgccaggctgtcaccatgatgattttaaatttctgcattagtagatattaaacatttccaaaagtgcttaaatttccatccactaatttttttgtcataaaatagagattgcagatgtattttgtactttgaagaatattaagggctgaataaggtggaagcacttacaactaatgagcctgcacatcttgagtgagctacctagagaatgtttctccttagcaataaagaacgacaactgctttgttctagctcagtaataacaataatatcgtagtatgtcctttgggaaactaactgaaatataagttcagataagttcacatccttgtaaagcaatgatattttgctatgttgctttcctacttaaagctgccatggataatgcacaattaagtcaacacatctaggcttaccaaaaataaattcctagattgtatttggtcttatccatacaaatgcttttggtttatgggcctgacaatggaggagattggaggtcagaataatctcataacagttactggttgaaggcctcttgttaacccatcattattgctttgttcctatgacctggcatcagacttacccttctaatcagcagtgcagacctcccccaccacccctcctcccattttaactagaactctgcagggaacctcacacttgcttgactgagccataactcattgtttaggtctggccagttttttctcttgggggcagtaagttcctatatcttaactgccaactcctgtaaagggtaattctccatgatgctgcatggtattacactatactatataatataatactatactattatattaatataatgggaagcaataatattgcatcctgccttaccttctatctagtgtatattttcctaatcataggagctggcttttggatagcgatgccagtcctgctcaaacccaacttcatctttttcttttagatacgattttaggattcttagaggttagagccacatactttccttattctgtgtcccttcagtcttgttggccctttaggttacatctataaagcctaaatatatgcgttttaagttttaattattcactgtgagtttttgtttaactgaattatttaatttacttatatacaagttgaacaaaaaattaagtagaatctgaaagttatcattcttgctttctacttagaaatatagaaatcatttccaaagaaacaactgctttattgtaaccaaggcttgatttagaaaaaaacaatccatgatttttaaatgtctgatgtctgtttggagaattatctcaggctctctggggggaaaaaagaattagtgtatttgattcatactgcccatctctaaacccaattgacagccccactttaatgaaaatgcagcctgactttcctgagtgaatcactatctgattatacaaatggcccacaaatttctctgcattctctatgcctatacttccttcattcttggcagtaaattttagaaaggttgctgattttttatatacatcctatattatagggcatgtgagtgacattctaattttttaaagtaggcaatttagactgttatttaaattataagtttactgggtatcagcattatattttcttagttctttaaggaggtatttcagtgagaattttttttttttttttttgagatggagttttgctcatgttgcctaggctggagtgcagtggtgcaatctcgcctcaccgcaacctccgcctccctggttcaagcgattctcctgcctcagcctcccgagtagctgggaatacaggcatgcaccaccacaccaagctaatttttgtatttttagtagagacagggtttctctgtgttggttaggctggtcttgaactcctgacctcaggtgatccaccggtctcggcctcccaaagtgctgagattacaggcgtgagccaccgtgcccggcctcttctacccattttattttggccatcattgtacaatattttgatccttgagttggataaaaatagaagacatgcttttcaaatatatggattatgcaaattaaagtaacagaatagagatttatgaaccactctcaggctagaaggaagtgacaatttaataagagaacatttaataaggatacacacagaatcctgttcttggtcacagtagtgcactgcagaaataaagaacaaggaagatgccgctagatttggcaaaaaagattttaggttttttttttctttttttctttttctttttttgagatggagtcttactctgtcacccagactggaatgcagtggcatgatctcggctcactgcagtcaccgcctcccaggttcaagcaattctctgcctcaggctcccgagtagctgggattacaggtgtccgccacgacacccacctaatgtttgtatttttagtagacacggagtttcaccatgttggccaggctggtctcgaactcctgacctcatgatccacccacctctgcctcccaaagtgctgggattacagatgtaagccactgcgcccagccagattttagagttttcatgcattggtaagctcagcataagttgacagtttgatgtgactattaagcaggcaatggcaattgttggccactttaatataaatatattccctgggtcagtatttctcagagtggcttattgcatcaaaattacctggagaaattgtaaagtatagaatgcaagacccaacaagttatccactgaaacgaaatctcttggtgtgggatctgtatttttaaaaaaactttcaggcagtttttatgcaaattaaactttaataaccattaaaatggactaagggcaattttgatgctattctgttttatcctgttttatcactgcaggatagttgcgttttactctcttgcttatactttaagaagggtgtgaaattttggctgcattcgggaaaaaagcaactttacaaaaatggggaactaattcatgtccatgagtaatgcatggagaaaatggaacttttacatatttaggatataattgaacaattaaataaattatggtggttaatttgactgttattcatgaatatctgataaatatccactaccataaagagattgttgtgaatatcagatagtaacatgagaaaatgtttgtataaataacgttacacaaatattttgattacaagtgtctaaaaagaagatgcacattaaataacaccagaaaaaatacacccaaatgataagtggttttctttgaatgatactataatcacttttttttttgcaaaatagtctctgtttatgaatatgctcttatatacttaaattaattttcaaagttaataaaaactatgatattgttaattacctcaaataataaagtatactgtagatgagcagttcccagtctttttggcaccggggactggtttcatggaagacagtttttgcgcagattagggggcggtgcagctgatttcggggtgaaactgttccacctcagatcatcaggcattactaagattctcataaggagcacataacctagatccctcgcatgcgcagttcacaataggtttgctctcctatgagaatctaatgctgctgctgatgtgacaggaggcggagctcaggtggtaattcttgctagcctcctgctgtgcggcctggttactaacaggccacggactggccctggtctgcggccttggggttggggacctctgttctagatgataaaacattatttttttctaatacaggcaaatataaagaataatggtatgaaacgaatggaagtaaattctgactggatttaggaaaaaattttttctgggtctcaataggatgtgataaaattcacttatttaatcatatgtaccaagttctactttttaaattttgttgaagcaaatgcaatttatactttttttacaccatattcattaagtacctactgtttgttcaggatatacccatggctgttttgctatactgatggaagtttataaggctatgtattaaataaataatgttctggtttttaagttgtgtatttagaacataggcctgaaagcaaatgcttgtgtaaaaagaaaaaaaaaatccaacagtcaaaaagtcaggtctatgttataagaaatacagcattcctggaaaattgcagtgctttacattgcccagatgttatcatcgctgttgggttccttggcagagtcattcagaggctctgcatagctaatactatcatggttctctgtggcacagcccccccttgattgcatttagtatcttcttcctccagcttggggcttagcagtttctactcaaaaaagtgacacagcaataaaatttgaaaccatagaatgatcactcatcctagtgatgtgttatttggcatctttgaatatatgactattgcaaatagttcatttcaaattttagcagattgttttttctcaattcaaaatcacattgaaagggggagagaaaactgccacagtggaacgtttgcaggtactccattttttcccaataaaataatgttttatcataaattcagcatgtgttaagattgacatatttatagcatatctgggcaggatatagcaactagagctgtaatgattgctttctctactataaaaactatgacgctcatattaatacttaagacatatttatattattaagctcacattaatattaccataaaatatgacagtttacaggccatgtattactacacgggatttttcttttcttttttttcttaacttttattttaagttcaggggtatatgtacaggtttgttacatgggtaaacttgtgtcatgggggtgtgttgtacagattatttcattacccaggtattaagcccagtacccagtagttatttttcctgatcctctctctcctgccaccctccaccctctgataggctccagtgtgtgttgttcccctccatgtgttacatgggaatttttcattcactcttttactcacttcatgatttttggtatttgattaggagcaagaaaaacaaggaaaaatagatacagtgtctctttccatctgacattttccaatgcctagagtctataattctatctttcatcctattagatatcataatccagaatattatttaccaattttatgtcttattaactacaagtatatttagccaaatatttgcatagttatttcaagtacatttatatttattattttatatttttcattgcctattttgaaattatattttttaaatttctaaaataaaattaattttgataactgtaatttttacattggtaacttttgtgcattttgtcagtttttatagtcattgtaacacatttaaaaaaaaatatgacgttgtctctgttttttaactaaaggcaatttacattaccattaacaaggatttgtatatttttaagtcataatataaagagtcccttccagagagtcctccattccagtaacatacttaggaaataaataatgcatatgcaaaagacatagaaccattgtcaagatagcactttccgttttctttctttattgggcagacctatacacagttcaatttgcattaaactattttgactttagtataatcattattgatttttttttttttttgagatggagtttcactcttgttgcctgggctagagtgcaatggcacgctctcggctcgcggcaacctccgcctcgcaggttcaagcgattctcctgcctcagcctcccgagtagctgggattaacaggcatgcgccaccacgcctggctaatttttttgtatttttagtagagacgggatttctccatgttggtcaggctggttgcgaactcctgacctcaggtgatccaccagcctcggcctcccaaagtgctgggattacaggcgtgagccaccaagcccgacctattgatttctttttaatgaagtttctaggtttaaatatgattaagtttccctaccactgtaaaagaaaagttttgcatcagacacttgatacaattggcaagacatatgcaaactatgcaaccgacaaaggtctaatatccagcatctatagggaactaaaacaagtttacaagaattgaacaatcctataaaaaagtgggcaaaggacatgaacagaaacttttcaatagaagacagacatacagccaacaatcatgaaaaaaagctcaacatcactgatcattaggggaatgcaaatcaaaatcacaatgagataccatctcacatcagtcagaatggctattatcaaaaatttaaaaataacagattctggcaaggttatggaggaaagggaatgcttatccactgctactgggaatgtaaattacttaagccattctggaaagtagtttggctgtttctcaaagaactcaaagcagaattatcatttacctagcagtcccattactgagtatatacccagaggaatataaatcattctatcataaagaaacacacatgcgtatgttcaccacagcattattcataatagcaaagtcatggaatcaacctacatgcccatcaatggtagactggataaagaaactgtggtacatatacaccatggaatattatgctgccataaaaaagaatgaaatcatgtcctttccagcaacatggatggagctggaggccattatcctaagtgaactaacacaggaacagaaaaccaaatactatgtgttctgacctataagtgggaaccaaacattcagtacatgtggaaagaaagaaggggacaacggatgccaaggcctacttgaaggtggagggtgggagtaggatgaaggttgaaaaactaccttattgggtattgtgcctatctgggtggtgaaataatctgtacatcaaacccccatgacatgcaatttacctatataacaaacctgcacatccacccctgaagctagaataaaagataaaacaaaaaattgtcaagacagactactacaacaggggagaaagattttagtacagaactgagatctgtactaggtgagaggatttttaaatgctgaagtatagtaacagaaaagtaccgaatggcactggggaaggagggaaatttgtccaatgtgattggaccatctatatgtggtcattgccccatttcaaagttaggctactaccatctcacagagactggaagatagggcccctatctttatttgtttttattgatacacaatagttgtacacatatgtggggtacatgtgatattttgatacatgtttacaatgtgtaataaccaaatcagggcagttgggataaccatcacctcaaatgtttatcttttttttgtgttgtgaacacttcaattctttcaagctgttttgaaatatacaaaaaaattatttttggcagggcccagtgcctcatgcctgaggccaaggctggtggatcacctgatgttgggagttcgagaccagcctgaccaacatggagaaaccccgtctctactaaaaatacaaattagttgggcgtagtggcgcatgcctgtaataccagctactcaggaggctgaggcaggagaatcgcttgaacccgggaggcagaggttgcagtgagctgagatcgtaccattgcactccggcctgggcaacaagagcaaaactccgtctcaaaatatatatatatatatatatatatatatatatatatatagttaactatagtcagtccactgtactgtcaaacactggaatttattttttaactgtatttttgtacccattagtcaacttcatttcctccccctctctctaccaccctcccaagtctctggcagcaaacattctactctacctccatgagatccaaatttaagctcccacatatgagtaagaacatgtgaaattgtttgtcattttgcatcttcctgtttcatttaacataatgacctccaaatatccatgttgatgcaaatgacaatattttatgacttttatgactgaatagcattccattgtgtatatacaccacattttcttcacccattcacacatcatttagtcaactgcccgttgatagacacttaggtagattccatatcttggctattgggaatagtgctgcaagaaacaggagtgagaatatctcttcaatatactaatcgcctttcttttggatacattctcagcagtggaattgctggatcatatggtagttctatttttagtttttctgaataaatttcttacagttctccacagtggctgtactactttacattcccaccaacagtgtacaagagttcccctttccgcacatccttgccaccatccactgtttttgtctttttgatgatagccattttaactgggctgagatgacatctcatgtgcttttgatttgcatttccctgataattagtgatgctgagcattttttccatatacctgttggccatttgtatgtcttcttttaagaaatgtctattcatctattcaggtcttttgcttatttttaataggattatgtgttcctatacgctctttgtcaagtgatgttatgtattcatttaatactcaactataatgattaataatagttgtagtaattatatttttcctataagtaaaataaaattagacggatatattgtattcctatacataatcctgttatgagttccctatacattgtgcttattaatccctttgtcttttgcaaatatttactcccattttgcagcctttctcttcactttgttgattgtttccttcttgatgattacacttcaaagggatggttcctaggcccttgagaaattcattcttgggttgtagaagattcatctcaaacagtcagaggatttataattgcaaggttcctaaactaaatgctctaagaaacggaggtttgggttggaacaaagattaaaattttttggtagcattgaactttttcaggaagaaatttaagggaactggtgtcagcatcctagggacttggccctgagttgttagaaactatgctattatttgttcaagtctcttattatggggggtagacaaaattgtttgtactgaaaattgcagttcccatagaccaaggttgaggcctagccgaggagagagttcagaggagactgacaaaagttggtcaaggaaagagtctttttcactgacccttcaccttaggaaaattgcctgcaagtaatggcttatattagtgaatgtaaattttgtaaatattttacttttctatacttatagttgcaattcaaacattcgaattaaagaaacaagttgtgaatttaggccataatatttgattttatacattctgtgagattctcccaaaacgcatgccatcccagtgtaagcctggtcatatatatattgatgttatatagcatgttatcagctacattttgcataatcagtgtggtagattctggattcagagttcatgacctcaaaaattgactccacctcttatcaactgtataacattatcaaattgattaaactgtccaagcttcagtttcctcatctgcaaaatgggcattatagtaataggtattgcataaagtaactgtgaggattaaatgatccaagtgctttgcagaattcctggccagcagtaatgactcaatagatattagtttctttttattttattttattttttttattattattattttttttgagatggagtctcactctgtcgcccaggctggagtgcagtggtgtgacgtcggctcactgcaacctctgccacccgggttcaagcgattctcctgcctcagcctcctgagtagctgggactacaggagcatgccacaacacccagctaatttttttttttgtatttttagtagagacagagtttcaccatcttggccaggctggtcttgaattcctgacctcgtgatctacccacctcagcctcccaaaatgcatgctgggattataggcgtgagccactgcgcctggccgatattagtttctataatttgtattagatattattagtactgaataagtactagtggagaaagtaattacctgatctatatcattaacttatttgaaaactcttgaaaataagagatttcagtttttatttgaattttcttctgtcatttgctctgtatacttgctgttcttagcccattttcctttatttattttgtgtatgtataggataattaatttaaaatgtgtcatatttaaaagaaaataattttatcagttaaatgttaattctgttttttttcaagaacaaagacatcttttcttctgattcataactcgcctgagagggagtagacctttgagtatgtataacctatatatagtctggcttatttattaatagaggtttattttaaattataattgaacacagagtttaggaagacaattacatttgagattgctaatcttggggtcagagaaacttgattgcatacaattccaaactctttgtcaagtgatgttacgtattcatttaatactcaactataatgattaataatagttgtagtaattatacttttcctataagtaaaataaaattagacggatgtttacatggattatctcattgcatttttacataaattacataaaacacattttccccctgaaggaaacagtaatatatacatatgtatacaagtatttgtaccattttaataccaaatagatctagtttttaaaagatatatgtactgaaaagataaaaaaatgtaaaaattggaagggataattattgaaaaataaggtgaagatagtggtaagttaatacacaaaatacatgccatacagttctggaaactttgctgtagttggcctataagtgtttaacctaatagtcacatacattttattgatggatcagagactattttatttaaaacgctttcccaaattcagatgtcatgaattcacatgccttccagtcctcaccccaagggctagaaatgtgcttttatgaagtctttcttgcctttttttgtggagtgggggcaggggggaggattgaaagagggaatggtactgcacggctaaatttcaaaattttgttctgtaagtggaattttaatgtattcttcattttctaaaatccaagaaacaagagaggccataaactatttcctcaaataaacttagaaacacagagacagttttgaagtcatcaaagataaagtaaaataacataaatgattgaggttgaattatctgcgaaaagaacaaacatactttacattttgccatatcctgggtcatgaagtcaaaatgaaatagtcattcaagatctaaactctttgaaaactctgtcagccaaaatttcgaattttgaccatgtttgctaagcatattgccttctaactcaaaaagcagaaagagcaatgcttatttttaattttcttgcactatgtagtatttcattacatttggccagtgttgtgttgagaatgctcctgaacagttcaatggataactatatcaccttaatttctttcttacgagttttagtgtggtttctcaagagaaccattatacccatgctgacctagcatgggatatactagaggagtatgtgtgcttggttatctgagacagtattcttttatcatatttgcctgtatttcactgctttgacttcattatagatatcttatatagactgaaaaatcatggacttatgaaggcaacaattcataccaaaaataaagagtgaactactaaattatgttacaaatgaaggaagacgttaatatcaaagcaaaacttcctgtcaacacgtgagcagtataattctaataagcagttaaaatagcttaagaacgtaaaacttgggttttataaatacatatatatttgtaaatattgatctggatagttattttaagctgctttgaaatcacatttgttccctttggaaatatgcaagagagacaattacttgcctctcagtggactattaaggtttgcctttgcttatacctggtacaaaataactatatatctgatgtaagcaacagagatatgttatgcaagagtagatacggtatgagcagaatcatgcaaataagattcatattagaaatcttgtgtcccaactctggtttgtcagtggtgaaaacagagttaacaggtaatgcataggttcccaaattcctgatgaagtaacatctctctaaactacagatcaaacctccaacagactcagtcaacaaaagccataagtctaaaaacccaaaatgaatttggcaatgagaaatagagcagcgagaaacagtactgggcctaaagagccagaatccattgacttagaatcatttttagttggttggatttaaaagtcttaggtaggggccgggcacggtggctcacgcctgtaatcccagcactttgggaggccgaggtgggcggatcacgaggtcaggagatcgagaccatcctggctaacacggtgaaactccatctctactaaaactacaaaaaattagccgggcgtggtggtgggcgcctgtagtcccagctactctggaggctgagccaggagaatggcgtgaacccaggaggtggagattgcagtgatccgagatcccaccactgcactccagcctgggtgacagagcaagattccaaaaataataataataataataataataataaataaataaataaataaaagtcttagctaatctttcttcattagtacttctcagagtataggaagaatacattaaaaactccaagcaaggggtgggaggtctaagatggagagtaaagtgttggcagtagacatcacacagtatacagccaagcatttttggccaacttcctgctttaggataaagaaggcatcatttttcccatttgacaattgagaatgttgagacccagaaatgatagataacttacaaaggttatacagcaagaaagaaatgaaaatagtagtagagcctgattctcttaccttctatttagcactctttcccagatgccatgttgatagcactgcctaaaatgtgtctagtttcgtacttttgtcattgttttgatataaggtgcagtgggtcaagagaaccatgatattcaattcgtgacatttaatctatttttattttgtttctatgtgtgactgcatgtgtatgttcttttttctgcatactgcatttcatttccactctcctccccagtacaaacattgtgttttaagtataaatttttttatttgaatggtgtcctttcaaagtatgaattgctttctgtttgtgaattataatttatgtaaaatacattctgttagatatttcatttttcatcttgttttctcactaaggtttattatttgttaggatccttccacattgctatacacctactctatgacttctcacttcatggtgtgtatatattgaatctccatgaaaattgggaatagcgaattccaagctatttatttccttgccaggcagccccttggctaggtgcgcttatacaggcacaagctatgcatctgtacatatctgcaatgaagcccatggttgtgtatccagcaaattttgcctctttggccttgatggaaactcaggttacttctagctctcaccattaccaatagcactgtaatgaatagccttgtatatgtgtcttatgcacctgcgtgaaaattttcctgggataaatgccaattgtagaattgctatgtcaaagggtatgtatatacttaatttgactaagtagtaacagatggataggcagattgctgctgctgtctaccctaccaccagtagagcaccaaggctcctatgtcaccatatacatgtggttggttccttttgtatttcatatattcttgccttgtttctctagctgcagtgaaggaagggaccattttaaatggctcagattataaatcctaggaattattaaactaccagtgaatatacttggcaggtgaaagtcaaccaactttcaaagtggttcaaattaatcatgtgttttgtgaggtataactgttgtttaatttgtgtttttagagctaaacaatgttctcaatcagacccaacttagagttgttttgcttttatctctgatttgtttctttctttcacccaattaaatatgatttaattttacccattatttgctttttaaactaagacagaatgaaaatgtcaaaaataatatgacgcttctaaacctgtcaagtatgaatgtcatggatcacgaggatttactgttatattttgggaagttggcataatataaatcgtgacgctcttctgatagaatgtgtcatcactttaaacccagatgtctgaattttacagcaaaggactctgaataaggaaattcttcccattgatctgataatgttcaaatatatcttaaggaagggatagtcaaatgtgcatcatttaaatgtgatcttagatattttaatctattcatttaatttattctttactcatttgcttctctaataaaatgaatgacaataatctaacttcagccagcttcagaaatgtattcagtcatattatcatgaaatatgtaattctcatgagtgacactgcctggcccactcactgtgtcattgggattgccctttctctaagctcgcatgataaaatgtcattccaggtgcaacttaagagtcacgctccccttgtcctttacaataatgctaggtaaatagcaggaactcagtaaatatgcaccaactaactgataggtaacttttaaaatatgaaatcttctattctttgactctgtagagaaagtgtttttcttcagctctatatgaataccagatatttactgaatgttttgccacgtctcagtcttgcatttgcacgtccgcacactacttttatgccatctgttgtctttcgtcattcaactgcttatataggtgaagaataaaaacggagagtgacagattagctgtattctatcttctaacagtttattataacagtttagttagctttcatcccttcttaaacacacacacacagagtgagagagagagagggaaagagaaagggagagagagagagagagagagaaccgaaacaaagtattctctcactttcttctcttttaaatataattaattttagtaaccattgtgggatagaggtggggccggtctgagatgaaaacaaaaattgagcaaaacagccataaattgtttgtatagagtgagcatctcattcccaattatttgttcaatgctattgacataaagtttcctgtgttctaaagaattaatggcatcacatcctcttgactgtgctgttgcttacttggccatgggtgtcctgaagtaggtgaccataaaatgtattattgaaattggggcaggcttttagctttgttaataattctgttgacaacaggggtgaaacaagacatatgcttatcctgccctcaggaagcatcagaatgagtagcttttaaattcgctgccaccatgatgacttgaaggatcagaaagcctcttatacttgacgcagaaacattgtagaacacctgtaaagtggccaaggtagtggaaaaaacattcaattgggagtagttaaacctgtatgatactgaaccaaggagcaaaatgatgagtctaaggcaaggagaagtcagacgtagaattcctaatccgtacgagactgtacctcgtcaagcaaaacttgggagttttaaaatgaaattttggaagaaatgaattattacaatagcaataaccatttttgttaccatcctggttttcctgatctctacatattggcatgccctggattcagtccttggtgtcttggatcttccctttctatacttacagtcttatagtctcagaaaatcaccttatatatcaatgccctcaaatttacatctgtggctcaaagccttctactcatatccaaacttggatatacaacttgctactcaacatctctaacagtaagtcagtggacatcttcacatgtcctaacctgaactcctgtccccccgcaaagcctgtgactttcaatttttaattgataacaacttcatctgtgtttgctcaggctaaatggtttggtgttgccccgacttctctcctcatttcacatcccatccctaataaatcagctttaacactaaaatacagctgaccctcgaataacatggaggttcaggggtctggcagctccccacgaccatgcagttgaaaattcatgtaaaacttaggagtccccccaatttttttttcaaaatggagtctcaccctgtcacccaagctggagtgcagtggcacgatctcagctcactgcaacctctgcctcccaggttcaagcaattctcgtgcctcagcctcctgagtagccagaattacaggcgcccaccaccatgcccagctaatttttgtattttaagtagagacggggtttctgcatgttggcaaggctggtctcaaactcctgacctcaggtgatccacccacctcggcctcccaaagtgctgggattacaggcgtgagccaccacgcccagcctgagtcccccagaatttaactactaatagcctactcttgaccagaagccttactgataacataaacagtctattaacacatattttgtgtattatatgtatcgcatactgtattcttgcaataaagtatgttagagaaaaaaatgttaagaaaatcataaggaagtacaaatatatttactgttcattaactgaaagaggatcatgatataagtcttcattatcttcattgtcatcttcaagttgagtaggctgaggagaaggaacaggaggagttggccttactgtttcacagatggcagaggcagaagaaaattcatgtgtaaatggacccgtgcagttcaaacctgtgttgtccgagagtcaactgtatattcagaattagacaacttttttttttctttttttgacatggagttttgctgttgtcttccaggctggagtgcgatggcacaatctcggctcaccgcaacctctgcctcccaggttcaaatgattctcctgcctcagcctcccgagtagctgggattacaggcatccaccaccacgcctggctaattttgtatttttagtagagacggagtttctccatgttggtcaggctagtctcaaacttccgacctcaggtgatctgcccgcctcagcctcccaaagtgctgggattacaggcgtgagccaccgcgcctggccagaattagacaacttctaatctctattcccgatcttcatcactgttatgatctcttgtctcaattactgctagagtttctcaagtggtctgaaaatcagcactttctacccatgcctcaaactgcctagtctttgtatagtaaccggaatgttcctctttaagcaaagagcagaatgtgtaattgctctgtgcccactcttgcaattgcttccattgcattccaaagaaaagctagagtttttacaagagctagtaaggctttttataatgtggcctcctgtgtcctctctaaccttattcattattctcatctgcagtcaattcacttgagccacagatgcttcccacatacatgtctgtgcatgccttggggcatggacactgcttgttctttctcctttcttctggaggctgtccttccagatatgccagaattaactttttcatcttagtctttacttcgatatattcttctcaatgaggccaatttaaaattcaagcgtaacttcccccacctccagcacctacctatttcccctacaattttctttgatccataacatttatcatcctcaaatatactctgtacttgatttatttttaatgtttatattacgttcctccaacaggaatagaagctccataagggcagagatctttgtcaattttgctcatagataattcccaagtacctaggacagtatctactagatgcttataaatatttgcagaatgaatagataaagtaagaagcccagtgatgtcaagaaaatgaattaccctctgtgcacctcaagttgtgcaaactaaaaagattaaataaaatggtttctatatgtcaaccaagcgcacatgtgtacattttgtgtcttgtggggatcctgattcagaaatcaaatgcaaaaaaaaagaaaaaagagagtgagatactaagaggtatttgaccatggcttgttattccattattttaaaaaattattcttatgtcaatacatgtgataatcataagccctttggttaagggcttatgtgtttgggatgcaaaatgaagtatttagaaataaactgatatgaaattgaggatgtggttttaaatattccaggaaaaaaaataagtgaaaggaataaatcaaacaaaattggcaaatactgctaattgttgatgaggggtgataggtgcataggagtatattgtagtgttctcattacttttgtgcatgtttgaaatatcccataataaaagaattaaaattggtaacctctgaagtccctcactactcaaaaaatcttttattagagccatcattttataagtagatcatttgtatcagatattaagaggatcattgggatccccgagataattccacagtataacgaaaacataaaggaagataaagagagaaaatccaatagaatgtcatttataaactaaaccttcaactgtaaatgatagttgttctaaactgtggctctgtctaaagaattttacccaaatttccattcattgtgaataactaatgcaagtaaatgggtaaattatgtctgtatatttaatcattgtacaaattatatcccataattccattagcagaatggagtacaaacttttttctaaataagtccttactaaatagatttaacagcaataactatgcaatttgactaagcaacaaactgccatttaaactatatattactatataatataatatgtcattaaaatataaatactaaaggctgtcaagatttttttttaaaggattgggccaggtgcggtggctcatgcctgtaatcccagcacttcgggaggccgaggtgggtggatcacctgaggtcaggagtttgagaccagcctggccaacatggcgaaaccccgtctctactaaaaatacaaaaaaaattagctgggtgtggtggtgtaatcccagctacttgggaggctgaggcaggagaattgcttgaacctgggaggcggaggttgcagtgagccgagatggcaccgttgcattccagcctgggccacagagcaagactctgtctcaaaaaaaaaaaaaaagattgtttatcttctatgtgtatgcatattcatagattggtatagatataaattgtgtaatgtggatatacaagtaatgagacactgttacatgaataagttctgaatcgtgagtcattttgatgataaaacatagaggagaaacagatgagatcatggatataacttgtttgaaaatggtctcatcccataaagtatagagaggcagaacattataaataggacagttaggtgaagaaaaaaatatatatgggatttgacacaagggcaaaatattcttattaattgttgaaaatctaggaaaaataataatgaaaaactttaataattgagtaatttaaccatgatttcttgaggctatgtctttttttatgacaaaacatgctgatatagaggatcaaaattagatcatagaaatcatagagacagcaaacagcatttttgttttctttgctgtcattttgttatcttggcttcagacttttttatcattgttttgtttattacttatatgttataaactgtctcccctggcccccaatctcctgaaagttttagaagcttgatctggtccattctctgcttgaaccacagtaacaagtatctcctggcccctccttccatccgcaaagttggattaaatcctacattctcaattgaactcaaatgaaaatgatcacttcttccttaaacattaactctctcaacaaatagcttcagatttatggtcttaatgagcctttcaagcatgttttgttagtcaacgaaattggactttaggcttatttgtttctttgtttttttgttgttattgttgttgttgttttgttttttgttttttgtttttgttgagacagggtctcactctgtctcccaggctggagtgcagtggtgcgatcacaattcgctgtagcctcaacctaccaggctcaagtgatcctcccacctcagcctccttagtagctgggactacaggcacgtgccaccacgcctggctaatttttttaatttttgttttgtagacatggagttttgccatgttgcctaggctggtctcaaattcctggactcgagcgatccatttgccttggcctccaaaagtgctggaattacaggcatgagacactctgcctggcctgtttcttgtattttctacagcagtgattttcaaacttttttgatgtattgacacatatacaatactgtaacactcgtgacacctcctggagttttgcagcactttgcctacaaacacctgcaactcaaacaaaagttcgctgagctaacacttattttcactatattctcaggtaagaatccaaccttatggagggtggcaaaggttaagatttcaaaggagatggctaagcaagcaaaatgttggcctgtcacaactccataggtgctcaaagtagacaatgagattcaatgggttagagcatgagtctttaatattcacaatatagcaaatagcaggaacagtagcatggtagtaccagttcctctgcctcaagtattacgaggtgacacaagaggccaaaacggtgactatgcacacagtgggttgtgctgcagctggggaatacagggccaaggtctcaccatgtagtaaacaactaacaagacagtctcctttccctggagagaaaagccttatggtagtcatgctgtggtcacttttacctaattaattgcctacgtgactagctacagaaactgctcagtaccatggtatcaagggatgataaagccttagaatttgtcacacttaaaaaggacaggcagggttgtttatcgcccatgatggactgcccttttcaacaaacctgtgatacatgattgaattgtttattttactccactttgataaaatgctagtctagaccaaatcaattgacttcatgacccaataatagatacaactcacagtttgaaaatcactgccttagattcctagtaaatgccttgcagattctaattcaaaaagccattgttaaacaccaaatatttgccaggtagtgtgttccatgctcagaagacaatgttatagctgttacagcagaagaatcatggtctttgtaacaactgtagtttaacttcccattttgctatttatttagtcattgtttagtattttggtctttattatcttattttgttcttgcgaagttaaaacatgataatcttggtgaggcaccttgtgcattgccaggtagctgccaggtatttatcttaaataatctgccttccatggatttctttgcagtgaaatattacacataagttaaagaaaaaatattgaagtggcactttaagaaactgcatgaaaattgaaattactgattgaactcttgaacttagaaaacacaaatcatctatattaaaatttatacattttttctctctctctctctctctctcacacacacacacacacacacacacacacacacacacacacttacttgtattatacaaaagccagttaatgagatgtaaaataaacttgaagcccgatgtggcaaagaccaaaggaaacagaagaaagaaaaatctgagattaaaaaaataaatttgtttttccttatatcctataggtagctttgaaactttgtgtaattgatattacttactattcattaattttctggttataattctttaaagacaaagtcaatcaaaatgttatgtttgctgttttttgtacagaaaaaaatctcatttgtttcctctaccaataaaatgccatgacaatgtagaataaatatataatttacttcatagtgcaggattatgctgaagtatacatgaaactattgtccaatgaaactgctttggtatgataagtttttatataaatatcaacctggacacatccggtataatttttattttgtaatgtttggcttaaccagtgcactctctttgttaccatttacaaatgaccatgctagctatttcttcagtctatggagaaacatggaagcctaaaatatttttttaaatagctatttcctcatatctcctaggtaagacatatccaaagcacgacaaaagaaagctaccctgtctttatattaaatcttgttgaggaatatttatagcatcccagagttataactattttagggtgacaatgcaactgatgttgagcaattatgttctgctgctatatcctatgtctatggtcttaattattaaaaaccaagaaatataaacctaaaattgttgactgctacctaaagataaagatcattattaaaatactgatgacaagaagtttcattattaaaacaataatgtacaactatggattcactttaaaaacttggtttattcatctgtattcaagaaacagagttaatatcaaagaaggcaaagaatattgaagcatattaaggaatgctgtgatttagcatttgtagtcatgttaatggcatcagactataaaattataatattccctcaatttagccacgtaaaaataaatcacttaatgacaaaagtacatattttagcaatctgggatttcatgtggaagaaatattgatttgccactgcatctgcatgtcaactcacatacttgagtaaaaactagtatttctgagaagacacgaaatcactttgaacctattaaaatggacaaaagtgacaatcagttgatgatatgaaatgcggtcttttgagccaaactttgacaatttataattttctgttgtgtgataaattttaaatggaaacagttgcataactcactagagtcagaacatacattataaataatttagtccataccctttgattaatcgataattgggaaataagtgaaatgtcagaagtctgccaagtagttattgggtgagccaagactcaaatctagataaagtatttattctactatacaaattaatgtcattaaaattattgctttatttatgtattcacgtgaatattctctaagtgtttttaaacacttacaatgtaccaggccctgtgctaggacctggggataaaaatggaaaagatatgggtctgtcatctagagatactgtggtttagcaagggagtgagctactaatatgaagaaggagaaggagaaggataaattattatagtacagtatgataattgtgctaaaagtcatcacagagttctaggattgtgcccagtaccctttgactagtagagaggggagaggtctcacttgaattacatcccttcttatctggactgttgcatcttgaaagatctcgccacttccagtttgaccttcctccaaatatttcctccaaattgctgctggggtggtctttctaaaatctgaaatttaatcagagcactcacctgtataagaaccatcagagtttctccatttcttcaaaatgaagttcaaattcattatcttatcatgagacctttcatgatctggctttagtcaatcactccagccttacttcctgctactctttcagaaacattctccaattcaaaagcatagatctacttatagtcacctctaggtctgggtcaaagagcttgagagcattgtagctcgaaggccaccattaactcaatgaaatcagcagtaatctttaaagaaaaaaaaaaaagaaaaattggcaataggagtcctgtgggagaagttaaagtttgtaatagtgactaagatgatagggagagaggaattctgggccgttaataaatcaatgataaggtacagttagggctaagcgtgcttttgtttccctaataatttatgtgtaatttaacaactaaattaattgaaaaccatgtttgaatctcaccttaccaactgcccacctggttgaaaattaaatactattgaatcttaaagacaggtattttttagaccaatttatatattttgctgttcatgttatagatttcaatttgacataataattcaccacaattaaaaatgttcttgaagtaaaagatatttacatgtctaacatatctaaatagcttgaaaaattacatgaaacattagtacatttttggagactcttatcttgcccttattttccaaaggataagttcttgaaattgagtaaacgacagaaatagcatagctagattataattttgaataatgctgaatactttctgatctggaacctgtaaaacgtggctgtagtgagggagctactcttggttgcacaagggaattgggaactgattgtggttacgtgaaaatcgtaaatgtcggatctcagtttaattgtggtagaaatatgtggtagatgattctgagtattaaacagctgtgtaaatattggaagagcagaaaatctaacataatacaacaaatacatagatcttctgatgttcttctttttaaaaagctgtaaattaaaatcctgtgtaggaaaaataaaggtaagatgcagtgtacaaatcagggtttctcaactctggctacacattgcagtcactcagggagatttcaaaataaactcatatctgggtcccactgctagacattctgcatcagttggtctgaggtaatggctaggcattagtattgcttttcttttccttttttctttttaagatgtagtctcactttgtcacccaggctagagtgcagtggtgcaatcttggctccctggctcaatgcaacctccacctaccgggttcaagcgattctactgcctcggcctcctgagtagctgggactacaggcacccgccaccacgcccagctaatatttgtatttttagtagagatggggccaccacacccggccttagtgtatatctgtttctgctgtgcaacctgagttgagaactactggttaacatagatgaaaataaggttcatatatttcagttataaaaaataaggcagaaaacttatccaatgttattagaatttttccttgcatagctatcatgcaatgatgtagttaacaaaaattaaattgcttacctgcaattttatgatgaaactgaccaaacacaccttccaaagatcaatggaatgaaggcaaaatcagatagaagtgtatttcactgtcttttgtgatttcacctctacctgactaaaactactaatgctcaggagaacgaatcaactgacagtgcatttttatataccccgtgaaggtctcataaataagacatggctgaaattaggtaggaggaacatttatcttgaaaatccaaaattcctaaagcaagggatcatatactgcatatgttaccgtcattatgccaaaggagcaatgtatacacacacatacacacacacacacacacacacacacacacacacacacacacacacacacacatatgacagacttctccagctctctgaactacaagatgctttataaaaccttcacatgggccaggcgcagtggctcacgcccgtaatgccagcactttgggaggccgaggcgggcggatcacgaggtcaggagtttgaaaccaacctgaccaacatggtgaaatcccatctctactaaaagtacaaaaataagccaggcgtggtggcatgcgcctgtaatcccagctactcaggaggctgaggcaggagaatcgcttgacccaggaggcggaggttgcagtgagccaagatcttgccattgcactccaacctgggcgacagagtgagagagcgagattccgtcaaaaaaaaaaaaaaaaaaacctgcacatgtatatatttcaccaaacaaatataagcacaaacaaaggaatgcagctgtcttaaatagtccccatctatttggtgtagatgtattgcaccatttttccccggtgcaagaagactagacatgtttccaatagaggattcacctcaaagcgttcagctttgccaccatcaagaatatttgaaagaatgtgccacacaaacacaaaaattaacacttattgtgaggccacaaacgttagctgaaacctcatttctgcctaacttctataaatattggcaatttcattgataaaattttgatacttttccagcttcctaggattcttgttaggattaaaaactaagctccctgaagggagagggttttgattattttattacctgctcccaagcctctggaacaatgtttagaacttaatgctaggtcaatatttgttcaatgaattattggaacataaggacatatgactgactaccttgcacttaggagttgttcagaaaattgtagttagtattatttctcttttattttattcatttcaagagatgcttgcctaacttgagttgccaaaaaaatgagatgggatactaagacagcggaaatgggtccttcaaaaagattgtctgtttctatattgcaatgatatctgaaatctgatgctgtgataagaaccaaaaacttatcaggggtggaaggattttgccctgaatgagaggaggccccggtgaagatggtgtcttataatatttggtcatcatatgcagggctggcatcttttaaagtgtagcagttttagacctagactgaaaatccattatatgtgtcgtattccaacctcttcccaaacaagactcggattgtctcctatggtttctggtcacaaaacagataaaataaaaccatccctcctgttaccctattcagaaactctgatagcattcttcatatctctcattctcaatataaatcactctccaccaaaatttgtttattctccttgtctctactcagacacctgcccaaccctactcaatgtaatattttctatatgttatagccagaatgatctttcataaaggtaaagttgataagtatcctgaagttttaaaaaaaaatggtacattctctttgcccttgaggtaatgtcagcatactttaaaagacttacaaggtttttcatcattttgcccctttggactctataggaaaaatacgtgtatgcacacacatacacatatgtgtgtctattttcatttatgtctaactgaaatttagtatttgcttcatttggaaatactagccacactaattagtggctattgaaagaaactgttactttatcacttgaagttacaaatattttcttattatattatggtttttgtaggtttctcagatattatttgcattcattgtcactccaaaattaggcctgccactatctcctgtcatgtaagtgtcaataaagaattacatgttactatattgcaaattcattttattactttttttttttttttgagatggagtctcactctgtcacccaggctggagtgcaatggtgcgatctcggctcactgcaacttccgcctccccggttcaagagattttcctgccttagcctcctgagtaggtggggttacaggtgcatgccaccgcacccggctaatttttgtatttttagtagagatggggtttcatcatgttggtcaggctggtctcgatctcctgacctcatgatccacccgcctcgtcctcccaaagcgctgggattacaagtgtgagccactgcacccagcctattatgttttgattattgcctttcaatataactggttttcatcataattcaatgaagttttattttgtgcatatataaacattccagaaaggcatccataatcaccaaatgccaaaggagtccatctctctctcctgtacgcacacacaatgttaagatcctcaggactatattgtaataccttgcatattattgttcacttgttttccatgtaaaatgtttacaccattagaacaggttttgtttcagaatgataacctcccagactgattcagtagggactaaattaatatgcatctaattaaattgaaatgaaacaaagccccgagatacggacagaatttcagatggtaattttgagaacacctttagcatttagtaaggtggtactctttaaactcatgctatgttgtcagtattaacatttccaaagtcactaggtttaaattttagagacttactttctgactaccggctccaagcatttattttagcctatgtgtacaaacattcagactggctatgtgatggaaaagtaaaaaaaaaaagatgacttttgtcctggccctcaaaatcttatagcttaagatctaattctccaaaagtagacaaaagttgcttgagtattgggttgcacttgtttgtatagtttttattcagataagaataatgaagactcttgttctctctttctatctattcctttataataatagtaatcatcatcatcatctcaggcaacagcatcctcaatgcggtaaattttgcctatcatataaaaaatacatttgaatatatagttgtatcatgtttactttcacttttttgtaacatttcaaaaagtattattctgctatgacattttttgggcttagtcatagaacaaatgtgagctgttagggaactttaaatgtcttagttttattgtttatttataactaaagagcatttttagtctactgtaaaggcaagttatcatatgctaaacaacataaaaatgactgaatattaaagttaaaacttttttatgagaaaatgagagacccctatgtgatttattttaaaataatcattgcatatgccctcacacagaaaatcagaatggtgtgattgttgcctgcatgaccaaaatcgattctgcctcctttgtggttagccaacacagtgacttcagcacctagtagacacaggttgtgtagttgtagtggtgcatccttagtgttatgctctccattgctggcaggacagattctttcatgcttgtcttctttaaagcattgacttaatttttcaactgaaaacagtaagtgacaaatggagcacagagtattttagaacatacccagaaagagcacttaaagacaataagaaatactcaaataattgaaataggaatatttttattattatgtcattaaactagctggtgcttatctgacatttccatgttagacatccgtgcttatctaacattgtaatgttccacgttccaagtctgttttatcttgacctgtgcactattaagtaccagcagagagtgatcaatattattgtccaaagcagtgcatcacaacctttactgggcactggaaacacctgaggatcttgttaaactgcaaattcggattcagacatgaggctgagagtcttgtaaaagaaaaattgaacagatcggttaaacaggtaaagtagactttattgaggactgttgtaataggagagagtttcatctcaactcttccactgaagcaaaaggtgaaaggatttttaaatgctggggtgagctaatggaaaagtactggaggacataggcaggatggagaatgtgattgggctggttaatatgattaggccacctgtgtttgctaatggtaccttatcaaagttaggctcctacactcctatagagactgggaagtagggccctatctttcttgatgattacatttcaaaggattggcgcccaggtccttgagaaagaatttcctaggttgtagaaggtttacatctgaaaggggcagagaaggaatttacaattgcaaattttccaaagtaatcgctctacaaaaaaggaggtaataggcctatctatagtcagaaagaagcttgtctaaagttgggagggggggaccattaaggccattgtggtcagtcagtatttctacaaactcccaggtggtgtcaatgccattggtctgcaaaccacaggtctgcactgttacactgataggaaagattccatattgatgattcatgttaacgcattttctagcttatacagtgtactgtatatagaagtgtgtatttgaaatggtcaataccattgtctgtctagatggataataaaagttgttgtgtacaatatttatagaatgatatcttttcatacttctagaggcctactcagaacatctgagtctctcctgatgagatgaaatttggaataagttatgtcccagaattcaggacacatttgatgtttaacttatttcactatgagaaaagtagtgttataatgatgttccacagttgtattttgttttaattattctcattaagcccctagcaaacaggttgcttcatcatttttttctttctttctttttttttttttttttgaaatggtgttttgctcttggaatgcagtggcacaatctcggctcactgcaacctccgcctcctgggttcaagcaattttccttccttagcctcccgagtagctgggattacagtgcccgccaccacatctggctaattttttttgtatttttagtagagacggggtttcatcacgttggccaggctggtcttgaactcctgacctcagacgatccacatgcctcggcctcccaaagtgcagggattacaggcgtgagccactgtactggctgattcgtccatttttaacagatgaaaaaaaaactgtaatcaattttggtcagtgacagtgcaaaaaatgcaatttaatactacaaatacttattacctgataaagttctcaaataatgagctaaaatagaatggatatgccaaaactgtagcaaatcattaaagacaaaataataacattccagggacttaaaacaaattgaattctccaaagaacattattataaactaatattcctaattgcataggaatggaagatttttttttttttaatgttagtcataggagtttcaagacatttgaatcacctgcgtggacactggcttttatcctattaaatttaatgtggtaatttagagtgtttttattagaataatcaacattctaaaatgcaatcattagcatatttggcatagaaaatagatctgaaatgaacccaaaaaatgagctttaaaaattgctaaaactagcagtgtataatggtaacacaatccaaaggtcaaaaaacacaatgattaattaaaactaaagaataataattaattagtagtattaagaaagctttgcctccttttcaaaaaaaaaaagctaaaaaggaaagttgttgaatgttattgtttttaaagaccagcttttcatgaatgaagtttttaatcctttcaaagcctaatctaaatttaagaattcaaacaaaaaatccctaatattttaatttgcaatcaggagaggttcaatcagactaagactttttaatttgacagtctcctttttaacacatagagctacttctttgatctgccttggttaatgaaatggatgagttccaataaatttggatgcaaagtaataatcaacagaattccatttcccattgattttcattgtaaacttgtatcacttttttgacataaaataagcactctctggaatgaataatttaatttgaaatatgaataaaaaataaattatggtgcagaatattgctaagtccttcatacatttgcagcactttgcatctaccactgcttacttcctagacagagaaccatttcctataataatagctaaaacccatgaaggatttcctatctggaaatagtttctataacctttacatctattcatcttcatgattacattgtttaatgggtactatagagatcgtcagcatccccattttacataaattgtaagtgccagagttttggtttaaaccaggttgtctgactccaaactcttcacttaaaaaatatattttatttttatagataataatacaaatactgaaaatatttacaaaacaaatttacaggtaatgaacactcttattactaatgaaggcaaatgcctttattactatccttgatgtcagaagctagaaccttgcgagccattccagaaactttccacgtgccttcttataaccatctccggacacacgcgtgcacacacacacacacacacacacacacacacacacacacacacacaactgtgaccattatgatgattttattttttggaatggcatccttacttttcttcatagttttgtcactcaaatatgcatccctaaacactgtagtttagttttgcctagtgtgtgtgtgtgtgtgtgtgtgtgtgtgtgtgtgtgtgtgagacagagtctcaccctgttacccaggctggagtgcagtgatgcgatctctgctcactgcaacctccgccttctgggttcaaacgattctcctccctcagcctcccgagtagctgggattacagatgcgtgccaccacacctggctaatttttgtatttttagtagagatgcggtttcaccatgttagccaggctggtctcaaactcctgacctcctgatccacccgcctcgtcctcccaaagtgctgggattacaggcgtgagccaccgcacctggccagttttgcctaatttttaaaatctattaagtttcttttaatctataggtttcttcctttatctttttcttttatttaaacagtatatgtgttgaggaagctaaatagtttgttctgtagtcttccgtggactggcttttgctgcctgtgtttttgtgatgcaatttgttttgtttcactatcatccgtattccctatctgccttgttgccttgcctgaagatcaccaaatttcaaggacttctttcctgctctgctccaaggcacttctcagcccactctggatgtgcgtgggtggtggccagtagaggtgggctgcaattactggcttctttagtaagagctgtgaggttacatatattcaactctgggtttctaaaggcccatccaaggacaagttccagggaagatagggcatgcatgagtttgaggcagaatgagaaaaataagcaacatacaatacattttttcataaaattaaatttctccttttaaagaagtgttctttattatatttcagttagcctactgtttcattggcatcgtttccctttcattgtttgtatttttgttttggtgaaacaaaaaattagaaacccaatgtcagtctttgttctcttcttatgatgctaatttccaaaattgaaaagtgttggaaactctgctttagccttaaattttctgcagaaaattacattttgaattttcataaaagaaattattggtcttaacccattctgtatgataatttttaaaaaaaaaaaactctctaaagtgtaccttgaaaaatagtacctgtgatttgtctaagcttttgaataattcattctatctcaaatgtatttctaccactaaagttgctataccactttatggaaagaagaaaagcaactttccttttttgtacaggaaacttgaaagttcatctcatggaaggtgtggagagaaaggtggctatgtaattctcctttggatatttctggatctgtttctcaatcagattggttccgttcacactgcctgctgtcatgaaagtttatgcctcgcatgcaatgccagcataaatttctcagcacaaaacagctctgcttgttaaggaagatgttctgaattatcaaatatatattttttaattagccaccctttcttatgctttcagaatatatattaaagtgatctggggtatttcatgttaatgtaagaaaaacaatccaaactccctttgtttcttgacttagcttattatatcttcagtacttgcaaactgtgtgatacatgatcagtcacagcacactgctatttactgagcatccatggccactggctgacgtggcattgaatataacattgtattgttgctctaagccttttagccttcgtgctaaatgactcaacccatcacaagaaatttataatggacatataactcacctagttagtctgcatgagattgatttgttgtgaagttattggctataatgtctttgagaggataggccttcatttcaaataaagacagcctcatttatggatttcaaagcatgtctatacactgtaagtctgtattaaagaaatgggatgaagccagctgttaaaaacaagaaaatatgtgcaaaaggatttggagttgactgtattatatagaagtattaaattaggagctttagggcatactgaagcttcatattgtttgaaagtttattttgaattctgtagaaaaatgagtactgttaattaggtgatgtggtttcagcattctcaggcgtctgctccccacagtatcaaaacctttgcccaagtccactcactttattgtgacccctgtagatgctctatcattatggtccctttaccaaaaaaaaaaaaaaaaaaaaaaaaaaaaaaaccttgttgtctctcaggcaaccagcgctttttgtcagcctatttcatctccccatcccttcctacaatcgtttatactactgaaaacttgaaagcccacatcccattctctcctggatctctaggcctaccaaagtttctttctaaaaccatgaaatgaccacaagttaatttgatgaagtgattcataataaattgttaataagaagtgacctacaactaggtcaggtcattcttcaaccacctattttattagtgatcccccacaggcaatacatgtgactgaagctggaatttgaactttctgtgatgagggccctgtagcgtatatgtgagacctctggtagcaggagtctctgagagcctctaactcatggtagtctgaaatagacataggcaaagccccagggacatttttaagagagctgttgtaagtaatccagtattataagttaagtctgtcctgtattcatcagaaaaaaacagaatctgctgctacaagatattaggatttctggtcttaagcaacagacttgaatttcactacctggattcttctctttggcttcatgtttgcagataggatggttgaggaggatggagctattgagagggtggctgctctgtgcagttgcttttgtttatattcttactgacctggcacagtgtaggtggaggtgatgcatgttttctgacattgggccagtgatgtatggcctgaccttcaaaatgagaaacatcatctctgtgggtgagactatagccgtgcaaatgcttttatcccatattgctcagcagtttgcaaccggttctgataaaaagcacccaccccgctgagttcgctgaagcttgtatattggttttaggttgaacattttggcaaattaacgactgagtgaaaccataaaattggttttatttacaacaaagccttgtggtgtctgttggttgttcttacatctctttcctttaatctttgaggttgtttctgtaggtggcttatctaactttacattgaaatttgcattcatttcaggataatacttcccctgggtttcttcttaattgacattggacatggtctgcattctcaaactttgtgcataaagttggtaactatacagagtcctagtttacgcctaccccaggtgattctgattcgggagatgtgagatggaaacccaaactacacattgttagtcagtaggtgactcccccagtgtgaatctactgatctcatgtttagaaatactgctgtataccatgcaaagctgtcattttctaactctgctaaacaataaaggttcacaagccatacttctgatttgccataaagttcgagtttttctccatttggttcaatggtgttgctatggatggcattcatagcaaatgataagattgggcatagtatactttgagtgaattcttagttttccttagaacaacaagataatgagttagaattataagagagccatctagtggataaggatataggcctgttgcatcttgtcttaatgtcggctttatggttttatcagattacagatttaaatataaatgaaattaagtgtagatatatactctgaatatattacattaaatatatattaaatgttagtgaattttgtttttgttctttttgttttaaaaaaataatttcttattttataaatgagtctgtacttttaagtagttctactcctttaaatgaaacatggatacagagatgataagacatgattttaccgtaaaataaaacacacattatatttttagggacataaatataggctagtaactaaaacatattttttaatgcctactatatgttccttggatttgaatgtaaaagagatttcaggacttaaatagtagtttatgcaattagagaatgcagaaatagcgtgaaagaattatagtctagatacattactattttttatatactctggaagtttttaacagttcgtaacaaatgccttgggcagattagggcattgccaaaaatcaacatcatgctacttacatttacaatcatctgacagtcatctctcagacgagcatcctcctgattgcctaacatgtttcttttataatgtaataaaggtgagttacacatttgagcaacagtgtttgtctgttatacctagagagaagaaaaaagattgtaggagagcaagatacccaagatactaacttttccaggcccacattttaagtgtattgtcaaaagaagcattttatttttatttttttttacttttttattttttttgaggcaagtgtcttgctctgtcgcccaggctggaatgcagtggcccaatcttggctcactgcaacctccacctcctgggttcaagtgattctcctgtctcggcctcccttggagctggggttacaggcacccgccaccgcacccagctaatttttatatttttaacagagacagggtttcaccatgttggccaggctggtcttgaactcctgacctcaagtgatccactggccttggcctcccaaagtgctgaaattacaggtgtgagccaccgtgcctggccgaaagaagcattttaaaagtttgatattttaaattaaattgaagatactctatcacaacttaacattcttatgctgggtcatccctccttcccctgtactcaagctcctagaaatctcatctatttatacctgactctgctattcaagtaacttccaggttttcttcccccagcgctacatcttttcttctcttctccaggatcctgctggacatcacttcctgatattcttctggcacctcaacatggcccaaatcaaattagttatctttgcactgtttttgtattgtgtatttcagttaaaggggcttacctttaattttcttaagaataaaagattatagtcttatttaatctttctttttttcttatctccttcccccagtttcctgttggttctacctctaaaacctatctggcatcattcatcaggatactttgcaaaatgaggattatgaggtcaggtcctgtggtaagcagggagccaaaaataagaccctcagagtttcttgcctccctgttgtacacacccagtaaaatccccttcccttgagtgtgtatgagactatgaataggatggataccacacccccgactaggttacgttatacagcaaaatggaagataattttgtgtatataatttaggctgcaaatcagttgattttgagctaatcaaaggaagattattctgggtgggcctgactttatcaggtgaaagcccctaaactaggaactgggctcttcctgaagagataaattctcctgctaggaatgaagtactccttgacaaagtaagcagccatgttgtaagcgggcccatgagagggccatgtggccatgaatttcaagtggcctctaggagcaaagagtggctcttgtctgacaactagcaggaacagagatctataaccacaaggaaatgaatgctgccaacaaccacatgagcttggaagagcacccaagctccataaataaatgcagcgtggctggcacctcaatactgcttcgtgagactcggagcaggggacccagttaaaccgcacttggactcctgacccacaaaaactgtgaaataataaattcaggttgttttaagcactattttttaatttttaatttttatggatatataatggttgcacatatttataaagtaagccactaaatttgtggttatttgttatgcagcaataaataacaataaatgtcctcattatcttttgctttggatcagtgcagtaaccttcaaatgaagctctcttagctcatccgtctccatgaaatcctacataacacagccaaagtcatcttccttatcctacataagacagccaaagtaatctcccttataaacagactataatgtaacctccatgagatagggttatagatagagttttgttcaaagctgtatctctagaagaacgctaacatttatgcatgctataaatattgactgatggactcaatgaataaatatcatctgtcctcctacacatacatcaaaacctttgctggtcccttgcctacagagacatcctccagatacaagaagagggaaggtatataataaaatgcttcagcatacaggttctagagtaaaaccttgggtttagatttcagctctaatatttcctagctttgtgatctcttggaagatgtatgactttactaagcttcggttttccaatttataaaacatgaataacttttaccactcaagactgtattgaatattaaataagacaatgcatttaacatattttcacagtgcctggcctatgcaatagatcaacaagtattatttatgattataacatttaaggccctttactatatacctttccttcctgtcctccagccttatgaagctggcacccttgtgtttcctgcctttgcagcatgatggagagtgagatgcatggatacttttaaagtgtccacttctacgcatcccctgctaaatgaccttgagcaagtttcttcccggtctcagtttggttatctgagtaatggggctaatttgaatacatagttctcgagtttgtattgagtcgatccctgcattagtcagtcacattgaacaataaccaaatattggccactgaggtcacttactgcaggaacaatataatggacgtctttcataacattatgaagacccatggaaaacttttcttaatattagaaatagttgtgttggtactgaacaatcaacggttgttattgtttttatctgaccaggcttttctctttgaattagcttctagttgagacaatctgtactgactctagttcagaccttgttccctgtctctgtgtatttccttttttctcgttacaaatttctaatttatgttttcctgctatatttaggtaagttaccttaaattcattctttaaaaaaaaggtagaagtaagtatataaaaaccttccatggttgttacatatgtaacaagcactattcctgtgtcatttgtgtgagggtatgtgtgtgttttaatggtgagagttaacaaattatgtaagaaacactgacattggaaaactgattttaaaaaaacaacttgcaaaatttcatcaaatgagtcttgtttcttgcattgaacagatcataaaagcaattcataaaaaggcaaatatagtgattcttacatcacccatttagttaaagtatcccaaatgctatagcataaggaagtacatgtgctaggcagcctttgagttaatgaactgatgttgatgttaaaactggtgcactcttttctcccggaggtatggctgaatctgtgccacagccagccactttttcatcagattccatttgaaagtcaattgatgaatcagccctgatgcctcattgaacataatgtcgagaagcaagatttctgtactctattgatgtgtttaagcagcatcaaacaagcacacacatcaatggaaatatcggtcaaatcatttgtcaacaattttatagagaatacagttgacttcctaatttctccactgtttgggttgctatagtctaataaatcatgcttctgcatggagacatactaatacttcgtggaaaagtaatcagaagtcttaattgaaataaaattatatttgtccctgtttaaagatattcaaacactacttcagttcacagacttaaaagtgaataacttctttatgaccttattgaatgaggatgtgattaatgttactaaagtcacacttacgttggattgggggactgaccgaccatgctgtgagatctttagcgagaaaattgagctctcttctggttagcgttgactggctatactttgtgctagccatcactgacttccacctaaaaagataaactgtaggtgtaagcagcaaatatcaagccgtcttaggctgtattcttctattccttctctttttttttttttcctttctttttctttttttttctttttttttttttttttttttttttgagatggagtcttgctctgtcacccaggctggagtacagtggtgcgatctctgctcactgcaagctccgcctcctgggttcacaccattctcctgcattctcctgcctcagcctccccagtagctgggactacaggcgcccaccacgcctggctaatttttttttttttttgtatttttagtagagacgggggtttcaccgtgttagccaggatggtctcgatctcctgacctcatgatctgcccaccttggcctcccaaagtgctgggattacaggcatgagccaccgcacctggccccattccttcttcttcttaatatttttccatttcaaggtcacaactgcaataccttatatatcccatattagtaatgaggacatctgtgttgcactggtattgttaaattggccttcagtaaaatcaaaccattccttgcagtaatgggtgagaacttgcctttcacctagagccaagttcattacaaattcatgctcacagcccagagaaaaacagggtttttatgaggtttcaacaagtaatatatctgcatgatgggttgttccaagaaactaagcaaatggaaatgtcagtttgcagaaactgtcaaaacgaacataacctaattagaattgctgcttatttaataagccatcagtagccctaccagatagagtcctgccaatcttgcaagtactcattcatcttgcatttaagtttgtagatactctaggctctgctaatgggaaaacaacgttaattagataccgcacccaatcattaaacagctgcaagcatagttagtgcccttagctatgaaatgctgtaagccttcatgtgaatataccttgatatgtcaacatgggaccccagtgtgtattgcagttataaaacagtgtgcatcactgtatgctttgcacatggcagatcctcgcaatgtacacatcgataagtagtttttattaatgtatattccatgtgtttgaattgcatgtcacccacttaaggtaggttcttatttgatgcccgtagtgtttgcatattaagggccctgaatactactactttgcttagtaacgtgtctttacagacattacctctgacttcatgttttatggttgttagtaattgtgaaacaaatgtgtctgactgccactgggcaatgctgcttcaatagagtacacacattaagtgtatgacattcaaaactagcagaggaggaactctgaaggaggtagggcaggggatgacaagagtgtgggaggaggagaggtgtaaggagaggtattatgaaagaaaaaataatcatgcttttttaattgcataaaataatttgattgcaagtttcaaagacaaactaaaaaagaatgtaatcaattatctgcgtgttggcacaatagaaatttatggggagactgtggaggaaacgaaatgagaacagctgaatgaagtcaatcgctgtgatgtggcgccttccctattgttgagaatggaaaagagtgcaaatgcacagtgcaccggatttgtcagcaagctgtgttttctcggtatggtagatctctattgctcatgactattgagaaagacctacacacctgcttctgttattctcaagctgaatgatgaggacagagtttataaatagcctttctttcctctctgttaagtgtttcctcatatgtgggagaaggtagattatctggctatctaaatatcacctggaattgttacaccatgcagtgaatgtttaagaaatgagagtggacgattttggttgatggttttagttagctacaatgttttcaacatctttaatcatattatccagacttcttatttgttcttcctgtattacctattgattattataattctggctccatatacctgttacctagagtcacattgatacatttttgtcatcatgtgacattgctttccctcaatctcatatgccatttctaatctcattcttgctttactgtttactcgattacatctgaatctgggaatcactctctcatccaacataacagcagcccctcacatggctcctttgcttctaacttgcctcaatttctttctagccagtagagatcaccaagacccaatttggtcatccattatgtttgggaggacagaaatattattttagttatatattcagtgacttacaattgtttatcacaaacctaaagttacctgtagtaagcactggatctgtttcaggtacactgtcaattgtagaaggtagttgtggacatgaataaaatgttagagatgtcagaggccgatgtggctgtctttagaggtagagttttattggaatatggcctagaactttattttcaaaacaaaacaaagaaatggataatcacctcttttccttatcaatgatctcttaatctctactgaattagttttgcaaattatcactgaaagaggatttcaagaaatatgattttaaattatctttttcatatttctctagattttaaaaagctttctttaaaaagatgacaacctttaaaaataacttttagataccatatatgccttccaatctaaaaaaaatgaaaatattgataataaaacatttttctccatggtctgtgttaaaatttatagtctgactcactcaatactaatctatgtggaatttatcttgggtagtctaatctttgttgcaaaaagtgcaatacatgtcttccttgctttaagtactgctttcttatgtgatagaaaactgttacaactaaattacattatttttaaaaatatgatattttttaaatggagatctttttgaatatcataccacattcaatttccagttaatcaaatggcaagttaaaaataagtagtgtgcattagatttttattgctgcagttgtaaattaccaaaggcttagtggcttaaaacaacataatgttattatcatactgacacaggtcatactgatcaaggtctcagcaggactgtatttcattctggaggctctaggagagaatcagtttcctttgccttttccaacttctagagcaagtttgtccaacacgtggcctgcgggctgcatgcagcccaggatggctttgaatgaggctcaacacaaatttgtaaactttcttaaaacattgtgagatttttttttttttgcaattttttttagctcatcagctatcattagtgttagtgtattttatgtgtggcccaagacaattcttcttcttctaatgtggccaggggaagccaaaagattggacacccatgttctagaggcttaccacattcccatgacttatggcacctttcttcaatctttaaagtcagtaacattgcatttttctcatccttcttcagtagccatatctacctctctgactcttctgcttccttcttccacttaaggatggttattattaaattggatccacctggataatctaggctagtcttcctttaaggtcagttgattaacaacagtaattccatctgcaagcttattgccccctttactatgtagcctaaaatattcacaggttctggggattaggacatggatctttttgttgggggaggcattcttctgcctaccacatagtagtatataggtacacacacacacatatatatatatatatatatatatatatattttttttttttttttttttttttttttgaggcagagtctcactcagtcgtccaggctggagtgcagcggcatgatctccgctcactgcaacctctgtctcccaggttcaagcgattttcctgcctcagcctccctagtagctgggattataggcgcacgccacctcacccggctaatttttgtatttttagtagagacggggtttcatcatgttggccaggctggtcttgaactcctggcctcaggtgatccgcccttctcggcctcccaaagtgctgggattacaggcgtgagccacctcgcccggccttataaatatatttatacctaggtttgcacatggaagcaagcatcactattttagattatggacatcttaattttcaactttggcagtaggtttttacctgtaaaatgaaaggaaatcaacctgattatatactgtgtactttgaatccatttgaggcctacaaattgtttgtaaaaacaattgtttttgtccaactgctttttttccaactgcatatatgatttatggaatttgatgataagatcatggaatttttctcaaccaaaagtaatggtttgtgacactaatacatgaagcacattccagaatgatactccagattttaaaaagagtaaaggcaaaaaattgctaacgtctccaaacattttcctgtgagccactaaccattgctaatgtttccttgacaagtgaagaaaacaattattttttaaatattctgtcaaatggtactattttcttcaggtcaattctaaattccaaaatttcagggattatgagcaagctctcgatcgctctcatccagaatttatagtgtccgtgaaactttatgtgcagtacaggaacattttacattttggggttaagagttgcaatagtttggatgattcctctgcaaactgaaactaatagagtcatacaatacaggaccatgttcttaaggcaaatatactatatagtgaatgaaagaaatggattttggtaactccctttcgggctgaactgagtaagcagttcttcacacaaaggcaccatgatacagtgataaaaatggtgagttgggataccagaaacttggtttctggtcctggctctgtctctaattattgcatccttttaaacaagttaaaggatagctttttgcctcatttctctcatttaaaaatgagtttaagaggaattatcgctgaagtcctggatcatgcacagcttctgtgatgttataatcccagttttacatggccaccacatgcctaacatcatctgtggtggctcctggaaaaaagaggggatgtgagcaaaaaaaaggaaatacagcagggagatgtgatatgacaaaaatcttgctaccacaattgttggaaacagaaagcttactcaatcgctgagagctaaaaagggcttttatgcacatctccttgctactttactgttttctgagttcaattccaatggaaatggtaaatatgaaggggccttaaaaagaaatagcatcaggatgttttactatagttctgccttattgtatatggaatagacttgatactagaaaattgacagcaaagtgtagttctctatataacattttttttccccaactgcttttgtagaactgaaactgcactcccaggggaagataaacgatcccacaaggtgcagtaaaagtcagagaatgctattgcagtagggacaagatggcccagagacacagtctacccaacacccacatttaactgatgcagacctgcaaacagagagtcttcatgattcactcaaggtcaagaagccggttagttacagagtcagagctgaggctgtatttactctttcccacaagcaaggttcaactgttcctacttgaattgcatatgattacatacagtatgaaaaaggatttttttctgttaactgttgacaatattaacatcagtcactaattttaataatagtacttaattgatgctttgtatgtgctaaacagtcttgtaggtgttttactcaatatagttttattaactcatctaatcatcccaagaattctgtgaaataattctacgtacactcctactttacaggaggggcgcccatgccccatttaaagatgacatttgaacttagacactttggctgtaaatccagtgttcccaattgtgctataatgcctctgaacttaaatgctacaagaaaaatcaaactaccaggttggacctcaattatgattacagtcatatgagatgagccacttaattgtatggatctttagatatataacattttataacttgaggctcattcattcaacatgtagtgattaagcatctattatatgtacagggatttaccaggtgttataaaggctaccaaggataatgtaattgataatgctagtatgcgtgataaaatggtataattcaaagtataacgaatagcattaataacaacagttcttagatagtacgtatttaatatgggccagcctttttgctaggcaccttgcatatattatctcataattttcaccccagtcattaagccaagtcatatttttccattttagaaatgatgaaacagacgtgaataggtaagcaacttacccatacttacaaaggaagtgacagagttggtattcaaatctaggtctgtgtgaataacaacctcattttatttcaactactctgctttaaattagaaaacccaatcctatcaaaagaacacgtgaggcccctctccaggcccagctgggaggcttattgctgaatgcatggccagaatccattgtggcttctttttgcacagatcttacatgttccccggggggtttattatctccccatatatggtaaagaggagaaatcctggagttcatctccagtctttctgtttaggctttgcccaccagtgaaatttaagagcagagtattgcaaagcgtatttggaatatgttaagaacccttcattttgcgttcatgctttgatgcttcaacatccttctcattgtcctaattttgagtccacattcaaaaccagctgaaaccccttgaaaataaacccaaccgctggcatctggctccgcagccacccaccttgcttggtttgctttcaaattgcccggtgaaattcactggcaccaatcacaagtcctcatgctctctctgctcatcacctattaggtcaagcactcatgggttgtgccgtgttgtggccctgcatggcatactgtcaccctctctctgggacctgtgagaataagaaatgtcatcctctcaaatcactttctcttgttctcctgtggcgggaccaactttcccataccttaaccaacacctacattcttagaacagatggaatgaatggaaacgaagctacacaactttctaaacttgtgattctaacttcaaaagtaatgattactttttctctttcctgctgcttttctattttatctctcatttttctaacatcttttctctcatctacctctgaagatccactctacctaggatctggagccttccttaattcagtcactcatttagggactgtactgagtttcaccaggggtttcaccaaataatgatataatttcagctctttatgccttttgagtgacactcataggaagagaaggattgcatctctacctctaaagggtcttgaattgtgaaagagtttccctcccctcttctcttgtgctctacttcctctgctttcctcccctccttttccctctcccccacacatgtaaacattgtgtaattccatgtgtgtccctgttatctatttgtttctagtgttaaggtgacttacagcttaggggtacaactgtatatgtattatattcagatgcagacttgtcaagacaaatacagtcttcctgacactgatgcatgcagtcaacactggaacagaaagttgatagctgcattaaaatttttgcaatggctgccatagaaacccacgcaagagtgactttgcgctgaaatatgacatctcagggatctgtctggtgaatctttgacacagaaagagaaataaattagaaaacagttttccacagagccttttagatccttaaaacttgagtctcaaagcacttgaacaaagtaactatttggaaaaagaaaaggtattcgttcttggcatttttaaattcattgaatagattctccttaaatgttaatagcattttgatgggagaattactctattcagagcattcggctcacctcagaaatgatttaaaaattttatgttatgccttttaaatattaagcttctcattttccatcccatatcaaaactggcataacatttcagaagtcaaggtttaacagtcagcaaataaacatatttgcaaaactgttaaatgatgattatttttgcatttgatacgcaattgtatctacaatatatgtcttgaggaatatgtgttttattcactgcatgtatgcaagcaataaaatttcactaagcagactccatggcaaattagttacctgagtattccaattactgaggttcctcaaaccactagaactttcatcttttttttcagtcctttttttttaatcatactctaagtctgggatacatgtgcagaacgtgcaggtttgctgcacccatccacccgtcatctatgttaggtatttctcttaatgctatctctcccctagccccccaccccccgacaggccctggtgtgtgatgttcccctccctgtgtccatgtgttcttatacttcacctcccacttatgagtgagaacatgcggtgtttggttttctgttcctgtgttagtttgctgaaaatgatggtttccagtttcatccatgtccctgcgaaggacatgatctcatcctttcttatggctgcatagtattccatggtgtatgtgtgccacattttctttatctggtctatcattgatgggcatttgggctggttccaagtctttgctattgtgtacagtgctgcaataaacatacatgtgcatgtgtctttatagtagaatgatttataatcctctgggtatatacccagtaatgggattactgggtcaaatgatatttctggttctagatccttgaggaatcaccacactgtcttccacaatggttgaactaatttacactcccaccaacagtgtaaaagcattcctatttctccacatcctctccagcatctgttgtttcctgactttttaatgatcaccattctaactggcatgagatggtatctcattgtggttttgatttgcatttgtctaatgaccagtgatgatgagctttttttcatatgtttgttggctacataaatgtcttcttttgagaagtatctgttcatatcctttgcccactttttgatggggttgtttgtttttctcttgtaaatttgtttaagttctttgtagattgtggatattagccatttgtcagatggatagattgcaaaaattttctcccattctgtaggttgcctttcacttcgatgattgtttcttttgctgtgcagaagctttttagtttaattagctcccgtttgccacttttggcttttgttgccatcgcttttggtgttttaatcatgaagtctttgcccatgcctatgtcctgaatggtattgcctaggttagggaactttcatctttactagatgaatcaaacctggcaatcctcagataccaaaacaaaaacaccttcatatacatgttagccctcatagaattcttcaaaggcatactttctgtcttaaagtataaaataattcaaatataaattttcttttctcttgatgattctgcaccgtagtacttttgggtgttagtgtaatctactggtgcttttgtgtagatacaagatgcaagtcaagaatcagatttgttgtcatctctcatcgctctttttttttttttttttttttttttacaaatgtaaccttgtgcaagatgcctttagcaatcaatgcctcaagaaaaaaagagatgattgccaagtggttaattagccttctgccaggtcttccccacctcagcaacctatttaccaacatgcaaacttgatgcccactaacagtggaaaagtcttaggcctttaggggtcacagtgatgaggtacaggtgactctttacccaccccacccctgatagctgatctacctctcatcatccttctagtcatgacttcaaattaccaccatgctgcctggacagctgatgaggggattttcataacagccagtatggctgctttgaatgattgccatggaattttttccctcttctttcggtttccctcccttttactttcttctatctcctgttgctactacaaattttctgtgaaaagctggtttatatatagattaccaacccatcagagaatacttttgctttcaagtaggaaatcaaataatcatagcatactgggtactattttttatgggttctctcttctatgttgtttattacttggattcatggggatgcttcattcttcccaatgaggtaaggtttccagccctctttttgtaaccataattgttttgaagtctagagctgttcccaaagattgagagttctgaaagtttggcctcaggagtgggtggggtgggggagagtagtaggtaagctgttgtgtgtatatttatgcttattgtttgctcagcaagcagtagacatatacttgaattaatctggcaaagtgtttagttttaatgtaaggtgaaacacaggaaaatactcctatcccaaagatgtgaaaaaatagtttgttaggggaaacaggaaagagcagctctacaaccaatgatatattcatatctaagttgaagtcatatattctgttttatgtggagcacacaaattagctttgcaagttggtcggctatgcctagatatttactgtaacatatatttttctaaaagcatatatgggtgccttaaaattaaaatctgtaccacaaggaatattggatattagaaattatgaaacaatagggcttatacaaaagaggtatgtttattcatttacttactgttttttattggatacatgtgattaaaagaaaaatttttatataatcctattgtctcaaggacaaatgattctgtgctcatctgggcatgggacatgtcacacagatattaaagacactacagagccatactgaaataacacggacagagaaataaaaaaaaaaaattaaaaacagggtcaatagtggcaaaaagtgagcttgttaaaaaacagaattggccaggtgcggtggctcatgcttgtaatcccagcactttgggaggctgaagcaggcagatcatgaggtcaggagttcaagaccagcctggccaacagtgaaaccctgtctctactaaaattacaaaaattagctgggtgtggtggcgggcgcctataatcccagctactcaggaggctgaggcaggagaatcgcttgaacccagaaggcagaggttgcagtgagccaagatcatgccactgcaatccagcctggttgacagagctagactctgtctcaaaaataaataattaataaattaattaaagtgaaggcatgcaaaatatcctctttggagtctaatttagacatcatggaaggataattatttggtggtggggatgacatggagattaaaaacaggagaaggaaagccctgtgtgttttggcattttagacatttagtggaacacactagggttcttgacactttctctgtaacttggagaggatacttttatattgtagataaccttgtggagaggtagaagaactatggtggagtctgaagaagtaatacagttcaaggtgtttccaatttgctctaagttagcaaaagaaaaagacaaacacaaacaaatagaaagtattggctgggcatggtggctcacactagtaatcccagcactttgggaggctgaagcagacgggtcgcttgaggtcagtagtttgagaccagcctggccaacatagcgaaaccccctccctactaaaaatataaaaaattagctgagtgtggtggcacacgcctgtagtcccagctacttgggaggctgaggcacgagaattgcttgaacgtgggaggcggaggcagaggctgcagtgaaccgagatcatgccactgcactacagcctgggcgacagagcgagacaccatttcaaaaacaagaaaaaagaaagtgttatacaagttatatcacgaacaagataatataaaaagctattgcacatcaataagaaaagttcaactcaatgcaaaaatgcacatatgatatgaatagacaactcataggaaaggaaattcaattgactttgaaatatatgaaaatatattcaacctcatttgtaataaaataaacataaattaacattaaacattttacccatcggattaacaaagttaaaaaatggtatagagaattaggtgttcgtacactgctgatgggagtttaattgttacagcctaaattcaggcaagtcagcaatacctatcaagaacaaaatgatgcatattctttaggcaattctcaaatgtatcttgcaaatatggtcattcatgccatctcatgctcattcatacacattcatgccgttgtgtgtctgtgtgtttgcagccattgtgtgttgaattgcataagattggaaattactgacatatacatcaatggaggactagtcaagaaagttataggtcattcacaaaaagagactattctatatctattagtatggaaagaagttgaaaaggtatcattaaatgaaaaagtaggggattcgaaacaacggttatagtacggtatttcttgggggaaagaatacacatattgtgataatggaatatctctggcctgtttatacttgggtttggctaagggattgtctctagggaggggaactcggctggggagattggagtgggacaaaaatttacttttcaatttacacagttttatagcttttacattttatatcttattgtatggtcaactcagaaagaatagttaaaactaaagggattagaggaaattatgaattctaagaacttactttgtctgggaatttaactgtgcattgagctagaattatttttgttgtattaggaatctggtaatagtgaacatgaaacaggagagaaaaatttttcacagatattttgacatcaaactgagatcatttgatagtttttgcctgattaatattcttaaatgattatggagaaggtgttgtgacccagaaatgcaataacccattatagtatcttgtttacaccccattaacactgatagcactctatgttactttattttcaatttttttccttcagagtctcagttatttaaccattttccaattactaagcgatatatgaatctgactcacattctatattcagaacaatgaagatcaaaatatgtatttcttatagcagttatagattacaatagtggaaaatgggcttcagagtatgaaaaagtggagagcaagtcaaaatcttatatgaatatgagagaacattttagttataattacaaagccccaatggcctaattttcctcattaatgctgagtgatatttttgaaaagtatgtagaatttaaggtaccaattgccaaaacagtgaaataaaggaaaggcgtgagaaagaaagataaatgaaattcccaggtattacacaatttacatcaaagtattttctaattggtaatgtaaaatgttatataggaaattttacacatcattttatatatctctttacttgaagtgttaaagtgatttcccatataataattcagaaaattatgtataagctaacaaaacttagacctgtagactctagttgtatgtagaaactgccaatagctgctaattcaattctctcttcaatgtaccccaactgatatcttgtttactgggaatatcacattcttctctctcattggactttatttcactggaaaaataagtcctaaagggaataacaaagaaaactacaattgagaaatagaaacaacaacaacaaaaagtttagctaaataattaaagatatttgatgagcatcctggggatatccaagttaatgaacttgagtgagtaggatgggcattcatctctgattcccacctttcagaagagtgaagaaagcattaaaccatgaaactatggcttgtgaagatttccgagggccagtttactgagtgctgagaatgccagttttttaaggcttctcattaccttttagcatttggaacccaaagtggagaatgattgcttctgaaataacaagaggtcatttcctcttccttcaggtctcttcctaaatgttctcttgttccttatgctgcatgatatgtaagataaaatttatttttttcattgtatcattaaaaataagaatctttctgcaaggaaaaagaagggtatttagataaaaccaggagtttactttgatacttccatgtaaactcctgtttgtatcagcagtggtaccttggctgttgtccagcggtttaattggctcttgtttgcctaatctcctgtaacagataatgttattacagaatcgtaggactccaaaatttcccatcagacaaaacaagccttttaatgagaatcactttgttttacctggcatttggcttggtttgagccacctcaatcccatctcacttgtgagaaatgcattatttttcctaacaaccatgctaattctaagccaggaaacatttttttggatcacttcttttctggaatgattcaaagttcaggaaagtaaaagtgggaaggaatttaaattaagctgagatgggaaggagacataattaaattggactttattacccctgttttgcaactaggttgatgttaattggtatctcaaaagacatagcactataacatttgctgtttttgaatttacattaatttcttctataatagtacgtcagtgtatataatttgtctaaattctgtatcttttatttatccatttagtaattcttacattcaaccaatatttggtgagtgtatttcgtgtttaaggcactgttctagggaccactaatagagtaaagcaaaacaaaccgacaaacacaaaataaagtcctaactgtaatggagctttttgttcaggtagtgaaaattgttttaagaaaaataatatatggggataacagtagaccgtgtatgcaggagtaggacagttatatttatacatctatacacacacacaaatacatgtatgtattcacatccatatacatctgtctacatagatatagattataatgttatattataggatgtcaaaaagaatctctttttgataggctggcttttgagagaattaaaaggaagtgaaggggcaagacatgtagccatatggacaaaaggaaattacagacaggacacagaaagttgcaaaaacctgaagtaaaagaatgttttgtgtttaaggggcaacaaacagtgatgtgagttgggggaatatgctagaagaggagatgagagagacaaggtgggaatggaaaaagtccagtaggacttccgtgacaaatatttaggaatggattttgttaaacaacatgtatacgatattgtggttaaagtagaaaatcaatgatagactggattaagaaaatgtggcacatatacaccatggaatactatgcagccataaaaactgatgagttcatgtcctttgtagggacatggatgaaattggaaatcatcattctcagtaaactatcgcaagaacaaaaaaccaaacaccgcgtgttctcactcataagtgggaattgaacaatgagaacacgtggacacaggaaggggaacatcacactctggggactgttgtggggtaaggggaggggggagggatagctttaggagatatacctaatgctagatgacgagttagtgggtgcagcacaccagcatggcacatgtatacatatgtaactaacctgcacattgtgcacatgtaccctaaaacttaaagtacaataatagtaaaagaaaaaagaaaaaaaaaaagaaaatcagggccatagagaaaagatggaagcaaatatagtgtagagaaagctaatatgtttctgtagttgatcactagatttctctatcagtttcctagtggccagggcatacagggaaataaaaatgttgtatgtctggttaaatacatttttttaaagcaagcaagtataccaattatttagggaaattgaaacaaaattacaaaacaattgttgctcttgtttgtcttctttgttagccaaaaaatgcctcccctttatttttatttgttgttgttttggttcttcagtttctattaaataaatttccacacttgagacgctgtgtaatttcatctagttttgtacaaggttgtgggtgatacaatcttatgtcatttttaaattgtccactaccatactgaaattttcatgacttgccttcatatatgagtatgtttttatttcaatcccaagattcaagtatacaaacgcagtgcttttttaataggaagaacatattaaaagtcttcatataccaagagaaaacttacttctcttagaatactgattgtctctttataaccactcttttataagtaattgtataaactcttacattgggattatggtagtttcttattgatctggtaaatgttttctcgtgtctataacaattcaaggtaaaatacactacaatcaccagaaataaactatgttttctggtactaaaatcattattttagtaatttttaaaaataatgttcattattatccattatctgagagatacctctcattacctctctcaaaaatgacaagaaagtgaaataacatgtctaagattattgttacctaatgtttataaaaatagataaacccaagaaaaatatcgaaaagtattaattgtatgaaaagatggagaagaggaaaatatcccttataatgaaaatcagtcatgctagatgataaagtggtgagatttaaacaattttctgggcattgtattctcaaatggatagtgagttgagcaaatagattaaaaatagtgtaaagtaatgcaatagtaaaataaacatgctgagtaggaagagttaagtcttagataacaaaaggcagaagacaaattaaatcaaaataatgtagaggcatgacaatgaaagctaagtagtctatggaaaactgttaagagacctgaattaattaatgatgataatggtcgtaactaacatatatatgtagtgacaggaatcaatccaagtattttacacaaactcctcatttaattggccccacaactcctttaggttggtattattatcatttccatttacacatgacgaaactgagagcacctagaggattaactggatcctaacactcaaaggctttgtgatatgaagtgttcagtgattaatgtgtttgataaggttgaagatttggggtgcatcatttcatatcaactatagtaggtggaccctgtcaggagaccagggaagagatgattagaaaacccagatgaaagaaactaggacctttatcaggaactaaaggtgaaactatacatttagatggtgtaaatgccttaggggacctgaaaaatggcaagcatttaaggtgaaaggtaaataggtgagtagccccaattgaatgtataatattaatgaaagtcacatttaaagatgtttagacataaagcaaatggtcttgttatttagcgggacttaaaaggtaaatcagtaagtggagaaaatctcatctacaatgggaaaatataattgagcttagactggatataaaagggcagaagtggagagctagatctatgtgtatttatccagggtttgttatgagcccagagaaaatgtaggaaaagaaattcaacaactgaaaaagcaaaaaattaaatgaatctgaacaaagaaagctgcttatattagatatattttctggaaaaagatataggtgtcctgtcttagcaaaataggaactagaacaaatgccaccatctttcaaaatttaatattttcttgctacaatttatgtttatgatttatacttatggatatgatactctattaagaggcatcttgtgtgaaacaattatcatatacattgcaaaatagaatatgtataaatgtttccgtgtatatgtgtagatgggtttgtgtgtatgtgagagagagcaaagagggggagggagagagagggaggagaggagaagggagagagagaggcagcaatttctaagtatttctaaacataggagggttataagattatattcatggaaaaaagacatgttccagttcaagctgtatgcatttatacagtggactactagtatgatgaagctggagaacaagtcaaaacactggagtggaagcagaataatcacacacaagacaggtgaaatattccagagtcaccttgaaataaatataaaattgatgttggcagcctgacagtgacaggagtcaagaaatgatgctgctgtgaaatcacaaaagatgcaattgatattttaatctcaaataccacgtctgaggagaaagcctgaaactaggaattgtttgtaaaagtgtatctgttgatagatttctgattttgctgcttttcatttttatcctcttatggagaataataataaaagtagtcacatttttagtttatattgctctttaatttttttcttaaaatgaatttgaatttttttaagacaagaacataatatgctctgaaatcgtgtcattagatttaaaaaacattattggagatatttttcttgttagaccactgcttttcttaagtgaagttgaccttttgagtttttagtaactaaggtatttgtgtgtgtgtgtgtgtgcgtgtgtgtgtgtgtgtgtgtgtgaaattcattatatttgttcttctaaaactattttcttcagttctaggtttcctagtttggagcagaattctatatttttcttgttttatgccctaggaagggcataaaattattttgaatatttttttccctcttcttcctgacccatgtaatcgcctagctgaatcaggcctccccagaaactgattcatggtcgttgaagtatctcatatgacccccatcccacctagtccgatattaaccctataaaatgtctcaaataaactcttattttcgtggcctctaatctccttaattttttaattttagattcagggtgtacatgtacaggtttgttacatgggcatattgcatgatactgaagtttgggcttctaatgatcctgttgccgaagtcctgaacatagtacacaaataggcagttttctaacttttgcttcactcctgtctttcccccttttggaatccccagtgcttattgttcccctctttgtattcatgcgtacccagtgcttagctcccacttttaagtgagaacatgtggtaattggttttctattcctgcattaattcgcttaggtgatggcccccagctgcatccgtgttgctgcaaaggacatgattttgttatttttttatggcaatgtagtattccatggtgtatatgtaccacagtttctttatccagtccactgttgatgggcacctgggttgattccatatctgctatcacgaacagtgctgcaataaacatatgagtgcaggtgtatttttgctagaagaatttattttcctttgggtatatacccagtaatgagattgctgggttgaatagtagttttgtttttggttaactgagaaatctccaaaatgttttcacatcagctaaactaatttccattcccaccaacagcgtataagcattcccttttctctgaaacctcgccaacatttgttattttttgactttttaataatagacattctgactggtgtgagatggtatcttgttgtggttttgatttgcatctgtctgattatctaatctcctttaaaagcttcctacatcttcctgaaaatatatattgcttgattaattaatttatttatttttcccttccctttttcacaaaggattgctggctgcttatactaaaaccacatattattaaataaacaacaacaatgtaaaggacacaaatgatgcaaattaatcatataaaagggacaacaattttgctgtgactatttttcttactgtcatttgagcttcctagcagggaatataaaaggcaagacacagtctccaatgcaggactcaacataagataggaagatatgttaattgctgatttcattaaattttatccagccggttcattctaatgcctctgttttttcaactgtgcaatgaagatcatgcctaccttgtagagctactataagtagtctgatagttcagtgacacatatttcagtgtgctcatcacatttatccaagggtagcttccgagatcaccgtcagtttcacaggaccttatctatataaatgatgatgatgatggtggtgatgataattatggtgattacagttagcacttattggtaacttgtaactgggaagtatggtaagtattttcttggcttacctcatttaatcctgaaaacagctctatacagtgggtacttttaaaatgtgcattttgcattgaggagaccttaggctgagtgacttgatgtccacacatataatatgaatctgctatatgtttatatatatagcatttgaatttgtgtatttgaatttgtaatgataaatatgggagaattaccctgttttcttacctcctctcactactgcaacttattaattggacgaaatatgaaagtaataaattcagaagagacagagagcatttttcaatgttcattatttcagtaaaatataaacagctcacagagatatttgaaaaatagtgagccaaacacattcatttcatttttccttgttcttcttttagaataacaagcctagtatgtctctgaaactttttgcaatctatccggttataatgttagcaccaatgtagccataagtaatttttttttgccaagtttgccctaatgcattatatcatttgagtgcatgggaagatattagcgccattaaaaatattagtaaaactgatttcagttcaacaacctgtacattgaagttgttgcatttatctatttacatctctctgttctgtacaaaagcagcaacttaaacgatgtagataaataatagtgacattttatctccctttctaaagttgaattccagaaggtaggaaagatcctttcatgcttacattaccatgacaaactgaaagagataaatccctaacggatgggatgagatgtgggagttagaggattaatgcttagatgcttcctccaatttatttctcctattatatgtgttaaaaatatataccatatgtcatgcagcatgttttaatcccatcaaaatgtctcacacaattccttaggggatatgctttttgctgccaagttttcaccgctggaatgctgacttactattcctttgcagagagcttcatggtttattttatgataacatgttgttataacttctctggctgtaatttttataaggagaattagtcccgggggaatttattttgagagtcatatgcttaatggtgacagaaaaggagagaaatatttccaaaaagcaatgtatccttcagttgttttaatagaacagaaattcctttgacaacatttgtgaaagcctttattatacccagcatttaaattcagtccttgaaatggggttttcccggatcatttgaaggtcaattttggaatagttcttgtgtcctatgacacctttcaatgatagcactttacagagaggaacaaatttaaggcaaaaagtctcttttagtgatactaagtatacatgacttatagcaggtgacaaaaaagctgcatataattgccctagggagaattttctttgtgccacgttgtcgctttaaaaaaaaatgcatgtagcaaaatttcacatgtaccccataaatatatacaaatataacatatcgaacaatttaaaaaatattgaataacaatgtgagcgattaggtaaagaggacaacttgaactaattttcacgtcacaaaaaaacaaggttaaaactttacaccaggaattaacaacatgttaccttcgggttcctctgtgtgatgttttagtttgaaatctcagtatccttaaagttaccatttgttttatacgacattgttcagctaactcatgtaggctagggcccactctggcccccaggtatatgattttcaccaatcagggatcactacaagatttacttaagtactcaaatataataaagccaaagttattatttagttttttttttttagaaattaagttgctccgaaatgtatgcaccctgtttccaatcaagccttctaattgtaataacattcccccacagaggctctgttagcatttatgggctatattaagaagaaaaaatacacacacatgagcacaattccagagatgccctttgggttttgctttccttattggaagatataacctaaatggatgtcaggtgtgcaaatagactatattttttttgttccataaaatctgctgggcatggttcaaatgctgtcttttaagccctttgatggtacttaataaatgcagggatgcaaactgaggagttacttgacacatcatcatgccattggcagtatattgatggtaaatatgaaataatttgtttctcccctccccaactctaacctcataagtttcacacatatcagaccttagcttctctttgtcagactcaaattggatttccttttctatcatctctaggctcagacttcgatgaccctaatttggcagctcttcaaggggtttatggtgtaagccttttctatttctaacaaaaaacacagctcaaatcctcttcacattagtgaatactgtttgaagtttcattttccaaaagataccatactttcttaactcaatttttaaaattatttttactttttctgtactgaatagttagtacattttaattttgagtgaaaaaaagttggtttgaatagaaagtatgcattaaaattctccataactggatttcgtagtcaaatctaggacagaaataatataaactattttatatactattaaataaatgggatatttatttaagcaactgttatttataatttaggtgctacttctacatttagggatttagtatatactcctgttggccagattttaacagagttcaaatttcttaaatggtgttctctttagcttaaataactatatgtcacaaaaatctgaaaaaaacatataagattaatcatgattttaaaatttaattgatgctggataaatgtaattagaaacaaaatttcaaagttgtattactactagaaattctcatctgatctatatattaaaatatagtcaaatatttaaggttgcctacattacagtgggaaaaggtaaattgaagttgcagcttcttatgacatataacctatacatggtatcatgggtcattttgcttgtttcatttcccattagaggaattttaatgaaggaggccagtaaaatgttgattaataagtgttgatgtgaaatacacttactgggccatataaaagtggcaagcttatgtagactaccccccaccattattatattttttaattctatgagtatggaactccagaagactggaaaccatagcttttatctttttcccatgagagttatttatccagcattttcttcaataattctacaagatataactagagacatagatcctattagtttggtaaacagttataattattacagtagccttccttatttttcacctctttgtcccaattcattcttattaagatttaaatgttggggataatttattttaccaaatgttatagaagacagagaaattaaaagcaaatggctaaagccgacataaggtttcaagagctaactgaggataaaactctaatcgtgcagactttagttgctgtattagtctgttctcatggtgctaataaagacatacccaagacagagtaatttataaaggaaagaagtttaacggactcgcagttccacatggctagggaggcctcacaatcatggcagaaggcaaatgaggagcaaagtcatgtcttacatggcagcacacaaaacagcttgtgctgggaaacgcccatttataaaaccatcagatctcctgagacttattcactaccatgaaaacagtatgagggaaaccgcccctatgattcaattatctccacctggccccgcccttgacacatggggattattacaattcaaggtgagatttgagtggggacacagtcaaaccacaccaatcacgtcggtaagggtgagtcaaatggctagtgttccctcaaaagtgagtgtgctgcaagagggtatatgtgatatatgtatgtgtgcataagcacaatcacaagattaatggattttaataaaagatgaaaaagtattacccagaatactctatcaccccagtttgcttgattgatcaattggcttccggtatcataacttgcattctcatcccacttatatagttaatttttatatttgtaataaaatgtatagacagtaaaaataatatagtaaatatatatattatatataataaatatagtataactgaacgaataaaataataaaatgtatagacagtaaaaataatatagtcaatatatattatatataataaatatagtataactgaataaataaaataatatttttatttccttgcttttatagatattatctccaagaaaatcataggggaaaactttaaactgttattgttggtcagtcacttaatcattaaagtaccctaaactttttttccaacttgaagtcgactttcctaggtatgattttaatggctgcaacacatgccactgcatgattctccattgttgcctttcagattgctgtgattttttttaaaactacaaccaggtacatgcagataatgtcttcaatgttatctgataaataagataatttgtaggcaaaaaataataataacccttcaggctctttataaatgtttttaatctaagtttccaagagacctggaatcaattccatgccttaggctaaattcttaatcttccttggagacatgttcttcctccagacctcctcaatttagtgagtggtaccaaaacccaccctcttgctcaactcaaaaacctggctgcctctttctccctctcccttacccctgctttttgccgttatacgctatcatgtttctttccttctacttccttgcagtggtttccatcacatttagaataaaatccacctttttaaaaaaatataatctacatgctgcccacccctctaacagatcactaactcccaggcacacggagcagacagactctcctgtacatgctgttcatctgtttggaatgttcttctcgcacttgccatgtctggtttctttttgttcttcaggggtcaattttaatgttccatttgcacagaggccttcctagatgacctcaatctgaagtggctatccttcgcttgcataatacctttcctttctttggtgcctttttgcaatgtataatattatttaatatgtttgttggcttacttgtttaaatatctctctttacaactagatatactcatgaaggttgctaccatgtctgttttgtttaccagcatatatgccatgctaatcatgttgcctgacacattgggttatagtggattggactgcttgggtttttgtcctggctctgaaatgtattaactgctgtccttgagtacaaatgtaagatgggcataatgataatacctaccgtgaataaaccaaattattcatatacagttattagcatagtgcttggcacaatatacattctcaatacattgtagttactattattttgttctagtaggcattcttgaaatattttttgaaagagtgaaataatgagtttattttgtgatataaataagtaagtaattacctctttggtatatgagtatgccatttttatcccaatctttattgctttgagtatcatcctttaagttactaataggtagctgggcatggtgactcaccatggtgacccagcattttgggaggccgaggtcggcagatgacctgaggtcgggagtttgagaccagcctgaccaacatggagaaaccaagtctctactaaaaatacaaaattagccaggcatagtggtgcatgccagtaatcctagctactcgggaggctgaagcaggagaatctcttgaacccaagagacggaggttgcagtgagctgagatcgcgccactgaactccagccttggcaacaagagcgaaactccatctcaaaaaaaaaaaaaaagttgctaatatgctaaaaataagaataatgctcatgtttttacttccatacaattgattgttagaggtgaaaccttttcccatctgcacaaatttctggaagacaataaatgtttcttcttctttcattaatattttaactgtggaggtatctgtttcaaaatgtaaaatccaataggtaatcagtgaggaatataacctagattaacttttttttttcaaaataaccaaagcacactcagtttaagtttcatgttaaagtgagccaaatgccagttaccaaaatattggatggctatgtatataatcctttgctgatgagtaatttagcatcaatttagagatgttattttttttctaccagatgctcgaaagcattaaggcaagattagaagtcattgtcccttcttctgttatcagtggtcccacaatatttgtttatatcaccattagaaacaaattgtactgtattatagttatttttttgtttgtccctcctattagagagtgagttcactaagggcagacattatgttttatactttattgatgtggaaagcaggcagtaaagaaagaatgaaggactgattattggacatttgttattaatgatcttagcttattattttcctccaaatgaaaatgttttagtgaacataaactgggaaaacagcaggagcaattcagttaatactcagttaccttgaagaggttgaagcagaaagtgtttgtgtcagttgttttaacataattgccagtaaagatactgaaagtattccctcatgataatgagaaaaatccagaacacaaggcttgattactcctacaatatttgcctgctttgactctgactgtgcttaagtatatccaggcatgctgtgcaaagtacagaactgaaataaaataatccctagtccaatcataggcttacgttactaggataagtcaagtttgtggtttcacctgaagtaagaaagcattaagtcttcttatcacacccaatcatccatattaggcttgggatagaaaaggcactagagacagtagggataagatttagtccagggagtaagtacttggtttcattaaaactaccctagaattggctcaccagtattaattaagtcctttttatttgtaatctcattcatcattctctctctctctctttctctctctctctcccccccccccgctctcatagagcaatgttaaacaatgtacacttctttttttaaagttatagatttctaaatttaaaatgttctgatatagtctagctctccaattagggagaagtagaaacatatgctgctcagcttttctaaaatcttttaaagtaatcaattagcatatgggctaagttcactttagatggatacacacatgcactatatatatatattttctttagacatgttaaggcagtggataaaatttccttttgcaatcctttgctcatggtatattaatgctgatagtattttatgctattttgtgttgatgctctcagcacaaattggccccaaaatattctgtattcaaaagcatgtatttttttcctaagcgtactatgattttaatagaagcagaaatgagtgtttccttcttttgtgaatttttgggagggcatgcttccctgcagtctctggagtgtgtgttgacattttttgtgccatgatttcccataagtaacacactcttttgatagtgaagcagtgagggaaagttgctaagttccatctgtaagaaagcattatcagaagtggaagaagggaaatttactaagttccatctgtaagaaagcattatcagaagtggaagaagggaagtgacaagaaaagattcaaagttgttttgttttagctccagtagatgctttataacacactcctaaaaagagtgtgaatataatatagttaatataaaatttattttatataaataatttataatcttcaaatataaatttgtttttactatataagcaatgtaacattgacctaaaaattgaattgaaaaaatataaactttcttctcagaaactgggttctcaattactctctatgtacctgtttataaaatacaaaccatctagataatcattgcaccacaatttgtatcaaactctgtttcttagccatcctagagtacaatcaatatcattgatcttttcgaaaaaccagcttttggtttcattaattttctttattgtagagttctgtttctttaatttttttattattatttttgagaccgagttttcctcttattgcccaggctggagtgcagtggcgctatctgggctcactgcaacctccgcctcccgggttcaagcgattctcgtgccccagcttcccgagtagctgggattgcaggcatacgccacgacacccagctaattttttgtattttagaagagtcggaatttcaccatgttggtcaggctggtctcgaactcctggcctcaggtgatccgcccacctcggcctcccaaagtgctgggattacaggcatgagccaccacgcctggccctgtttctttaatttttagataaggatctacctttaacttatgaatataatatataatatgaattatgaatattatgaatataatatgaattatgaatattatgaatataatatgaatggcattgttgtagggtgataactattttaattcaccttcttgaaatagataacatttggcttttggttagattttagatttatctgttaatgttcagaaaaagataaaagataaatcatggaatctttttttttatttttttattttattattattatactttaagttttatggtacatgtgcacaatgtgcaggttagttacatatgtatacatgtgccatgctggtgtgctgcacccattaacttgtcatttagcattaggtatatctcctaatgctatccctcccccctccccccaccccacaacagtccccagagtgtgatgttccccttcctgtgtccacgtgttctcattgttcaattcccacctatgagtgagaatatgcggtgtttggttttttgttcttgcgatagtttactgagaatgatgatttccagtttcatccatgtccccacaaaggacatgaactcatcattttttatggctgcacagtattccatggtgtatatgtgccaccatccatggtgtaaaaatgctcaccatcactggccatcagagaaatgcaaatcaaaaccacaatgagatactatctcacaccagttagaatggcagtcattaaaaagtcaggaaacaacaggtgctggagaggatgtggagaaataggaacacttttacactgttggtgggactgtaaactagttcaacccttgtggaggtcagtgtggcgattcctcagggatctagaactagaaataccatttgacccagccatcccattactgggtatatacccaaaggactataaatcatgctgctataaagacacatgcacacgtatatttattgcggcactattcacaatagcaaagacttggaaccaacccaaatgtccaacaatgatagactggattaagaaaatatggtgcaaatcatggaatctttaaaaaagaaattttattcctgtgttaatgtgtagttttaaagatttgtttaacagtgtgtactaatgaagcataatagataccaaaatgttttcattaggaacaaaggtcaattgtgcgagaaggagtcaccatttatgacctgacaggttgaggtaatgcaggcagggtaagacaatacatgagtaagcaagcccccctcccaacagtagtcatcattaataggaactcactgcatttagggttaacagatatatgatgggtttgaaaattaccaaagtggaacccagatggatatgtagatttcagtatcattatatacttggaaattgaggaaatagtgtagaaaaatacataaactggaaaaaatcttatcagtcaagaattaagttctagggacttgctttgacctctcattcattcctttatggcctcttaatttctctactttttctaagcttctctctgcatatatcttcactcttatctccctaagactagctttctctacttattcataggttcctccttatcactttagattacatgtggtcatcacaacttctttggccctaagtctaccttaagccttttgtttatactcagaaaggaggactctgattgggctagctcatcttttctaatgaaaccaagagataggttacttgcctgcataggacttggctgcccttggttaaggggccatcatagcaccaatcagtcatgtctggtctggccatggggatgcataaataaacaaatggtcttacctttccaacctcttcctcaatcactacctaccctaggaccacaaactctatgttctatccaaaccactcttttccacagatacctaatcatttcactattcacagtgttaacctgccttttctcacttcttgaaatttccatcacagaatgcatgattaatctcaaagcctcatcccttgcatgtccccatgaagtactcttttactttcctaggaaaagttaacactctgatagtgctttgtttatgattgaataaggtcacttctggtattgtatttccactatgagagtgatgtacatgaactattgaatataaaaacatacctttgataccattttgttgtatagtttataaaagaaagctatgacaccatagggttattaacattatattacttaaagtagtggtaaaaacaacacacatatacacacacaaacacatacacatacatagcacagccagacttggcattctaacatccccacacatgagaactatcaaagtatcatttctgagctgcgttgtttttctacttgtgccctatttctaatagtggaagaatttttttttaaagcaaagctgttatcttttaaacactggaataaaaaaaaaattccattttctgcatgagtcagttttttcagtgaatattttcagcaaatgaacaagctctgcattaaatccatgctttgttttagtagtttccttgggtggactagtttcaccgaatgccatgtgtaaattggtcacatagaacaagaatttatatttccacaattttatttggaactttgaaacttccattatctcacagaacccagaaattgaattgaggctttgttactaagccaggttgtagcaacagacttaggagtcagtagctcaattttctacttctttgcatcaaattttctcctgagaatgatgcatgcaatacagaggaatggcagggaggagcctctgtgaagtgttaaatgtttggttcactgggtcctatcagcaggtagggcctgtggggagcttgtttatccagcagaacaatctcattatgaggacagtgatgtacaatagtttgcttcataccccaaaaccattcaaggaaacgactgagtgaatgatatttttccgggccctgtattatgctattatgacttgcaataactggcagcatattaaaacagaagtcagggactacagttactctgttgaatgaagttctgaaatttcaaaggtgttgattattcagtattttccaatttacagaataaaagagtatgtgattgactatttcatggcgcagtaatggaaataaagaaagagaatgaacaggcttgattaatttcagagtaaatgcttatttttcataattgcataattctcaagtgggtctctgtgtagaccggggtggccttttctgtcaaatacaaagataagaacttggcattgaaaattaaggaacaataaaaaataaatatgtgtgcatgtgtatatatgtgtgcgtgcacatacccttgtcatcactaagggcaagccaccacacagccttggttagctttgaaaatatctatgaatactacattgaaaaaataaagtaagatttgggacaaacatccatcttcctcatgacaatatgctgggaacagctgtaagcttagaataaagtggggaaccctgcttaatgcgctatgcagtaagcttatcaaatctcagcccagctagaacagtgccctaggatacaacaggcaccttgtaaatatctgttgaaataaaggatgaatcagtgaacgaatcaatgaatgcttctgtccagaagtgacacagactaaatgctgtaaaatcattcatcctctaaaatttcaaatattgttggttgtctgaaacatattaaaggaaagggacatggtatgaccactaagtgtctgaagtcttaacttttgaaggatgcatcaagaaacccagctacatcttttcggtagaaagtagctaaagaaaggattctgaattggatgaaccatgaagtcctaagttcctctttaaagctatttattaaccatacaaaaacatactttcactcactgagaatttaaacttttatttaaatattagtgatttactgcattaagtgttatcatgagatagcatctgctaggccagaaaattcatctagttttgagtttaatcgttgttaatatgcagactgtaaagataatctcactggtaaaccagtgataaaccagcacttgatgatcttttaattgctaagtagcactgaggcagcttacatttggctttggatttagtagatatttatattaacaactggccagtacagcttttcacgtaagtacttcacctcaaatttatcaatcctttaaaatatacatgaatttaccccacacccataagctgcactctcaaagataggggaaaataaaaccaaaagcaacaaagattgaatcaatgtaattttctgctgtttaaacataggtttctacttaccttgattatttaaagaatgcctgaaatcatgccaatgaaaactctggaaagtagagtttaaggttcaaggcaaccttctttttttttttttttctgtgctgccatcatctctcacctgaactattgcagtgatcttctaataggtcttctttttgatgtctgtcacctacattctattgtcaaccaagcaggcagagagcctattcttaacagctttattgaggtataattgatatacaattaatcacatatatttaaagtgagcgatttggtatgttttgacatatatataaactcatgaaactatcatcaccacaatcaagactgtgaacatacccatcacactaaaagtttcctcatggccttttgtaatgctctctccctttcgtcactatcccagacaatcactgactcgctttctgccactatagtttgcattttctagagttttatataaatggaatcaaaacagtatgtactctgttttgtctgacttttttcacttggtgtaattattttgagattcatccatgacatgtataaataattcattcatttttaactagtatttaattatatgactacattcatcatttgcttattcacctgttggtaaaatttacattgtttacaatttggagctactctgaataaggcttctatgaacagttgtgtgcacgtgtatagacgtagagttttcttgtcttagtcaaatacctaggaatggagcagctagatgacgtgaagttagtccatttgttcttttatgagttatgcttttggtgtcttatctaagaaacctttgcctaatccaaagtcacaaagattctctcctgtcttttctaaaagttttatggttttatgctttacatttggatccatgatcctttttaggaaaatttttgtttacagtagaatgtatgaatcaaagtttagattttgtcatatgggtacccaaatactccagcaccatttgtctaaaagagtatcttgtctgcactgaattgcctttttgctttgttgaaaatcagtggcaaatatatgtgtggatctatttctggactctaattttgttacatttatctatttttctatcttgatgacaagactttgattatgtttgattagtttgattatggtaactgtgataaatcttgaaatcaggtagcataagacttcacgctttgttctttgaaaaagttattttgaatatagcaggtacttaacattttcatgtgaattttagaattagtatgcccatttgattgtcattgtattaaatctatataacattttggagataattgactaattttttttaaacttctgttttacattcagggttacatgtgcagctttgttatataggtaaattgcgtgtcatgggagtttgctatacaggttatttcatcaccaaagtaataagcatagtagctgataggtagtttttcaatgttcacactcctcccaccctccaccctcaagtagaccttgttatctgttgttctattctttgtatccatgtatacttcatgtttagctcccactttataagtgagaacaggcagtatttggttttctgttcctgcattagtttgcttaggatgatgacctccagcttcattgatgttgctgcaaaggacatgatctcactcttctttacggctgtgtagtattccatgatgtatatgtaccacattttctttatccagtctaccattggtgggcatgtaggttgattctatgtctttgttattgtgaatagtgctgcgatgaacatatgcatacatgtgtctttatgacagaacgatttatattcctttggatatatacccgataatgggattgctggatcaaatgatagttctgctttaaattctttgagaaatcaccacactgctttccacagtagctgaactaatttaccttcccaccagatgtgtataagcattcccttttctccacaactttgccagcatcttttgttttttaacttttaaataataaccattctgactggtgtgaaataatatctcattgtggttttgatttgtatttctctaaggattagtaatgttgagcattttttcatgtgcttgttggctgtgtgtatgtcttcttttgaagagtgtctgttcatgtcctttgcccagttttgaatgctgttgtttgttttttgcttgttaatttgtttaggttctatatagattctggatattacacctttgttggatgcacagtttgcaaatactttctcccattctgtgtgttgtatgtttactctcttgatagtttggtttttgctttttgttttttatttttatttatttatatatttttgccgtgcagaagctctttagtttaattaggtcccatttgtttacttttgcttttgttgcatttgcttttggtgtccttattatgtaatctttgctagggcctatttccagaatggaatgtcctagattatcttccagagtttttatacttttaggcgttacatttaagtctttaattcagcttgagttaatttttgtacatggtgtaaggaaggggtccggttcaatattctgcatattgaaaccagttatttcagtaccatttattgaatagggagtcttttccccattgcttggttttgtcaactttctcaaagatcggatggttgtaggtgtgtggcattatttctagactctattctgttccattggtctgtgtgtctgtttttgtaccagtgccatgctgttttggttactgtagccttgtagtcaggctttattactggttcaatttcagaactcactatggttctgttctgttattgttctgttcaaaaatatggtttctccctggttcaatcacttataaaggcttggtttggctggatatgagattctttgttagaattttttttttaacaattctgaatataggcccccaatctcttctggcttgtagggtttttgctgaaaggtctactgttagcctcacggggttcctttgtaggtgacctgccccttctctctagctgcctttaacattctttcttttatttcaaccttggagaatctgataactatgtgttttggggatggtcgttttgtacagtattgttgcagaggttctctgcatttcctgagcttgaatgctggcctattagcaaggttagggaaactttcatggatgatgtcctcaaatatgatttttctttctgtctttcggggatgccagtgagtcatagatttggtctctttacataattccatatttcttggaggttttgttcattcttctttattcttttttctttatttttgtctgattgacttaattcagataaccagtcttcaagctctttgctcagcttggtctattctgctgttaatacttgtgattgtattatgaaattcttgaagtgaattttttcagctctatctgatcagtttggttctttcttaacatgtctattttgccttccagctcctgtgtctttttattgtattccttagatcccttggtttgggtttcaactttctcctgaatctccataattttcattcctatttatattctgaattacatgtctgtcatttcagccatttcagcctagttaaaaaccattgctggggaactagcacagttgtttggaggtaagaaaacagtctggctctttcagttgccagagatcttgccctggttctttctcatctgtgtgggttgacgttccttcagtctttgaagttgcgtcctttgaatggcactttttgcttttatcttctgtgatgccagtgggggtttgtttgtggtataaggtgggtttcaactggcctcttttctggaagattttagggggccacggctcaacacagcactcctggactgtgtgttctaactctgagggacttttaccgggcccctgcctttgctctcgagccccttgaagttaagatcttgctgtactggagggacctaagtgttcttggtccactggccacaacacgctgttggagagtgccagccaaagcgctttgtccagtggtagcagtgggatctgtgctcactcgggtgtgccagcagccacagcatgtgtggtagggtgcacatttttcagctgaggaggggcaccagtgggggcagggttgctgtcatctgtgctagcatttgcacctgcagtggtgggagtagggcacttgcagaggcagggtttcctgtgcccatacacagattcacaccggtggtggcagaagcagggttggtagcatccatgcgtgtattcgcactggcaggagtgggggcatggtgggggtggggttgccagtgcccatcaaggcaatcttctatacttgaatttgttaatcatttcacaatacatatatatgtatcttaaaacaaaacatcacattgtatgccttaaacatatacaatttttatttgtaaattatgcctcaatacagctggaaaaaaaacacatgcaaagttacataaatatccccatgattttttcctcaagttatcaccccttttttcttacttgagtctgagagtgtttatgaaaatgctatgaaaatgaagaagtactaaaccgataacatggatggatattattatatgtatgacaaaaatgagaaggaaaggtcctgaaggaggtacacagatacatttttgtaataccctgaacaaaatgcagtatgtcaacagataccaatcataatagatatatgattacacatatgaatgtagattaatgcccaaaacagttgtatgtgaagctaatctgtttacaatatattatatatttcatgagacttctctgataaaaatagacttggcatcacttaaaaaatggttctaacctttttaaaagttctcacttagaaattcacttggcggagcagtacacaagctgtgtgtgtctaattttcctctacaatctctgtaagaagttaatcaaataggcaattaatctgtatgatattattcatgtgaaagcatatgcatattaaaatacacaacagacttcattcttattttccttaaatttttctctaatgccaggggcttgaatgtccagcagagctcacaatatgaaaaggatacatggcagtgcttttgttgcacataccagaaagtacaagcaataacgttctgctgtataaacacctgtaatgaaggcagaaaatgtgtagtaagctaacaaacaagactttgaccccaacaacacttatctctcgccttgaatctgcttttgctcctcatttccattaatagtgccacaatcttctctggaatcctgatttgaaatctcagagtcatcctagactccttctcctccttcatctcgcccttctgatcaatttcagcatcctgttgattctgactacaattcttcccacatttccttgtcatatcctttgctacttcttttttttttttgtaacctctattttaagaactttctgagttgtctccttactcctagctatccccttccaatccatccttgatattgtcctgaaagtgatatttctaaaatgtgaatcagataataacacttcgtttgcagacatttaccactgtcaacattggttttagcagtgggtttcaaagtgtcatccctggaccagcagcatcacctgctttgtagtaactactttgtagtaacgcagatccttaggtcccaatccagaccttctgaatctgaaactctgagaggggagcacaaaactctgtgttttaaaaagtcctccaggtgattctgatgcacacgaaaacttgaaaactacggggctacagaattaagttcaagttttttggcatggtgtcttgccaaacctgtcttttctgcacttattttcacctccttacactcttctgtactcctcaccactccactatttcagaaccttaccatatactgtcctattaactgggataaaccattggcttgcaattttctcttccaaattatcaggttttgaacgaagcacatttttaatttcatctctttcttaaatcctttttgatcttcctagacatatttcctgctccattatttcatctgtgaaatggaaaacagttctgggttgagaggtaaaacaaacttcttgctttgtgtttcctcagtaatgttatctttgctctcagaatttattcgtttttcttgtgctatacatggtttttgacaagtctgttcccacttatagatgatatcttcaagggtgatgcaagtctcagtaatctttgtcatagaagagtgagttgcacatcatatgcggtctataacatgttgtctcacaccaatatatgacttgaactttaatgcatgattattttatatgttcattgctgaaaacaatccattagtccatttgggattgttataaaatttaaagaccttttgtaacttactatcttgaaaagtgtaattctgttcttttgtctgctctaaaacaaaaacaaaataaaagtaaatctgtgccttgaaccctgttactttctctttaaaggatcaatttgctggctgggtgtcctgccatctaacaggccttccctgtgaggctcctctaaattgggaaaaggattaaattttatcagtgtttgtttggtctgttgctcatcatgttgatatttaatccagtgtccaacaagtgtcccaaaggaataaaatgcctgaagctggcaatactttttgacctatctgtctgaacatattcctatcagtttttacccaaatagagggttttccaggagacatacatgagctaaataaacaatataatagtaagcttaattcagtaaactatgtttaatatatcaacaaggatttattgagttctgaagtacactcaattttgtgaaatcaaattattctgagttagaaaattgtatcactttgcaatattataaaggaaaaatgcatactgctattttttaattatcagggttaaaaatatctacaaacaatagttataagcgattgtgttaacaccaaagatatacattttcaatactcatttaagtgaacagttatttagttaatcactaatttattcaacacacatttattgattgcctattgtgccccaaatatatatagatatggaaatagctctaaatttataattagagctaaatgaggtttttttttcttttttaaagatagggtcttgctatgttgcccagacgagactagaactcctgggcttaaagaatcctcccacatcagccttttgagtagctgggactacaggcacatgctgctgggtccagtttgagatttagatatgtagatgatagatacatagatagataaacagatagctaggcagatatagaaatagagataaagatagagaaagatagagatagatatagagatggcgatagagatacggtaaagtcccacttctcagagtacaccacacttcagtgatcaatgaaatacatgtaagcaaataatgatttaatatgatacatgctaatgaaagtatgtattaactaaagaacatagggtaactaaatagtcaaaagaatgaaaaaagtcttcaaagtcaaagatggaccatatgtaccaagattttacctatctgcatcagtttcttatgcgaaggctaataaaagaaaataagaatccagattttcttgtaggatgacgtgcatctgtttgtgtttgctgaaatagcagggctttttctgctcctgttcagtgtgggaatggaaagcagaacatcccctgtgttccatgtactgtgttaggtactttctcatgtcacttctaaacactaagagaagtaaaaaaagaagattcaaaaacaagtcttaagctgaatttacttaatgcaaggcaggaataacatgatcccacacagatgcatgggaccttcagattaacagttaaagaattgttcagagaaaattaacctaaaacattgaggatttgttcacatatagacacatacaaggaagagcaacccttatgaagactttttctcaggccgaagtcaagtgtagagctttaaaaaggcaaacttagaagtttgggtttgtttgtttgtttctccaacaacaagagttgctgctgcaaagtgagagtcgctctccctactttttagttattattccaagatatctatccaagtagacacaggttgagtatcctttttttctgaaatgcttgggaccagaagtgttttggatatcagatctttttcaaattttagaatacttgcatatacagtatataatgagatatcttggaaatgggacccaagtctgaacataaaattgatttatgtttcatatatagcttatacacatagcctgaaggtaattttatattttccttggggatgctaaataaattgtgttctgtgaatctacattttgactgtaacccatcacctgaggtcaggtgtagaattttccatttgtggcatcatgttggctggcactcaaaaagttttgaattttggagcattttgggtttcggattttctgattagggatgctcaactttactttaaagtaacataatttatccttctataaatatagtattttgttttcatattagtatgcaacatgtataaattatatcattagacttttttgaaagaattcaaacttcaagtttgttaccatgaacatatttttagcttttacataggtagtaacagtgacttaattaaaaatactttttctactcttatttgaatatattgataatagccaatatatgtagttttcttcatagtacatcagtagtgaaggaattacttctgaatcttaattccattactgtcttcatatatgctcccagaactttatgagaggtaacaaaaatgaatgaatatggtacttcttactcccactccccaatgtaacttcatggcttccttcataaactcccattggctgtgaaagaacgtgtactgcagagatatgttgaactggagtatttccatagaatcctcccatcagggaaggagagtaccaatagcaaattttctgagagagacttacagaagggtattttattccgaaagggagaaaaacagattaagtactaccagcatccacaattacctgatgataattttaaaaaacaataacaataaaagttatatgaattacatacaattaatgtgtactgaaatcaacagtgtctagaaatatgcttttggaatgattgttcccaagccaacaaagcttgtgtgctgaagtaagaaaaaactgaatggatcaacagcaattctgttcatcaagagttagattttaagttatcacatatccttttaagatttgaaaagtctcactacacaaggttaaaaaatatactttgtggctatatttttaaagtctttattcacaaggggatacatactgacgtatttggggatgaaatatcattatgtctctaatttcttttcagctggtttagaaacaataatacaatatagaaggtgtgagagagaacatgtgtgcagatgaggcaaaccgttaacaaaggaaaaaaatatatctccttcatcacttctttcatttagtaaaatgttttattgtaactattgaagagagacataggtccatcatttgtttaaatgattttatgcaggccgggcttggtggctcactcctgtaatcccagcactttgggagaccaaggtgggcagatccgagatcaggagtttgatgccagtctgaccaacatggtgaaaccacgtctctactaaaaatacaaaaattagctgggcatggtggcgtgcgcctgtagtcccagctagtcaggaggctgaggcaggagaatcgcttgaacctgggaggcggaggttgcagtgagccaagatcgtgcctctgcactccagcctgggcgacagagcaagactccatctcaaaaaaaaaaaaaagattttattcaaataatttgaatatgccttgaactgttctttatagtgtttaccatcttttcccaggaattattgaaccattttaagtttattttttaacaggatgcatttagtttaatggtagtaaaacctcctaagccatagatcctccctctgtttccatattgaaatgaacaccaagtgtctctaatgtcgtccaaagtgccatttcttcattttgcctctaacttttctttggcacatgacgttgaactgtatgaaacttttttcctgactgatatttaggtatggaataagagtaattttcaggaatatttgtgattttcttccaacattttctcagaaagcatattctgaaagtgtgtagtaatatctatatgcattcccaacacaactctctctctattctcttgatctaatttgttactaactttttaaaactttctagactaaatctttttgcttaccttcaagcattttgttttatactacaaatcttctgagactcgaataattttatcttactgtttatatactgctaacttgaaggtatttcagcctttttcactagcagcgataccctccatgacagatagtcagttatattaacttgattctattgtaatttacatagtggtaaaacaaaataattttacacttataatcaaaattataactgtttaaaaaattaccacctaggattcattttatgtaatgggaaaatatacaaaactgttttgataaatattatatgcaattatataacttggacatctctgtgtagttttttcctcctgtttaacgtggtatgccagctctacagtagtcatgacaggaattatgacaatgactcagacattgatggtgcccaccaagcttccagcatatttactctagatagtacctcaatacagcccttttgtaaaaattttaaacccaaatttggtaattgaaatgaactaaatcaaagaatgctgtgaaattgacacctttattaaaaaacaatatgtgacagtagggagaattaattctaggttcagataaagctgggtgagaaccccagcactcacccttattagctggcatggagtttcttcaactgtataatttggtaattcagttgtttattttgcttatttattcatgcattcattcatttattcatttagtaaatgtatgctgagctggttagcaggcacaattctaggcactgtggctaaaaagggaagtgagaaggacaaagtccctgctctcaaggggtttacattcaaccggggagacagaaagcaaagtggatgcataatataacatcaaatagcaataggtcttgtgaaaaaaataccaaggcatactctggatcaagtgaccaggatgggaaggcaaaaggcctctctgaggaggtgatatttggcaagaaagaaagagaaagccatgcagatggttggcgaaaaatgttccaggcagagggaagagcaagttcaaatgcctcagtttatatttctgtgaatagtaaatgaaagtttatagactcctggcacatcgttaagtgcttattagatgttagatataattttaagataataaatgtggataattaattccacgttattatgtgtcttctttgctgtaatgtacatcctccttttcatctagaccatttttcttctcttgaatattatattatttatcctgttctcagagctgttagattgccctcttattaatttgtagtgactttaaccctgcttgcaatattcaaatgttattactgtcagaggtcctgttttctcagtctttgcccttttgctcaacatttgtatactctgagtaatgccaaattgattttcttgctaagtgttgggcaactgccctctctaaacagtaaaattcacaacttctctgtgatgatgataatgttgatgtacctgccctatggggacctgttgttttgtatgcatgtgcagggagaggggtgatcaaaaaatggtgtcaagatgtcatttggaagatggtacctgcagaaaacacagaaaacccaatcataccccacccccatcctccgcatttcccaccatggtttcttgtttacacttctccgattctcccagaagtcagagcaaagtgactgtttacctctgtctctggctgggaaaaaaccactcccagagctcaactcacttttattgatttctatattgtttggctgtaaaacatttattctcagttgtatcagtttgggtccagttagagaaaaaaacacagtcatttgaacagtgaaagtttttacaaataattattaaatgtaacaggggattatagtaatgaagggattggctagcataaaagaaagatgtattagtttgctcaggctgccgtaacaaaatactatagactgagtggcttaaacaaaagatatttctttctcacagttctagtgactgggaagtccaagatcaaggtaccagccaatttggtttctggcttttggatggctaccttcttgctctgtgctcacatgatctcttttttgtaatcacgatggagagaaagagcaagctctctggtgtctcttcttataagggcactaatcccatcaagagcctcgttctcatgaccctcctcatctaaccctaattacctcccaaagaaaggcctcatctccacgtactgtcatattgagggttaaggcgtcaacatatggattttcaggggagggcacaaacattcagtctatagcaaaagagaaccataaataatagaggaatggctaccattagccctagggctgagatagcacacctgagaaaaagtccctatgttttcatccccaaagcagagatccgcactttattgggaaggtacaaccatagcttaccgaatggcagaaatcgctaagttgctataccagcagaacttgtcagaaatctgtcttcttcaagttaacagagaccctccctctaaggtacctgggaaacatcgccaagctgctggttgccaagcactgtaggagccaggtgctgaagaaggcttgcacgctgtaagagcctgccaagtgagcacattgaaaataggaagcaaatccctttcttcctgaaatgtctcaccagtgccctctccccacaaagcttcagtgccagctagttaagaaaaacatatctcaaaggcccagatctatttttaccgagcaggcagaaaggtacatttagaactaagaggcaataaatcaataaccagcacactgatataaacaaataataaataacagcagaagcagactcagtgaagaatatattgtttgttagcagagtccactactttgcagggccattctcagtttgattcattgctatgtgctctgtgcctagaataaaatctgacccaatatggatgctcagtaaatatttgttggatgaatgaataatctaattgcttattttttttgcctctaatgtttttcctctctttctctgtctctttttttacgatagccgatggatgcactgactggtctatcgatatcaagaaatatcaagttttggtgggagagcctgttcgaatcaaatgtgcactcttttatggttatatcagaacaaattactcccttgcccaaagtgctggactcagtttgatgtggtacaaaagttctggtcctggagactttgaagagccaatagcctttgacggaagtagaatgagcaaagaagaagactccatttggttccggccaacattgctacaggacagtggtctctacgcctgtgtcatcaggtatccctttaattctattactgctgaatcaaagaaagcacaggctgctttctcgtacttaaatgttgctgctatctcttttgcctaaagccgttgtctcaatatttgcatgtgttgctgctttctaaaatttagaatcaaaatcataaaaagatgggattggaatttatattagacattatttctagcttatggagaaaagcgataccatctgggtagctacttatgttaccaagaattactaaaaactatgaaataaaatttatacaggaagtaaaatggtgcaaataaaatgtaagcaaagacttgcagaaaggatgcatagtttcttgctaaatgagttgtaacattttgctattgcccttcgcagacagatagagcatggatacttctggttcacacacatttgcaaagatgatttaggtaatgtgtgtatgtgcacagggagaggaagagagaattaccatgttagagaatatgaaggttgtgttccagattgctttgctaaccaaaacttctgggtcaatacaaaaatcttcccaagtctttcagggccaataccaaagttaataacaaattcagttcctgtatccccaaggatacccaccatacatctacacatctttgtcagcttctggaagaggtatatgcagtttgtttaaagataatgcattgaagcaatgcccatgtaacacattcgcagttaaaaacctcagtttaagcatttagcccctcatagattgtgaatcacatccttcatgaatgatcatgtatgtcattggactattagaacattagcgaagctgggtatagtcatatagagggtgtgtttaaatctatttatttggctttctgtatttgggcttattcagagaaataaagaagaatctaaagtaatggattcccataactcagagaaagtctcagaatcacctagtgtctttttcaaataaaaatttaccgctcctgaaatcctgatcagcagctaacactcctctgtcataaatatcatgcctccctctcaccgtcatctctaataattacctgtaagctgagccatggctacgggtgtgctaggacattgaaataggtcaagttgcataaaagttaaacagaaaggtatctttctaacactagcaacatatattatgttagagttaatgttggaaaatataaatgaatataagtaaagagttgtgcttgggaaaaatgcctaagggattttcaaagaacaaatgcatctggccgggcatggtggctcacgcctgtaatcccagaactttgggaggccgaggcaggcagatcactttaggcgaggagttcgagaccggcctggccaacatggcaaaaccccatctctactaaaaatacaaaaaaattagccgaggatggtggcacgtgcctgtgatcccagctacttgggaggctgaggcaaaagaatcgcttgaacccaggaggcggaggttgcagtgagccaagatcacaccactgtactccagcctgggcaacagagcgagactctgtctcaaaaataaataaataagcaaacaaatgcatcattcctttggcaactcttcttctttctcttagggtttactaatccttttatgattaaacataactcttaataaaagtagaggttttgtaggggtacagatcaataactgtcacactagtacagttaaagaatactgtttggactagctgttcccatttgaccaatagtaattagattttaatttcatatctgctgtgtttctttttaaaaatcattatttctgattgttcatgcatgtcgtaaggtgattcttcaagataggcaaatgtgtgtcctcatttatctgacattagaattgagttggatgtccatagtataatactacatttcgtcacttattattgatggaaaaataatgatgtgttcacattagtaatctgaattttgaaaacactgaggttgcaattctctgatgtatttaaatatacactgtgatccaatactctgagaaactgcattaaaatgcctctggaagggctgggcaccgtggctcatgcctgtaatcccagcactttgggaggccgaggtgggcagatcacctgaggttgggagttcgagaccagcctgaccaacatggagacaccccatctctcctaaaaatacaaaattagccgggcatgatggtgcatgcctgtaatcccagctactcgggaggctgaggcaggagaatcacttgaacccatgaggcagaggttgcagtgagccgagatcgcgccattgcactggcaacaagagccaaactccgtctcaaaaaaaaaaaaaaaaaaaaaaaaaaaaaaaagcctctgaattaccagttgcaataatgaatgaaagattgaaaagtttccaaaatgatgacacttgccatatgttcatatgtctacattttaataaaaggtgaaactaaaagacaaatactttaaagtttatgtgtgtcaagtggcaatctagagaaagggataaactgcaggaagagatacttttgtcactgaaattcaaatatgccaatcaatttgaagggagtgttgttacagctttcttttccaatttggaaaggggtactcaaaagtctttacaaacagcatttgaaatagcacggcttggtgttgacgtgagaggagctcaagggctgtcagttgagtcactgacattttggcatattgttagctatcaggccactaaactgtcaccattagtttttaaataatccacttgcaaagaattttagaggcttgaaaatgttagcatccattctaaggttctagtctttctgataaatattctgagtattaacttgtcaatgaaattgtttatcaagcttttcatatacaactaatttccatttacacttaaatatatgcaattaaatggcatacataatggaaacacctaagactcctatcattataatgaacaagaactttcttatttccttctttaatatctattttggacagaataataccacacaattctttgctccatacttactggctctttactcagtttactcattcttaaatttatattttattttttacatgaaaaagtgaatgaaggaaagctatgtaacaatttcttttgtcttattttatggccatatataaaaacaagtttactcttaaaaaaataaaaatttggtggccaggtgtggtggctcacacctgtaatcccagcactttgggaggcagaggcaggtggattgcttgaggccaggagtccaagaccagcctgcgtaacacagtgagaccccgtgtctacaaaaatgaaactgtttaaaaattagcctggtgtggtggtgtgcacctatagtcctagctactcaggaggataaggtgggaggatttcttgaggccaggagtttgaggctgcagtgagctatgatcacaccactgcacttctgcctgggcaacagagcaagaccttgtctcttaaaaatgaaatgaaataaaataaaataatagttccgtattcttgacctccaactttttaattccccttttcatagttatgccctattagcagtttcatatgcaaagctagctggtatatgtggaagcattccagtgccccccaaatggtagcatgctaagttatttggcaccctatttttaattaaaattttatttttgagataattgcaggttcatattcagttgcaagacataacgtagagagatgccatacccagatttgctcggtggtagcattttgtaaaactgtggtacaatatcataatcgggatattgacattgatacagtcaagatacaaaacaatgccatcacgtctcaagggcccctcctattgttcttttatagctacatccatctctacccaaccccaatcccaaacccctgtcaaccactaatctattctttatatttatagttttgttaatttattaatgcaatattaatgaaatcatacagtatagaaccttatggaattggatttttcactcagcataattcctttgaaatccatccaagttgttgtacatatccatagttcattcctttttattgctgtgtagtattccatggtatggactaccaccatatttattcacttgttgaagggtgtctctattatttccagtttggggatattaaaaaggaaacttctatgaacattcatattcaatttttggtgaacataagtttatttttctggaataaatgcgcaagagtgaacatggattgaatggtagttgtgtgcttagttttatgagaaagaaccaaactatttttcaaagtagctatagcatctgatgttcccaccagcaatgtatgatttctccacatccttgcagcatttgcgattgtcactacttttaattgtagccattctggtaggcatattgtgataactcattatgattttcatttgcattttcctaatggctaatgattaaaattttcatgtgttgatttgccatctctcttcttgtcagtaaaatgtccatatttttgtacattttataattgaattatttatgtcctcctcattgaattttgagaattctttgtatgttctaaatattaattctttttggagatgtagtttgccaatattttctgactgcctgtaggttatctttttgtccttctaacagggtcttttgcaaagcagaagtttttaattatgataagtttcaatttgtgaatttttccagttatggaccatgcttttggtgtgaagtctaaaaattctgccaagtgctaagtcctgaagatttttccttgttttattttttatttttaagatttaaaaaattgttaaaaattcagttgctttacattttacatttaagtctgtaattaattttgaattaatctattttttgaagaaatgcttattttattttttattttttatttttatgtatttatttatttattttaagtcctggggcacatgtgcaggatgtgcagatttgttacataggtaaacgtgtgccatggtggtttgctgcacctatcaacccatcacctaggtattaagtccagcatgcatcagctatttttcctgatgctctccctcccccagcccacctgcccagccccagcaggccccagtgtgtgttgttcccctccctatgttcatgtgttctcatcgttcagttcctacttataagcgagaatatgtggagtttggtttcctgttcctgcattagtttactgaggatactggcttccagctccatccatgtccctgcaaaggacctaagctcattcttctttatggcagcatagtattccatggtgtatatgtaccacattttctttatcccgtctatcattgatgggcatttgggttgattgcatgtttttgctattgtgagtagtgctgcaatgaacatattcatgcatttatctttataatagaatgatttatattcatttgggaatatgcccagtaatgggattgctgcatcaaatggtatttctgtttctatatctttgaggaatcgccacactgtcttccacaatggttgaactaatttacgttcctacccacagtgtaaaagcattccttttttttctgtaacctcgccagcatctgttgtttcttgactttttaataatcgccattctgactggcgtgagatggtacctcattgtggttttgatttgcatttctctaatgataagtaatgttgaacgttttttcatatgtttgttggccgcttaaatgtcttcttttgagaagtatctgttcatatcctttgcccactttttaatggagttgtttgtttttttctcataagtttttttaagttccttgtagactctggatattagacctttgtcaagtggacagattgcaaaaattttctcctattccttaggttgtctgttcactctgatgatagtttcttttgctgtgcaaaactctttagtttaattagatcccatttgtcaatttttgcttttgtcgcaattacttttggcattttcatcatgaaatcttaattttgaattaatatttatttcaggactgatgtttgtttaggttaagtcttagttttatggggttggatgtccagttgtcccagcaccatttgttgaaaaggctatgcttcctccattgaattgcttttgcatctttattcagaatccattgagcatatttttgtaggttaatttctgtgttttttattccatacctttgtctatccctctgccaataccaaactgtattgattagtatagctatatggtggtgaaaatatcaactagagtgattcctcctactttatatgtctttttaaagattgtgtttagctattatagggcctattatttttcatgtaaattatagcataagtttgtctatgtctacaaaaatccttactagaattttgatagcagtttcattaagcctatggatcaatttgaggagaattgatatctttaccatattgagtctcactatctgtgagtacagtatgtgcctccacgtatttaggacttccttctttggtttctttcatcagcatacaaatcctataaacattttgttaaaattttaactaagtatttcattttctttggaatgtttgtaaatgatatcttctgtttaattttggtttcgacatgtacattgttactatgtgaaaatgtgattgatttttgtgttaacattttaaaaacatatttttttcaaatgacatatctataatgtgttatatctagcatgtagttcatttgctcaagtcttgatttttccttttgggactatgtaactcttttttctcattgaaagaacacagtaagtaagcatctatcaaaaagtacttaaagaacatccatttattcactcatgctatgctaatggtaggatttaaaagatttaaagagaagcttttactttcaagtagtttacctaagagaaaataagtgtgtaataaattgctgcagatactatgaaaatagtttagaattcagtggaattctgccgagatagagtagccccgttcctcttaagtcttccttcttacaactaaaaagtctgcatgtaacggcaaacaagcataagaagtctctgaaagatggaagaaatacctctgagaaagacctcagaacttgaagaatgacatggcaacatgtcatgttctcactatcctgtctgctcctcacagattaaggcatgaattcttatcattttttcactttgttccttcatttgaaattcaatattttcattgcctacctgaacaatacatatttatttctggatgaaaatccagtttatgtttactttctttctatctttcctataattacttcaaaaacaattgtttcttctacctattctggggagaaaacacactaaaacttagtgccttaaaacaataaccattttatttgcacgtgactctgcaatgtgggctggactcagctaggtggttcttccagtgatcttgcctgtggtcacctgtggctggagtccactgcaatacagggttggctgagcctgtttctctattatttctgagggcctctccatgtgctttttccatttatctatcaggtgagccagactttttatgtggcaactcagaaagtataactgcttatcaagcatctccttgagtcatgcttactgatgtctcatgagccgagttttgagataataaaggagaagactttacaagggctttgaggtgtggttcattggtaggaccaccaaagtaacagtctaagagtcaacctttgacccttaatactgtcattcatgtccttataaatgcaaagtatagtgaccccattcctaaaacctccaaagtcttatctttctgtggcatcaggattaggttagaagttgatgatcttattatccaagtcagctctgagtgtgaatgaggttcttcctgcttagttccctgaatacaactgctcaggagtggctgctcttcatccaaaactctgtgaactaaaaaggtatataatttggccctcacatagccaacataaatagtgagatagggataacatagctaaaccaaatatccccatttgaaatgggggctgcggataggagatacagagcagtcactggcccatggcaattctaaaattcagctggatacatggcaccagtttattttattcttttcccaaggagagtaaatatactttattttttattttttttattatactttaagttctgggatacacttgtagaacgtgcaggtttgttacataggtatacatgtgccatggtggtttgctgcacccaccaacctgtcatctacattaggtatttctcctaatgctatcactcccctagccccacaccccccgacagaccccggtatgtgatgttcccctccatgtgtccaggtgttcttattgttcaactcccacttcttaattagggctcagttctggttactggaagtggttctctgatattcttgggtccatgctcttcctttctatataaaattaatggcccaggcctctttgcaatttgaactttatcccttttggtataaggtagtatcgttccttaaaatgttgtgaagcttccatgtattaagttgtaatccacttcatgaagcagaagccacacccataaatatcttcaggaaagatgcccctctactttgctgttcaagtcaggatgctggaggacaatgtaccaaagattcttaaatgagttttgcctagctagtcttagggcatgcctcatagaccctcctagctaagaatcttagagtctgccccatagactttcttagctactttctctggatgatggagtatgcattgtataccaaacatattaccacagacatttttccccctcagaatcaatatgaggtgtttgtcaatgagaaagcactcaatacatatttattgaacaaaataatgagtgattgaggttagtgttccttagaataccttgtggaaaacactgctatagacaaaattaaacaattttctgattcctatcattttccataagaaaataaaataattctttttcttatgacatctcttgtctgaaaccaacacaaattatgaatggcttgtcctaaatcatgatttttggtatttcagatgacaattttctgtcttttgacagaatatacctttactgtcacctggtggaaataaaaactaataaagtgttagatctgatagacccaaacaagtaactgctataactgtagtataaacaatttaagtaatttttaaaaatctgtatgatacagtatacttttaatatttatgaatttttatgtaagttatttaaaaaatcaagtcattcttgaatcaaaggatatataatgtcagcattattttagaaagccttaaacatttatgccataaggagtcttcataatttgttcagggcaatcaaagtccgtataaatgttttatatcctacccagtaattttaatgattgtgtgcatatgtgttccaaggatctagtgtagtttcacaatcttggtttcctaatttttaaactatctctcttaattgaaaccatagtatacccttgagaatatcagctataatttataggttataaaaatgcaattaaacctacataagccagtccctttaaaaaaaaaaagtcatatacaagtgaaagtctttaaaataagatttcaagtttggatgtagagtctcttatagataatatatttattttgtaaaactgcacatcaggcactttctgtagttttttggtagagacatctttcttgccatagtaggtttcaatgagatttttcagctggataactctgatgattcttggagatggtgttgaagtttaagccatatttccatgtctgagacacgaagacattttctaatggatcaaactacttttaacagagcaataattagccaaattgctatatttctgggttgtgctcttttcaaaaacaacaaattcaattgatggaagtaaaagccaagagctgtgtgaaatgtctatttgatttactgattttttttaaccatctaggaaatacatgtcttcaacaaaacagcctattttttttttttttttactaagaagatgaaataaattctgctggagtgatcatggggtagtttcttagatcactggattaagaaaagctttgtctaatcttaccaagtcctataggagagacagctttgagaactctttgaaatcaattgtgtcatgttcaaggcagagacttataaattttcttcaaaaagtatcaaattaatatggagtagatagagtactggaaaagatacatttgtaaaataattaggtgcataaagtccaatttgagattttatgtagtcttttttgttttccattttaggtcaaatgaatcaccataggcccttttcaaccatggatataacatgtgtatttatcgtatttcacaaacattactgaaaatctaggacatgacataattggtaattataatgagggaattttaaaaattacaaacaacatatgccaggcaaacaaatcacttacaacccaacaggactttattggtggctatacagggttatactgtgattattactatttgttctttatttgtaaaaaactattctccaaaaaaaataaaatgttaactgctaatattgatgcactaagtgaagagaaattgattaggcttaataaagtagtagctgctgatcagcaaaatttgggataagtgataaggtaatcacttatttgagatcagtgaaaaagaataggaagttaagattattccaggctctttctaaatctaattttgtgtgtggtcctaaagtaaaaaaaaaaaaataaatgaataaaaatctcatggaatgtagagaagacaaaaaggggctgattaaagagcgtatgaaggacttgtgatttgagcagtagtttcaagactaaactcatggctagggaaagtgtaactgggaaagatttctgttaaaaggtttcaggaagactactacaagaaaaattaaataatgaatgaaaacaggggttggcaaactttttctataaagagtaaaattgtgcactttgggaggctgaggtgggcagatcacgaggtcgggagatcgagaccatcctggctaacacggtgaaaccccgtttctactagaaatacaaaaaatgagccgggcgtggtggtgggtgcctgtagtcccagctactcgggaggctgaggcagaagaatggcgtgaacccgggaggcagagcttgcactaagccactgcactccagcctgggtgacagagcgagactccatctcagaaaaaaaaaaaaaaagtaaaattgtaaaaaattttagatttttcaagccatatagtctctattacaactactcaactatgttgtaatagctagacaatatccatacacaagatataaatgagtggacatggctgtgtttcaataaaactttacttacacagacaggtggtgggacggatttgggctgtgggtcacagtttgctgacccctgatctagaaaatgccttgcagctgtcaaatagcaaagccaacagtagcaactgttgttattaacaaagaaaaagctacaatatattcctgataaagcaagtagatcagtgttgttagaaaatgggctttctgtaggtgatagttagaaggatgactgtaaataatggtaaaaaaatgctaagacttcaatgccaagaaatatcaagcagggaatggaaaacagaaagcagttttcctggaagtaccttacaggaattctatgaaaccagagaaattagaaaatggaaaacagacaaggagtgtttacaataaatgaggcataaggcaatggggggcctatgtttagagtattaatggtagaagtgccaaagaaaataaaacagattcaaggtcatttttggaagaaaaaaatccatgagagatgatacttgattggatatattctgagcttcattggatgttgctatgggaaataagtaaaagagacagcaagaggcctatcttaatgcttttcaatacaaacctaaacatttttaccaaaacaactcaagctctgagaaataaaatcgcctacactttaagctattagacagggaaacatgtaaataaagttcccccatcgctggtttgccatagagcatttgaataaataaaggaaggagtttgggggtactttctaggttctctgatggtctgcttattagtctttcccttagatcatcttaaaggcaaaggtgtaactttgcatctttgcatctttgcatctcttattacacatatatgatcactgagatctgaacagagtaaaatcttttgattagttgtcacagtttgggggtggctttgtgtataacaagaatcttagaaataacggtggcttaaacaggagagaactttgtcagggaaaagtccaatatatccaaatttcagagcggatgtattggctgcctaattgtctaggcctcaggattctgccctctatagggtatggtcttcatccttattttcccaagatgaaactctgtccatcatatctacgctattacaagctcgaaggtgtagactgaaaggaacaaaggacatgatccttcccacctttaagaacaagtcccagaggttacttatatcacttttacttacattcataggccagaacttgttcacataactacaccaagctgtagtgatggcttgggtatgtagtttttgttagtaaaacccatgtgcctgataaaaatactactaatttaaggatttcaaattgatttccctaagagaaaagcctaagatagggattcctgtgcaagtgagctatgaagagagtgctctcagaaaaaaacctgcagggaagaagtcaggcagagatgtgttttcaagtctagcttcagcctgatcccacagggagctgtggtgcataaattgcatcacagagtttaatctcacattgaagcaagcctggacatcgcaagtatctctatctgagtggttcttgtcataccaaggtgattatcaagaaaagggtacagctatgggccttgaccagctagtacccacagcagctagagaatgagtacaacagctggtgaagaaattctgggtgggatgtcaaaagcatctgctacactgaagaaggaggacagattttgagggaaaattagtagccatttttgtaagagccaaaagtatcccttcacacatactgagatgactcaatatcctatttctgttttgtacatggttagtactctatcagtatttgtagaatgagtaatgcatattcttggacaaccttctttttttttttttaatttccacagccatcctttaccatttttgaaagtattaagaaatgttaatactttcagtaccaccatacctacccccagtacatacacaagcatcctgccctcaatagctatttcctctactcagattctaagtcacactcacaaccaattgtagaattacctcactggcattctgaagaattagctggcaaatttcctgcattttcaaatattttaagttccggtttccagaaaaattctccttgccctggaaataatagccagacaactatgattagaatatatataacctgcttatattcaccttctttaaatctttggtgaagaataggtatggcttttctcatcggtttgctctggcctagatttatgttggttttacagtgacatttctgactttcaggcaagtatccattgagtaactgttttattatacaaaatctgaggttataaaataaagacttaaatgagcatttcactgatttcattatatctcacaattatagatctggatctatcaattttttctcatgaaggtcccaaaagactgttctataagagccgtgattatggagtgaatgagtcaaatttgaagtctggtccaatggtttcaggaaaatgttttatattgttctaaagccaaaaaataaagaaagaataaagcatcatttcaaagcactatcacaccaggttggattagttaggcttcatattacagaaaagcagcttaagtaagatagtttagtttctcacgtaaagtagttataaggtaggcattcctggacttttatgataatttcaacgttttgcatgacttaggctctaaagctttatgctttgccattctcagcatgtggcttccattcccaatgtcactacgtgctcctaatacaactgaagaactgaatttttaatgttatttaattttaaatagccacatgtggatcttagtctttgttttcaaatagtcattacaagctgtttgtggctactgttttagaatagaaactcttctggatagctcttatttagcctggaatcatgtaatgtaaacatggaaaagattttagatttcactgtaggggttgcttagttttacagataaacaatggaggaagtccaaagaagtattggctttctagaaattcaaaactaatgtttagaaatactgaaaatcgagctggatcttttgatttcttaatcagtgcactcataaaaaataatttattaaaaatattttgtaattgaatttgttgattattcaggtagatcttcctttatttacttaaaaaagtaagattttaatacaattatttttttcaatccattcatttccaatggctaatttatttgaagaatgattgcagcaatctgacaacaaagttttaccccatctactctagatattgaggcttaggctgtgtttctattcttgactctataagccaatccattaaatgataagctaacaattaatttacattaaaacaagactactatttctgttactgtagaagttttagaattagttgcatgtaagttaatgtgattaaattggctaggaatatttgatactgtatctatttaatttattcttttagattattaagtatctattctatgcaagccattaggccagctgttgggagcacagcagtgaattaaaccacagtagaattaagctagaatagaacatgtctcttctggaagtttattctagaaaagagcctttgaaacagtaattacttggatcctaacttttatgaagagaaagaacaaggtgccttaagatcaggcaacaggctggcttagcccacttggtaaatagtctctccctcaaaggctcaacctcttcaaactgaaatctgactacttctgaggttgcacaaaagttccacagactgttccgaaaaaaataatttgaaggaaattcatctccagaacctcaactttcacatgtactcttgtctaaaattgcctgaaatctcagaatagcatttcctccaccttacaaaagaaaggcacacctttcttccttcccaaattgtagcatgatgcattgccccagaacttagggtgccaaacaaagggatagtctaaaatattactttgaaaactcaaggccccttaaactcagagatcttctcctgcctgtgtttcaggaatttttgataacttcagtgcttaatcaaagttggtatattcctaattcagaacagccaaagccttatatagtagtgatactgaattgtgtcagtgtaattggaatgttttataggactatcattttttcaagatgcatttgataaaactcaggaacacactttacttgtgatggttaatactgagtgtcaacttgattggattgaaggatgcaaagtattgatcctgggtgtatctgtgagggtgttgccaaaggagattaacatttgagtcagtgagctaggaaaggcagacccacccttaatctgggtgggcaccatctattcagctgccagcacagctagaatataaagcaggcagaaaaaaaaaaacacgtgaaaggactagactggcctagcctcccagcctacatctttctcccatgctggacccttcctgccctcaaatattggactccaagctcttcagttttgggactcgggctggctctccttgctcctcagcttgcagacagcctattaagggaccttgtgatcatgtgaattaatacttaataaattcccatatatatgtcctattagttctgtccctctagagaaccctgaccaatacatttgttttctttcatatttgatgtgcattgtccaaaaataacacatggaaagcctatttcattaaatcatgtactatgtattccacttagttaattctcatcatattccatttatacaatatatagtattttctctctcctattaacaaataactaaaattatttaaacatacaaaaatagatgtcacctttaaataataggtttttataagtcatttaaggtaaatgtgacacaaaaaagcttggaaaccccttttcagggtttctcaaattataatcgtatgtctaattagattaaaaaaggtcaccaaggtgctagtgaataaaacaaacaaacagattcctagatcctaccacttactgttgaatcagaatttctggggaaacaaggatcagaaatctgatggatcagcatgcatacagatgattcttatccacattaagtttgtgaatttatattcaagtgataacggttactatggtttggatgtttgtttccccaaacctcatgttgaaatttgatcccagagttggaggtcaggtgttactaatgggagtttgagtaatgcgggtgtgtccttcatgaaaagattaatagcctacttcagcagtgaatgagttcttgcttagtttccaggagagctggtgctttaaaagagcctggcacatccaccttttttctcttatttctgctctcatcatgtgatctctgctctcttttgccttccactataagtggaagcagcctgagttcctcaacaaaagcagatactggtgccatgcttttcgtacagccttcaaaactgtaaactaaataagcatcgcttctttacaaactagctaacctcaagtagttctttatagcgacacaaaaaatggactaagacaatgatccttttaagagagttctatcccatactaattcaaagtcaacatggtgtttcatataatcttgttgtaatagtctcttggtggtggacatccggcacctaacacagtgcccagcacatgttggagtgtcaagaattaatgattgaaagtgaatggaaaaaaggtatatatctcctcccaaaacatcaggagattgaatataaaggacacatcttccttctataatgtgacagatgcactctatagttactgtttgagagtttttttagtgcaaactatttacctcttaggctaaatttaatttacaaatggaatcattagtagtgaagatatagcagggtgccttccagattcctctgctgtgatcttcaaatgaataagcactgcagattagtcaaccttctgaaaagttcttaattaaggaaaccaatactgtgcagaataacagcctgtgtgttaaccttgttgacacagtgtagaaatctcatgtagatagctagtacaaaagaataaaaatgttgttctagtttctaaagtggcgtttccaaggaattatacttctaatgaaaattgctgctgtggatgtctgttcaaaggctttggcttacaaagtaaagatttgaaaatatcaaacttgcttaatctctgaatgttgttttcattcattaggtgaatatgacagctctctctttaccctaatcgccccccctggaggaaataacatttttgtttgtctaaacagtacttaatgactactctaaaattagagtttaagatctttaactctagagtgcaaagctctacgtccttgactctgacgtttatcatgaatattaatttctgatcttaaagtcaagccatgaaatttttatatattatcatacatttcccttgacagtttttgtaattgccgtaatttcctcatcagcaagagttgtttgtggctctcctggtctgaggaggctataaatttggcagctttgaattccctcttttgtttgaatgtggaaccatcgacttgtttactctgaacattaactagatctcagatcttaaaagaactatagtttttattggtgcctttacatgacaaaagactcaatatatttgttgccattacatgttttcattgttacctttggattgactttcttgttaggggagatttatgtccatcttcagatacttttcctgctactcacataaaaatgttattttctgccacatagctaccattttctttaaaattgatttattagtagtgtttgattatcgaataccagactgtatatattcacattgtgtataagtatccaacatgaaaattatttagacaatattcatggacatgtatacataaacacacatactttttaatatatgtaattcaactgaaatgttatcttccgtttgtactttcaacaaagatttatcgaacatctactacacatcaggcctggatttttttctgcacacaggaataaaaatagacaagacacaaattggcctgaagatgccacagtcaaccaggcaaacagacagactcataaaaaattatctgtatcactgtacggcaaatgctgttaaaaatatggtgacaaagagctgttgcaaccagagagactcagggatggatacacagaagacaggtctctgaggctacacgagatagatctttcttcccagagaaattgaaagggcatgttattttacacagtaggagtggccagacatggtgatttagtaaaagagcttcagaagggaaaagcaacagatacacgtggctggagtgaaaagtgcaaagtggtgcgtgggaaagaaacagaagctagaaagttaacttttggatagatttgggaagtacccaagaatagaatctcaggttcaggtgtttgactttttttttcttaggacctgaagacagtgatccaggatggcctaaatgtcgcagagaaaattattctatatattcagtcattcagacaattatctaatgaattctttatgagagttgtttttggccaggtgatgaacaagagtcaaagtctctgttcttaggaatcttatagtctttcaagagagaaagttaagtcactcaacgtttaatgtctgatatgacagaggttacaacagagaaaagaacagagtgtaatgggcacatagatgtgatgtgtaattcagaataaaaatcaggtaaggcttcttggagatttaaatattgagttctgatacagaagtaaaacttacctggatgaaataaggagatgaaaaaggagatttggaggagatcctaggtggtaagatagtatatggctacagtcattatatattcttctaattgtccacgactatagtaaagttcccatgacttgggtcatttttagagaagttggaaaggatcagttcatggtcttggggtacaaaacgggagagctgaaactttacacaaaaaggttcagggagacaatgaaaaactttaatcagatggatgacaaaaattggatttgagttttggggcggtcatttagcagcagtgtgtggggatgttgaatggagggcttggagagtagcatctaactacagggttgtcttagattggactcctctagaaacaaaccgcaaggaaacatcactagaggaatggggaagtaagatgtagcagagaagggaagccagtaaagtatgcattataaagctgttttatcccttttggcaactggaaattaggtttactggaaaactctgtgagacaatgtagacatactctcagagttatacccgaagggagaggaaactgggttgtttttctaccagctccctacctgttcctgattgagggtttcttctactaggaatcttagttctctagcatttctggcttgcccttcatgaagaccaaggttggtctcagggccagacaaaagccatcagactgagggtgtcacgtatttgtaagaagcagccttcatacggtagacgtttgggtggggcactgacataatcagctaaagaactaacaagatgggaggtgttgagggtctggacttaggccatgatagtggtaatccggggaagtttgggagtgctactaggccattgttttaataagatttggccatgcattaaatgttaggggtaaattatgaatgatgactttccagagagtagacagatgttgatgatgtaaaatgtgtgtgtttaacaacgtaaaggttttagtataaatatgaaacctatattaaagtctctttataattgtatctattttagaaaagtattataatacagcagtataaaaactctctaaccagaagacctagagtacttcctagatccagatttctaacagcatgaatcttggatgatactcttaatctctcagagcgtctcatgaaaaaaatggaagtaaacatgaaagaagctttgcatatgttacgtaaaccaaagtgtcagtaagccttgtacaaaattttaacttttaaatagaaattacataaagtatttgggccctaggacctaccaagtcgattattattaatgaatgagtaaatctagtcaatcaaagacctttcatttttcccacacctatatttgaacagatgccagttagtgagcatctttgtttgttaatatctgtacttcatacttaatggactaattttttctctatcaaaaaagctgcctttgttaaaacatttcaatcaactaaattacttaactctaatgcctattttgagggaaaaatatacttagagggagaattaaatgtgtaattttatttctgcctcattaaacctcctctgtgtctaggccaacaagagtttcctcctcctccaccggcacacacttattggacgcttcattgtgagaaaatcctcaggtcgctggaacttggtagtgagttacatacctgcccgtcccctccagtatatgtactaattatcttatggaaaataactattttcttgcttttttttttcctcaagaaagccttgagtctcatccagaagtcagatgagtgttagatttcttccttctcttggcttcaatggcaactcttttttttctgattctaaataaatagattgttatacccacatgaatatccacaggaccaacactgcccctttattactcaggaagtatttatttttcagctttctctttcctttctggccctttgaaattcaagcttatttaataatgaattttagtgaaattattttaaaatatcttttaatcacattagcaaacttctagcagagcattgagtttcttcctcagataattcaagttgtcttttctaaaatatgtacttaaaatgactttgaaaaaagagatgtatgatgtcagaaatttctttcaaaagaatctgggtgtggttggggtgatgggtagggatatagatgaaattaaataagcgctatgttgataaatgttgaagttggatgatggtatatgggagttgtgtagtgttttctacttttgtatatgtttgaaattttttctacacttgaaaagataagagaaatttaaaaattaaattggttctcacaattttatttttgtagctgttttttatttgagacgaagtttcactcttcttgcccaggctggagtgcagtggcacgacctcggctcactgaaacctctgcctcctgggttcaggtgattctcctgcctcagggcatgcatgtgtacaagcaatgcccttaccatttatgcattcaactattcttccctctacccattatttaatataagaagtacttatgatgtctgtgctgctgactgtgctaatcattgaagaacctagggtgagcaaaaacacacacagccattgccttcataggactcatagagaaatgagcaagaaacccaatgagaaatcacacaaataaatgtaaaattgcaaaaataacagctgttaaagaggaaagatacatgattttatgtgaaattataaccgggtggtattgacttgatgatttgagaaatcaggggaggcttatctgagtttgtgctgatttaactgagatcaaactttgatcttggtgtgtggagacatagaacataaacctcaattcacccatggtagacatgtagcttgagtgagaaaatgtaactttgttattgaaaaagtcatgacaattttgtaatctggcctatcctgatgaacattcatagggttatgatgggttatccttatatatcttgagaacaccaaggacagtggcagagcttggagtgagaaggaaatccataaaccagatgccaaaccttcctggagtcagcatagacatgaaaatgcacaagagggcaaaagagttatagaaccaactggtatgcatttcaaaagagcaggattgtggagaagagagtggatgaattattatttaggagctggaataggaaggaaggatatcaagcccagtccctatctctgaaatgcaaaaagtatgaggaagtaaataagcaccacctgagatagctgtaggagaagtgataatcacagaggagagctaggtttgattgggtgaataccaagaagagaaggggatactaaggatttagagcggttatatgagtatggaaatattgcatcaaagggtacagtgaaacaatttgagccatgagatgtgtgtgtgggcacagaatatgaataaatgaatgaatgaatgaataatagcattatagaaatgctaatgcagtagaagtgtatgtatatgagtgtgttggagaggggatgcttacaattttggcattgatttgttaaactaaggatgacagacatcctgaattcaaccttaatatctctttgaggaagatgactcacttggttgggggtgatgggaaacccagaggcaatagaatccatatacttttgatggtgggttgatagtaaaccagatcttcagatccccagtgtccattactacctacgttgtagtctaatctctcattaattctcacatgtttaattccctccaatccagctgtcagacatttttattcctctctgcttagaaattgatatttatggggggccgggcgcggtggctcacgcctgtaatcccagcactttgggaggccgaggcaggcggatcacgaggtcaggagatcaagactatcctggccaacatggtgaaaccccatctctactaaaaatacaaacattagctgggcatggtggtgggtgcctgtaatcccagctactcgggaggctgaggcaggagaatggcttgaatctgggaggcagaggttgcagcaagccaagatcgtgccactgcactccagcctggtgacagagcaagactctgtcaaaagaaaaaaaaaaaaaaaaaaaaaaacgaaaaaaccagaaatagtttatttatggccaggcgcagtggctcatgcctataatcccagcattttgggaggccgaggtgggtggatcacaaggtcaggcgttcacgaccagcctggccaatatggtaaaaccccatctctactaaaaatacaaaaattagctgggcgttgtggtgcacgcctatagtcccagctacttgggaggctgaggcaggagaatggcatgaacccgggaggcagaggttgtagtgagctgagatcatgccactgcactccagcctgggtgacagagtgagactctgtctcaaaaaaaaaaaaaaaaaaaaaagaaattgatatttataaaatataaatgtgaacttgttatctcctgtttaaaaatccttcaatgatttttcaagctttccagataatatttaaactgtgttaaaacacaaaagccctttaccgtctctcctgtagctactactttagtgtcccttcaaagcactttcccctactcatctttcatgtcagcaacagaactattttaattttttaaagctttcttgtttcatgctgctgtactggtgtctgtgctattcaatctatctggaacctccatcctaacctctttgtctggttaactcctccccaaagggattaatgactgaattaatgatgccgcatatgtttttctaatgttcttttgaagtaactcaattgactctgaaagtttcagaaaccccttgtcaagtactgatcaagcagcttatttcactgcatattttttaaaattattttttcctgaagtttcagaagtcatgactttatttcctttggaagtgttcaatatttatgaataaaattatgaagataatcatgtaaaaacagcttaataaatttaaataaattttaataaaataaagagatgatgaaaaaaaggagttatgaaaagccataacagcagagaaaaaagaagctacaggaagtgtgaattggaactaagatagaactatacatagcataaatgggaaatgtaagaatgtaaaatttgtgcacttgaagaaactgaacacaattgcaaaagtttattttgataagtggaaaacattgtcatcatttgtacatttttttcccttaatagaaagcttcttaaattatatctaagcacttatcttattgcactgaatgtaagatgccaaatatagtaagagacacaatcaacaatgctttcttatagcaatcataaaagatatacccaattttggagatgataaaatacaagcaaaatgcacatcttagaactgatgaaatctggaaattgatgaaaaaagtcaagtaactaggttattgcatacatggtattagaaaactgccaaaggaaatttttaaaatctttagaaagaaaattatcaatactgcttgatcacatttgatatgaatttttaggaggacacaaatattcagtccataacactctctgagcttgtcttcttcaagattctttcagttgcaagtgacagaaaaccgagatcaaagactgattaagcatagaaagggatttttttgattcacgaactgaaaagtccaaggatagcctggctttttaggcatgtctggatttagattagaggctcacatgataacagctgaaacattctctctttttcccacttctttccttggtgttggctttattcttaggtaggcaaagatgacccctatctcctctagtcttagattctactgtcttagccaccagagccagagaaagacatcatgcattcctaaatctccaacaaaaatccaaagtgtggctctcattggcctcatatgtccatccctgaaccaatcacggtggccagtggaatagaatattcagattgaccagttctcaggcataagaaccagagagaatcagtccaacttgaactacatgctaataacaaaagaagggagaaaatgttggataaggaaaaacagtagaggagccccagtactcactaaataggattaatttcttaaatctgcaaactgggagaagataccaaacctttaggactgctgtgaaacagaattaaacaatatgtgttattatactgaattgcactcatgtgactaaattattacacaccacatacccgtatattgcaaaattctaatttcttaaggatctgtccttgacttcattgtggcgattatacatcccccttgtagcccacgatagaaatgatcaatagaaaacattgtccaagcgtcctggctttcctcaggcaagatgttagttaatgagacctcaacaaggatgagtaactctttccaagggacatcttcagggtctccctaaaggagaaatcaatgccccctaactgatttggatgaggaagccactagggtctcaggaagtcccccattgaaatgcaaattggtctagctagggctttatcttaaacaccagcaaatagctcagttattacttagcacagctgcagggattatcaaaacttgcagttttgttgtcctataggacataagtcaatattgtatctaactttgcaatcttattctatctcttttagtcaaagcgatactgcaccaggcatttgttaaaaaaatggcaaggaaaactttattcaaagctattgtaatatcagttaagactattgcaataggggcaagaaagtatactcaactttattgaaatgaaaggcaggagaggttttaagccttagggtgagctagaggaaaagcactggaagacactagggggaaggtcggtcagggtgattgggcttatcaaaattaggctcctaccctcccacagagactgagaaatgaggatgttatctttcttgatgattggatttcaaaagaatggcttccaggtgcttgagaaagacattccagggatgtagaagatttacatctcaaagggacagagaatacatttacaatggaaagttttctaaaataactgctccaaaaaaagggcggggctgggctcagtggctcacgcctgtaatcccagcactttgggaggccaagtcgactagatcacctgaggtcaggagtttgagaccagcctggccaatatggtgaaaacccatctctattaaaaatacaaaaattagccggacgtggtgacgggcgcctgtaaccccggccactcgggaggcttaggcaggagaatcacttgaacacaggggcggaggttgcaatgagctgagatcacaccactgcactccagcctggggagacactgtctaaaaaaaaaactggccaggcgcggtggctcacgcctgtaatcccagcactttgggtggccgaggtgggtggatcacgaggtcaggagatggagaccatcctggctaacacggtgaaaccctgtctctactaaaaatacaaaaattagccgagcatggtggcgggcgcctgtagtcccagctactcgggaggctgaggcaggagaatggcgtgaaaccgggaggcagagcttgcagtgagccgagattgcaccactgcactccagcttgggcgacagagcgagactccgtctcaaaaaaaaaaaaaaaaaaaaaaaaaaaaaaaaaaaagaaaggaaaaaaaaaaaaacaaaaaaagggtaagtcgggagcttattaaggaaagaatcctagtctctggcattctatttgggccaactttgtcatccttgtaattccctctaaagctttggcatgtgctcacactatatccgtatgaagttcatggctttatatttataaaaattatattttgacttcttttctcttatattagttggtagaataagcagaaatcaaagaagctgaaactagaaaacagaacatagcaaaatagcaacaaaaagacattaaaacacaaattttgaaagggcaaaaaatcatttttggaatctgactaatgagacagcatggggaaggctaatggggtaaggagaagaacaaatagaaataattgtctttggaatgtgaacattaacataatggagagcaatgaataagaagtatgacaatgttaagtattttatgtcattgtcccaagaggtgctcaattgagaaatcacacacacacacacaactttaattataagaaaaatatgtggtaacaaaataacaggaaaactcagaagtcagagaataaattgcttattaccacctcctaagtagcttttaatgctctttctaaattttctttgtaaattcaaaagttaaattgaattttgattcagacataaaatgaaactgggagcatttatttctgtattgccaggagaaatatttaccttgatttatttaaattcttctaggcattcctatttattcaattttataaacatcctcttctttgatgttactctaagtttattgtttcattgtctgagaaaaatcttattgccatttcctaaattggtgtttttttccccatgaaatttccagaagcatccaaatgactggattaaaatgaagtatggcaaattgccttttagaatgactcttcccaattagaaattgccaaaagtagagatcaaagcagtatacagtggttttaaactagctcatataacatcttccatgagctagttatataaagatttttgttttgattacttttatcttataattattcttaccaaattccaaccataaaagatattttgtacataataggtactcaataaatgaacattacatttgaaaagcaatgacctgctttatatttcagtctaaatgtaatcgatatgaatcaagcagtaaagaatatggcagagttgcattacaatttgcagtccaaaaattcttgagtaatctcaggaaaaatgtactctaccagggctttccaaagatcgttttcaggaatactagcctgtctatgtgctgccaaagcgagcacaggaatactagcctgtctagatcaatgcagttaacacaacccagtagatctctgtgcttgatgatgaaaatattctatgtctctgctgttcaatacaatagtcaatagctatctgtggctgttaagcacctaagatgtgactaatgcaactgaataacaatttttttcatagaaattaatgtaaatagccatatgttgctagtggctacggtactggacaacatagctccaaagttctcaagaacaaagaaaaaaatttatttatttttctttaaagaacaaaattttgtctaacctagcatttcccaaatttagttcatcacgaaattcctctttctactttgagaagaacattagggtacacttttcaaaaattttatattattaataaaaaggaataagatgtttaaggccatttacacatgattccttattttatttgctgattcatttatgtatccactcaactaacatctaatgagctaggggcttggcaatattgagatacagttttgttcattattgagttatatctaatgggacaggcagattaatcaagagataattacacacagtctggtaagttctaagaaacacagaggactgtgggaatacacaggtgggtgcagaatcaaaatttgtcatggggaaagtttccagagggagaatggaggacaagtaggacattgtctggttaaaaagaggtccccggccaggcgtggtggctcacgcctgtaatccctgtgctttgggaggccgaggagggtggatcgcctgaggtcaggagttggagaccagcctggccaacatgatgaaaccccatctgtactaaaagtacaaaaaaagaaaaaaattagctgggcgtggtggtgtgggctgaggcaggagaatcacttgaacctgggaggcagagattgcagtcagccgagatcgtaccactgcactccagcctgggcaacaagagcaaaactccatctaaaaaaacaaaaagggtgcctttgcatttttatttctcttattcccctccccagggtttgacacttagtctgtcttattcaagctaagtccttgaatcacaactatgcctagatccttatgggttgcttatttatacctttaaacaaagagaaattcatctgatttttacagattgatttgagaattagaggctgttaatactatttcctttttgccaccccaaccactttttcctgttctaacttcttcatactccagtatacaccacagaaacagaggctgatatggtttggctctgtgtcccacctagatctcatcttgaactgtactcccataattcccatgtgttgtgggagggagcggtggaagataattgaatcatgggggtggtttctcccatactgttctggtggtagtgaataagtctcacgagatctcatggtttcataaggggtttcggctttcgctcctgtcttattctctcttgccaccatgtaagaaatgcctttcaccttctgccataattgtgaggcctccccagccaggtggaactgtgagtccattaaacctatttttcttcccagtctcaggtatgtatttatcagcagcatgaagaaggactaatacagaggccattcgtactttaaatgtattacggctaattatagtcaagagattagaagtcataatacaaatattaaccacagagaggtttaaatttctctatataatctacagtcttctcaaaatagccttcaaaattttgacctgagagcaggaacaggcctttcatgttttaatcctcaataaaacacagacatacaagcctgtgtgtgtgtgtgtgtgtgtgtgtgtgtgtgtgcgcgcgcacatgcattctcacgctcatagtctgtcttttcccaacttcgacaattgtcccactgatttctctgtaccttcctttctattttaatcaaatctccgcaaaataaataagggatattctaaaatgtaaatctcattaagccctcccccagataatactcttcaagagtttcctcagtttccttcaaaatatgttctatggccattagagtagtttaaaattccctgtataatctagtccaagtttatttctccaacctcagagcaaacaattctagaacagtgtctagcatataataaacacccaataagtgttggctattgttttaggaaatggttgtctgtccaggaagcctaaaaaggtgtcaaaccacaatattagggaggcaatgcatagtgcagccaattcacaaaagagaaacaagtcctagaaatgttactaagagctcaccattcatgacaacactaatctcctcccgcaactctgccctcacccttcattctttgaggcttcaaaggatgaagtttatccattcatatcaaaaccttcctttttcacatatcaatgcacatttaaaataatcttgtagacactgttttctccttaagagtctgagagttaggaaacaattctgtaaatattaaaaacacaggtattgtaagactgattggaatcttacaaactaattttgttttactaaccaagacagtgtaggatagttacacgaacccaggtctagtaaataattcattcgcgattgtgggattgagtgcaaataattagtgtaaattgtcactttctcaaaacaaccgccataatagcctgttgattaagcaacgctgagtttattacttagtgcagtaataaagatcaacacttgacacagggtcttagttctctgaagacagtggttgaaggtagatattttttatagagttttgagggggtctaggttcaagtggtttaaagaagttctttgaatgcagagatttgattgaaattgggcaaaatccaagatataatagacaagaattggtggacccagtgagtccaggttcttagaataagtcttgatgagtaaatagctgttgaataagtaagggagttcatcatgttaacaatccattgtcccatgaaagggagctttttctccaaataaacaacttattgtcttaagacagagctacttgatcactgtgtagttcagataaatgcagtttcaggaatttcctgacgctgtatattagtttacaacattatttcctgggaaaatgttttgtggaacaaaatgcaaagttatattgacgtaggggccttgataattaagttgagcgacaacctctctgagtttcctcaattgtaaaatggggataccagtggcacctttttcttttggttgttttgaggatttagtgaaataatgtgcataaagtcctcagcaggatacctggcacttagtaaaagtacaatggctgttaaatatatttttcaactactttcacagtagttactcttaaagtatcaactcattttttcatccactcttctaaaacattcaccaaaatattatatgccatgttctttgctgtgtgttaggagcacagggatgaaagaaccatgtactcaataacttgtacttatagacatgttaccctattactggagactgttttggtaaaaataggaataacatgccaaggcagctcaggggatgtaggaaagtctaaaaacctgtcctagtgaaactgatgcttgacctgggccttaaaggatgagtaataatccattagtcagccaagggtccgatcattccaagctaaaggaaaactatgtacaaaggctaggaactattaatttccatgctgggttccagatataaaggagaaatccatgtgatttcacctaaagggtcagatggatcagcagaagatgagttcggataacaaaaataatagttaatagaattcaatatatgataagaatattcggtgtttataacaaacgggataattccaaccagaggatggaaggatcaaaggttttttttctatcaaggtgtggagctggggtcctatcttacacagtttagtcattctcaaatatttttatacaccagaaaaacatggaaagacttaaaattgcctccgtcttgctcaaaccttccgaagattccaatttaattgatctgggatggagcctgggaatctatattttttatttttgtgtgtgttttatttgtttagtgctctcctagtaatactaatatataagtaggacagaaagctgcctgcagtaagcagtcacaacccaataccagtagttagaagcccaaaatgagtcatttaaacaatattcttaaggtccacgtgcaaaattctggaaacaaggagtcagtagaggttacagaaggtaattttagcagcagtgagaggttgaattaggacagtgagttttcagtcatttctgcttatctggcacttgctttctatgaagaaaaggaaagagcatattcagatactcccagtgatactggagtcatagtctcaggctaagatagtgggcatgagatgagatggactcaaaagacagaagtagatgttgggataaattagagtattgggataaagaagaaagagagagctcaaagaacaatccaaaggttgtaactataggggcaggagcagtaggtctaggatgtagataaagaactaatttgaaagtgttgactataggcagcttcccaataaaccatggctaatacctgagccattatttctttcacagccccaggcacaactgtgtggtgcctcactttctgaaacattttaacagtctcctcctttgtatatgaccccagtgccctcaggccattcccggactgctttcttggtttcaaaatatttcctctacttaagtattggttttagaggagactgaattgagaattgtgctatagggagcatcccagaaccacgaaaatgacagtggttatgaactatcactgatgaacattttaggcaaaagtggccgattttgaagatgacctcgaggtcatccaaacttccctctttcctcattgccaaaggtcctgaggaacattatgaaaaataaaaattaaaggcaggtggaaagcccaaacatacgtctttttatttgtgatattgaattataaagtgagaattactaggctttgttgatggcaaaaccagactctgtaaaatattttaggcagtcagattacagtttggttttatacattttatgaaggcaggagttttaggcaaagacataaatcaatatatggaaggtacacattggtgaggcctaaaagggtgagatatcttgaagcaggggcttacaggtcataggtggattcggagattctttaatttgtgattggttaaaggagtaaaggtttgtctaaaaatttggagtaagcaggaaggaatgttttaagttaagataaggaagtctgttaatcaatacactgggtcagagtgacctgtaggggtgtgcgatttaacccttgtctgacatggccttaggtcctgtttataatttggtatcttaatgttgcagagtccattttgttagtctttgctctctattttacaataacattaatgctagtcagttgtgcctaaactccaaaagggagggggtataaaaaagcgtgtctgacctcctttcttgtcattgccaggaattcagtttttaaggtttctctggggtctcagtggctaagagagggtctggtccatttgtgacgggctaaggattttatttttagtttacagcaggatcaatgattatgtttcctaagggacctaattctagaagtccttcagttctccccaaatattttgggcccttgtgtcacaattgctgaaaccctgactccaaatttgggaggataacattgctgccagctttttactggtatcaagaaaaatgccagaaaatatgcaacatatgttgccattttgtcaaaagcagcaatgttaacatgacaatgaaagcaagttccttttggatttctttttaatccctggaaggtcagagggccaaagttttctagtaattcatctaggaaattaaccacctttggcttttcttactattttaatttacaattatgatttatagatgaacgttggttggaaaatatttttacacataatggcttttttagaatagcatctacagatacatgacagaaggataaaaattgtaactgtgacagcaatttcaatcagaaataaaaaccttaaggagcatcatgaaatttaccaaaatttatgcttctgatttcatggtatgtatttgttgatttgtttcttccccaagggattagtagtgaatatgtaagtaaaaaaggacatgattacacatgaaatacaatatgtcttctgggaaggtggagaaatctttcagccttagtggcattcacgtttgtgtggctgtgtatgtggatgtgtgaatttattcaacaaaaatgataccacttccatttgcatgatattgtaaagatttttttctttcccatatattctctctttttggtctcctgataatcctgcgaggtaacattaatatatgtgatacatttaatgaaagtctttgacaggcagcaacatatttgagaaaacaagcttgggaagtaagcaatattatcttcatttaaataatgagaaaaatgagtctcaaatagggtaagtgatctaccaaccagcacccagctctccaagatagaactgatactcaaaactaagtcttgttaacccagtactgtgcttgattcatagaaaatgttccacaaatatctgaaatttaattcatagtttgtgtaggtacagcatgcaaccaccacaaggaattttggctttctctttaaaatgtggacttttatgtgccaagataaattttctttgtggctgaatgtttttcaggaagagattactcaactaatttgaaccacattgacctatctgtaatttatggaaaagtgcaacataatacaggattatagaggctagagtcacgcttgctgaatacatatgctgtacattattttgaaagaaagaaaacattttaatacaaactatgtgaatttgatgacgcattttccctttatttctgttagtataaacctgcctatatctgataattgttggtgggcatgaagtaaaaggaaattatccccctttctgtaggttgtctgtaaagaaataaagcaaaagggaattagtacaaaataataacggtaatctaagcagacatagagttcagtgtttgttttatttcacagaaagatgcctatgcaacttgtgtaacaaattggtaggctgaaagaataacctcatgtaaatgaagaatgtaattaccatcttcacagttttggtacatgttggaaatgtcatttcaatcagggctaatcataatatgacaggaataactgtgataccataagtgataatgttatgctgctcactttttctaaatttggtggcaaaatatgcaaagataaaactttcaaagagccagtaaaacatgttcaagaattttctcactttaaaaaatattttcagggaagtactcatcattatagatcaacaattattttgataactccattgtttttaaattaaccctgttttagtattttggtcatcttttatggtcaattataaaagaaaaggatccattttaagtgacaataagtatttgatattttactttttccacatatatattcctatattccatatggcacatatgtatattttgtatatattccacatataatccatatatatatattagacacacagatacacacatacgtatgatatctgtctatctgtctgtctatctatctatctatctatctatctatctatctatctatctatagttgagacaaggtcttactctaacagccaggctggagcgcagtggggtgatcacggctcacagcagactccatctcccaggctcaaatgatcctctcacctcagcctcccgagtagctagaactacaagtgcaccccactgcatgtagataaatttaattttttttttttttttttttgtagagacagggtctcactgtgttgcccaagctgtcccctaactcctgggcttaagcaatcctcctacctcagcctcccaaagtgctgggattatagacataagtcaccatgcctggacacatgtgatattttgtatgtatgtatgtatgtatgtatgtatgtatgtatgtatgtatctatctatctatctatccatccatcgatctaaaaatttaaatatagttttcgaaatgttgtctctcattttttttttccgtacatgggcttcttattaacaataaataaagtagctaaaaacaacgaactaagaacttcagcataaagctcaatgggtgttcccattcattgcattgtgaagttgatatgaatgccattttgatgctacctcattttctggctcctgatgaagaaacagattaatgacaaattcctttcattactaatttctgtggttctcatgaagtttatgacattttaatttaattttattttgttacttttctaatccactactttatggacaagtcaacaaatggtttcttaaaagtacctctctactaggaagttggcaataaatacaaataactaactgttgctgtgtggatacagcctcccaacgggagacaacaggggagtcaggggagtgaagaagaaaggaagaagtatgatttgtattttgtttttgttcataatttttggtgttgagtacaaagtttgacccaagacataaataaatgcgttgatttttgaaaactttaaataaaggtatcttattctgtggttcaagaaccactggaaatgtagaggtcatccaaatgtcctgaaattggatgcaaatttttatttctatgtgcatatgtacatttttatggggaaaggatacacgacattattcagattttcctcaacatataagactagcaaataggttcaggaccactgccttatctattaattatattcaggtccaaatgggaaaaagacgtttctaagaaacaagaatataaatgccttaatccatgaatttacttttatttatacaagatattacataaaataatctgaaacaaagcatcttccaaaatagtgttataagaatgaatattatgccgggcacggtggctcatgcctgtaatcccagcgatttgggaggctgaggcaggtagatcacctgaggtcaggagttcgagaccagcctggccaacatggcaaaaccccgtttttactgaaaatacaaaaaaattacccgggcgtggtggcgtgtgcctcaaaaaaattactgaggcaggagagtagcttgaaaccgggaggctgaggttgcagtgagtcgagatcatgccgctgcactccagcctggacaacagagtgagactccatctcaaaaaaaaaaggaatgaatattataatactatgttatttacttaattataagaattaaaaatatatttgagcatatttagggcctcataatcatgcatagaggaaattgatatgatccattttatgttgagtaactcattatcattattattattaataatattgcttactacaaaaaattaggcaaattccttttcttataaaaattaagagttgaatatgttgttatgcctaaactacataacgtctgcaaaggttatggtcttatggatgatgatttttctcaaatattagtgtgaaaataacaagtttctaagttttccaaataacttaatgtgaaggcaaaggatttttaagaggttttgattatactcagagagtggaggactaagtgatgaaagaccaagatgagtggtgatctgtgttcctttaactattatgtgcagttgctgacacaaaatggttttgttctttctaaaaggtagagagagaattttgcccacagacagaaagaaaatgtctttcaagaagtggtttgagaggctggagagaagcagattggttacttgattactgagagggccattaataggagctcatttctagctaaagtgctgacatcactttgaagccatttacaattgttaaaaggaagcaaccctttagtataaataatgagcctgttacagtgaagtgcattggcagatattcataaacacagatacaggaggagctgttattcattacaattactgtttttcgtatgtttgaaaaatgcaaatatatgtgtgtgtgtatgtgtgtagtcgcacagtgatattttgttttagtacgtataatttagaattatcaaaaggaggtttgctccttatatgtaggttatattatgtcatgtgtctacttttggagagagtgataaattgagacaaatattccctaagtttggatttaacaacccaaaatcctctaggatgtcactctacactttatttggcaacttttctatgtgcatattttagggacgcttgcagaaaaggtatgtatggacaagacaagatccttgcctagaaacagaaagaacaaatatgagcagaggcataaatcaaaacataagcaatacaaatcagtgctaatttttttaattaaataaggctttctgattcatgatctaacctttaaaagtagtttctgaagtatattctctgttatgaaacttcgttcttataataaaaatcatattttgcaaaaaaaaaaccctaattttcaattacactatgaaaaaataaactaatgagttttcactattaaaaaaataacagaagccaagttcatggagttgctttttctatgtatgtttattgcttgtagtctttcacaaggatacatatattccaagttcaacatctttctttctcttttctttctctttttttctttctttttctttctttctttctgtctttctttctgtctttctgtctttctctttctctctctctctctttctttcttttttttttgatggagtttctttcttgtcgcccaggctggagtgcaatggcaccagctcggcccactgcaacctctgcctcctgggttcaagtgattctcctgcctcagcctcctgtgtagctgggattacaggcatgcaccaccatgccggctaattttgtatttttagtagagatgaggtttctccatattggtcaggctggtcttgaactcccgagctcaggtgttctgtctgcctcagcctcccaaagtgctgggattacaggcatgagccaccacgcccggctaagttcaacatatttcatattcaaaatatctgtgtcagttagctttggctacataataaactactctaaaactgaatggcttaagacaatttagttcactgttctggtaggtgtttcttctggtctgggcttggctctctcatgcatctttggctcaagtatggctttccacagtgtcttaacccttcaaagactcaggttttacatctaaaaccagagttcgagaacaggaacctcataactgacaaaaaaataaaagttactcctcagtgttgtctgaactcatctctcctgctaaactcccaaaggagaattcaaaactggcctattttcctcaagctccctattcaacccttctcaaccttcccctctccttagccaatatcctacctgatatgtttttaaatattttagaccctcagatatgaatgctcttgccttccctatatcctaatgataaatgtattcatgatcacagccaacctcacgttcttttcctggctttctcagaggagagtctcatcgtccacttaagagatacctatttcacttgcatccttgattttatcaattcttattctctttcaactgtatggtcatcttcatcttttcctctctactgtagaactgccattttatttttcttcttttctgagccaatcttctcgagggagtaatctcaattctctatctccatggcttaatttcccacttcatgctaatctactgtaattcagtctttatttgtcatggtgcaaaaactattatttttataatcaatggtgacttttatattggtaaatctagtgaacatgtgctagttttttttttaactaggtctctcttctgcacttgacactgttcattactctgtcttagtctctacacacttgcctcttattatagtattctctgttttctttcctttgtgaacactgtcaacatccttcacaagtttctcttcctgcagtcaccttttggatagaggtgccaccatgcttccgtcccagttcctttactcttcttatcctgcacatcctcttgctgtcttcattccatctccaacccttgcatttccatcagatacttctctggagtggttccatagggatgccagatgcactacctaccaactcatactgaattttttatatatatatatatatatatatatatatatatatatatatatatatatatatatatatatatatatatatccccttcttctttagcacaatatcctggagaatcacgtagattagaaacaaacgggtcactcttgttcccctacttcctcactttcctattcaattagtcatcaagacttgcacattttgacaactaagatttttcttttgttccatcccctttcagcccatcacagtcccctaagaccacctcttagttcaaatattttgtacctcttgtttactaccacagcacacaacagtttcacataacttcacattacatatacactttcactcaaaaaaggatagcatttttggattttgaagcacggcataccttttaacgtgtgtataagatgtgttttctcatgacttcttatacaatcacatgtactattctgcattgctgctttatacgcttgtgacttatctcatgtaggaatggaaagagggtgatccctttccttcccatcataagggtcacagttgacacctctataaaaagagagaagccatacaaatttattttatcatagtttcttgtggcttgggagggagccttcagaatgaagaccccaagatacagggaagactacctttttatgcttaggttccatgaaggatggacagctgtgtagaactgtgattggacaaaaagggtatgatctaatactaatagactgagtgggaaaaatcagcaaggcctgtctgtccagattcttcttgacctctctgtgcagcgttccttcctcccaggtgtggtgcaggaactctctctggtatgggggatctttgacctatagtcaacaggtaagttagagaatttctttatggccagttcttacacataaaggtagggggtaagttatgatgatatttttaggttttatggctggccttgaggagaaacatttctgatttctatgaccagttttagggaagagggattttaatttcgatggctatcctcagggaagaacaaggggtgagagacaaaagggcaggagggcagaattttgtttctgaaattgcctctgaggacttcactttggggtactgcttcctgtgcctcaatataatcaatgtgatcaattttacattgttggtattattcaatgatactttagatttgtgaaattcactagttagaaccaagctatttattctacattaaaacatttcaatagatagaatatcttacaatagctattgtcaaaaaatcattattattgggtttaacatttttatatttagctctgtgtggaatatcttaattattttttgacttctctctcatgtagcatcagaaattattcacttgaacagattttagattaatttattgatattatgattaccatgcatatccattaaatattttgatattgacaattaaaaagaatgaagtatgcatatatgtctcaatcatccagctgatcctaggaaagggatgtgcatttattaatcatgtttttaacccacagcacttactgtgacatttgtcacatagtaagcactatatatgtttttaaattaatgaagctatcaaagttcaccaaccaatataatttcagaggacagatgaaggctttcacgtcttcatttgttcacaccctatattcttccttatgcagctatttaaaattaattggcaagaattaccactctccttttctcatacttgttttggattctaaactttgttattttatttttgccatctctattctttctacttacttgacaattttaaaatcacacattatctaaaatcaggcagtgttttaattggttgatatattttacaagaaaccattccaccattatgttcttggtgatttaaatgcctatttggctacttacttgcacattatttgcaagaatactgatatctctttgaaatccttatctgtgagtgtgttagtccatttgtgttgctctaaaggaacacctgaggctggataatttataagaaaaaaagtttgttttggctcacagttctgcaggctgtgcaagaagcacggtgctggcatctgctactagtgagggcctcaggaagtttctgatcatggcagaaggtgaagggggagccagtgcatcacgtggttaagagaggaagaatgagggagaaagagtggggaggtgccacagttttaaacaaccagatctcacatgaactgagagtgaggactcattcattattctgagtacagcaccaagccattcatgagggatctgtttccatgacacaaacacctaccactaggccccatctccaacattgaagactatatttcaccataagatttggaggggacaaacatccgaactatcagcaattatgtagctacatagaaacaccaaagctgttctttctattttatttggtagaggttaagataagagaatatgacagtttatttcactcaaggcattttattaattcattgacatttgtctttgaacaaagagggtcatgtacgttcctgccttattcatggtgaattggtttggatgtaatggtacttgtacaacctgaggtcttaccaaggatactatctctccagttcatttgtatgtctttccaaggactctgaaacattttgtccaaggaaaaagtttcttattgaatttgaacttacatcaaatgaggcaaagtacttagcagccactccactttcagcataggaaaattctataatttgtcttgtgcattgtatgcattgttctatttagaatctgtgtttaccttgtaaatgtacttttaataatacctgaaaaagtaatattgagaatgcattgttctatgtcatagccctcattatttcattaaatgaagagctgaaaaagagataatcatttaatttatgttttaaatatctatactgacttgtttgaagaataatatagccaccatttattaaaccttggaagtagtgattttacaaacatttttttctcattcgcacaatgactctgcacataagtggcctattattattttcattgtccagttgacgattcaagggttatacaatttatgtgacttcccattgtcatattggggctggaatctataccaattttgcagaacttgagaatttatgtcctttcctgtataaccgtggttttccatgttttccttctgcttccatatttccacatgggcaacacattcccactcttttacataatatttcttcagaaaaaggcaagaagaaggttgtatgtaatctgaattggctgtcttttacattcccctctcaaaccctagaggttgcaatacccatgatcctcttgagaattgccacactatatagcagtggttggatgctggctccaaattagaatctctaatagtctgatttaattattctgggtactaagatgctggtattttaagagctctctaggtgatttaatatgcagccagagttgaaaaccaaggtttcccttctattgtatttcatgaaatgaaaaagacaaaataaaaaaagaaattcaatttatattgtttgctgtcaatgaaacatatcacataacctcccaattcttaaattacaccagtacttcatatttgaaatatatattcttaataaatcttttaactttcagggctctttccccctaattcttttcagttactttattagctctttgaccttgggcaactttctcttagagtcgattttcttttcttcattctaatttataaattaaactcttagctaggtaatattatttattacttttttgaataggtgactcttataaaatttcatttattttgtttctggtatttacatattggcctagtgaccatactagatacttaatatgctgtatatattttatacacataaataaaaatgtaaatacacactatatatatactatatttatttttagagtaaataaactttttaaacttcaggttatttagcactaacatactctctgatggtcccagtattaacatggtttttaggagtgcacaaacccttttctgcaagagaccagagagtaaatattttaggctttgtaaaacttatggtctcttttgcaacaattcagtatctgtcacaactattcgactccaccattggaatgctaaagcatctgtagacaatatgtaaacaaataggtatgattatgttgcaataaaactatatttatgaatgctagctgtaggctaggtttgacctgcagtctgtcgtttgttgaaccctgctttttatgatgattgtgaccttgattttgttttcctttttcatagcaggtgcttcataagtattgatttatattagtatgtttcctactttcttcctgccacaacacagcagttgttcacaggaattttgttgcttctcctagccttttccataattttttggtattaaccaaagtaatctactatatatggagaaatttgctatggtattacttttgtataggttatgtggtcagctgctctaggttgattattttagctctattgaaatcactttggtagatctaggctgcagcaacaaggtgaaataaagttagaacaatggaaagagtggtaaataaaaggatcaaggccaatgaaaaggcttatataagaagatatcccaaaatattagagttttttagtggctctccctattatacacactgtaccaattaaaataaatttaagagacttcagaagaataacacagttttcagatgggtggatatggacatattctccaatcctcaggtgactacaagtaagaaatccactaattggaaagaaaagaaagtagactgtaatataacaggtaacaacttcatgaaatgagtaatctcaatgagtagtttagactaaaaatacaaataaattatatatgtatatatatatagagagagagagagagagagagagacagagagagagagggagagagagagttcataaatgaataattgtagaaagttggtttgagatttcagtaataacgtcatggagggcagctctgttcatttttcagaatgctctattcaaagtagttatgtctgtgattttatttatactgtgattttttcttaaatgttttgatttctcttaaagtcgtatgcttttcctctcattatttaaatttagatcacggtagtatgatttactattaaaaggttaataaaatgggctgatatttctcattatatatgagatagcttcaaattatgatatagaaaagccattacattgatatagagcattttctgttttatctaacacagaaatttcccaatcacttaatctgcttaatatttatagatcttacattatccatgattactgtttcagcttatttttactttattcatgttgtgaatagatagtacatgctcatggtacaagattctaaacacacacacatacacacactcaaacacacacacacacacaaatgatacagagaaacagtagtctcttttttcttctgtccgtctatatcctgaattcaattactactatgagtctcatctagaaatagttcatatacttacaaacatatttaaattcttatgtaatcccatttgacccagcaattccactcttaggtatatacccaagagaaatgaaaatacatgttcacataaaatcttgtgcacaaacgttcatagcattattcataatagtcaaaagtggaaacaacccaaatattcatcagctgatgaatggataaaacaaaacgtggcctatctttacaatggagtataattaggcaataaaaaatgaactactggcttggcgcagtggctcactcctgtaatcccagcacttcgggaggctgaggcgggcagattatttgaggtcaggagtttgagaccagcctggccaacagggagaaactccatctctactaaaaatacaaaaattagccggtcgtggtggcacacgcctgtagacccagatactcgggaggctgaggcaggagaatcgcttgaacccaggaggcgaaggttgcagtgagccaagattgcaccattgcactccagcctgggcaacaagtatgaaactccgtcttaaaaaaaaaaaaaaaaacaactactgatacatgttacaacattgctgacccttgaaaacattatgctgagctaaagaaggcagctattattaaaagaccacatattattcaatttatgtgaaatgttcagaacaagcaactctatatagagaaaaattactgttacagggctgctgctggtggtggtggagggtgatgcaggaaaggggaaaatgggagtgactggtaataggtaagaggtttcttttggggagggtgaaatgctctgcaattacatggtagtggtggttggacaaccctgtaaatatactaaaaacactgaattatacactttaaatggatgaatgatatggtatatgaattatatctcattaaagctgttttaaaaaatgtatatttgttcaagattttgaaccagcaacatctgtaacatattcaaatgcaatttcattttagcttccaagcatggtcactctacctcataggtgttaattcagtattagaatgactagtccaaggtagcatctaaaactctgaacttaatttagtgttaaattgtgccccttccccggtttagggctactgcagacaggagtattacaacagaaaagacaggcgtggcaggcggcgtctttaaatctgttccttggacttctctcctgcttacaccttgctattctgactgttccaaggtcagagcagaataaagacagaatgaggtgatataaagtgttttctaggcctaatggctggttaagtgttctttctctttgtctctcccctcccagccctacctacctctcctacagtttccttgacccagacaggctcaatctctatctgtgtggagacttgttactctttccttctcttctgaagatctaggcttcacctcaggttcttgttgctgaggttcttatactcccataggtggctactggtcagaacccaagtcaacccagtgttgactctattttctgtgtactttgctgttagggtgcccgtgtaagttatcatccaaactgaaatacatttgtgagtgaaagggggtattactaataattttgatgaggccgggagtggtggctcacgtctgtaatcccagcactttgggaggccaaggcgggcagatcacctgaggtcaggagtttgagaccagcctggccaacatggtgaaaccccatctctactaaaaatgcaaaaattagctgggtgtggtggcacacgcttgtaatcccagctactcgggaggttgaggcgggagaatcgcttcaacccaggaggcggaggttgcagtgagctgagattgcaccattgcactccagcctgggtgtgacagagcgaaactccgtctaaaaaataaaaaaataataattttgatgagacaggcataaaatgggactgttctgagcaaatgggtcttatagatacccactgtatagaaaatactcacatatcctttgcccccaaaggtttggaacactgcctcatctattctgcttgtggccattgctctgcctctctcaggtgtgaggtgagctccattcctccacatcacccaactgcaaagaacacattcagtagatttcaaaggaatctcatagaagacccctttacttggctggagataatagatgagaattctcagctctttcccaaggagatagacaaaatatcttgtcagagaaatatctgcacaaaatccttcctctgcactttcctaaaccatttaaaatctgaaagtcaccaaggagttcaagagtaaggaacagatgcttacccatttcctttaaaaatctctatttagtgatttgtaactcacactagtatttcgcatctgttgtaacatggtgcctagttccaacttcaattttaacatcttattctgtatatattctttttttgtccacacaaatgtgagagttatttttgaaatataatgtcaaaagagatgatttgtcttagtggttcagtgtggcacaggctttgaaatcagaaaaccagtgttattagatttttgactttaggaaagtaacttgacttcttgcagccttaacttcatccccagtaaaatgaggataataatagtacctacctcatgggactattatcataattataagaaatcacatatgtaaagaaattaacataatactcaacttgtggtttgatgtgcaataagttaactattattattactatgattgttatttttaatatctataggaaaccaaataatatgaaatgtcacaaattatttttgaaaatactattctaaggtcttttttttttttttttttttttttttagattctatatcaatttttattccttcattgttacgaaacagatgaataatccttggcagatatacttgagagaagactcttctctcttcctgactggggtccaagtagtcctaatcccatttatccgcatctgtatattccacattggatttgtctcacacatgtccttcttgagatgttacttctgtgtttgagccagattctctgtctagaaaattgtccttggttatacctgctcaatgtttgctattaataatgatatacatcataatcatttaaaaagcccaaaactataacaaccctttagattaaagatacatgctccattggcagccctcaagccatttattttcacaatgtgctgagtttaactcactcattcatttataaattgacttggttgccaatatttggaatcagaagatgtttatcccaaatccagctttccatgggaaatcaggtaacatgggagaacttggcccatattttatttatttatttatttatttatttatttatttatttattttatttttttttttttattgatcattcttgggtgtttctcgcagagggggatttggcagggtcataggacaatagtggagggaaggtcagcagataaacaagtgagcaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctatccacacagacccggcaaccatccgatttctcaatttttttccccacccttcccgcctttctattccacaaaaccgccattgtcatcatggcccatccccaatgagccgctgggcacacctcccagacggggtcgtggccgggcagaggggctcctcacttcccagtaggggcggccgggcagaagcgcccctcacctcccggatggggcagctggccgggcggggggctgaccccccccaccatcctcccggacggggcggttggccaggcagaggggctcctcacttcccagtaggggcggccgggcagaggcgcccctcacctcctggatagggcggctggccgggcggggggctgacccccccacctccctcccggacggggcggctggccgggcagaggggctcctcacttcccagtaggggcggccgggcagaggcgcccctcacctcccggacggggcggctggccaggcggggggctgatccccccacctccctccaggatggggcggctggccaggcggggggctgacccccccacctccctcccagacggggcggctggccgggcagaggggctcctcacttcccagtaggggcggccgggcagaggcgcccctcacctcccggactgggtggctggccgggcggggggctgacccccccacctccctcccggacggggcggctggccgggtgggggctgaccccccccacctccctcccggacagggcggctggccgacccccccccccgcctccctcccggacggggcggctggccgggcagaggggctcctcacttcccagtaggggcggccgggcagaggcgcccctcacctcccggacggggcggctggccaggcggggggctgatccccccacctccctcccggacggggcggctggccgggcggggggctgacccccccacctccctcccggacggggcggctggccgggcggggggctgatccccccacctccctcccggactgggcggctggccgggcggggggctgaccgccccacctccctcccggacggggcggctggccgggcagaggggtcctcacttcctagtaggggcggccgggcagaggcgcccctcacctcccggacggggcggccggccgggcggggggctgacccccccacctccctcccggacggggcggctggccgggcagaggggctcctcacttcccagtaggggaggccgggcagaggcgcccctcacctcccggactgggtggctggccgggcggggggctgacccccccacctccctcctggacggggcgactggccgggcagaggggctcctcacttcccagtaggggcggccgggcagaggagcccctcacctcccggacggggcggctggccgggcggggggctgaccccccccacctccctcccggacggggtggctgccgggcggagacgctcctcacttcccagacggggtggctgccggacggaggggctcctcacttctcagacggggcggttgccaggcagagggtttcctcacttctcagacggggcggccgggcagagacgctcctcacctcccagacagggttgcggcccagcagaggcgctcctcacatcccagacagggcggcggggcagaggtgctccccacatctcagacgatgggcggccgggcagagacgctcctcacttcctagatgggatggcggccgggcagagacgctcctcactttccagactgtgcagccaggcagagaggctcctcatatcccagacgatggggggccaggcagagacgctcctcacttcccagacgggttggcggctgggcagaggctgcaatctcggcactttggggggccaatgcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccagcccggccaacacagcaaaaccccgtctccaccaaaaaaaaaacgaaaaccagtcaggcgtggcgtcgcaggcactcggcaggctgaggcaggagaatcaggcagggaggttgcagtgagccgagatggcagcagtaccgtccagctttggctcggcatcagagggagaccgtggagggagacggagacggagacggagaggggagaggggagaggggagaggggagaggggagaggggagaggggagaggggagaggggagagggagagctattctaaggtctttagaagcaaacagtgccattgagaattcctcaaagcactaaattacaaaaatattcacatagatttaaaggttaaacctggcttatagcaggtactcaactaatattgaatgaattaaatgaaacaactctttatctatcaggtacctttacaaagtgtacactaccattatgttataatgtattagtctcctgagtctgttgtaaaaagttaccacaaacttggtgacttaaaacaacagaaatgtattctgtcatggatctggaggccacaattccaatatatgttagaaccgcagcttattagaggaaataagcaagtcagaatgcttgactgtacatatcattctaaactgatagacttgacctgaggcctttgacctcttacggaacaaaggacaagtactttgtgacagctatttttctattttattatttgcctatatttgaaagcacatttaaatgatagatgttgaatttgttagaaaagtgtcagtctttaacttttgaaaaaatgccagttaataaaaaggatatataggtatcaagtatccttgattgtgttgtatttaaaaacagtcgtgcgtatgtaaatagttccaaaaatatgtgatagctacagactttttggttgtttatggaaatatatctcaattatagctgttttttataagcctgaccatcatagccaatcactggtattaaaaaaatatatatgtatattatacgtatatattttatatacataaatatacatatatacatatatatctataccttatatacctatattattattctgctttttggtagaaaaggtgtgtgtgtatatatatatatatgtacacacatacacctttaatatatcatatgtatatatacctttaatatattacatatatatgccatatatatatatatatatatatgcaccgttttggggtgtgtgtgtgtgtgtgtgtgtgtgtgtgtgtgtgtgtgtgtgtatatctatgtatatatatacctgatatacctgtatcattctgctttttgaccttatctttgaaaaactttgtcttcttttgtttttaaggatattcacaagaatatgaatagttcgaaatgtaaaatacaaactgctgtagggtagaaaaaactgtagtgccttttcctcagggattccaagcgttgtggccaacactcctatgccaaaagacgttaataagataaaagcataacagaattaatcaaggtattttgtgacatggaaggcttcagaaatgaagacccgaagacccagggaaaactgtatttctgtgcttaagttcgatgaagcatagacaggtgtggagaaatgtgattagacaaaagggtatgatctagtgttaccagattgaggggggaaatccagtgaggcatgtttgttcagattcttctggcctctttgtgcagcattctttcctccaggtacagggcaagacacctgtcacatgtgggttttcaggggagaacagagaaggtcagagagtgacatttcttggttttatggcttgctttgggggagaggagttctagtttctatgacttacctgagagtgtgggtggagaggaattctggtttctatgtcacactttggaggagaaaggggagccggagactggagggtgggagaaggtctgatagacctgcttctaaggtccccccagtctcctccaagtcaaagtactcagcatacaaaggtgccatactttggggtattgtgttctgagttccaacatggcaaacatgcccttttattataaaatggctttggacattttactgcattgccttaaaaaataaccaaggaaatgtgccaacatttataaaatatatgtgtaaataattatatgcattttaatgtttctatcaaaatatagactagtatagataggttttgagtttatcagttgaacactgtcaatcttaaattttaagctgactgtggactattttatcttaaagcattgtctaagagataaaagagtatacatttacaagattactttctaatttaaagggaaaaaagattagtattctcaactttaaatgaaaatcagtagcagtgaggaaatatagtactagctaaaataggcgtcttgcagctcatgacccttgagtttatgcttattatatatgtgaccttagagaagtacctttacctcagttaacttcaatgtccccatctgaaaaataggagttgtgataatgatatatgaattacaagattttttttctgtattaaataagatactatacacaaagggcttaaaacaatatctgacaaatttatttatttattttttttgagatggagtctcactctgtcacccaggctggagtgcagtggcttgatcttggctcactgaaacctctgcctcctgggtttaagtgattctcctgcttcagcttcctgagtagcttggattacaggtgcccgtcaccacgcccggctaatttttgtatttttaggagagacagagtttcaccatgttggccaggctggtctcgaactcctgacctcaagtgatctgcccgccttggcctcccaaagtgatggtattacaggcgtgagccactgcacctggccgacaaatttattcttattattatgcatcatattaaaaattaggctttttaaattttttggtatgcgtcattctctggactgagcatcttaaggacatagaaaccatatcttaatcattttttattgtggcttcatcaattaacactattttatccttaaatgcttgaataaatgattcactgattgagtgaattgtcggctgagttaactataaagtgtgtgagaggcatataaatttaatcactttaggaaatttttagtttcagtattatatgggaaatggcacacacacacatacacacacacacacgcacattgctgagccaaatacatttgaacatagaatgctctatttataatgaatctaaaagtgttaaattatacgtttgattcttttcatttctaagaaggttttgtagatattattaaatctttgtttacgtagttgttaaatatttgcttttaattttagacaacaattggctgaaagaaaagctcatgttatttttaaaaatgttgctttttaacacacatttcctatattacaactctctgagggacaagtgacagaaatctaactgaaaatagttcaaagaaaaatactgactcagtcagtgagcactccagtggtaggactgtcattgtcctcagataaagttgaatccgggagctcagttgatattattagtactttgtttctctctctctgtgtcactctccctcatccccttcttctcttcctgtctctgtctgtctctccatttcttaactgttcatttctctgagtccctgtggtaactttattatctgtgaggccctatctttctggtgattaaaatggcctctggctacctcagacttacatgattcttggtgccccccattttagaaagctccacatttttgtttggtctgattttgatgacatgctttgatcacacgcccacgctggaatcaaccctagtggctaaggggatatgttaccctgattggccagtcttgggtcatatgcccagcactaagataaataatatgttcggcccacccgagccgcaggtactgagaactgtgatctgttctccaagcttatgctgggtaaatacacacacacacacacacacacacacacacacacacacgcacacactcaaatatcacatgttactatgttgatgacactgtgataaaaattggacaagtcttttataagaaaggcaacttgacatattggaaaaatgtaggaggcagatcattttcactcctgtacattttggctatttgctgtcatcagccaagttatataacctttctgagcatcaattacttcactgtaaacataggatagattgtgatgaaaattaaatgatacattatgtaaagaacctaacctagtacttagcacatagtagataatcaatgtatattaaatgtgtaatcactctttgataaaaataccttaggattcagaaaagggaattgaaaagtggggaaggggtatgaaatttaaagaaatactatctgttccctttataaaaaataaactttttaaagaactattctagatatgcagtattattatagttagttctttttaaagaactattctagatatgcagtattatacagttagtttctgtataccctacgcttagttttccctgttactaataacttgcaaaagtatggtacagttgtcataattaatgagccaatatatgttactaactaaagtccacattttattcagctttcctcagttttccttaacattcttcttctgttccaggatctcatccagataatcacattacatttaatcatcatatatcaataggctaaccttggctgtgacagtttttcagattttccttgtttttgaggaccctgacagttttgaagagtactcactaggtattttgtaggatgtccctcaactgggatttgtctttatatgtatattttttcatcagatgtttctgggcaaaatataaggtcagagacttgtcagtcaccttcatccctatagcttagctcattatctgttgcatagtaggtgctgaatacatgtttttctgccaactgaaagaatagatacagtggtagagattactgtttatctagtcaatattctttgtttccttctgccttactgacaagaacatactttaaaaatatatactcaattgtttgttgattgaggtgaaatttgtataacataaaatcagtcattttaaagtgaaacattcagtggcatttagaacattcacagcgctgggcaactaccatctctatctagttccagaatattttcatctacccaggagaagttgctgtacccattaagcaggtgtgttccccatctctcccacttcccctacccccagctcttggcaattaccaatctacattctgtttctacagatttacctattctttatatttaatataaatgaattcacacaatatgtgactttttgtgtctggcttctttcacttagcataatctttttgatgttcatccgcattctgtcgtgtatcaacatttcatttctttttataataaaagcctaattttttttggaatagcaatgaccaagtttaaaactacattccctttcctttggtcgtgtggcactgatgccaccaatgatgtctaggaatcccgataaggcctctaggcaattttcttacagacagctggttcagcctgcaagtaccctgtttgctcttttcccttttccttcttcctttctgaaatacaggtattatggtgagagctatagatctaagcaacataacacaaggatgatggagtgaaaaggtgaaggagctggagtctccgaggacaccatgtagctgccataccagccctgtaatgactactttagccttcattcatgtgaaagagaaatgaacatctagtgcccttaaaaatattagtatagcaattcagattttactatgcattagaaatccagtgaaagctagagacatttcctggccaatgggtttatcataattctgaattaacctatgtaagagaatattcaaatgtccactgaaatcaatgttctaattattattgcccttgtcacccttagcttactattcctgtgttcctagtatggcagaatgaaaaaggctaaaacgttatatctgaaattggaggttgctgacctgtaaaatgagttagttagacaacaatataccattataactccatcttaacacatgttaccacccccttctggaaaataaatccaagatgtctgtagcacctttgtagccctgacggaagagtcaggccctttgtgttgcctgcacattcacttaggagagaatgaagcgtgctaatttgtggagcatataatctattcttttattaaaagtgtatgacaaatggatacagagatacctacctggcatactcatttgcatactaaaaatataatctttatagaagacaaaatagaatacgtccttgagcaaaacagagggaacaatttagtgttggaatggctaagaggttggaataatgatgactaaacttgaaagtgaagatgaaaaagttgagtctgaagggcaatgaaaagccagtgaggatttttaaaaataatagtgtagttggagcaaaggaggaaaaagttattttggtagaaggaacattttctattacgtgaggaaggtaaactaatgaggagactggagcatggagtatgctaatatgtgaatgaaaatagtgagtacattgagagcaaccttaggattgaaaataagcttaaaaatgaaaaaatgaattaatatactgatgtaccgtgattgctttgctttgattctttttttaatttttgagacagagtctcactctctcacccaggctggagtgcagtgggatgatctcggctcacggcaacctctgcctcccgggttcaagagattctcctacctcagcctcctgattagctgggactacaggtgcacctgctaccacgtacggctaatttttatatttttactagagacggggtttcaccatgttggccaggctggtcttgaactcctgacctcgtgatccacccacctcggcctcccaaagtgctgggattacaggcgtgagccactgcacacggccttgttttgtgtgtgtgtgtgtgtgtgtgtgtgtgtgtgtgtgtgtgtgtttgttttgttttgtttgtttgtttttgtaattttagcttcaggaaaaactttctgaggcaaaaaagttaattgggacttaaaaccaaagaccagaataagtcattcatttgaatacatttattgagaatttactatattccaggactctgctaggcattggagattaaattgtgaattaaaaaataaggcttttacccccattgatcttaggttttagtgaaggaaagacagtaaacagataacaagtaaatacttaaagagacagttaatagtgtcacagtttttccaattttagttccatttagcagtaaaaacagaataaaatgaagccacatgtaattggaagagagaggtcaagcatgtaacttttcttgaagatgaatcattcaacaagcatgtttgcatctggtcattagtgatgcgtttgggcagctttgccctcactgtcctcagtcacaagaaaggatggacatgagcagaggaccctgtagaaaaaggcagacatacatgacaatatgaagtatcacttggttgcttttctaattatttatcagtttttaaattgtaaatatgacttagactgcaggctagtatcacctgaattgtctaattatgctaacacgctactaaaaattacgatgttgataatgtgtttctctttaagttcaagtaaacatcattaaaagaagcacaaagcaagtgaaatatgcatggcagagaagcagtataataagggaccattgctaggtcacaggttccaatgttaacagcgaatgaagccgttttcttttttttctggaatagaatttcaagtagatgatgactgaaaagtcgttcttggacagttcagcctcattacttctggaggtctctctcatcagtgcctagtggagatgacaattcctaaactgtctgcaacaagtattaattacttgggtaatcaaaacaatataattgttgatttcttccctgtatttattttataaaatgaaaacagctttaactgtttttctggctgttaaaatacaagctccttggaaaaacctgtaaatgaatagtcaaattatcaataatggttttctcccatggtgagattgtaggtacttttgctttcttgtatttattttccatatttttgttcccagtgagtcccacagggagaagctgagatgccataaaggaaaaattggggctcatgagcaaatagggtaaggacccagaagtggtacaggcctaatggttccctgctttttgttttagcccaggtatccccctttccttgggctaatgtagatgagtcttttcctttgcccccaaagaaccctgctaaaaccgggtggggctacattctacacttgtatttattggtcatcattccacagaaccaagcacacagtagaaactcaagaaataaaatacttgattttattaagtgtcttatttcctgaaagtatgaaataacattacgtggtggagatatggttaaaaacaatatgatcaatttcaggagaaggaaacactccataaagtgcgagtcaacttgatgatattctatgagaaaagattgatttgtagtttttttttacattagaaatctcatatatgtgtctttgtgtgcaatatttatttaaataaaggctaaagattcccaaaaacattagtgagaaactcttcttaattagctttcacttcttggcccacattagtctttctctctctcactttctcacacacatacacacacaccacacacaaatgtaggtaggagagcaagggaggaattccgcattaggacatatcgaaagtagattaatgcaaatgaacaagatgccaagtacagtatgaaaattgacatttatcagcacactctgtatgaagatattttcaaagctttgccatacatatgaaaatattccatttttatgcttatgttttcgttattcaatagcatgcattactttctgttgtttccaaatgcaagttgtaaatctcctcagaaaatttcaccgatgtgagatttcacttagtcttttatggttgggtggatcatttcctttcaaccagaacagtaattccatgtaaaagagtaagaataaattgaaatagaaagccatgttgctttgaaattgaaaaagaaataaattattaattttagtggctttttggccatacttaagttcctattttcatctatggaattatattttaacatcataaacatgaactatgttttatgttcacagaaaagggaaattttcatctagctattcattttacatagctatttgccttgattcactttccttttttaaagtatttataaatttcatacatttttaattagacaaatgatacacacatccattcctattatttaagaaaagtaaaaaaataaaacacacacagggaacatcttaatctcccttggccattactcactctactctccaacttctccagaggtaaccatgttttttttgtttttgtttttgtttttttgaaacagagtctcgctctgtcacccaggctgaagtgcaatggtgcgatcttggctcactgcaacctccacctccctggttcaagcgattctcctgtctcagcctccccagtagctgggactacaggcacatgccaccacgcccagctaatttttgtatttttaatagaggcagggtttcaccatatcggccaggatggtctcgaactcctgacctcgtgatctgcccgccttggcctcccaaagtgttgggattacaggcgtgagccaccacgcctggccaaccatgttttaagaccaggacacgaccaatcagacatttttaatggaaacttgatggattgtttcgtagatcatctttttaactgacagagtatttcacgcttaaactacacaaaagttacatttaatcgtttccttattggtagatatttagaattatccaaatgtttcaccattacaaataatgcttcagttataatccatgaatatgcctcattgtacacataagcaagtatttctctgggataggcactaagaagagaaactgagagtcaaagggtacaggcatcatgaattttaatagatactgccaaattgccctccaaatgtcagtatcgatttattttctcaccagtaggatatgagaattcacagcccctctatcttttggaagcactgagaagagaaaatgctattgacatgttgttgtaatatgcatttctctgatttctcacaagctctggttttcatattcttagtgtctattttgtcttccttctctctgaaatgcccattgataacatttctccatttttgtattggtttgttttatttttcattgatttatagataatattttgtaaattgttcattttaattttgttggattttatatcttgcagatatagtatcttatttatcttctttttactttgcttaggttgttgaaaattcttaaatgtttacaggttaaatgtatcaatctttgtctcatgttttttccccttgctgtgttatttaagaaagccagtatcagactctaaactctggtacatttataggtttttaataaaagcaacttgatttataatccatctagcatttattttgtgaatagtctatgatagaaattgatatatatatatatgtttgtacaaacatgaataatatatgacagtttttcttttaattattaaatcaccttacaaatcaaacaactatggaatattattagcttaactacctgggtgattagcaaaagttttatatttcctttccctatactttttaatatctactctaaaataggaaagttactttctctggctttgagttgtcactaaaatatattcctttttgtttgttaaggccagtcagttcttcgatttgaagcccaaaaggctccaatgaggaaaagattcatttcttctctctttggtgctgttgttaatatcctcactcagatgcagtcaggaatatagtaatgcctgtctcccttataaggaccattatgattacattgggctgatctggctaaacctggataatcttctcatctaaagatccctaatgtaatcacatcaacaatctcccatttgccatgtaaggtaaaacactcacaaatactggggtttagcatgtggacatctttgggaggccattattcttccctccacattgtcaacctctggtccaactcacttgtcatcagtgtaggagtgcctgtggaggcaggtagagtggtaggagttgggaggattcttgattgccttcagctgagcttgaacctgtgctcttagtggagcagtttcatttaaaaggggatgtggctaagcaggcaccataaaatgtacttctagtagcatccctgaattgaaagagtttacatataagactgcatgataaaattaaatgagttacattttgtaaagcaggtagaacaatgcctgagcagagtaggcatcatatacgtatttgtgcttgttaaataaaacccaaaaataatttccacgaggaaaggagtttcaagcagataattaatttgcgaatgtgatatatcctcttgatccagggagctaattgattttgtgaattacatttctcagggtacactaaatcctcactgttggctatcaagaggaaatacaccttgacaggtttctccagtggtggtgaagattgtgtatggattatacacttaattgtcacatttttaatgagaataacagcttaaaatcaagagtgaaacatatacgctgaaaaatggcagtattaattagctcattccatatttattgaacaactacactgtaccagattttacagagcatcagtgataaataacagtccttgtgctcaagccttttgaagtataatagggtgaattcttttgggtttgcaaatacagtctcccccaccccttatttgtaggagataggttctaagacctaccttacccgaccctgtggatgcctgaaaccatggatagtactgaacctgattttgtcaaatggaacatgttttttatcatgtcttccacccacaaatttaatgccttttccatcttaactaagaacttatatactgtggctgtaacttttgcagttagaggtgcaactgcaaaactagcatgcatttctttttctttcttcacaatttctcagatagaaaatttcttcttactgtagatcttagcaaacagtatatggtgattttttttctttcttttcttttctttttttttttttggagagagagggtctctctctatcacccaggctggagtgcagtagcatgatgatggctcactacagcctcaacctccccagctcaagcaatcctcccacatcagcctcccaagtagctgggaccacaggcacatgtcaccacacccagctatttttaaaatttttttgtagttacggggtttccctgtgttgtcctggctggtctcaaactcctgggctcaaccagtcctcccaccttagcttcccaaagtgttgggattacagatgtgagctaccatgtccagccgtttacttattaagttgagaatttttactttttcacttaaaggaagcactttatggcttctctttggcatatccaaattgccagcataactattcttgcattttgggaccctgattaagtaaaatagaggttacttgagcactagcactgtaataccaagacagttaatctgatcaccatgagggctactaagtggctaatgggcaggtagcatgtacagtgaggacacactggacaaaggcatggttcatgttttgggcagaccagagctggacagcatgagatttcatcacaatactcagagcagtgtgcaattgaaaacttaagaattgcttatttcttgaatttcccatttaatattgttggacctctgttgactgtgggcaactaaaaccacagaaagcaaaactgcacgtaagggggactactatacttataatacaaaatgaattacactgtggcccgaagaaaatattaaaacaaagtggtataaagtattataaattagagtaatcactcttgtaaagatgtcttagagtaacaaggtagtatttgaaatgagctttgaccataaaggtgaaaatgagatgggacaccccaggtaaggggttaatattacctaagatagagagagagaaaatccaaacctttaaaataaaacagcttggcagaaatagaggatgttgcacctataattgtagtgagaaagaaaatggaagagttcaatgtaacttttggatcatatctgggtgtaaggagttaacaactcattaacaagtggcctaagtgacaaatagtgaaagctttgactaagatagtaagaatgaactagaaaggaggggctgggtatgagagacattgtgttaaagcagaatccacatgatttagcaactgatttaggaggggagagaggggcccataatgactgctttcctgcttggatgactagaataatgtagtttcagaatagaaacaggaaattggacagatgatgtattcttgtctttaaatgaatggatttaagatgctggaagaattttgagggtgactctttcaaacaagtatttgaaaatgaggttggacattcctgagggagatagagaaagatatttgggagctttagtctaaaataatctcaaaatgggagaggggagactttgtagctcattttgtcctatggactcatcttacttgagttccagccctttccttgtaactgccaaatgtttttctatcctgatttgaactttgagtctatggaggccaaacccgtggccccctggaggttacctcaaaatcactgacatgaggcaaattgatgagtgggataaatggcatacaaatttatttaacttgtatatacgggagccttcagaatgaagacccaaagacacaggggaaattgtccatttttctgcttagattcaacaaagtatagacagccacgcagaaatatgactggacaaaaatgatatgatctaatgctgatagattgagtggggaaacccagcaaggcccatctgtctagattcttcttggcctctctgttcatgtatttcttccttgtgggtatggatcaggaccctctctggaatggaggtcttctgacctatagtcaaacaaggtaagtgagatcatttctttatggccagtttgtacacagataggacagagagaaagttagagtaatatctttaagtttatgagtggctttgggacaaaaggagttctggcttctatgacctgccttggggaagagggattctagtttctatggccagcctccgtggagaatgggatagagagacaggagggtgggaagaggtcaaagaaaaacttttgcttctgaagctgtttttgaggctttcattttggggcattgttttctgagccccaacgagtctatgacatcctgaggcaggcaattctgtttgtaccattcagtttgaaatttcttctttattctgagttgtctaaagttctttccctttgaacctagttctacatcttgggaccctaccctagagcatttgcggttctgtctcacaaaagctcctctgatgttttaagaaagctataaagtccctctttagcctcctcttccagtaacgcagggagtgtaaatggtgctcagcggcagtataatatcttcatgccctcttttgcttgctccctgctagagttttcccagatataaataaattaatagaaaactaaaaacaacttgcataggttctaggctcaattaatctaacatgtgaaattgaaataaaaatccttcacagaaattaatagggtttcaccatagataaatgcctgagggcatatgtccacctctgtcacctctcccgcttccaatgctcctttattcttttataggctaaacatctctacttggcacaatggttcatgtgacagtttccagtcatatcactgtctttggtctaagtagcatggagaagaacaagaccagcccctcccttggtctacatactgttattttatatatatatatatatatatatatatatatatgctaaaatcagttgtgtgtttggatacacccccccccccacctggctcatagacacactgccaccaatgcctgttaatcatctgcagctcgctatgtaaccaagtggaggttcacccttcactgctattatatttcaccttactatccatcaggtcctcagataacatcgttttgttcaatgttgtttcattataacactgatgagaaaaaaaatcaatccccagccaggaccactgtctatgtggaatttgcatttctctgaatgtccgaatgagttttctctgggtactctgttttcctcccacatccaagatctgtgcatgttcaattcattggtgtgtctgagtggttccagtctgagtgagtgtgtgtgtgtgcgtgtgcatgcgtgcacaccacacacacacccagcgatgggctggcatcctggccacagtagatttctacatggcgccctgagctgctgggataggctcccaccacttgtgactcggaactggaataagcaggtaaatcgtgatttacttattttatgaatctttcttaaatgatgtatagctcatatgtatttcaatgtttaatattagaagtacgttggtctttagaagttttgtgatattttatgacaagaaatatgttacaagaacttaaatcttgtttatatcaattagcctatgagaaaattggttgtgtatgaggttgttgcacctaaagtcgcagtttccaagaacctatagatgacattaagtgaggacttactgtagttgaaccttactctaatctgcacgatcatttagatctcaaattgatcatgtttatcagcttgccttttttctctcttgctaagacattgttgatgatgtagaattttaagaaacttacatttaggatagtgtgcttgacaaaacagtatttttccagtttgacattaagttgtcaaaggtctgataaggaattttgggggaactttattgaagtggtatagatgttaaaagtgctttttaaaatgagatgacacttggtttattctgaatttatttatataaaataacactgtcttacgtgttgagaacttagacttttgattcaaaacacccagcatcaagtcctggtctaccatttatagtttatttatgctccctgaatctatttccttaagtgttatatgaggctattaatgccttcttcctaggctattgtgagggtttgaggagacgatgtgaataaaacacttagtaccttgtttggtatataataagtggctgttatttttctatgaaagtctgattacagtataaaatataactttattccctttgcgttcattttcatgccgaaaggttttctttcaatatgaaattggtatttaattgtataatgaatacttaggaagaaatatcgaatgtacatggtaagccttctaatgttttttgtaagaatggattttgatttgccgtacattcttttcattctttgcgtaagcagcaatacttactgattttgaaggtgataaaggccaaggatgtagtctagaaatccatgggcttggtgttcttaacttttgtgcttttatccaagctgccctaccatcatgatctgtaaccttcaaaatccatccctttttataaacagtattccattacccatttgtcatagcttgcctggagtaaagaaggatactgggaagatagtgggcactcttacttcaatgactgaccccttccccaccatttgttctcatcagctgtttttaatgttccattaaatctctcccttgaagttttgatattatttattatatttttcatttctggaagttcaaataattttgttcaaatcaggtaatctttgtagacagacatagaaatatctgcataagctttatgcttatcttttatttctttaacctacttgttttaaaattgctggctgataactccaatattcatagtttcaccacagagagcaatagctgctctctgctctttcatatgattcttgctgtaggtactgtatttctttttgtgtttagttgttttgttttgtttctatttcaatgagctgatcagtttccctggaatgttatttgtggggattctctgaggcctaggttgaagggaattcttgtagagaggatttccattagccttggcaggtgcctaaggtataaccactctgggatcactataaattaaatgaaattcatagcttgaggttttgggggaccatccaagtaataagaatttgtgctgtaaatctatcttaaggatatataaggggtggagatggtcaagtttagttatgtttcattatttttcctgaggatgtagcccttagctttactgggtagaggttctctccaatttgagatttaaccaagcccccaccccccatccccatctctttagcctcctgctaccattaaacctaggctcagactactggaatgtccaggatcagtgtcctcaggaaaaatgtcttcagtgggccacttaaccctttgagctctgattttacttagattttgggcataggaattcctatcttgtgaactatttgataactttagaaaaaaaaaataacccagtgttgttccttattttcagtggaaaggttgctccaattaaccttgcttgccatattaatagaaatagaacttccctgttatttctcacttaggagttttctcaaccagattttatatttaacatttcaaatttcttggcacaattctcattctctgaccctacttacttgctactggcagctttatttttaaactctgctttagcttttcttttctcctttgtataacttatccttcaacaccttgaaatagttaactcctgtgagtgtaataggaaatttacaaaaaataatctttaaaaaccaccagattatttgattgtgtgatccaggaatgaatgcatgtcttagaagaaagagggcaaattgggtgaaataaaagatgttaagcaagaaactcatgggtggaaagagagtattattgagatgattggcaagaccacttaggctgtcagataattaaatgaagccaagaaggggttatgggaaataagctgattacggcaggtaagacaggaaggaatgatggaagaactggaggaaaaggagcacctattaatcttggggaattttatcatgtattcagatttttaaaaaatcaattaatgaacatttgactatagaccatataaatcagggctgattcatagttttcccttttcttaaaactaattagcagatattagctataacaaaggatcttttgacctcaaaagaatacccttggtacattttctcatcaaactaatacttagaaacaatagggaaacaggaaattaatgagacatctgaaactttatgatttcttttcatctggaaatattagggggaaatcaaataaaatatacattttatcatgctgtttttacatcagacttttcccctagtattctttctcatttggaacatgttaatgtactacaaatgaaagaggatgaaacacttgaaaaatttctggattgtaatatgtttaaaaatatatatagttctccatctctcattttctacatttttccagtgttttttttttttttttaaatttgcttagccacgattcattactcattgaggtcctcctctgtccctggcactatggtaagtgttttgtgttttgcatatagtttctcattgaatcctcagaaaacctatgaggttctaattattattgccattttactggcaaaattgagactcataaaaaataagcaaacaaataaccttattgtttataaagtttacctatatttattttgatgtgcgttttaattgttatcttcatatcaagcctatgattttgtcagatactgttattattttttttaatacatgaggacaaagaagctcagagaagtgaagtgacttgtcaaagcttccagtataccgatacagatggtgctttatctcaaagcttctaagtcacactactaattttctacaatgctacacttatttggaagataaacataggatgatgatgatgttgatgacaatgactacttttaaagtggtacaaagcttgagatttagaaaaccattagtatccaacactagttgtatttggtaatacagattctcctctgctcctcatagtttagtgtagcctaccttaaacatgttcagcacacttatgttagcctacagttgggcaaaatcgcttgacacaaaacctattttatgatctcatgtaatttattgaatatgctacactgtagagtacattatccattgtttatccttgtgatcgtgatggtgtggctgactgggaactatgtctcacttctgctgttcagcattctgacagaagatcacacaaatatcactagcccaggaaaagatcaaaatccaaagttcagaatagtatttctactgaatgtgtattgttttacccatcctaaagttgaagaatcacaagtcaaaccatcataagtccaggattatttgtttatatatcttgtagggaagggaaaagtgaaaggaaataatgttctttctacccttctacattattggctggagcccctgtaacaaaagacaaattaacaagagaaaacaaacaggagtttactaacatgtatatctcatatatacatgggtgatacccaaggaaatgagtaaatctcaaagaggtggcttaagaatcagtcttaaatacgatcttcacctaaaaacaaagaaagaagggtatgggggaaaccacttatgggggtgaccaggaaaagtacagtaaacaagagtaaggttttttatgcagatttaagccatttccttcttcattaataagactccagtcttcttggtacagacagaaagagacacccttacaaatgaaaatttacgttataagtgtgaatttgccttacaaaagggtaacttctactttgtttgcagagcttcacatgtgtctgctatttctcaaaataactagttcaaaataatccttatactgaagaggcatattttggggtatcatattctggtctcctacaatcttaatatcaaatgccatagaaataacccaaaggatgggcacagtgtgtgaaaagttctaggaagaatataacaagtagactatataactactaatggcaatctgtgtcccaaccatttatttagctttatcagatatatttttctgaagatacttttctttctcatgtgctccactggttaaaacccagaaatacttgtagcataaagatataacccacaaacagcaatcatttcttttttcttgggtgtcagaaatagctcctttgtaaattcaggtgtgatgattaaagtaaaaacgagcgtgagataaactgttacgctaattatctggaattctttttgagatttttatgttagattgatttaggtgaggaagtatggcatagggccataaaatcagaggaaaaagaccgtatctgtgagttataaataatttttgtattaaaagggaatattcagtatagtacatctcttcaatttctaaaatgtctatagtaatattttaaaatattcacagaagaagttgaagtattattgataaggcttttgaagactattttgttcattaagtaaacagtaaaaaaaaacattttttgttaggtaaattttcaggattactcagaataagaatacttacagatataagggaaaactacctcaaaaggagtttaaagagattatattaaaatatatagtttgtacctaacgattaaaattttgtcctgagctcatcttaaattatctttgaaatcattaactatgtgttctgaaattttattttgggtacaaattgtttgagatggttgtttattttatgtatatatgtattcatgcattaattcatttgttcattcatattttttgtaatcttcagttccttatcatcattggcccaggctagtgctgtttcttcattatatgtgcatatatatgtgtgtacacgtgtgtatccatatatgcccttatacctacgacactaatccctttattctcctacagtgaggcaatcgttttaatgtactcaacgtgtatctttttatttgcacgtgtttttgtaaaatttgtgttgttggtttgtgtgtgtatctttttatgtaaattatgttatatatcatatactgttttctacatctttactaagcactatgttttaaagatccatttatactatatacatacatatatgtatatagacatgcatatatacacacacatatgtatattttgtgcatatatacacacacgtgcgtatgtatgtgtgacacatacacacacacacacacgcacacactcacattctaatttctaaatgcttcgtggttctccatagtgggcatctactacatttgaccctattccctctcccaatatggataaccagttgcctctacatctatacgaccgcaaataatgctacagtgaacatcctctcatgtgtccccttatagatccctgtgagaatttctctgagatatacatgtgggagtggaatggccgtgttataggtaaatatctatttctgtgctttccagaattttgcaccagtctgcactcccactagaagtgcttgaagattcccacgattgctcatttccatcagtatttggcaatgagtagtgttctagttttcgcctcagagaaatgtttaaactattttaaacacaaggttttcaagagtattctagtcactattactctgctgataaacctttattattattcatccaccaaaccaatctcaagaaaacctgtactacatgataatttgctagttatggtgtatgtattgtaaaataataaacttatttccttagaaaaattctttcagatattttattaatactgctaggatttagaattggtgatagtttatcttacattttatttctaatttgctcatagcaaattatattcatgatcaaagaatattttctgtcataattattgtccaaacagtgtttaggttgcacatggaatttaaaagtactcttcagtgagtaaatgacaaaatcctgtttttttacttagaacacttttaatactgtggttcacttttctataagttatactagtgggataggtcacatgcagactaaatgtagaaatataactaggctgtggaattaattagctttgattttgcatttatttgaaaaacaaaaaagaatatgaagaccactgacatatatttccactatttttctttttcaaatcatacaattgagataaagattcagtacttcctccaaataaacagccccgtaatagcagaaatgtaaattacaacacttctaaatctgtttttatcaactattgacctaactttattaaatgtacctaaaaatgtagggctactaagcagctggaaaataatgtattcagtttgtagaggggaaagacacgatacctttcctccgtgtcataaggttcttggctgacactcctataacaaaagacagattaacaagtgaaaagcataacacatttgtttaatcaaaattgtatgtgacacaggggacttcagaaatgaaaactcccaaacccggggaaaacgatgtcattttgtgcttatggttgttgaagagtgaatagctgtgaagaaatgtgactgaacaaaagggtatgatctagtgataatagaccgtggagggaaaccgagcaaggcctgtctgttcagattcttgtgacctctttgtgtagcattccttcttctcaggtaagggcaggaaccccctctgaaatgagggtattcaaggtataaaggaggagagggtgacttttctgggttttatccttgctttgggcaagaggggttctagtttctatgacttaccttggagaaggattctgtttttttataaattgcttcagagacagaaggagggataggagacaagagggcaggaggtcagaaagagaatttgcctctgaggctgcttctgcagccttccaatctcctttggttcaaagtaatcagcatgccaaagcactgttctctggggtgtcattttttgagccccagtaagtaaaagaagaagaaatcatgggcaagaaaatttcattgtctgtgtctctatctctgtctctgtctctctctacgcacccaccccccgccacacacacagagtaacaaattcacataaagaattgtaaagttattgtcaagatattttacttcagtacttaaatattaattgggtacttaccaaaaagcatgaacataaatacatatgtgttattttatatatatattatttataattgacaaataattgtatatagatatggggcacaatatgatgttttaatatatgtatacattatgacatgattaaatcaagctaattaacatatccatcaactctgctacttatcattttgtcacggtgagaacatttaagatttactttttaagcaattttgtaatatacatcaggccgggcacggtggctcacgcctgtaatctcagcactttgggaggccgaggcaggtggatcatttgaggtcaggagttcgagaccagcctggccaacatattgaaaccatccccctgtactaaaaatacaaaaattagccaggcatggtggcacatgcctgtaatcccagccactcgggaggctgaggtgggaggatcgtttgaggctgggaggcagaggttgcagtgagccgagatcacgcatcactgcactccagcttgggcaacagagtgagactccatctcaaaaaaaaaaacaacaatgtaatatacatcgaagaccttcagtctaattaggcaaacatactccaaaagtttattttagcaaaacgtggtttatatactacaataggctagtataaagaaaatatgttcattcagattttttcctcttaaacttatcaatatatctgatgtttttagaacaaattccttactttcattattttagccactactgagaagtcaatcatcaagtcactcatagtttgtctacttagggcctttcaccaatactcagtccctttaactggctacaccaaccaccatcacccttcccaaaaatacaacagaaaataaaataaaacaataattatagctcagtgacttcagagtactatcagtctatcactgtcagtgatttcttaccacttgtgaaatttcaaaagcctgccatgtactatttgtcctgtcaactcataccaggatcgtctgccaaatatctcaacatgaaggctctgtacaattacagacatctccatttgattcctcctctgaaatgtgttatttacatggttttttgtgtgtattttgcccatcattcactaatagtggcttactccaatgatatatagctatcctcccttctttacctagttaaatttcccagatgctcttcataggatccctctcaactattcaaggtctctttctatggtttaagggcttctcataaatgcagcctatcctcattgggtaaactatgggactagttagaggatagcagtaaggtgcatactccagcttttccccccacacggattcagactcatacttgggtaccttctgcctgaaggtgatggtggcagatactttgtaacccctgggttactaaatccttctcaatatttctaggtagccatgttattaccattccatttccacaaagatccctcaagtaccagagccaatattcaaacccagatctgtgggaactccaaatgctattctcatctctatatatgagggggtggggagctcaccaattctcttgacatgccaggagccatcttaccctttattttggtcaattttgttttgttcttcttttctcttgagctaatatttatacgctgattatgtgctaggcattgtgctaaatagtttaattattgcatttcattcccataattttactgaggtgtggctttatgaatgagcaaactgggacttaatgagtttaaataactgacccaaagtcaggcagctaataaatggtggagcttggatttaaacccagtctgctttaccttagcagccatacactaaacctgtaagcattcccaacaggacacatgggtttccatgattcagggtttcgtaaattggttaactgtgtttcttaggatcatgaaaaacctgcaggctttcagatttatttgaattatttttgaccattgagtcacacatggagtggattagttaggaaataattataggagtcagagttaaaataaaattaaatccagattggttataactcacacatttcactcttttatattttagcttccttttttttacataaataccacacatttaatagttttaacttgttattttggtcaaaataaattttgtaacgctgattcttctgttgtgtttagactatttggttgaatcaaggattttaaaatttgagtttaccaagttaagcactaaatcgaagtccaaaaccatatctgctttttatcccagtactttagacaataactagcacatagcagttgctcaataaatatttatttagtgaatatgtggaattactatacatttattattaatttgtacatcaaatgatctttcatcttttccttgaaaagtatttcctcattgaagaaatgctcaaattctgatacatctttcttcctaaaagagtatctttctaaagtccctaagcttttaagggtgctattaaatatatgtaaataatgattaatgaaaaatcaatctaattttaagatagtgatgcataccatctcacacaatgtgttttttcccagcttatgataataaaaaaatgtctctgagatgagaaagcatactgtatctgaaacctagccaaccacagctgacatcctcactgaaggttagctggtgttgactgatgcagggagggtacagatggaacaactgtagagtatagaatctagctctatgcgattttcatcttcctcagactaccttagatatgttagcaggtcaattggagacgggcaccaaaaaatggaagaaatgtgtaagtattaattgaagcctctgctttatgacttcgcattggctcaaacaggtcatttagtgggctcataaccagagtaaagtttccttaggcaaaaggtgcggatacagtcacagatggagtcattaacacaatcaacctatcatataagctaaactaattgtatttatttccataaattacatctggccttcctactacagtcttttgattttctactgagaagtgcatgctaaaaactaccttaaacacacacacacacacacacacacacacacaactttaactttctgcttactttcatttctgctaatattgtactttgtgctaatataattcattagctaaaatattcatttttgtagagactgagcaaaaggatagcagtcttttaaatagaaatatcatacagtatggcctttgtggtcagtatacaagacaaatatccacatggcatttatcaaataaaatttatgtatgtggacattttatttacatgcatatgttggaagaaagccatgtattttaaaaataaaaatgagctgatcattctacaaacgttgcagttgcctattataatgaaattgtgtgttaagtgtcactcttaaatcaatggagatgacatttgcatatcagtttaattgctttggattaaacattgaaagatgagagccaagagagcttattaagctgaaatgagggcaagtgataaaaaagtgatattatgtcaacactacatctggaggtctgttgttgtttccattttaaattctaaattgcagtgtttctaaaaaaattatcatcaaatgccatagttttgaaatatagtacaaaaattaaaacagttaatgcatcaattgtgcttgataaatacaatttgatttgaaagccaagctagggttttctctactttgttgaaatgtatttcttcttaatgtactagattgtaagattttgaaagcttttgaaaaacattatgtcttatttactgctgtatcttcaggactttgacatagtgtgtcctgtaataggtgctcaataaatatttgtgaataaatgagtcaatgcaaagtatggcaacaccttcatagttactgtaaaacactctaagtgagttcctgggtaccgctgattttggttgatgccagaaactgtatccacagctccctaccattcagaagcactgtgtgctcattggccttcttctttgcttgggggaatcatcagtcattattaaatatataaattcctgcaatgatctactttgaagtaggctatgtggactgtggcatgtgtgaagcaatttgattcccaattctgagggtctcctgtaggggtgtttgatttgagactccgcttagaaaccaccatttgtttgctgtgaccacagcatcagaaaactgatgacccatcattatccaacgataatgcagacctctttcatttgcattagagaatttgcatcacttccaggtattccctattgctcatcggagtgatttcatgtttgccagatagactatattgtgttagatcatctaaaacatagccttcaaatttgtttaaattaatccctccattgcagttatattgggggatttattttatggaatatctaagcatcttacaagcattatcttctcaatccttataacaagtgtgtggaaaaagttctatgaaatatcttcattttacagacgagaaaactgaggcacgggaaggttaagtggcatacctacagtatgtggaagagccaggttttgaaattagacagtctggttccagagggtgtgttcttaaccaccgtgctgtgagtaaataggtgcctgaggttcccctaaggtccctgaaaatgaagtattttgtatgccacatctatttcattgttgtttttagcttttaatcatagtacaaaaaaggtaacataaaatttaccatcttaactttttaagtatagagtttcagtagtgttaagtacattcacattattttgcaacagatctttagaactttgagttttaaaaattctatacccattgtacaactcctcatatcccctgtcatatctatttttaagtactatcatcccaaacatagcacctcaatctgatgagaagctatcatactattatcacttcaaatattaataaacagagaaaggagaatttttgtatttgcatagattagtatatgcccagaattcaaaatttagaaaaaatacgaatgcagaagaaatggagttgtattaatccgttctcacatcgctataaggaaatgcctgagactgagtcatttataaagaaagggggtttaattggctcacgattttgcaggctggacaggaagcatagtagcttctgcatctcgggaggcctcaggaaacttataatcatggcagaaggtgaagagaaagcagtcaagtctcacatgcagagcaggagctagcaggggagtgccgcacacttttaaatgaccagatctcgtgagaactctatcactagaacagcaccaaggggatggtgctaaccattcatgatggaccaagcccatgatccaatcacctctcaccaggctccacctccaacactggggattataatgtgacataagatttgggtggggacaaagatccaaaccataccaggagtgatttgaaataaaaagaaatgtcttagtgatttgtcttcctcttgtttctcagtttgaccttggatatttgcagaagaaaacttttctgatgtagtttatctgaatgacctgttcctaaatcatgacttcagaaatatatttttagttaaaagccaagaaaacaaaaagttatatttaatttacttgtttcttaaacacataagtattatgttaacttctgcataaaaataaattctattcaaacattgataaaaacaaaaagtacagttggccctctgcctttatgggttttgcatccatggattcagtcaaccacggattgaaaatatttgggaccaggcatggtggctcacacctgtaatcccagcactttgggaggtcgagatgagcagatcacttgaggccaggatttcgagaccagcctgtccaagatggtgaaaccccatctctactaaaaatacaaaagacaattagccaggcatggtggtgggcacctgtaatcccagctactcgggaggcttaggcaggagagttgcttgaacccgggaggtggaggttgcagtgagccaagattgtgccactgtactccatcctgggctaccgagtgggactctatctcaaaaaaaaaaaaaaaaaaaaagaaaaaatatttggaaaaaaattgtatatgtactgaacatgtacagatatttttcttgtcattattccctaaacaaaacagtgtaacaactatttacacagttggattaggtattgtaagtacatacattggattaggtattgtaagtaatccagaaattacttaaagtatacaggaggatgtgcataagttatatgcaaatactacaccattttataacagggacttgaacatctgtgggtttcagtgtccacaggaggtcctagaaccaattccccacagataacagggatgactgtatagacttttatatatgtatacatatttaaaattctatgtaaactgtagatagaattttaatcagtaaggtaaaaaacacgaatttcatataaatgcatgcaaaattatacaatctacgttgaagaaaataaaaaggactgaaaaagatatttatattaatacatattttcaattcttaattttctttatgtttgccatcatatttaattctcaaaaataaccctatataatagtttgaaatgtgatgtagtaaaggatgctaggaaaatagacttagatgggtggtgctcaggcagagaaggtgaaaggagttcctgggtgagggtcttcatcaacacatagaagtgagggagagcatggcacgtagatagcaccaatcgttacaaatggtcagagccctagatttgtgaatatggaagtggtaggagacagggaggagagataggccaaatccggatcaagaaagatttcctatagccaaataaattaattttaacgtgatttcacatattatagaaatgaaaggaaggggccaggcacattggctcacgcctgtaatcctagcactttgggaagccaaggcgggtggatcacttgaggccaggagtttgagaccagcctggccaacatggtgaaaccccgtctctactaaaaacacaaaaaaattagctgggcatggtgatacatgctattcggggggctgaagtaagaggatcgcttgagcccgggaggtcgaggctgcagtgagccaagatcgtgccactgctgtccagcctgggtgaccaagtgagaccctgtctcaaaaaacaaagaaagaaagaaaataaaggaagaaactaacaggaaaaatacttttttaaaaaagaaagaaatggtccggcgcagtttctcacgcctgtaatcccggcactttgggaggccgaggcgggtggatcacttgaggtcaggagttcaagaccagcctggccagcatggtgaaaccccccatctctactaaaaatacaaaaattagctgggtgtggtggtgcacacctgtaatcccagctactcgggaggctgaggcaggagaattgcttaaacccgggaggtggaggctgcagtgagccaagactgagccactgcactacacactccagcctggatgatagagtgagactgtgtctcaaaaaaaaaaaaaaatagaaatgcaaggaaggatattaattaatcaaaggattgtgtcgtagttagaaatgacacagataaaaatattttatcataaatccctttgctagtgtcaggacccattctgcttccaacttcataatattatattaccttaagttgggggttgatcaaatattaagaagaaagtctgagaatttttctaaggaccccttctaggtccacaagtcagagtagaagtagtttgggataactgtatgctgatagattttgtgtttttaaaaactacttggtaattattttgtcagttattctagcatcaaatattaaaggttctgacagtcgcaaggaagtgatcaatgatatttgcaaatgctaaagagaagatgattaccagccatccacagggatgattcaaatagcaaatatcattatggtaaaaacaaaattttcaacaaaaataactgtttaagaagcacagttttctgatatttttgataggtcaatttttttttttttttttttttttttttttttttgagacagagtctcgctctgtcgcccaggctggagtgcagtggcgcgatctcggctcactgcaagctctgcctcccgggttcatgccattctcctgcctcagcctcctgagtagctgggactacaggtacccggcaccacgcccggctaattttcatatttttagtagagacggggtttcaccatgttagtcaggatggtctcgatttcctggcctcgtgatccgcccgcctcggcctcccaaagtgctgggattgcaggcgtgagccactgcgcccggcctgataggtcattttttaaagtcaccttcaattcgagaaaatcaggaagataacatttttgagtaattttatctttacacttacatataaaatatttttaaagcatatatgcacatatatgaatttattcaagttttttttagggggaaaagagcttgatctagtgatatagtttattaactcactctgttatcttaacatatattgtttagaagctgtggaaatcatgtgtaattagcaaatataatcaaagttattttatatcataattatttattcttcccctgcaattccctgttgtaatttgtttgtttaatcagttcatctaaacttatcatttttcattcatttgtccattataagccatgaaacttttaccttttctctctcttaattataatcttgtctgatgaggacaaaataactgagacagaacagaggagcaagatgaatggcagacagcaggtgcatttgtatattatgaagtgtttgcaaaataataagcaccacatgaataatgcatttgaagaatattgtctggcaaatattattaagagtcatatatccaaatcatcccacaattactgaagaatgaaaaacaaagtgtctaatgcctctggttttgtcagacacagagagaatcaccatatagagcttctaggtagagcaaaagggcttctatttatttttatttatttatttatttatttatttatttatttatttatttattgagatgaagtttcgctctgtcacccatgctggagtgcagtggtgcaatattggctcagtgcaacctctgcctcccgggtttaagcaattctcctgcctcagcctcccaagtagctgggactacaggcgcacgccaccacgccaggcaaatttttgtatttttaggagacaggttttcaccttgttggccaggctggtctcgaactcctgatctcaggtaatccgcccaccttggccacccaaagtgctgggattacaggcgtgaaccaccatgcccagcaccacttattaatagaggactaaaaatttatatatatatctttatacaaatgtatatatctatattttatcatatttatatgtattatttatatatttgtatttactacatatatatgtgtatatataatacagttggccctccatatctgtgggttctgcaattgcagattcaaccaactacatatggcaaatattaataaaaaggatgattatgtttgcactgaacatgtacagtctttattcttgttatacttcatgaaacaatacagtgtaacaactatttacataggatttatattgtgttaggtattgtaagtaatctagagatgatttaaagtacactagaggatgtgtataggttatatgcaaagactgtgctatttttttatatattttatgtatgtatacctagcaaggtaaaatactgacacaattcaaaaaatgaaggaaaacctcagaaacgctttgattcaatgcttgtgtgtatgtgtttctgtttttgtttgtttttgtttgttttgagacaaggtcttgctttgcccaccaggctggagtgcagtggcgcaaccatggctccctgcagcctccacctcgcgggctcaagcaatcctcccacctaaggctgtggagtagctgggatcacaggtatgtgccaccatgctcagctaagtttttttgtttggggtgtttgtttgtttttctttttctttctttttttttttttttttttgtagagacagggtctccctaggttgcccaggctggttttgaactcctgggctcaagttatcctcccacattggtcttccaacatgctggaattacatgtgtgagccaacatgcccagcctctgtgtatgtgtgtgtgtgtgtgtgtgtgttgaaagagagaaaacataaagtaggactcaggattttagagtggttgatatgccactcctcattttgcctcttgactgtcttgctctatgaccactccttggaggtagctgagctgtttgtgttgctagtgttgctgcagccactggctgctgcaagaatctcaactgttctatcttctgttgctgctgctgctgctgctgctgctattgaaaagcagaagacagctgggacctctgctgagggaggctttaccaaatcttttctgggcaaaaccaacctgagatatcatagctgcctgaagctacagaaaacttctgactctggtgagattaatgagaacagctttatgagtccttcaggcctgttcttgattgcttgaaccttgtgcagaaccctgtggccttggctgtggagcatgagaagttgtgtgttgctgaaagtattgttgcagaatcaactgatggagcggcagaagcagcagcagctgctgctggatgttcaaaatgagggaaccaagtggaagctggagtagagttaatggcctgagacctgaggtacttaaaaaaaaatgctaaacacacctgattgaaaaggtgcctgcattctattggactgggccatgcatttggtagcatacctcctgaggaccgagggccactccctttgattctcgaaggaaatggggcattaacagtacagcccagcatggggtttgaaccactccccaaagcccaggctccgcagactgggcccactacattgatgactatttggacagttgagtttgccattacctaggaggctgggattgtttttgaggagttggaggagaccaggcagtgtgggggaaactgaccccatgattcaagtatctccacctggccccacccttgacacttggggattattacaactcaaggggattattacaattcaagatttgggtggggatacggcaaaatcatatcacttagctcaggagaaggtggacaatgagacagctccagatcctaattcagagaagatgtagaatatctcttgcagcattatttcactgagcctgtattcaccttttgctttttataggctgatcatttcagaaattctccctacctcggactccttgtcatgtggtccttatttattcgctgtctctcctgagtttggctagctcatgtcgtatatgttgttgtttgtccttttttatttagagttttaaaaatttatgattcatggtgtctttccaactttgcaatggcttatttaagtataaaatttatttaaaaacaaaacattaaaagttatgagtgaataagaaccagaaaaaattttttcgtaaatttccttttagagtgtcaaaatacaatttttctctgttttaccttgtgtgtggatgtttatctgtgtattgtttttgcaatgtttttatctgcttaattaatattcggctattggctttttttttctcagaacagtaatagaagatacgtttttgaagtggtaggatatgaagatgacatagcttacttaatttcatagttcaagaccagcttcttttgttgccattatgacatgaagtattttttttattgttaactgttgttattggtggtggtggtattttaaataaatagtacacttttccacaagccttgcgtctcctgattctttgacactcttgggtcattaggatccttcaactttagtctgttcttttttttttcccttagccataagtcttcaaagaatacatttcttctcaaaagtgcttccctgttcctaaaaggagatgtttacttctggtcctaaattctttttatgctcctttcttttgattgcccacaaccagtgctctaatctacctagtttcaaatattatctcagtatttcccaatccagcattgggcctcaatcacctcctacaaattattaagaataagaaaaatacctccggaggaaaattaggtcaaaataaatattcattaaaatatataaataatatttacatatatgaaaagatgctcaacctcacaataatagagttgcaagttaagactaaaataaaaggctatatttttgtattttctttttctctttttccttgtattattatttttatttgacacatattaattttacatatttttggggtagagtgtgatatttcaagacatgtatataatgtgcaatgatcaaatcatggtaattagcatatccatcacctcaaacatttatcatttcctgtgttgggaacattcaaaatctgctcttctagctatttgaaaatatacaataaattatttttaattatagtcaccctatagtgcaatagatcactagaacttatttctcctatctaaatgtactttttttttttttttttttttttgagacagagtcttactctgtcgcccaggctggagtgcagtggcacgatcttggctcactgcaacctcctcctaccaggttcaagcgattctcctgtctcagcctcccaagtagctggaattacaggcacctgacactatgcccggctaatttttgtgtctttagtagagacgggatttcacaatgatggccaggctgttctcaaactcctgatttcaggtgatccacctgcctcggcctcccagagtgctgggattacaggcatgagccaccgtgcctggccctaaatgtactttttaaaaaactaaacttagatacagggggtacgtgtgcatatttattacatgggtatattgtgtgatgataagattggggtatggatcccatcacccaggtaagtgagcatagtacccgataggtagtttttcaaagcacactctgtccttccctttccctctagtaatccacagtgtctattgttcccatgtttatgtccatgagtgctcaatatttagctcccacttataaatgagaacatttggtatttgattttctgtttcttcattagttcgctgaggatattggcctctagctgcatccatgttgctacaaaagacatgatttcattctttttaatggctgcatagtattctgtggtgcatatgtacccattttctttatccaatccaccattgatgggcacctaagttgattccatgtctttgctattgtgaatagcatggtgatgaacatataagtgcatgtgtctttttggtagaatgatttattttcctctgggtatataccaaataatgggattgctggattgaatgttctttgagaagtctccaagctgttttccacagcagctgaactaatttacattcccaccaaaagtgcacaagagttctcttttctccagagcctcatcaacatctgttattttttggcattttaataacaaccattctgactggtatgaggtggtatttcattgtggctttgatttgcatttctctgataattagtgatgatgagcatttgttcatatgtttgttggttgcttgtatgtcttcctttgagaagtgtctgttcatatcctttgcccatgtttaattgagttatttgttttttgcctgttgatttaagtttcttatagattctgaatattagactttcgccaaatgcatagttgtgaatattttctcattctgtaggttgcctgttcactctgttgatagtttatgttgctgtgcagaagctctttaattaggtcccacttgtcaatttttggtttcgttgcaattgcttttcaagactttgccagaaattatttgtcagtgcccatgttgagaaggctgtttcctaggttttcttctagaattttcatagtttgaggccttacatttaagtctttaatccatctggggttaatttttgcatatggtgaaaggtaggggtccagtttcattattctgcatatggctagccagttatcccagcaccatttattgaataggaagtccgttccccattgcttttgttagccccatcaaagatcagattgttgtaggtgtgcagctttatttctgagttttctgttctattccattggtctatgtgtctttttttttttttttttttttttgtaccaatacatgctgctttggttactgtagccttatggtatagttcaaagtcaggtagtgtgatgactctggctttgttctttttgcttaggattgctttagctattcaggctctgttttggctccacatggattttagaatcgtttttctaattctgtgaaaaatgacacttgtagtttgatagaaatagcattgagtatgtaaattgctttgggcagtatggctactttaacaatattgattcttccaatccattagcatggaatgttttgcatttatttgtgtaatctcttagttctttcagcaatgttttttagttctccttgtagagatctttcactactctggttaaatatattcctaggtatttttttgttactactgtaaatgggattatgttgtgatctgattcccagcttggatgttattgatgtatagaaatgctactgatttttgtaaattgattttgtatcctgaaactttactgaagttgtttatcagttccaggaggcttttggctgagtctttcggattttctaggtatagaattatatcatcagaaaagagagagagtttgaattcttattttcctgtttggatgccttttgtgtctttctcttgcctgattactctggctaggacttctagtactacattgaataggagtggtcagaatgggtatccttgtcttgttacagtttcgtgggggatggtcccagcttttgtccattcattgtgatgttggctatgggtttgtcatagatggttctcagtactttgaggtatgttccttcaatgcttagttctttgatgttgttgttgttgttttaatcaggaatagattttggattttatcaaaagctttttccagttcaatgaggtgatcatatggtttttgtttttaattatctttatgtggtaaattgcatttattgatttttgtattttgaaccaccttgcatcccaggaacaaagccaacttgattatggtgagttaagtttttaatttttcatttgtttttattttttttaatttttaatgttttgttgtgatgacctctctttttaattttttttttttttttttttttttttgtgacgaggtctctttgttgctgaggctggtctcaaactcctggcctcaggcagtcctccctcctcagcttcccaaagtcccgtgataaaggtttgagccacaatgcctggctgtttttaacgtgctgctggatacagtttggtagtattttgttgagaatttttgtatctattttcatcagtgatataggcctgaagttttctttttttgtcgtgcctctgcttggttttggtagcaggctgatgctaccttcgtataatgagttagggaggggaccttcctccttgattttttgaaatagttccagtaagattggtaccagttcttctttctacatctggtaaaatttgactgtgaatccatctgatccagggctttttctggttggttgctttttttttttttttttttttttttttaacattgaggaggttattttattttattatttattttttgagacaggttctctctgctgctcaggctggagtgcagtggcacaatgggctcaagcaattgaggagttcattttaaatgtatagtgtaatccacatctaagctctgtttgcagaatgagaggttgatgaaagaaagctcaatgaagctgcagagtcttaatcttgcttttggccgcaccagccctggcaggacctcgttcacaaagacagagaattaacatttgtcgaatgaatgaaggagatgccgtacaaagattgtatggttcctttcagagcctaaatatttaataggtgggtcactgagggtctgaactagaatatttgataagcagacatccagggttgagtgttagatgttctgcagggagatggatggaggggtacctacagggttctgcaagctcagtaatagatgttgttgaagaagaaatataagttagagacaggacaggacacacagagaatgcacctctttggggtcaataaaaaaagggaatgagcccagaggaagcactcaagatcagttgcaaattgatatcccaaatgttttggaatacttctaggaaaaaactctcctacatttcaaagtccagataatactgactccaccctctggcacagaggacttctatggcaacatagcacaggagtggtacatgaaggcaaagtccatttgtcttagctcatatcaaatggtaaagcagagcttcttttattttaatttagctattcaagctgctgaagctatacccaaaatccctagccctttctctgatatgagtctctgtgtttccatattgggagcaatttttttttttttttttttgagatggagtctcactcttgttgtccagactggagtgcagtggcatgatcttggctaactgcaacctccgcctcccaggttcaagccattctcgtgccttagcctcctgagtagctgggattacaggcacccgccgccatgcctggctaggttttttttgtatttttagtagagacggggtttcaccatgttggccaggctggtctcaaactcctgacctcaggtgatctgcctgccttggcctcccaaattgctgggattacaggcatgtcccactaggcccagcgcaattgttttttataactagaaatgtgtttggctttcctccaacaaaccaggaaggtcaagagatatgttctagatacctctttgtggttgcttaatgcagagctcatgcagacacatctgcaaacctaaggaaacgaccctctaaggactggttagccacttaaaatgtgggccaagataggctattaaattcgaatcctcactgcttcattacagcttcctcacattgttagcctacaaactaagttaaggacacacttaaattccagaagttgatattagtctattcagagttttaatctcttcttgattcagtcttgggagattgtgtgttttcaggaatttatccatttcccctagattttctaatttgtttgcatagagttgttcatagtagtctctgaggatcttttatatttctgtggaattagttgtaatgtcatctttgtcatttctgattgtacttatttggatcttctgtttttttctttgttaattaagctagtggtctatcgatcttgtttattctttcaaagaaccaactctcagttttattgatctgttgaatggatttttccatcttagtttcatacagttttctctagttttagttatttattttcttttcttctcctagttttagggtttgtttgttcttttatttcctagttcatttaggtacaaagttagatgattgttaatttgagatctttctaacttcttgatgaaggtgtttatcactataaactttcctctaaacaccactttagctgcattccagagattttgataagatatatcccgattttcattaatttcaaagtatattttggtttctgccttcatttcagtgttcacccaggagttattcaggggtaagttgtctaatttttgtgtatttgtatagttttatttttttttttagaaagtgtctcactctgttaaccaggctggagtgcagtggcatgatcatgggtcactgcagcctcaatctccccaggctcaggtgatcctcactagccacccagatagctggagaactataggtgcacatcaccattcctggctactttttttgcatttttttgtagagatggggtttcaccatgtcacccaggctgttcttgaactcctgggctcaaacaatccacccactttggcctcccaaaatgctaggattataagtgtcagccactgtgccctgcttatttgtgtcgttttgagagaccttcttgatagtgatttctatttttattgtactgtggtctgagagtgtgcttgacatgattttgattgttttgaatttactgagacttgctttatgactaagcatgtggtttatcttagaatatgcttcatgtatagatgagaagaatgtatagtctatggttgttggatggagtgttctgtagatgtctgttaggttcaattggttgagtgtcaagtataagccttgatgatctgtttatcaccctgctgtcagtgggtattgacatctcccattattgttgtgtagctgtctcagtctttttgtaggtcaagaagaacttgttttatgaatctgggtgctccaatgttgggtgcatatatattaaggatagttaaggcttcttgttggagtgtaactgttatcattatgtaatgcccttctttgtccttctttattgttattggtttaaaatctgttttatctaatacaagaatgatgactcccactgtcttttgttttctgtttgcatggtaactctttctgcatccctttactttgagtctgtgggggtgtcattagatgtaaagatgggtctcttaaaaacagaagatgattgagtcttttatttgtatccagcttgccactctatgtcttttaagtgggacatgtagcctatttacattcggggttagtattgatagatgagattttgatcctttcatcatgtagttagctggttgttatgtagacttgattgcatagttgctttttagtgtctgtgggctatgtgcttaagtgtgtttttgtggtagcaagtgttgttctttcaatttcatgtttagcattcccttaaggacctcttatgaggctggtctagttaaaactaattccctcagcatttgctcatctaagaaagatcttttttctccttcacttatgaagcttaatttggtaagatataaaattattggttgaaatttattttctctaagagtgctgaaaataggctgccaattttttctggcttgtgagtttctgcatcaaggtctgctgctatcctaatggagttccctctgtacatgacctgagccctctctctagctgcctttacatttttttcttttggattgacctttgtgaatctgatgactatgtgccttggggatggtcatcttgtgtagtatctagctggagttccttgtatttcctgaatttgtacgtcaacttctctagtgagattaagaaaatttttgtgaactatatcctcaaacatattttttaagttgcttattctctcttcttctctctcaggaatgccatattggtcatagatttggccactgcacataattccctatttctttgaggttttttttttttttcattttaaaaattattattttttctttatttttgtctgattgagttgattcaaagaacaagtctttgagctatgagattcttttctcagtttggtctattctgctattaatacttttgattttattataaaattcttctagtaatttttcagctctagaaattcagtttgattctttcttgaaatggttatttatctttcagttcttgcatgattttacttgattcattggattccttggattgggtttcaactgtctcctgaatctcaatgagcttccttgccagccaggttctgaattttatgtctgtcattttagtcgtgtcaggctgtttaagaagcattgctggggagctggtttgcttatttggaagtaagaggatactctggctttttaagttgctacagttattgcactgattctttctcctctgggaggactagtgttcttctatctgtggtgtaagttgggtatagttggttgtctttgtttctgcgtgttttctgagggtcaaggttctgtataatgtctttatttatggcttaattcttgcccatggtttcacaggaggatatattagcaaaatgtttttggtgctgtagtttgggctgcaatcctgtagatggtacataggaataacggtcagtagataggctcttactcagctgtgcagctcctgtgtatttccttgcatttgcagccatgctctgtggtataggggggagaagagatgacctcctcaccaggcctgctcctgggtcttaggaaacccctctgattacttccaccatgcccacatttattttgttaggtattctgggccatgggcctcccttgggcagaggctataacatggagatagactactccctttctggactggccttgcagagggaggcatgcctcactcccatgccagtccatgaacccatgtgtttcacccatttcagtgctgtgagagtgggctcctcccccactagagtgttgcatacagatctcagcttagcattcccgaactgtgcaccacagccttggggcaccaggactggctcgcagctctatcctctagacgttcagggttggtttctgggtgcactgggaaatccaaagtgctcccaggctgctgtgaatgtactcaggtgaagcaaagcatccaggctgggcagcataggctgtgccatgtatacattcctgtgtgggggaatggggggtatccaggtagaggctctgggaagggcttttgggcaggagagcctgcgaagtagacataccctagtcctgcaggaaagccagccccactttctcctggcctggcagtcagttgggcctagagattctcagaggaaaatggggatccctgtgggatgggcacctacctaaggccatgccctactggagctctcccacacagaaaggctcctggctttgcaccagctgaagcgttgtctctacctactctctgggtagattcccctgccagctcaaatgtctgtgggggacatggaatcccctgtagctaggatcccagaggttcacagtgagagtgggcagtcccacagcttctttactcacccctttcccaggagccatttggagccgaaaactagccataacgttcaggtaccttatacacggttcccagattcctctctcttcagcctcagtgcctgcgtcacatttccatccactcttggcatttttctctccaaagatgtattcaaattatgttgctttacttaacattttggtccctcttggcgggaacagtgctttctagctgtgtctagtaagccatcttgtcccacttcctagctgtatttttttttatctgttaaccatcctttggctatccctctcccttccctacccttccctgcctctgataaccactattctactctttacttcatgagatgtattttttagcttccacatacatgtgagacaaatataagcggtatttgtctttctgtacctgacctatttcacttaatgtactccaggctcattcatgttaccatgaaagacagaattttgttctaaaagaccattcttttttttttttttcctactagattactgaagatcggaacatttcatagcttatcatgttagctaatggtgtggggaaacagacacactcaaatgttgttgagggtttattttgtgtttttttgtttgtttttgagatggagttttactcttgttgcccaggctggagtgcaatggcacgatctcagatcactgcaacctccgcctctcgggttcaagtgattctcctgcctcagcctcccaagtagctgggattacaggcatgcgtcaccacgccctgctaattttgtatttttaatagagatggggtttctccatgttggtcaggctggtctcgaactcctgacctcaggtgatccacccgccttggcctcccaaagtgctgggattacaggtgtgagccactgtacctggccattgttgaaggcttgtattggtccaattcctatggataacaaagaaactaggaataggatttaccttcaaggtttttgggaatttctcaccactggcctatagtctcattaaaaatctactactttttaaaccttttaaaaataaatgcaatatttaccttgttgctttgtataccacctgcacaccagtgttactggtcagtggggcagcactactacattccgagtatcacttggtaacatgagagaattcaagaggaaatgtatagcaaggacaaaatcctaggaaaagtctagcatttatgaagaaagaagagaatgaatagaggcatattacaatcaggaatagacttactaataaaatttcaagaagaatgggagtaaatagtattaaatgccatggagtgctcaagccagttaagtattgagccagtgaaactattgaaaccatgtaattgttgaaaagtaggtttttgatagccttagtaacaacattttctgagaaatagtggagaaaaatcagaacatagtagaaaaacagatgagtctgtgttgagaaagtaaagagagtagcttagactgtcctgaaaagtttttgttagtgttgagaaagaagtgagttacaggttaaaatagaggacacacacatgcatacaaaaaaattaatagctttgtgtaaaatctctcaataatgcaataatagaccaggtaaatacaacataaataatgatgttaccaataatgtaattttggaatttttggaattgacataagctttcatggagatttttatatgataaatgaaaaagtaacatacgcaaaagcctctattcaaattaatgacttggctgggtgaggtagcacatccctataaccccagcactttgggaggccgaggtgggaggattgctggatccctggaattagagaccagcctgagtaacatagggagacctcatctctacaaaaaaaaaaaaaaaaaaaaaaaaaaaaaaaaaaaaaacttagctggacatgctggcatgcacctgtagtcccagctactcaggacactgaggcaggaggatctcttgagcccaggagttcaagaacagtctgggcgacatggagagataccgcctctacagaaagtaaaaaaacttatccagatgtggtggcacattcctgcagtctcagctactcaggaggctgagatagaaggatcgcttgaacccagaaggttgaggctgcagcgagccatgattgtgccactgcactctggcctgggtgacagagcaagactgttgccaaaaaaaaaaaaaaaaaaaatatatatatatatatatatatatatatatacatatacttatgtgctttgtacattatagacataataaatggtagataatgacatcagtaaccacaaagtcaaattatacagcaatacttcatgtaattttgattccaaataaatccatattagtaaaagaaagccaggagcattgtaatagcttttgtaaattagccaccaaggtagtcaatttacagttgtatttaatagactagtgaacagaagggttttgagagtgggaatgattacaatgctgttgcataaattggagctttaggaaagcactgaaggaaatggtgtccagttaatcattaagatattcttcacgtgcatatgaagaataatttgggaaaacttgacattcagataagactgaatataattgggttaaactgcaataatacatacatgttctctattttcttgctattatcataatgtacttttaaggaagaggcagatattgtaactgaaaatcatggatacagtaaagccatttcagttctttgttacagttgtttcctatgagaagaacatgagaaatgatcttatagtattgacagaaaaggagtgttgacagctgactgttgcaaagcctccagtgtaattattccacctcccctacggccagggatcagtgtttttcatatgacccatacttctgaaaataatgaatttcaaaatgtctgttccatgtacacagttgttgacatacacaaatatttagctatctagttctagaatccccttggtgtttcatccatctgaaactgagaaaagagagcagagtcagtaacagataagccctcgttgctgttttatttatgtatttgtttatttatttatttatttatttctgtactgctgcatctagggatgccttccactggatgcctctgtgtcaactgcagctctttcaggcaatactatgagacaagattaactgaatttcaaatgtatgagactccactcacagaaagggtgttctattcatactgaatctttctataaaaatgcaaaagttggatctggagaacagaaaaaggaagagagctgcattcacagtaggataaggagattaaataggaagagttatgtgatttatctcttttatgaggtgctgctggaaagcagattaagctttttaaaaagtggtgaccttgatataaatttcatatttagccagtgctgatggattttgaataatgaagggtatgtgcaacaacactgagcctgagaagatgcaagaaatgtagtgaagttgaccataatctgagtgctaatacatcactgcaaacaacagtaacaggaataatacctattgtgtagcagtttgcccattacaaaatacattcacaccaggatgctatttacttctcacaataactctatgagattaagtatccttagaatttgatgatctggtgctgaagttcaagaaagatgttacttgttcatagtcacacaacttgcaaataaattcctctccctgtgaaaatattctcttcttatattcattgtcacattcggataaagattggacccacttgtattttatttctaacacttttaatcatacctctaacataactctatggtattacattctgacaactgaaatgtaaagtgttttatttctgcattgtctctgttgacatgaatccttaatataatgtcatattctgagcatgtttatgtttataaaaaaatacaaatcattaggccattttctttttccaaaaatgaccggttattgccgagtaaagttactaggttgctggtattcaagccattcgttattttaatgaataataggtaattcagattaatggatttccattctagcaagaaatctctaaaaattacatggacttgaactgatattaaaattgtatataaaggaatggaaaggaaaccaactgtgaaatgtgtccaaatcatatagaataaaaaagttcccttccccaaaaacctaactctgcttttaaattctactaattcacagtgtaattctgctctttccttttttcctgtttttggctttagatacataaataagaggctttaatcatagaaaggaagctggaaaagtaccttaacttattacatttaccatgtttgaacactgttatttgtaatatttgcaaatgtacaactatataatttgtttatctttttcttttacctcatgggagacttctaggaatttatatataatgtggattaaacacttagactatttgttccctaagctactgtattggccaggacctagtcagttaaagcaaattcattccagatagttcagtagaagaaacttaacatgggaaacaggatatcaatatgctagaagagctgaaatgacccagaggttagcaacattaggaaaccactaccacccctatatatgaagggacaaagagaagaaggaagtcatgttaccagaacccagaaactgaaaggatagatcccctcttgtaaaaattcatcaccaatgccatttgtgaggagaaactgggaaattgagaaactacgtatgggataaagtggtaaacaaggcagataagactccctcatgcatgactcttacaatgttatggaggagaaaatatataccaatataaagaaagaagacaaagaaaagatcagttagtgataactgagaggataactataaatataaaactgagtgtatgaaaaaattatgagatttattcttgtggattatttttgcattaatttaatttttgaatattgcattgaaatattatctatcttaactagtgagtttatggcaccccctcattcaactcatgctagttccattggggtaagcccatgatgtttcaaaggactttcagctattttgcttgagcaattcggtggatggtgtagtatatgtcacaaataaatgaagcaactttttaagatttcaaaaaggcataataaatagacatttgaatatataaatctagaattcagagctggagatacaaataaaggagacacaacatagaaatggaatttagagtgagagggttaaatgagattacatagagggcaatgaaatgagataatgcattaagtctttttgaaatgatggcttaaatgaaatataattcatatatcatataattcacccatttaaagtgtaccattctaattttttttaactgtggtaaaataccacacaattgaccctttgaatcatttttaagtataaaactagtggcagtaattacattcagagtgttgtgcaaccatcaccactatctatttccgaaattttccatcatccaaaatagaaattatttacccatgggcgcagtggctcaagcctgtaatcccagcacattgggaggccgcagtgggtggatcacctgaggtcgggagttcaagaccagcctgaccaacatggagaaagcccgtctctactaaaaatacaaaattagccgggcatggtggcacatgcctgtaatcccagctgctcagaaggctgaggcaggagaatcgcttgaacctgggaggcggaggttgcggtgagccgagattgtgccattgcactccagcctgggcaacagagcgagactccgtctcaataaaaaaaaaagaaaaagaaattctttacccatgaaacactaactttccattccttcctcccaccagctcctggtaacctctactctactttctgtgtctatgaatttacttatcctagggacctcgaataagtttaatcatacaatatttatccttttgtgactgactgatttcacttagcctaatgttctcaggtttcatccatgttgtatcgtgtatcagaatgtcattgctttttaagtctgaataacattcctattgtatgcatataccacactttttaatcttttcatttgttgatggacatttgaattgtttccaccttttgggtgttgctgctatgaatattggtgtacaaatatctgtttgagtcccttttttcaattattttgtgtgaatacctaggagaggtgttgttggatattctatatttaacattttgaggaactgcgaaactgttttctacagtgactgcaccaatttacattctaccagtaatacacaagggttctaatttctccactccttgccaatacttgttgtccaacccccaacacactttttaaaaattttttttaattattgtcttttgagacggagtctcactctgtttctcaggctggagtacagtagcacgatctcagctcactgcaacctccgcctcctgggttcaagcaattctctgcctcagcctcctgagtagctgggattacaggcgcccaccaccaaacctggttaatttttgtatttttagtagagacggggatttcaccgtcttggccaggctggtcttgaactcctgacctcgtgatccacctgccttggcctcccaaagtgctgggattacagatgtgagccaccgttcctggcctacactttttattttttgataatacccatcccagtgtttgaggtggtattgaaaggtaaagctttctatacaatatttcttccttccccagtttgcctctcaataggatataaactccataaaatcaagtactctgtttattcactgctttatccccagccaggccacgcatatagccattgctcaatacatgtgttgtattgactgagtgaatgattttttttttttttttttgagacagggtctcattctttcaccaggctggagggcagtggtgtgatcttgtctcactgcaacctctgcttccaaggctcaggtgatcctcccacctcagcctccccagtatctgggactacaggcacacaccaccacgtctggctaatttttctattttttgtagaagtggagttttgccatgttgcccaggctggtcttgaactcctgggctcaagtgatctgccaacctgagcctcccaaagtgctgggattagaggcatgagccaccctgcccagccgtgaatgaattttaaatgctcagtaagtgagagttgtattcaattctttaataaataatatcatatatttagtcttatattacattgcatcgccattgctgggcttagtgttttctttttgttttattttgttcttatgaaacaacatcctttttgaattggaaatttaaggaaagatatgctgcatatacatagaatgaaattatttcaaaccatgacaggggaagaggagatgaacacgggatgaaagagttgaaaaatatgaaattaggaagtggtgaagaaagtcaagtaaaatctcatgtcctgccttcaaattagagcatcaagcaggtgctatgaacatgtaatttgagggaagtgcctgtgattctcttcttcagggagcacttctggtttgcgttttcattttctctagaccttttatagatgaagaatatcttgtttttccagatgcagatagtctgttatgttctgtctgtgtctgcagagtatggacccatttctaaatgtgctgagttcaaagatgtcactttttatacgaaactctgatcatgagttttggtaaatattatgaccaccttagaaaaagctgcctttgtaaagcttggagaacaaaaagtgatgtgcaacttacccaaatgtgactcacacatttatcttccctatcccttgtctttcacatcgagaatgtcaactatggttagaagaaggcctgttgtgtgtaggatgaaataagaagatcatcaggtgattgtgtgtagcttttcagtgcagagtatctttacaactctatgtcaattttttgccgggcatggaagacacatctgtttgccgtatatgctatcaaggaatatgtgttatttatagctgggcgcagtggctcatgcctgtaattccagcactttgggaggccaaggtgggtggatcatttgaggtcaggagtttgagaccagcctggccaacagggtgaaaccccgcctctactaaatatacaaaaaccagccaggcgtggtggcaggtgcctgtagtcccagctacttgggaggctgaggcacgataattccttgaacgtaggaggtgaagtttgcagtgagccgaaatcatgccgctgcactccaggctgggcgaaagagcaagactctgtctgaaaaaaaaaaaagaaaaaaagaaatatgcgttatttcaaaaccccagaaaatgaaagatggcaaaaaagtagtatggttgagtttaggtgggagttgtttagaaaggttaagccaaaaaaaaaaaaaaaaaaaaaagcaatcagaactttgtagctattagctaatagttcattcatttattcatgtaatatattgagagtacctcctaaatgcctggtactgtactaggcacttaaggagatcattaggcctttgaagtctttagcctcaacaggtcatcagtgaacaaattcctgtaatgaattaccatccatgtgtcaacagaaactgaaatgttcagaaaaggagaaagagtttaagagattaaaaaaaatatatatatattcctggtccctcaaaaagttaaaccatatgacccagcaattcaaattctagatatataccgaaaagaattaaaagcagggacttaaatatttgttcatgcatgttcatagcagcattattcacaatagctaaaatgtgaaaacaaacccaaatgtccaataagcttatgattggatacatggaatgtgatatatcatacaatgggctaatgttcagccaaaagaaaggaatgaagtactgatgcatactacagcgtggatgaaccttgaaaacattatgctaagtaaaagaagccagatacaaaaggctacatttatatgatgacatttatatgaaatatccagaataagcagatccatagagacagaaagcagatgggtggtttccagttattgtagggagagaggaaagaagaataattgctaatgggtactagcttttctagtcttagaactagatagaggtgatcattccaaatcattatcaatgtattaaatgccacttaattataaactttaaaatagttaatggttcattttatgttgtgtgaattttacctcagttaaaaaaatgtgtgtctaagaattcaaacagcatacagcttacttctttattttacatattatgagaagcatacatattaatagtggatgtagcaaaatgaggataaatactgtaattaaaaattgtgattgttggccaggtgcggtggctcacatctgtaattccagcactttgggaggccgaggcaggtggatcacgaggtcaggagatcaagaccagcctggctaacacggtgaaaccccatctctactaaaaatacaaaaaattagccgggcgtggtggcgggcgcctatagtcccagctacttgggaggctgaggcaggagaatctcctgaacctgggaggtggaggtagcagtgagccgagattgcgccactgcactccagcctgggcaatagagcgagactccatctcaaaaaaaaaaaaaaaaaaaggttaaaacggataaagatcaaagaaatcagccataggccctgaagaaattatatgtaatgtatgtaatcttgaacccatgtcctgggcctcagtttccctcagtgacatggtttttacttcttctccctcttatcttttcccttactcttggaatctacagaggtgaagtttgaaagtgttcatgtccaagaataactcagacagagaaatactggactagaattgtatatgcctaggccttctcaattctagtattccaggaataataggttagaaaaataaaaataggaaaattatattgatcactttctactaaaaaagagaagacaattatcttgaatttacagttagcaaaagactgtaggtggagttcaattcaccagttcaacaaaatgtttaaaaaagaatttcaaatgagaaggcagtaaactggcatttttaggttttaagcatctgctcaatggtctcattctaatcttttcaccaagggctgatttcaaccagggttaaatcaataggccctccagagctcttctgaaaagaaaaactaatccaaacaaatctctcatttagtattagtagctacaaacatactgtgtttaagaaagataagatataagagagggacacatgcatagcttcaggcattaccataaagactgacagaacaataaaaaaggaagaaaatggaaggctttaagattagaaataaactttcaaagtatatttaaggtttaacaaactctaagatgctctttccacaatctaaccttgacactttttgattcctaacactttatgtttacaactaatgattagacacgatggtcaaatttctggttgagaagctgccttccagacagttcacttctgcttgagtctgtagtaactgaaccttcagatctgctgccactctgtgctggttttcagtgccaaaggcttatgacacttgaaaaatattatgtgccttcattcttacaaaaaggaaagctcatgacttgaaaaatgaccagtgaatgttagagtagaccatataaaacacagaggcatagaacaacttaatccttttaaaaagttaatcaaatccctggctttcttacacactacttcatgaagtaggaaaagattgccaaacattatgaaaatggtatttcccttagggacttgaggattagcagaatatacaggtcatgtgtttagtgatcctattagaggatacattttacaatcatgtcactggtaattctgctagagtaagagagagataccaaacactacacattatcgtacatagggcatgtgattacagaataattaaaactgtgctacattaaggtatcacataaatggtttttaatatcctttgtcagtgaatcagtgatatacaaaatttccctttccacacatattttccttttttaccttctgcctgcactacccaaatttctgcactttgatctatagttatgcaatgtagtcatccttttaaaaatgaattttaaaatctctgatagcggccaggcacagtggctcatgcctgtaatcccagcactttgggaggctgaggcaggtagatcaactgagatcaggagtttgagaccagcctgaccaacatggtgaaaccctgtctctacaaaaaatacaaaaattagcctggcgtggtagcatgtgcctgtaatctcagctattccggaggctgaggctggagaatcgcttgaacccgggaggtggaggtttcagtgagctgagattgcaccattgcactccagcctgggcaacaagagcgaaattccatctcaaaaaaaaaaaaaaatctctgatagctcccatgcatatcaactctgaattgtcttctatttcaaagtacaacagtactgagaaacctgtggaggagttcagggtgctgctgtactgacttctggaaactgtatggaagtaattattttgaatttatttttgtgtcatatatcgattacttgtgttcaaaaatatttgggaattcccaatattttcactgaatcagattttttttttcttctttgtaaggcgggactcaaagccagtgcttcagaagtaaatgcttttatatagtagaaaaatatgaagaaaacatagtatttcaggtcatttgctcccttatatcacttatcagattttggggactttaaggacctaaattttcaaaaaaatcaagttagatcatggatttttttgaaaacttgggtcattaaagtcctgaagaaaatttgaaaatttaagtccttaacgtccagaagacgtttattttagactgtaaagtaaagtaaaaccaagggttaagggtaggtaactttcttttgttttaaacaatggtatgtctatatctatatctattatcatctataggtatatagcgtctatgtgtgctaacccagcaccaattgcctcccctagcttatagaagagaccagtgaattagaagtaggagatgtgagttctaaccccatttctaccactaattagataatagaattcgaaaaactcattgacttctttcagcattgggtccctttgctgtaacatgaagacattgaaagaagtaactttatgttagttgtttctccaatatgttgtgtgtgtacctggtgtggacctcacggtcacccttgccagagacaactagattttttttttaagtctatactaatattctttcctcactagaaaggatagtggggtgtttactctcagttgtaaataactctgttttctctgcctgtatgcatgtcctgtctctctagccattttataaatactgaaaccagtaatcatgatttaagtttttgtgtagactgcagctcatctgttataaacaataaaagctgagtaaatatgtgctaatggttttaccataagtcctgtaggagcattctctttaccccatttaccccattccacgttatttccctgacagcagagaaccatagcagttatgtcgcgagtttgatgatggtggaatgtactctttgctttgagagtgtgtaaattcccctcaggggtgtcatatgtttattaatgtgtcacaagttgcttgcttcctgttagctcttctcagtaaataggactatagcattcgttggatactactttatttttagctttttaaatcacctcctgatgaacagaaacagtaaacaagtattaaacatcgaaagtaatttgaaaatagtgccatcctggagagtctggagttccagacattaccagacactcatctcacagagctgaaggagaagttaggaaaataagaatacctaagtgatgctcctctggagccactttctgaagattaggggacatttgtatttaaagaagagaaagaggtgatggctgtggtagggagtccatatttaattcaactttagtcattcttattcaacccactcatatatttcaaatgaaaagtataaggacttatctggatttttaagcttcacactaattagacaccaaagaactgaaggcctcatcatggtagtattttctaatttgttaaacaaacactgtgcgactgtactgcaaaatggaagtataaagaaactgggaatgaaggaggcggtgccgataataagatctaacgcttactgagtgttctaagctctttatgagttttattgtattcgtttcccacagcagcctatggagtctttggtattactttcaccttatcctaataaggaaatgaaagccaaaggagccaagtaactttccctagttttctgttttttgagatggagtctcgctctgtcgcccaggcttgcagtctcgcgatctcggctcactgcaagctccgcctcccgggttcacgccattctcgtgcctcagcctctcgagtagctgggactacaggcgcccgccaccacgcccggctaatttcttgtattttcagtggagacggggtttccccatgttagccaggatggtctcgatctcctgacctcgtgatccgcccgcctcggcctcccaaagtgctgggattacaggcttgagccaccgcgccctgccaactttccctagttctcaaaaataatgagtgattgagcttgaatgagtgattgagattgaacccatgaggttgggctttggagtcttgctcttcacttgaccctgcctctctctctctctctctgtatatgaatgtctcgtattccatacaaagagatatagtacaacagacaaacaaaagtaatcaatagtttgaggagaaaggaaacctaagactcttgtgtctaaacgatttatgtggaagtttcaaaattatgatgcacagatttactttccttaaaaggcctttctgtttttgtttttgtttttttttttaattctgtgttctacaaatctgtatccttccaaaacctaagcattttctgaaagcatatttgaatgtgccctaaaatagttaataggttaatgtagataatttttttctgaaaaaataatcttataatgagcctagaaagagcatgctccagtcagccctggagtaaaattaataaataatgcatgagcagtattgctggcaaacccaaagagggatatctttttcacttgggtgtgaagctcaagctaaaacttaacacactcttttctctcaaagctgtttctttttcagtgttttttatgctgaaagattgactctacctttcatatactcaactgagaaaaattcttgatcatcttggatgcctctctctttcctttgcttcctcactgttacattgattcagtgtcttaagtatattttgaacatgatccctcttttctgtcccaatgtgtattgctttcattggggctgccatttgtttctgagtgaatgcagttgctttctaatttgcctcattgcatttattcttccttacagtcaaatccatttttctcattataatcagaaaaacctttctaagatccaaatttcatcattccttaacataaagtttaaactctttgaagtggcttatgtgactttcagtcttgcttctgtgcatttgtccagtctcaagtcctttatactccagtcactccacattatttgcaattacttaaacacagtaagttgttttatgccttccaggctttgtgcaaaccgttacctcagataacccttcttaaaattgccaaattcttattcagtctctaagatagttcaggtatcatcatttatggagccttcttgtttctttctttgataccactgtggtagttcatatctctttgtagtaattatcatattgaatttcagctgtttatttgcctatctctttccctggattgtgagggcctgaggacagggaatatgccttattctagcaaaattcctgaacacacacgctcaggacttttttcaagcttctgattacctttgtttaatggctaattatttcacctattaagtatctttcatctaattgtaggctaggtattataggaagctagagatgtctacattcaataaagaaccatctaattttgtggaaatattctttgttaccagatataaagcctaataacctacctatctattttctggacattctcactgtgtcatattagcattcaacaaaagcaagaatctaaataagggagctgcttaaatgtcaaagcattagctgaataaggaggaggacttaagagatgttgtgcatgtgtacagacacaaagaggaaccagcagtatcacggagcacctatgacaggccaagcagatttctatccagtatcctttttaatgctcagacaagtgctggctctcccatgagtcccacctgagactcaaaggagttaaataaattgcccagttttgtagagatggtaagcagtgagactcaaatacaggaatttgatggccatgtacatgaataagcagttgggcacttatttaccaaatgggaagttctaaagcaaactttgaattcaatattttattcctctctttcttctcattagccagcaccatgcctgacacatgatcagtgttcattgaatgtcctgagacttaaaaagcaagtagaagtagtgcaatttacccaaaaaacttcatttggtctcaacccttccaaaagatctctgcacaggatttatagcctcacttattccaagttataaacttgatttatgtaccaggaagaaaaaagagatgcttatttaatgacccaattctgtagaatctgtctatcaggatggggttgttcttatgtaacacagtagaatgcttagctctgacaacctggactctaggttccaacccaagtagatatgggtcgataaagatagtaactttgcaatacttttatccaagaatgtgttctgcccagactcagtaactactcgtcttagcaagacaaccaatagtgtaacttttatccaagaatgtgttctgcccagactcagtaactactcgtcttagcaagacaaccaatagtgtaagagtatgcagcattattcctgaacctcactgtgattaataggccagttacacttttctacttctattgaatttgccaattttagcataagcccaggcttgactttattctggacctaaatcttcctttattttttttctaggtacaaaatatctattaaacattttaaaacttaacctgaatgtaaaacaaaactttttctctggcaaataaaaacaaataaatatacatttagcttcacaagagcaagtattgtttagctgggtagcaagagagaaccctgtggaataagtcaagataccataaaattagttaaacagtgaagtttttgcttttcttttaagtgaattaaatacactgccttggcagcacttgctttttgttcacaccaggtcactgtatttattctgctttgttacagaaactccacttactgtatgaaagtatccatctcactgacagtgggtgaaaatgacactggactctgctataattccaagatgaagtattttgaaaaagctgaacttagcaaaagcaaggaaatttcatgccgtgacatagaggattttctactgccaaccagagaacctgaaatcctttggtacaaggtatggactgcgggtggttctatttcctattaacaaattaattgtgccttatattctgggacaaattggatagaaaacttagatgggtgtgatatagtttagctttgcctttctagaataatatagcaagttgtactggtcattatatgttttttaaccaatggctttagtaaattctagtcaatgtttgtattggtaatccactgtaataagctgttgtgtttatgtttatattttatttccatggacaattctttcaagtctactatggtctgggttgataatttcaggaactaaattaccttgaaccttcttttcagggttcttcacattagcatttcaaagtgtccccaaacaaaaggaaaaaggactgatttttttccaggataaaatcgtatactagtttttcatggaatgttctgtttaatggacataattttgtccatattctaatctttttcatgtataaacataaacattttaaagaaataacatctgaggaaattgtatgacaccagaaatataatattgaagtaactttcttccaaaaccagttgaaactttaaacttaaacagaataatccaacctctgactttcctatcaccatcattgatgtttatttactgatattccagatttgaacataattttaagcttgtttatacaataaaagaaatttttgttattgaatgtactcaaaaaataaagtatagatgctgtgaacattcttccagaatattttatacatagtttaaagaatccttatgtaacatttgctttgtctaactcactggaagtgggactttagaaactgggcctctttgtaactagatccacaaatgtcagtatacagaatgtgagccctcatgacagactgaagatgaattcaaaaactgttagaaataaaacaagaaacaaacctttaacaattttaaaaaagatttttccaaaacagcaatgctctttcctaagtaagacttacttttgattcttgataatgtgaaattgtgggttcagaacatcaagggaactgttggaagatttttatacttgtcccttgcttgattttcaatcctagaccatgttaaatggagctcaaatattagtcctgctggtttctgttactgtgggaatgaattttctttttctctttttttaattgttggagtatttcttatccttaaccaccctcacatctcaaaccaccctgtggtttgtctgacttccacaggcagattctgaggcaagccctgatgattgcttcaagggggagtggtattaggggaatttgacccaaagtctccaaataaacccttttttttcttagtactcatgtgtgacatcagcttctaaatatgcagtgtctttgttgttcactaataagtttattttaagagttgtgtttcttttctcaccttttgcaaagagcatcttaaaatttgctgaaagatgagagactacacacacacagtgtaaaaagtggctggtcctttagtcctatttccaacattgccacaataattttgaccttaagctatgcagactagtgaagtggtgggtggggatgcagtatatgtggtatttaaaagtcataacatttcagattatttttccatagtcaaagattagcccctgtagtctaaatagcagagatttaagggctacttctatagtggaatactataaaataatcaatctggctaaatgtagatgtcacacattcagtggaaaatttatgcaattaccacaagtcatgcaactaatatggcatatacagtgtatattttggtcagaaataacacgaaaattgcccccaattacacaaaggcattgagccacataaaataatgttctgcaaaaatttgatttggcaatacaattttttagaaacaatattacccctgaagaatgtcaaatgttttaaagctattttatcctcgttccattgatttcaaatctggctagaggaaattgacttctgttttggcaaaaacagaaatctcctgagccaacatcattattattcaaagcttaattcagagaccataatttgctaagtctattaacaatgaaaacagatatttatggaactctaaagaccttgcatataaatgttgattgtttcatggattatagcatgcatacactatgaagagatttaatttttactaaatgcaaaactaaaatgtttcaaatattgaaatagaatttaggtgcaatcattgaacggtgcaatcttttgtacagcaaattttctgctttccagtaaaataatatggtttgtattttatgttatcaatttcaatatggttgatttcacaataatgaaatgtgaaatatctgtttccaaaatgatgtcacggatagtcttagcatacatctctattcttatatctaataaatcagtacatatctggtttagatatactaatcttagaagttaattgacttttccaaaaaaataatcttcagattgaagtattcattggttcaaaaatgtataatgaccagtgcaacttgccatattattctaggaagcaaattgattccccagagattttgagaagaaatgaaattatttagcattagtttcaaactttttagtccctttaaaatgcaattttagaagcttttgttttagttatttaaaactgttctatatttttccattactatatgtactaccaaaattgtatgttcttcatataggaatgcaggacaaaaacatggaggccaagtattgtattcaaaagagatactctgcttataagagaagtcagagaagatgacattggaaattatacctgtgaattaaaatatggaggctttgttgtgagaagaactactgaattaactgttacaggtaatcacagtcttcaatatttcacttgcaagtgatgaaactactattttaagttagtttttatgctacacattgatatttttactctctaaagaattacataatcaaatgctaagtggattcctataggtgaaatttattcctccttgcttttgaatcatcttccactgaagtccattcaaaaggctagagacaatatgtttagggagttatagaaatgttaacttttgggccgggcaccgtggctcatgcctgtaatcccagcactttgggaggccaaggtgggcgaatcacgaggtcaggggttcaggaccagcctggccaacatggtgaaaccctgtgtctactaaaaatacaaaaattagccaggcgtggtggtgggcgcctgtaatcccagctactcgggaggctgaggcaggagaatcactcgaacccacgaggcagaggttgcagtgagctgagatcgtgccattgcactccagcctgggggacaagagcaagacgaagtctcagaaaaaaaaaaaaaaagaaatgttagcttttgaaagtacttgaaataaaaatgagtttatggtttccaaaaattatgcttatattttataatggtatcgtttttggaaacatttcctagagtggctaaatagaatatatgaaatctacctctgtcttcctgtcttgctccaaattagaaaagtcgcttttctcttttatttatttatcactctatcaatctgacatacatgtcctcatgaacttgaaaatagcataacttcaggtgcagtcattgaataattatgtgagatgtgatgcatagagtcattttcatagctggttgctaaggtggaaggacatgaggacaagattcagaacactacctgtaatcatgaatctacaactcactagtcacataggttggtggagttaccacagccttcagcatattagtttcttcatgtataaaatggtgttgataaaatttgctgttcttatttcatagggtttttgcaaggatcaaatgaagtaaggtaatatgtatgacataaatttgcaaaatgcagaattatatccaaatgtgcataatttttgtccatgaaaattgcattcatacattttttttctttatagtgcatttcttacaaggtggtttcatgagaaaagtggggataataagaacaacattcagaaattaaaaatattattctcatattcttattgagagattcttcttggtgacttttgtgtatgatcatacttgtaaaacttatatagaaaagcataaaaaggacattagctgttttaaattaaacagagttttatttgttcactggtccacttaaaattagttttccctgtatatgaaaagtgttttgtggtagtcacctacatcttataataatttatttcttttaaggtatctggctatacttgagtttctatacaatcaattttgaaatttgtttttcatctgttacttaattttttcctttaatctctactgaagtggtttttcaaccagtagtattgaggcaaaggaatttaaaaatataaagtaaagcaatctatcctgaatagaaaatagaatgcacttctagtctttattcttcagagtggagaactcatctttagtaagcacctctttcccctttctagaaatgctaggattctaaaccagtacctagtatgagacagttggagcacagtatcatggatactgaacactgggctctgaatggtaaaacagcttgtgtaagactattttatagaaccaaaaatagaactctttatatcctaaatgctttccagggcaaccgtactttcctaaacttcatttgtcccaaaatatcttgttttctttatataaaaacaaagagtaattgagtcttgatattcaagaggaagataaagttttaatgaaagttttcattccacttattatcataaatacttatatgtagccttacctgagacaatgatttgggcaaataaattatgaaacagtttgactggatgtgaaattttgggttaatgtagagctacatgccctagaattaagaacagtatatactaaaatgcattttaggtattaacaacaagtctactgggaagatatatttatgtataacattgttttaaatggtgtgacactatagcgcatttactgtggggccaaattaaagagcagttcttaaaacccaaattatattcctcagttaaagcaacaaacatgggcagtatctgaatgataaggaatcactgttttttatcttggttttctgcacatcattatcatattttacttaatgaaaatattatggaaaacataatattatttggttttagtggaatttgaagtttgttataatgtcactttaaaaaaaaaaaaaagaggaatcctatacgtaaaaaggaaatttctggccgaaggaagtggctaaatgtgcaggcagcatcgtgagcttttatgggtgatcgatccttcccttattgaaaatgtatatccttagctaagtgaagtactggttcaacaaaacagatcacagtgaaaggaattataaacctgtccagcacttttggtattttaaacatctttttttttttctttgggaaacagtttctctcttgttgcccaggctagagtgcagtggtgcaatcttggctcactgcaacctctgcctcccaggttcaagagattctcctgcctcagcctcccgagtagctgggattataggcccgtgccaccatgcccagctaatttttgtatttttagtagagaccgggtttaaccatgttggccaggctggtgtcaaactcctgaaacattctcaatttttttcttttaaattaaagatgttacggcaccatctctagcctctatcttttattagccttacccacattgaagttcttactccaaatgtcctccctctgaactcttattcatggttttctccctctggaaggttttttatcttctcctttgtcacatccctgattctcaccctttcttcaaggcacagctaaaatgttatccccttgttgaggcacgtactccatgcatccacagcacttttagcatctctattgcagcacttacctcattgcatcaaactatttaatgacactcctgtattttcataagaatgtgagcaacttagagtcaagggcaatgtcttttattttttaaataagcatttgattttagaacggttttagatttacagaaaaaacatagtagaaatcccatctagcctgcattcagttccccctgttattcacatctaatattaatatggtatattcgttatagttaatgaactgattttggcacattattattaaataaagtccgtagtttatttagatttctgtgctttttacctgatgtccttgtttctgttccaggatcccatctagaatagcacataacatttagttgttatgtctccttaagatactcttggttgtgactgttttacatttttttttatttttgatgacctttacaattttgaggagtattttgtcgaatgtcctatatttgggatttttctgagattttttcatgattaggtgagggttataggtccttggaagaaaaaacacagaggtaaaatcacaacatgtcatatcagcctgacttatcactgttgatgttgatcttgatcacctgaggtagtgttaggtaggtttttccactgtaaagttactctcttccccatttttatactgtagtttttgtcatccatgctatatgtcatccatgctaaaggagtgagaggttatgttccacctctctgagagcagaatgtccacatattttgtgtggtattctgctacatgagatatatgtctgttctcccacatttatctacttattcaattgttgctctataccagtttggacttaacagttattttatactttgctttataatccaaattaccttatttattttgttgctcaaattattacagttttggtcattaagagctcttttagttggctcctttgtccctgtgacatacttatattggggtgtgtgtgtgtgtgtgtgtatgtatgtttgagtactttcctactttctggccctttaagatgctctaagctcatcttgtatatttcctgccccagtccctacatcagatatattttttcaaagatgccatgttgcttttattggagaattataccaaaaatgaataccttcatgttgagagtactcattgctactgggatatagttgttttgaagcttttctaatcgacaaaaaaagaaaaatgtgtatagtaacacataaacatatacacatatctatagatatttatatgtgtaaccacctgtgtttatattaagttaaacatgagttcatactgatgtttccaactctaatttattaccatatggatcattttagcctcttcccctaccttatgtgtaacctcccaatccagtagttagaaaactggttctcaccatctgccattcttttactgaattgttcacttccagtataaatgtatagtgagatcagaatttgttaacctgtgcccatgtgggaaacaactttatcaattagaatatggtgtttacgtacaattgttttagcatttagccttacagacttcactcatttccaaagttgctaaggtcagcacctttcccctcacctgcttcagtgaggttatctcacatatttgtaatatagttagattgttttatcatattctgtatttcccaggatcctctgacctcctgaattatatttaaaatttgcatacattaaggttttctctttgtgctgtgaagttctatgagtttaaacaaatgcatagtgtcatgtattcataattaaaaagtaacagaatagtttcactgccctaaaaaagactctacacttcatatgttcagcccttctttctgccttccgaatccctggaaacaactgatctttttaccataactatagttttgctttttccagaatgtcatataattgaaatcatacagtttttggccttttcagactggcttctttcacttagcaatatgcatttccttcactcctttctgccttccttccttttaattgagcattttatctcttccatttttacatcaattttccttctttttagatatatattttagtgatagccctggatattccaattttaaactaatctcagtccaccttcaaaaaacgctgtgtagtacagataccttattacagagtactcccagttcctctctcctatcctttatgacattgttctcattcatttcacttacccatattgtataatcacccaatatattgttactgttattttaaacaaagttatcttttacatcaatttagaataagagaaataaaatattttattttaccttcatttattccttctctggcactcttctttatgtagatccaagtttctattccatacacttttcttctgcctgaaaaacttcctttggcatttcttgcaatgaaggtccagtggtgatgatgtcccttagttttcatttatcagagaatgcctttatttatttttcccctttgaaaaagaattttgctggatatagaatttttttgtttgtttgtttgttttgttttgttttgagacggagtcttgctctgtcgcccagggtggagtgcagtggcatgatctcggctcactgcaacctctgcttcctgggttcaagtaattctcctgcctcaccctcccgagtagctggaattacagacacgtgccaccatgcccagctaatttttgtattcttagtagagacggggtttcaccatgttggccaggatggtcttgatatcctgaccttgtgatccgcccacctcagcctcccaaagtgctgggattacaggcgtgagctaccgcgcccagtctggatgtagaatttttgattggtacttttttcgttttgtcactttcaatatgccactccactcttttattgcttgcatggtttttgatgagatgttcactctgatacttatctctgtgcctgtatagatatgatattttctctgtgttctttatttatttatttattttttttgagacagagtctcgctctgtcgcccaggctggagtgcagtggcgggatctcggctcactgcaagctccgcctcccgggttcacgccattctcctgcctcagcctcccaagtagctgggactacaggtgcccgccactaggcccagctaattttttgtatttttagtagagacggggtttcaccgttttagccgggatggtctcgatctcctgacctcgtgatccacccgcctcggcctcccaaagtgctggaattacaggcgtgagccaccacgcccaggctctgtgttctttcaagattgtctgtgttttttttttctctgtagattgaatatggtatgcctaggtatagtgattttgttatttatcctactcagtgttttatcagcttcctggatttctggtttgatgtctctcaattttgaaaattccatgaccattattatttcagatatttactctgctccattctttttttttctacttttgatattccgattatacatatattatgccttttgaaattatctctcagttcttggatgttcttttctgtttttatcattcatttttctctttgcatgtcagttgataaagttctactgatctattttcaagctcacacattgtttcctgaactggtgtccagtgtactgatgagaccatcaaagggcttcttcatttctgttacaatgtttgttttttaaaaactctagcatttcctggctgggcacagtggctcacgcctataatcccagcactttgggaggccgaggtgggcggatcacaaggtcaggagatcaagaccatcctggctaacatggtggaaccctgtctctactaaaaatacaaaaaattagccgggcgtggtggtgggcgcctgtagtcccagctactcgggaggctgaggcaggagaatggcgtgaacctgggaggcagagcttgtagtgagccgaaatcgcgacactgcactccagactgggcgacagagcgagactctgtctcaaaaaaaaaaaagcaaatctagcatttcctttcgattctttttaacattgcaatctctcttcttatattacccatctgtgggtatcgtggaggaataataccctccatacagatctcacactctacttttattaatatttaggttggtgcaaacataattgcggtttttgccataactttgcgggtttttgccctggaaagtaaaggcaaaagccgcaattacatttgcacgagtctaatactaccgagttttacataaaccttttcatttcctacattatattgctgatttgtattgagatttaagtcaaataacatcagttttcttatattgttaagtcaaatgcctgcctgtggttgaacttttaggtatgaatacagtgctgagtattcctatagagatgattatgttcatttttaatacgtcatcccagtgtatgaagataggttttatacttgattctgtcttacactataataacttctcttccttgacaaaagtcattacgttttttgttggaagatatgtctgttttgaatggaaacattgtttaaaatgttatatttaaaaggctctgtataaagctgtgtaatatgcttttatattttttctggaatgtattatttcacctctctttagtgagagatttttatcctaataagaaatacagaatccagtacatatttttacttatttcttttaataataacatatataaccaaaaagtgtataaaatgtaaacaagtagctgcttagcatgctatcaaaagaactcaactaggcaaagaaatagaatactgtaggccccatagaagcccccatatgcccttctgattataaaccccttcctctccactactggataggtacctcagtatgtgagttttggggtatttattttcttgcgtgtttaaaagttgtattagctgatagtgtatgacaaagcgatatagctacattttgcctggttttgaaacgtataaattaggacccacatgttgtgtattctgtctggcttcttcaactccaaattttgtttcaaatatgcatgtatgttattccattcatctgtactttattcattattcttatgctatgatattccattatatgaaaatctcagtttgttgatagacattagggcttgttgtaattttttgcttatgtaagtaatattgccattaaccgtcttatgtacacacatatatacacacaaacacttacatatttccttgaacatataagcaagcaattctgtaggatttttacctaggaaaggatttgctcattaaaagtatgtatattttcaaatttactaactattgtttgggctaatttgggtcatgggcgtatcctaaccgaattgactgtagggaggagagaagtactccaaagaaagttggaggtgccaaaataagtggaaattattctaaggaacataaaaagccattttctactacttctacacattatgatttcttaaagattataaaatataatttgatatgcataaaattctgttttgcattgtgtaacaattttctatacttccatattgttaaataaaaatgtgaaaacattcaactttgtattgatatacattgccatatcctaggattccttgcactaaactctaactcacatccagactacactataaccctagtcttctgccagatatatgtgggaatgtgggtatggggaaaacgtcatatccagaggtggtccataagcaatctagtgattccaaaataaattaaatcaccttggctcatcataaataccaactatgtagacaaaaaatacaaatattagtaatgatacatatttttggatttgttaggtctaaggaaaaaaatatacactatataggatttttttagatgtattgattacattacatgattttcatttttgcccatttaatgcttatttccccttctggccaaaacatttttctattattttaaaaagaaagatttaaaacaaagtaacaactgtattgccatcataaagtttggaaatgagtcagaccagttgcaacaccatttaatttctagggtcagatcatagaattaagtaatggtaagggaataccttgttaaaatgttatgtcagaaaaaattttcccaagtaaatttgagagtcagcaagcagagtgaggaagtgaagaaaggaaaactgattcgaaaagaagcaaaaagaatgaggtgattgttacaaggatgtgatagttttagtagcatttttatcctttatataactttttaacagttaatacagcagaatattcaaactacttcccaatcgaccacagactgaatttacgctctcaaaaggtacatcttcctcctcttttaatggatgaggaagctgaggcaaagaaaggttaagtggctttatcaaggtcacaaaacgtcacagtgacaaatttagaaataaaatttaattccctgaacctcagtctatgatttactccactggataattaatagcaaggcattgtagtgttcatattagctctgctgatcgctatgagagatttatattttaagtgcaacggaaacacatttaactgagacctctaattcttctgccatggatgtaattaagcagtgtatttgtggtctagcctggggatggagtattgcttctttttcttcctatttctttcaaaaaattgcgtattttatttctcctttaaaaaaactgtttttgttaaattacttcatggattaaagtgtgctttcactgactacagcctaacaataattgatgaaattgataaaaggggcagatctttccagactttactttgtatgtttgctaacattccaggatccatacccacaaaaaccatcatgtatattatttttgatgaattgacatatactacatttctagctgttttataagtaaatatctgccatatttttgtaactcaaatatcatttagattaattcacacttttgaattaaaagagaaaaatgctcataaatatggtgaaactgaatttaatcaacttggctatctaatgttgatttggagttgaattcctaaaacaaaagagctctttcatgagtggtttccaataactgtcctgaaaccactgacactcattacctttatttattatttaatcttaatatactaaatgggttgttcaaaaatgtatgaatcaaattaacatttattgttaaggtgtagtaagtttgaataaaaacaagatgtttttactcttgagcagaaaacgtatacattttagaacatattcatagcaaggttggaatgtgccatctctggccatggggaaaacaagacatcataaacttgaatgatttccattaatacaagaaaaattaaatattaataattagaatagttaacacctactgagtgttcaccgtgtgccaggatctgttctaaattctttttttttttttttttttgagatggagtttcactcttgttgcccaggctggagtacaatggcacgatatcggctcaccacaacctccgcctcccaggttcaagcgattctcctgcctcagcctccccagtagctgggattataggcatgtgccaccacgcccggctaattttttatttttagtagagacgggttttctccatgttgatcaggctggtctcgaactcccaacctcaggtgatccacccgcctcggcctcccaaagtgctgggattacaggcgtgagccactgtgcccggcctgttctaaattcttccacataacctcaacttactcacccttaaaaatttttccagtgctcgccaggtgcagtggctcacgtctgtaatcccaggactttgggaggctgaggtgggcagatcacaagatcaagagatcgagaccatcctggccaatgtggtgaaaccccgtctctaccaaaaatacaaaaattagctgggtgtggtggtgcgtgcctgtagtcccagctgctcaggaggctgaggcaggagaatcgcttgaaactgggagatggaggttgcagtgagccgagatcacaccactgcactctagcctgggcaacagagcaagactctgtgtcaaaaaaaaaaaaaaattccagtgcttgccaagtacctaatattcttctaggtttcataaattgcacttgaaaataattcactattttatttcccacttcatatggatttttgaatttaataaaagatgaacatccatttctggaaaatgcagtcaattagacctccatttgctgctctgaaacactgagaaaaattagatgaaataaaatagaaataccattttaaatgattagttgagcttgcaagaatgttcttttttaaaaaaagaaaaatctctgggtctaatttttatttagcagtattgaagtacaaaaaagttacataattcaaatcataattttatgaatatcaaatcacattttataatctttaagaaatcatgaagtttagaagtaatagacatctgctgtttatatttcctagaatatgtttcacttcttttgacacctcccattttctttggagtaccactcctctctttccttcagtccttttggttggtagactcttggtcaaaaaaatctccaatttgctgctcaagaagaattgaccagtctccaggaagggccttaacagggtcctcctggttcaagacagcatttaaaaaataaaaagagaccaggctcagtggttcacacctgtaatactggtgctttgggaggctgaagcaggaggattacttgaggccaagagtttgagaccagcctgtgctatatagtcagacattgaatctatccatacatacatacatacctatctgtattatatctctaaaaatgtcaggtactagaatccataaatacagactagaaattagctatgcctaaaatgatgggtcacatttttaaaaatctaaaacaataccagtatttttgatgcctgtgtgagagcataaatattaagaaaggcaattggtcagcaggactttctgccccagtcatatatgcattttgatttcattcaattttctggctgccctattgctgttgttgcctgacatagttcatcagccagaagtagttcttaattttttcactgattttctttgacagcattgaatttcaagtgtactgagagtgttttcattataataaccctgccagtgtaatccaacggattgcttgcctcttagaaatgatacagtcatcctttctgtccgtcccaggtgttagagctgtattacttctagattttcagaccactagctaaacttattcttacctcattgttaaagaaacaactacttttttttttttttttactgctaaccatatggcaggtactgtacacaattatttataggcattactatctatatttatcaaggagaaaagtcaaagtacattttggacacatatttaaacttttaaatacaaatcattatcattatttctaatgaaattcccttctttatttgcactctactgcttcaaattttcaaattctcttatattaattctaacaaactcaattttgagagtcaaaaagctgttcaataaatatcccttgatagaattattggtttatggctgggcatggtggctcacacctgtaatcccagaactttgggaggccgaagtgggtgaatcatctgagatcaggagttcaagaccagcctggccaacatggcaaaaccctgtctctactaaaaatacaaaagttagccaggcgtggtggtccgcgcctgtagtcccagctactcaggaggctgaggcaggagaattgcttgaactcaggaggcagaagttgcagtgagccgagatcaaaccactgtgcttcagcctgggcaacagaacaagactccatcaaaaaaaaagaaaaaaaaaattcttgttttagttagttagagaaaaaaaatatcaacaactgggctgtccaatataatagccacaagcaccatgtgtccactgagcaactgaaatttggctagactggattgagatattttaaatgtaaaatatgtgctaaatatttcaaatgtaaaatatgtgctggattttaaagacttagtttgacaaaaataatgcaaaatatctctttagtaatttttttatattgatatcatgttgaagtgataatatttagttaaataagatatactacaaaattgattttacctcttttcacttttttaaatgtagctgctagaaaatttttaattgtatatgtagttcggcttatatttctgttgcacagagctactcttgaaagtgaagtgtggtatcagcctggagaagtgtaagggaaacacacaagaccaagcatctaagggttgtcttagttccattggtggagctgccatgcctgggctcagtgaccttaactaagttatctgtcttcattaaatgttgtcttagtgttgagactgtgaatagtcatcactcacagtgctttggtgaggggtaaattagcgcagatgcatcaaaccggactgtgaaggaatatacaaatggaagtggctactgccatgatttggtttgatttttgaatctttaccttggtgatatggtttggctatgtcctcacccaaatttcatcttaaattgtagctcccataattcccacatcttgtgggagggaccccgttagaggtaattgagtcatgggggcgggtctttgccatgctgttctggtgatagtgagtaagtctcacgagatctgataggtttagaaaaagggagttcccctgcacacgctctcttgcctgctgccatgtaaggcaccgctttgctcttccttcatcttctgccatgatttcccagccatgtggaactgtgagtccattaaaccgctttcctttataaattacccagtctcaggtatttattagcagcgtgagaacagactaatacacgtggtttgtttcagttaatgtaattttaatatttataatcttttttttattattatactttaagttttagggtacatgtgcacaacgtgcaggtttgttacatatgtatacatgtgccatgttggtgtgctgcacccattaactcgtcatttaacattaggtatatctcctaatgctatccctcccccctacccccaccccacaacaggccccggtgtgtgatgttccccttcctgtgtccatgtgttctcgttgttcagttcccacctatgagtgagaacatgcggtgtttggttttttgtccttgtgatagtttgctgagaatgatggtttccagcttcatccatgtccctataatatttataatattaatctattccgtcaaatgtcactgattatcatcaatacaattattgactaacattcattgaccattaagtaatggtttatatgtgtggagaaaattcagaatatcttatttgtgtgcaagctactaacaaatgaatttcaatgtctttaactggggtaaataatgaatatgtgcatttctacctttgatatgattatatatatttatatgtatacaaatgcatacatacgtatgtatgtgtatatatatgtgtgtgtgtgcccctatattaatatatgtcttattgactattacagtcacttatttgcatctaagaaatcaggggaacatttttctatacttttttttgcaataatattattttctattttacaaaactgatttattttttgtggttaacattccaaagacccatttgatcatgattcctctcatatgaggtacctagaataggcaaattcatagagacagaaaatagagtagagattattaaaggttggggaacaggggaatgggaagttattgttcagtagttagcagagattcagtttgggatgataaaaaaaagttcaagagatggataaaggtgatggtagcacaacattttgaatgtatttaatgccatttaattgtacacttaaaattagttaaaatggtaacttttatcttatatatcttaccacacaaaaaaagattcatttgaaaataaatggctgttcttaatagtttggagcatatttttaaaattatttgccaagtgtggtggcttgcccctgtaaacccatcactttgggaggctgagacgagaggaccacttgagcccaggagtttaagaccagcctgggcaacatggggaaaccctatctctacaaaaaaatacaaagaattagctgggcatggtggtgcatgtctgtagttcctgctactcaggaggctgaggtgggagaatcgcctgagcccaagaggtccaggctatggtaatgagactctcactcaaaaaagaaaaatatcatatcaaagatttttttttaaagatcatcttttctctacttcatgttggctctctactttgacaggtattgatttttctgtaaaacttttgaagctcaaaccattatgtcggcactttatattaactgcttttagttttgacatcagcaaaattgactgaaaactcaatattgcacctgtttcaatacagagtctctggtgtggaaagattagcaagataagctaaagaaacttctattgttcaactttatcttctcagtctcatcaaatcaaagattgaaaatgtactctaggaggatgtatttctggtgaggttagatgactacacatctaaaagtaaaagttttaagagtaaaatataacataataaggatctagaatcttgaagaaagattccaacatattttatgacaattaagtctctaggtaccattaataaagatgactgtaacctcagagctaaaagcatttagttcattattccatgcaaactcgttaaaatatgaagactaaacttagcatctagtgtcaccactaaaaactgtttaaaacttatgtgatattgagtgagatacatttctttatggtttaataagtgaattagatgtctcagtgtgatgatgcctatatctacatgcacgtgaatgtgtgtatacatagatctatataatatatatctataaatatgtattttcattggatagagaattattaaccattttgtttttttttttcttttttgagacagagtctcgctctgttgcccaggctggagtgcagtggtgcaatctcggctcactgcaacctctgcctcccgggttcaagtgattctcctgcctcagcctcccaagtagctgggattacaggcgcgtgccaccacgcccggctaattttttgtatttttagtagaggtggggtttcaccgttttagtcaggacggtcttgaactcctgacgttgtgatccacccactttggcctcccaaagtgctgggattacaggcgtgaaccaccgcgcccagccattaaaccaattttatatatacagctcttatagttttaattttatttttgccacttagtggcaagaaatttgttacttggtataaataaaaccaagttgatttgtttaagcagtaggttcccattagacttaatgatgttgtatcatcccattattaatttgaataaatttctattatgttatttttcaaaatgaacaacagtgcatagaatcaacaattgagtcactgcaatagcagtataaccatgctactccttcaatatgggagtttttgttaacaaactaaactctgacagcttaatgtatgcaagattaagaaaaaaaataaaaccacaagctaatttcttattatactcactttgtgtattatacttaatggggtctcagatttgtttttcttctttcctagacaccagattaccaggaacagtgagaacttaggtagaaatgtggataatggtacactaataactagaggtttacaaaataggaaaggttaaaggaactgagaatattactattatttggattttaaaaaactctgggctgggcgcattggctcactcacgactgtaatcctagcactttgggaggccgaggcaggcagatcacctgagatcaggagttcgagacatggtgacaccttgtttctactaaaaatacaaaaattagctgggtgtggtggcacacacctgtagtcccagctactcgggaagccgaggcatgagaatcacttgaacttgggggggcagaggttgcagtgagccaaaatcgcgccactgcactccagcctgggcgacagagttagactccgtctcaaaacaaacaaacaaacaaacaacaacgaaaacctcaatgatgtgccataataagatgttaagtactggaagtgttcagaataatggaagagcagcaaagggtgactacattaaaaatccagcaggtaatgagtttcatgaggatttacaaattgttttttaaaaaatattgattaaatttattgctctgtgattttagcatttaaggatagttcctggaaaaaacaaacaaacaaaaaacactgctcaataatagggaagacttttggtgctgtattctttggaggttttaaaaatatgacagaaacccatttgaggcatgttcaggcatagacaaattggaggaaggtcactgagactctagtaatttttttattatgttaaaatttttatggttcatttttcctaatattttgtagtttaaaaaatagggagcaatttaaaaaatcaaaacattaggttttgatatgacagtttaataattacataaaggaatttaaaataatgaatgctatttttaaactgttcaaactattttaaagagcttctattactcttacactatgaaaaggtccactaattatatcccagggttagttttcccttgcctttatcacaatattgaaggctctttcttgatgataaaaccaagaggtaactcttaacttgcaattgatgtagatattttgtaacatatatttagaagaatttctaaaaactatttttgagaaaactgcatgaaaatggagttggtttttttcatgtcaaaatatataacttttgcatcataagagatttaatgttttcatttcttaaaatgcttgaccaagtcttttagtcattatattagcatctcttgttccatctggaggacctaaaaatccaatgaactgtaaatgggcagttcaatatgaatatgcaaattaaagacattatgaattctatgtaagatgtaaagaagtagcttactctgtgccttaattagaagaccttactgtatatttctttatcatttgttgggttgatcatcgggttccactccaacatatccaccaggaattctggtatataaatggcatcaaagattgtttacaaatatcgtggacaatgtctcaagtgataattgcaatatgtttctcagggaagaaaaaaatacaacttttgtgaatattatttttaaaacagaaatgctgtatatagtcactactgtcttctgatggtaatgatagaaattttggaacctttaatgagtacttattgttaaagttccattagataattatgttctgtttacatactgccatcatttgaagaacatatttgctttattcaccaaatcttgaagcatactctacacatgaatttaaatgctactatttctattacccaccctcagagtcttctaatttctaatatttacttaaatattttggttttcaaaattttacctatgattataaagcacacactgagcttttattttaaaattgaggcttgtgctgtcaatttaaggatgagagaagcacagagaaacgtgttctttttaaaaaagtaatatatatatatatatatatatatatatatatatatttttttttttttttttgagatggagtcttgctctgtcgcccaggctggagtgcagtggcatgatctcggctcactgcaacctctgcctcccaggtttcaagcgattcttctgcttcagcctcctgagtagctgggattacaggcccacgccaccacgccccactaatttttgtatttttttagtagagatggggtttcaccatgttggtcaggctggactcaaactcctgacctcctgatctgcccacctcagcctcccaaagtgctgggattacaggcgtgagccactgcgcccggccaaaaaaataaaatatattttaaacctttaaaagcaaacttggttatcaatgtatcatgtttctgtgtatcaacttttataagtccactactcaaaatgtaacctgaaaacagaatttttccaattagatattgttgctatggcgtaattgagctagttaatgatataactctttcagaataataagtcaataatagttatcagcaccaaacatgaaggaagtgaagtagaagatatatgaaaaataaccattaatattaaaacaatatattatgggggcagcaaataggtagtaagctatttactattcattagttggttatgacattgctaaaattaaattaaaacaaaaggtgaatacaaatacaatgaagtagtttggatgatgttttccatttggggtatataatcagatcattttatgttaatctaatttgtctttgagttaaataaacccaatagtgttgacctgccttttcatgtgtcattttttcaacattgtcgtttgataaacatttagtaagaaataaaattacactcagagcaataattttatactttcgcaagctatttataaaatctaattgtataaatgaatgtgttctttaaagatctgtatttgttgtttatgatgaagttaagaagttatagctacttctggtgctgttcaaaatgaagattggaaataatacagtgaagtagatctttaacccagatagtttgagatgcactcttctggatggcggatgaaggactgaaacaaaggccaggcagttagtttgcagaaaagaaatatgtaggaagtaagacaaaataattaattacatatacgtaatgacatatacttcttctcattcaaataatctctagtcattaattccaggaaaattactcagataatttttttttttttgagccagagtttcgctcttatcacccaggctggagtgcaatggcatgatctcggctcactgcaacctctgcctcccaggttcaagtgattctccagtctcagcctcccaagtagctgggattacaggtgcccaccaccaggcctggctgatttttgtatttttagtagagatggcgtttcaccatgttggccaagctggtcttgaactcctgacctcaggtgattcacctgcctcggcctcccaaaatgctgggattacaggcatgagccaccgtgcccggcctactcagataatttttaaaatgtgtgctttttttgtttgttcataacattcagagttctagagcataattacagagtatttcaacaatgctcagttagtagtggttaaatcttccacttcagtgcagctgttgctctgtcatgtaaacataccaaatgtaccttcaataggagtttaagattttttttatatgtatttctgtactttggaaatagtttctagtgggtgggtgtggcagaggagactcttgttggttagtatagagctgttgctgtggagcagctgctcagccagaaattcaatttcccagcccctcttgcttctaggtggaaccatgtgactagttcttatcaatgagtataagggaaggaatgtcatttctgagccaatgtaatgacgaagtagatatgctttttccctgtctttctttctccatcaattactggatgcagacaatggcaaggttttaacagatggaaggtgcccaggtctctaaatcacataatggggggaatttggtcactgaccagaaagactgtcattgaatgacttcaggagtgaaaaatgagtctcagttaaattaaatcactgaaatggtgaggtttacttgaatggcagaaagccttaccctaaatagcagtgttaggcaagttttaccaatgcaaagtcatttgaataaaagagaaatttattgtaaagtcacaaatggtctagaactgaaactgctaagctacacagctgccactttcctgtttgaatgcttctttctacacggtttctccatctgctatgcacttaccagatctctgaatgttcagtctatacatttttcaacagccaaatcaaaaacccatctcttctggtcaaccttcagtcctctctcctagatctggacagtcccattttccttagtggtcagtttgctttttgacacttttttctttcccctccacagtgatttggccaattggatatattcctactctttcacactagcctgtaaggccctcgagccacgactttgtcttcagcattatttagcatagagagaaaagatgattaataagtacttttgaaatgtttaataagcaaaagctgagttgggaatgtattttagaaatatatgctattgtagatagctaaatgtgattttagtctttatcacaaacttcttagtaattatttgagagctttcagcatatttataaaaataatttaaaatataactattttacttgaaagtctttgtatattcattgttcttgaattagtaggtaataatcctaatgagccataacaactgttctctcttcaaaataattctgatgatagggttttcttcttaagtcagcacaaaatttattctttatatagggtcaattgaagtgtttttaaaagcatgcacagctctggtaattcattcataaaacacaggaaaatgttttaaagtcaaaagcttcaaaaagattcacaatgtgaaaaacataaattagaacattaaggaaacttgtgttgtaggactttttccttagttcagctagaaaccaggttcttgtcacatgaccaggaaagattaggttcctagacacagtagaagggtgggaaaaatggaatttattgggcaaaaaggaaaaaggaaaaacaacacagcaaagtgagatggggtcctgctaaggggctctccacctcaccaaacgaatcccagggttaccaccccagaacaggagaggccaggctcctccccgctgcaaagggcatgaacttccctcatctccacactcccacacatacccccacccctgttctcccagtttgcaggccagttgtaggttctccaagaacccctttctcctttattacttggctgtctcacttagaagactgatgctagcaaaaaacatacacaggaaaaataagagagtaacagaaaaaaaaatctggcaaagaaggcagaagggaaagagactaagccataagagagagagagaaaaaaaaaatctctggtctgggaagggcatattttctaagcattagtgtgtaagatggagaagcaactcattaagctgtcctttaatgtagtattatccataatagtacaatatgagaaacaactcaaattccccaaaaatgatacagaatggattttataaatcacgtaagccagtgccatagaaaagagtctgaattcgagtggtgtgacttcagttatagtcctgtttgcagcctggtacaggacttaggcaaatattttaattcttacttgtatgtttgggaggcaaggtaaagacttcgccttcaccctctgaagataccctgaaaaatcaactcacagaaagcagattaattggaaaaaagacatatacatttattaacgtgtgcatgaggagaaccagggtggttacccatcttgccagtggagttcagaagcttatatgccatcctggtcaaacaggttatgggagtggagagaagaggaattttggtgagggacaataaaggatccttagggagaacagaacccatctgggagcagagattaattaagttgtaaatagttctctttggaatttgaatgagcctgagagacaggttagtcttccacagaggggaagaaacaacagttatcctttttggtgagtttggactttagacatataaaagaacttcaaagaacagcttcctcctggcttgagagagtcatttgcgggcggggagagggagggaatcagagaggctatgagactgctttttcagttcagcatgttaaagtgccatatttggggtatcggtttttgaaccccatcataggctacagaaccctacagttcctttcaaggctgaaagtttctaatacagtaaagtgtttaaaagtttacactattctgattttagcagatttcccaaatggtatatctcttcatagtgttaggtaaggcagaaagctattctttaaagagcaaatctctgaaagctaatgatgcctgggttgcaatctaaatgatatttttttctttttctaaaatgccaagggcaagttgacttttagagttaatttctttcatttatataaaatggtaatgagagttaaattatatttaggcacctggtacattacctagcctgtaataaactctctgtaaatgctagtttcctccctctgttgcattaaaacaactacaagatgaaaaacctatgtaaaccaaaaataaaagtctaagccccacaaccaacagaatggacccctcctttcggccaagagcattataaaggaaacctgaaatattagttcaggccttgatgaaatggatggttggatatgcctcattatactttcctccctttgatatttaggctaaccagcattagcattaaaacagagacctgaagactgacagaactagactctttaagcctgataagaaacatttacaactgattccctctaaagcctgctacctggaggcttcatctgcataataagaatttgggtctctataatcccttatcttaacccagacattccttctattgattccaagtcttagataaattctttccaccaattgctaatcacagaatctttgaatccacctactacctggaagcacccccacaacacacacacaatggcttcaagttgtcctgcctttctggaccaaaccaaagtacattttccatttatcgatttatgtcttttgtctccctaaaacgtataaagccaagctgtagcccaaccaccttgggcatgtattgtcaggatgtcctgaggttgtgtcatggacatgtcctcaaccttggcaaaagaaacttctaaattgattgagacttgtctcagatactttttggtttacaactgaaaacaatataggttagcgatacatctattctggtgtcaacgccagaatagtttgtcacagtcaaattttattactgtgattcaaaccatggtaaaattataacttaaattttataagatagataaaaacaattcaattaatattccctggttagtttcagtcataatgattatataagttgggtattctcaattacatgagcatctctttaaggcagatgagaatttgatgatgttaatcatgatgatgattactagcatttattgaatgtctactatatgcaccactctaagcaccttgcatatactatctaatttaaactggctcatagatgacatactagtttagagtgtactatttgttgactgcattttaccctgtacttcaatttgatagacagtgtagatgtactaaattcattcttcattccctttacaaaaattgactgagttcttattgatgtgctgtcctggacagtgtgaaaaatcaaaggatgaatcaggcagagacctcttcgagcagatattattgagcagaagaggtaaattatgcacacaatagggtgcaagatgaaaagtggtatgagatgaatgatcataaagggtggtgggaattctgagatgatcatgaaaagtttcctgcccaagtggaatttgaatttgtccttgaaagagagtgaaatctggactgggaatgtcaaattaaaaataaaaatccagactttgtaaggtggggagactattgcaattgggaagctactctaactataagatctacaagcctttcaaagttaggcaaaaggatttttctttcatagggaagagtaaacaaggctggaaagaaaaaaaaaaaaagcagatgtagggaagtgggatgaaaaggagtggcaagatgtgacagtggaccccagaatatttaatcctaaagccagtatagtctctggaagggggctattaagagggattgtatgttgcctcaggctaaggtggtgcaaagctcagggatctagaggaaggacagaatgttaaccgtctttctttaagaagcattatattctgattgatcacttggggcaaaacagttcataattatctatgaggcaaagagtgggaattttgagtctttttgtatggccctgtcataggcaagccaggggaacaactgtgaagcagggtggttctgtgcagtaagccatttcccaaaacacaaaaggatgtggggatttattaaacttcactgttttccaagatcattggtcttgggtaaagttcaacattgtcttgggtatgggaggaaaactcagttaggacttcttaaagaaagagatattcatgggaaggtttcgtttagctgggatgttgacattatgaaggaacgcactaataaatggtgatggttaccctttttgaactgccagttccttttctaaagttaaaaactatcagttcatttaatcttcacagtcatctgatgatacagttacaattatcctccccattttacagacaaagaatctgaatccctcagagtttaagtcacttgatgatactcctagtaagaagtacaacagggactccaacttatgaagccactgtaagcctgacagagccattttagcctcttttcatgacttcagactttccctttataccaaagggaatggaataaaactgcttggacaagagcaagaagacatgcatccatttttcacattccaaaataatggactccaacacatacacataagagaagcagctggacatagaagaacttagaaaaacagaaagtccaagtttggatatggtgcacaagaaacaacagcagccaatggagcttgacaaagcagagtggcgataacaggaaaggttctgagggcagggaacaaaacaatggagctagtcaagacagaagggcccactgtttgtctgctttctgttttttttgagaatgaggatggggtggagattagggttaaatttaacactgttatctttgtaggcccaggtttctctggttcatatctctgtcaatgagactatcacaggtctgtgaagtttttgggggatttggaaaatgcctgctggattagcttttttaaaaaaaagtattattattattttgagacagggtctggttctgtcgcccaggctggagtgcagtggcatgattacggctcactgctacctccgcctcctgggctcaagcaatccgcccacctcagcatcccaagtagctgggactacagttgcacaccaccacaatcagctattttttttttgtagagacagggttttaccatgttgcccaggctaatctcgaactcctgggctcaagtgatccactcgcctcagcctcccaaagtactgggattataggcatgaaccaccgtgcctggcctggattagcttttaagagcaaccctgagctaccctgaagacatctcaactagtacagtttagccctccagagttgaggacagttgctgaatccaacacacattcaactctccttcccttttccctttgccagatacatttgcatttacttctataaatcacagctatcattgtttttcctaataattatcttatgattcaatacactcagtccagtgagcccaggaatacatagtacatggttctaaattttattgaaaatatttataactttgaaatgtaaataattgaactaaattcatcttctataaatcatattttgggaagaaaccctgattgctctaaccaacagagatgttattagaaatgtaatataataataaaagcaattaacctttactgaggccatcctgtgtccctgaactgatggtaggcactttcacatcctttttcatcctcccaggaacctattagtagaagatatggtttctattttacaaacgaaccaattacagttctgagaagttaatctctttgaccaagcagttgtactttaggccttgagccaagttttgaactcagacctctctgactttaaaagtcctctaagccattctacttggaatcaattactcacattttcaagactactcaagggcagctgtgctacctaatacgtgtaatgttgggaacaatatttaactacccgttgacttagtttcttcatctgaaatgtaaaggcaatcagaacttccttagaggattattgtgaagattaaataaattaatacatgtaaactattttaaaggtatacagagctactattttataagtgttagctatgacgattgatgattatgatgacaatgaaatcatactctctttctcaagtgaatagccgtactcaaaatgtcattatgattttgtatgctaaacaaaaactacagaaaattaggagtattagtttgctcttaattaaatttacatgtaagtttcttttaatcataaatttggaaatctcttttgtgcctcccattatacttcttagtctctaaaataaaatttgcattttatttgagaccacagaatggcagttttgataattggattttaaaaacctttttaaaaaaaaaaaaaaaagatttgcatattatttccctggtataaggaatctggatcaccaaaatattaagaacattttctattatttctcatttgtgtggaacatgggggtgttaacattgtcttgacttatttgccccgtatggttgttaggttccagggagcttcagctgagcttaagtgttcctgtctgaaatatctgagtcaaggtgtatgaaccagagatcaaacaaatcagtaaagaagtaacaggcataagactgaagtaaaaaaacaaagatggttccctatcactactaagtatggacagcccagaggtgtgacaaaccctattggttcttcttgcctactgcacagtaaagccaatacactgagacagcagtgttgcagtagaggatgagtttaattctcacaaagcagctgagctgaaggatagtatgcatttctcaaatcgacctccacaagaactcagaaactagggtttttaatgataatttgatggacagggagctagggagtaggtgctactgattggctgggaatcaaaccatagggatgttgaaactgtctttgtgcactgagtcagtttctggtttgaggtcatcacaggaccagtcaagtcagttccttggtatgggtcccaggttcaggtggcatcagtttgtctgccaggatgcaaaaatgtctgaaaattatatccaagaccagtcttgggaagcaactggagaagttataaatcttgtgacctctggccacttgactcctgagcagtaagtaattatagaaaacaagcttgggaccaagggtaggttattgtttaactatgcttgcatcttagcagaattcatgctcctcccataagtctaagcttgtggcctttcattagctttacaaaggtggtttcagtctgaacaaggaggggaagggactgttatcatccttgctttaaatttaaactgtaaactaaattcctcccgtagttatctgggcctacatccaggaatgagcaagggcagttagcttgtgagtttagaagcacaatggagtcacctatgttagatttatttcactgtaataatttcacaaaggcagtttcagtcacaagtatttaagagcagagacaaccacccaggaattcaaatctagattgaagtacaagctgttttaaagcctgcaaggttggtgtgtgtctggatgacaatggcagtgctcatttacctcaacaaaggctttcaacagccatagaagttggtgacaaatttatactctagtaagtatgtggtttacagataaggcaggctgagtttaaaggtttgcagtagggattgcaccggatagtgtgaaaattgtattgaaactgatattaaatatcttaaatataaagcattaaatgacattaatctagatgttccgctatgacttttatactgttatggctttcatctgttgctgccttgaagttgaggagaaaagagcaagcagtggcctctttgtgaggtccatgccgactggaactatcatcacacaaattactactaatatttgctttgttaaaaaaaaactttaggaacaaaaaaaaaatgagtaaaaactttctaagactatgtaaagactatactgacttttttgtattcctgaaacaagaagaactaagatacaaattattcaatcctagacctgaagaaattgtgtcccatggacaaagatgaaggcatttttctgctgccacctgcttcacaccattctctgccctctgaaaccagatgcttaaaagcaatcagtgactcactccacattacccaaaggataaattcccaaatccttagttggtttaccaaaccgtcaatcagtagcccccactcataccccttaccatcatctgtctccatttaccttattacactttaacttcccaaaattgaactttctttagtgtatattgaggaatattctctctgccaagaccactatccaaccacaccatatacattcacttgattaactccaatgtattctttgattctaatttataactccaaggcgaactcttcccttaaccctcaaattaagtgactccccctttgtcctttcataatgtcagggcacatttgtttcaaacacttttatagtgatacctttaaagaaatgtttccaaaacttcagtacacacaggaattatctggagatcttgttaaaatgcagattctgattcagagtgatgccagtgctgctccctgtccccatactacagagtaagtagcagtctgtctgttccactagacctgagagtaggatcctcaaagccccacttatattaggccccgaattaacagctactggaggaatttaagaaaacaatacacaattggcaacacaatttagttttggaatacaagtggtacttacaaatagccatttgagaaaaaccttgttaacttccttccctccttctgtagcttggtatttccaccttttctttccttctctttgcctcagtcttcactcctaaatggaagtggtctctcagttccctccttaatcacggattcttttcatgcccagtagtcaacccttgagatattttcagtggtagcacttcagaaaatgaaaagcaaagggagccaggatagagacatgaagaaaaataaactcctattctcttcctcagtaatcagtgagttactttttctttctccagatctcacctctctggccccatcagactatttattaaagaatcacaagtacatctctagactcctcttcagtgttgcattgctcagaaattcgttgtgtaggtggtgctcagaaatagaaatgaacctcatatcagtcattcatttacataaagacttgtcatatatataattatagtgtatatatatgtgtgtgtgtgtggtgtgtgtgtgtgtgtgtgtgtgtgtgtgtgtatttttttttttaaatagtgatgtggtcttgctctgttgcccaggctgctctgctcttggacttctggcctcaagcagtcctccctcctcagcctcccaaagtgctgggattatagacatgagccactgcatacagtcaagaattgtcttttaacatctaagtagagacttaatcttgttttatgtctctctctgtctgtctctctctctctcccccaacgtgtagtcattttattccaaaggtttgtagttgcatggactataaaaatggaaaaataaaaataacacaaacttcctggggtccccttactacccatatccccataccttgtctcacctacgacaggtaaacagaatcttggagagcaagtgctgtggagtagtcactgcatccaaggtagagagtggtaaaaatgtttcatcgaaaaataatttttctatgaaatggacaggcctcttctccattaggtttaactgtgtttctgactgtgtataggagaaaatgggtcctcagatttccaccacagggtggttctactattagtacatacaaatctttgttaggctttctgtttctttattgttcaaaggcacaatataaggaatagggctagtctgtatttcagtgtaaaatatatgacactttatatatgtgtatatatatatatgtgtgtgtgtgtgtgtgtgtgtatgtgtatgttatgtatataaggttgatttggtctgtatctacataaattacatgatagatatataaatgtgtgtgtgtatatatgtaaataagtctaatgtatacttataatctatatatttgtatttcgtgtgtgtatatgtatatataaacctatattttcatttcttgtaataaaataattaaaataattaacatgaaaaagagatcagaagagaaactcttggtaaatgtataggtttgtctattaataagatgttagatgtgctatagatgtcatagtaaagataacatcccccaaataccaaggagaatagaatgattatactagggtgcgaattctagcaaattaaaataaatatctgcgtgatccatgtttgtaactatctgacagactgtttgctgttaataacttttctggaagccacaaacacagcagtagcactcaattatgatgcggtctacaatataacacaatgcagtttttctgctgccttcaagattacataggcagcagagcctaccataatgaactgtcccgaaaactcaaagtgctgtttgcagcaattttgcatgtgagtattcagattttacagtgtatgaagtctgacttgaatgtgctctacctcagtaattctcatttcaaaatattcacattaaaaacattcacatcttccttttttgattgaagaccatgctaataaaaaagcacatagaatattgcaaataaatagtcatagtgagctaagaactacatggaacactgagattcttcaaggtatgctaatgactttttgtttagtagatttcttgtgctgcagtacgcatgttaataagtatttcatcctcacacaaggtgcttggtgatgaacacactagcccagaattatcagcatacatttattcgattatccgcttgtaatcaagaaaatatattattccttttctcttgatattttggttcatattatctaagtatatgtctaaagcgttaataatattataattcacaaatgtaatgcttaaataggagaaaatattttaaagattctcaaaacctctgtaattttttttcccattaccaacatcattccctttttgctactacatttatcctaattagaaaaagtagcagagggtttgaaagaagaaaaaagaaaaggaaaagtgaagtcttcctaataagaaatattatgttaagtactaccacagcaaattatcattagtgggaattagaaggagcccccttaaatgtgtatataatgctatttttaaaggcttaaaatattttatttcaagttttaacagtatcctatgttactctttaaacattttagaaacttttacaactcagtttgtttcatattaaataagaacttagctgatctcttttggactcactgtggaacattgcattaattgttagccataggacaacaataaaaaaataattttagtaaaccacataacttaggtgactcatgaatgaaagcggtttacagatgtgcttattgaccagaaagccttaatgttcccctcagcttgactaactttagatagatcctttcatgattattggcctccgacctccctttgcttagagcattcactttagaaaatatggaatggtcaattctttctctgcccctttaaggtgtaaatcttctttcagtctcttgccagttttacaccccagaaatgtctttcccaaagatctgggagctagccctttgaaatgtaatcatcaagcaagatagtacccctacctctcaggctctttgggacagtaggagcctaactttgatagataagtgacaatctgcacatatggcctcatctctttgagcaactctccctacacaaagtcctctagtacttttccactagctcaccccaatacttaaaaattatcccaccttttgtactagtggaattgagttctgtctgtgtcacctattgcaagtctttaataaaatctttcttgcctgtttaactctgccttgtgcaatttttctatgacattatttagactccaagtttactgtgcagagtaaaggaatagataagtggagagattttttaaaagggtttaaatgaatgttctaagatatagcaatgactcatttacctgccatcacttgccttacccttttaaaccataatacttctccttctacttttatcattcatgatggaaatattcctaaaatgtagtagcaagccttctgtttctttctcaaaatgaagatttgtttctcaaattgaaagtagttttttgtgtgtgtttaaacaaaaatgtacatgtggaaaataagacactgcaaatcacagattaaagcagtgtttctcaaccttttaaaaatcattactgccccgctaaggagcttttttagttattttttcctgcctcatctccccatgagattttaataccatgaatacatggtatgtctgtttatgtactgctgccttttggggtgccataaacccttacagtatctaagatttgtttgctcccacccaagaaccagtttttgcaccattaggataatattgcctctttgaaaatgcatggtttaaagcacaaagtaaaaatcacttaaaatcccgtaccacagaggtgaccactgtttgcctttagacaaacatccttccagagatctttctaaccatattttatgtgcttttaaaatttgtttttgtgctttaataacaatatggaaatgtttccatattaatatagacatcatccctttcaagtatatataatttatttaaccaatttcctgtgacatacattcttccttcgatttttatattttaagtaatactttgatgaatatcatgtcgtatcacatttgtgcatttgatgtgctgtctttagaaataatttttcaaaatgcaatttctggatagagaggcacatacatttaatttgtttttataaaaatttccaaactatcttcccaaaagattttaccaatatacattctttcatatactgcatgagaatgcctgtttacaacatagggtattatcaatttgtttaatctttgccaaacttatagacacaaagtaagtcttcactattgttttaattctttattcttttatccttaatttgataactaattcattgagtttttaagtaagcatattggctatttgcatatttaaagatttccctcatcttgtaactttttgtcatttttttttactttttttctttgtagtccttattaattacattgcctaaaagataataatcatgtacagtaatgaatgcattttacagttgtgcctttgggaactgtatagggctctgtgcctattcatttcacaaattatttttgctttcttctgaactgacttcatataaaaataaagatgatgataactatggatacattaatgcatgtaagctttatagaaaatatttgtatataaaatagatattttatattaattttatgtgtaggtatttttttaaaaaattaaataatttccagtttttatttatcataaataattctcttttatttaaaaagagctctaacattctaatgtattcttttcatactgaaatttataaaccttctcagttcccttctcaatcacttctgctctatagactttgaactgacatatttatttgatttctttcatctttatctcttttgtaaaatgtcattaggctgagaaaaatataatgagtccatgaagagatattttttaaaaaaacagattttatggaaaggtaaaaatcaaggagaaaactcaggagagtgtgaacacatcagattaatatgatcattgctctcgttccagttaggctcattccaaatattttaacgtgctggtcatgtgaagtaatacttcttttcatagttgtcacactgttttttgccatctaatctgctgtccacttctccaaagttatttatgagatttgttattgatacatcttaatactttgcaaatgccaacattttcctaatattttgagtggaataatatatatttgtaaaacaaatgaaggccaataattatgctttagatttggggactttttgttgagaatcatcgatatagtttgatagtatttcattataccttacagagtatacttaaaaatactcatcaattattgttttaatttatagtttaggttcacaaaagcattatttaatccaaatagatttcacataatataaaatacactattttagccattttaaagtgtacaattcagtggattttagtatattcacagtgttgtgcaaccattaccactgtctaattctagaacatttccattactccaaaaataaaccccacacctttgaattctgcctcttctacctcctgccctatttcctggcaatttctgtctgtggatttgcctattctgaatatttcatgtaaacagaattatacaataggtgatcttttgttactagcttatgcaatagcgtatttttaaggttcatacgtactgtagcatttatcagcgctctattccttttcatggttaaataatattccattgtaaggatgtaccacattttgtttagacattcatcacattgatgaacatttctgttatttccactttttggctattatgaataatgctcccatgaacatttgtgtacaagttgataatgtgaacatgttttaaatttacttgggtatatacataggtgtgaaattgctaaatcataaggtaactgtttaacttcctgaggaactgccaaattgtttcccccaacagttggacattttatattcaaatactacaatccgtatgtttgtagtgtttgaagtttccaatttctccacattcttatcagcacttcctgttttctgggttttttgtttgttttattattgttgtagccatcctagtgaatgcgaagtggtacctcattgtggttttgtgccgttgtttttaaactgcttgatttatgaatgcatttgtggttttattaatagaattgctaaggtcaaaattatttaaaccattttcaaacatggtatgtgtcttgtgacatactacaaaaagttggcaatggttctctattacatttacgaaagaaaaaacctgctgatgaagttgaggctctgactgtatgtattaaactttaacctaagtcactattgacagcagagtatttcaacctctgaagacccagcctcactaaatttgcaaaaatagttttttaaaaattgtactaatacatttctatgttaatggaatggtcactttttcttttcaagtctagtatctaaagtactctgaaatggggaaaagatcatgcttttatagaaattttcttgacctgagcttccattaggggaaaaaacataacttccgattgaaaaatatatttacataataccaatatataaaccattctttcagggtaagccaaacacatctaaaaattccattaagtccattggactggcagttattatgttaaatatattttcatgaaacattttgcttccctggaagcaaggcaacaaaaaagataaaactaattaaaatgatatggggaagaaggagaaggaaagtcacagtcatagtatgttttagatttttcttactgatgaataaaaataactcctttgatttggattatattatagtaattttcatcacttttcaaaaatcttgttcaaaattgtttagttttagtaacaaaatgagcctctttctaccattttcttaggaattctgctactgggacattttgcaaaagctgcaaatgcagctttgattttactaagtaccgtgattttgcctgcattttcaagtacctagatagaagttagggcttaaattgtatttgctaaagttttgaggacttctgagaaaaaaatacaaaagaatataaacatcttataataattcccatactcccccgccctttttttttgttcccacttgtgtaggagacataacccaggaggtgatggagaggagcaaaaacctttccttttctttaatcacttgagaaagagagtcaatctaggaatagctaaaattactgggttctgagtgatgaagacttaagctatttgagaatgaaataaaaattttatgaagtgactgaaggcaaagtcaaaaataaagagttcacaaaggagaatatacagagtactctaataggtcctaaaggagattttagaaaagatattactttatcatactgtgttatttaaaattgccttcatgtttgtctatttttataaagtacatgtgtgtgtgttacaattttttggagatttttgctctcaattctttatatcttacgtgacagcaattagtaccatgtaatttgggcagaaattcctccaagcgacaagcagaatatttcacagtgacattttaatacatgtataaatatattaaaatttgtctctacaaatgcaaaattttaaagtaagatcaaataagaaaattatttaatttttattacttcctacataaacagagaatattttatttgtgggactttttataaatgctgagatgcctctccacctccaaatcagagtgttttaaattttataattctattatagattcaatcatttgggtaagtttacaatacatagctgttaataattattactgagactgaggtacatacaaatagtggaaagctaagatagtccaatatatgtgagcctctgttagcacaggacagtcattttatctgcagataaggacagttttatttcttcctttcctagctacgtatattttatttcgttttcttgccttattacacagactagatctttcagtactatgttgaataagagtagtgagaacagacatttttttgtcttattcctgattttagggggaaaacattcagacaatttgctctttcaccattaaatagcatcttagctgtaggttttttatagatgctcattatcacattgaagatgtgtcccctaatccctttatatttattcttctaagaattcttatcatgaatgggtgttacattttatcaaattcttttctgtattaattgataataatcatgtgatttttctttagtctgttaatatggtggattacactaattttcaattattgaaccagccttccatcctaagaataaactccactttgctctggtgtatacttctttcatatatcactcaatatgacttgttaatcttttgttaaagatttttgtgtttctgtcaatgaggggtgtttgacgtcagattaatactagcttcataaaattaattggaaggcattccatcttctcttttggagagaagaggtagtataagattgatgctaattcttctttaaatgtttcatagaattttccagcaaaatcatctggacatggagatttctttttttggagtagtgttttaattatgaattcagttttcttgatggttatagggctattcaaataattaaattcatattgagtgagttgtcacagttcatgattttggagaatagatccattttatctaagttgccaaattacaaagtgtagaattgttcacgttagtccgttattgtgcttttggtgtctacagggtctatagcaatagtgcctgtttcattcttcgtattggtaacttgtgtcttttctctttttgtctttgtcagttttgctagaggtttatcagtgttattgatcttttcaaagaaccagttcattgcttcgttaactttctctattgcttttctattttgaatttcattgatttctgctcttgtctttgttgtttcctctgtgcagtgtgctttgggttcatcgtgctttttcttttttcaggtttttgaggtgggagattagaatagtgactagagatttttcttcttctctaagtaagcatttagtactgtaaaattttctcttagcactgctttggctacatcccataaatgttgatatactgtgttttcattttcattcatttcaatgcattttttacattccttgaaacattttttggcttatagattatttactagtcgtttggtgtccaaatgtttggagattttcctgttatcttttttgttactgatttgtagctttactccattgtggccaaagaaaacactttgtatgatttcaattattttaaatcaattgtggtttgttttatcccctatctaggtatatgatccatgggaacttaaaaagaatgggttttctgatgtctttgagtggatttttctataaataatgaccagatgctgttgatttatgatgttgtacccagtcagtagatttggatctctagatcctgaagaatcttgccatgtacacagttggtgcttatgaagggtttgttaaactgtttggacctgccatagtattaccctttttcctgttaccacatatacctctcctgtggtctgttaaaatttccagaagaaaggcaagcagcttaggcagactacagtgatagtgtggcatcactaacaacccaaagttaaaaagtttgcaatagcagtcatttatttcatggtcaagggtctggagtttggcttggttttaattgatcttgtctgtgcttacctgtgctctactggactatcctggattctaggttttgggttagattcaaatctgttccatatatctaaattttaggattcatactgaaggagcaatagctgtctagatcatgttcttttcatgggaaaggatgtaagcctcaggagagctggcagaaacttggaatatctcttaaaggcacaatgtcacttctacctgtattccattgtccaaagccagtcacagtaaagtccaaagctaatgcgttaaaggtatatactctgcctattccagtaggaaacacttcaaaattgcgtggcaaaaggcatggatgtataagtctattacaatgagggagtgaagaactggaagctattattcaattttcctttgactttcaatctttaggactttctactctacacagggatcaggaaaatgaaaattaactctccacaggaaaactaatgctccacatgaaaatccctatttggattgaaaactataaagaatgtttcccttgacatatagttaagtcttatatattatattttggataatttgaagaaatggttttagtaaattaatgagaaaatgcttcagaatatactttatagtacatcaaaggcaatgtattttcaaatccaggctgtattatttgtttgtttggttttttttttttttttttttggttttgaactatatgtaggcattttgttgacaggactttttgagaatccattgcaagcctgcacagctacgttaaatatatgaatataaaataggactcaaccttatcaatttgacacgtgtgtgtgtgtgtgtgtgtgtgtgtgtgtgtgtgaatgtggtaaaacatctgcatttgtcatcaatttttggaaatattcgaaagacttttgtgaatcaaaaacctataaattatttggtatttcagatagagatcatggaatcctattaaatgatatatgtccagggttttgcaggtcacaacttgaattttattcgaagagatataatagtcattaaaaaataagagaaaaaaagaaccctggggacagaaattttaatttaaattcagggcaggcatgtagtacctgatattccatgtattcacagaatgacagaaaaccatccttacctgcatggaatgatggcagtgattgtttagtgtccattcaaaacagtaactggttgcagttgaagtagtacttttaatcatatggacacttgttccccaagaattgacctggagccaccaaaacataaacacagactattgagcacagaaggagccagtaattactttcaatcactccttgtcaaaatggtttgaattcaaaccaatcattcataagagaggagctacctcattaatagttttcttagttcaagatcaagaaaaatgataagccatattaaaaattgtttgtgtttgcaagcattcaggagaatgacatttgaaacacaattaccaaaacaaaataaaagcagctaacttataattcaattagagcctttccaatatttgtcaaataaaaaagagcaaatttcagtgaagaaaatcaatgaaggaaaccatttagaacatgcttattgctgtttgacttttgtcagttgcaagaaagggaaatagttgaaatattggcagtaaataaattttacagttattacttgtttcttctaattttctctcccttattgacttctcatttctggtaatatggcaataaacaatatgtaaagagctcagcactggatgtgattaatgtatgcagtatctgcagttaaaacattcttctctactgatgtctgtgtcatgatcctccttttttctcattttccttcaatgttgatttgcctcctcttaccttttttcttctgttattatctactttttacaactttaacaatgaccctgcatatccttcactggcctctctttcaaagaacccatcctacaaatatgcccagctacctactagacatgttcactggaatatgtccatgttaccctaacatctcccctcctttatgttgtgtcctgtctcctatccccttccctctaagtaaccaaaatcaactcattgcttttgattttctaattagttaattctggcacttaagtcaaaatcaccattgtctttgatttttgcctgcagacacttccttgttgaatatgtttgtgcaaacttctatcagataaatgtacctgaaacacacttctcattgtgtcattttactgttccacatgaatgtaaccattgttgatgtatactgggatgtggaaatgtttgggaagcactgatgaatgaattaacatgattacttcttcacaactatgtccctgtactcactggtgctagtctgctagtcttgaagatctggtgggaagaatagctctttcctatactgcacacttcttttcctgttgcggtggatattttctcaaaactttatcctcaggcaaatgattccacgtgcttacttatatccgtaaaatcctcaaatttcatagttagctgatggcaccttattattttattttggtgtgagaatggaaagactcattctcttatacagtttctgccatttcagtatgatttcatttgggaaataaagtaagataaatgttcttatttcagcattttatatatttttaacatctttattttgaaataattttcaacttagaagagttcacaaaataatacatagagttcctgtgtaccctttgtataacttctccaaattttaacttacataatcatagtacaattattgaaataagaaaatgaacattgattttatactattaactaatttacagattagttctggtttgtacagtgtaatgttcaactattagtatattcactacatttatccaaagttttgtttttagagcctgcatagccaaagcaaggctaagcaaaaagaacaaatctggaggcatcacactgcctgatttcaaactatactataatgccatagtcaccaaaacagcatggtgctggtacaaaaataggtacatagaccaatggaacagaatagagaacccagaagtaaacccaaatacttacagccaactgatcttcaacaaagcaaacaaaaacataaagtggggaaaggactcccttttcaacaaatggtgctgggataattgggggaaagagtgggaggggggtgagggatagaaggctacaaatatggtgcagtgtatactgctcaggtgatgggtgcaccaaaatctcacaaatcaccactaaagaatttactcctgtaaccaaatgccacctgtaccccaataacttatggaaaaataaaatgaaaacaaaacaaaaacacacaaagttttgcttttacttaatttaaaacaaagaaattttgtaggctgcatgtggtggctcatgcttgtaatcccagcactttgagaggcttaggcaggaagattgcttaaacccaggagtttgaaaccagcttgtgcgatacagggagactcttgtctctgtagaaaatttaaaaaactagctgggtgtgctggtccatgtctgtggtcccagcttctcaggaggctgaggtaggagggtcacttgggcacaggaggtcaaggctgcagtgagccatgatcacaccactgcagtccaacctgggcatcacggcaagaccctaactatctcaaaaaaaaagaaaaaagaaggaaaagaaattttgcacttgaaaatagttactgatctttagatggataagtaaaataataaaatacctaaaatattttttcattttattctcattttcaaaaattttatcttttacttatctaattattattcatcctagttgactattttcattgtacagagcaatccccaccattatacgatgaaaccttagcaagtttttgttctttgcaacctaaagactaagaatccttagtagaatcatatatatggaaactcttgcacaggaaccaaatgtgtaatgtgtctcattcagagtggaagtgggaccaagaaatttattaggaactgaagtgtgtgctctcgcttgctctctctctctctctctctctctctctgtctcaatcttagtgctcacaaattatttaatattaacctactgaatactgaatatgttaataatttattcagtactcagtagttttttcttcttgtctctatataactcttttacaaaacttttttctccccttacaaatggcaacattatgaccatcataatcaaagtaagtcatcttccagctctattattcgccatagcctagaaacttccctttgtgactctgttcataatgcaaaagaggaatttctgaacatcactggttttgggagggcagaccactgatgtgtcactggcttgtatatcgatgcctttcatcccttatgtcaggttcttacctctgactaaaccaaactagctatatcatttagtctttgctacattgcaaccatctaccccaaatatagtaacttatataataatcattcatttgcttacagtatggtggggtcgtcaatttgggctggactcagaatggcttatctctgctctacatgaggtcaacttatgtgtctgcaagttcaagtatcatggctgagcttctctttttatgtgttctcttatcctcaaggagcttagtctaggctcattcttatgttgatgaaaggggtcccagaaacagcaagagagagcaatccacaatacagaagtaccttttatgtctctccttgtgttacttttgccgatgtcccattgaccaaagcaagttacatgggcaagctcagattcaaggtatagagaaatagattttaccttatgttagaagaagttgcaacaacacattgaaaagagacatgtggctgggcgccgtggctcacgcctgtaatcccagcactttgggaggccaaggcgggcggatcacttgagatcaggagttcaagaccaccctggccaatatggtgaaactccatctctactaaaaatacaaaaattagccggatatggtggtgcacacctgtagtcccagctacttgggagtcagaggtgagagaatcgctttaacccaggacgcagaggttgcagtaagcctagatcatgccattgcactctagcctgggcgacagagtaagactctgtctaaaaaaaaaaaaaaaaagaaaagaaagaaaagaaaagagatatgcatacagaaatggaagaatttgtggccttttgaaaaatctgtcattctaggccaggtatggtggctgtaatcccagcactttgggagggtaaagcgggagaatcacttgagccctggaatcagaccatcctggacaacagaaaacagaaaaaacctatcacactaatatagggaacctgggtgttacaacgtagaacataactatttaggacaaaaggggatgtggacaagcatttccccagccagacttgtgaattagtagctccagaatgtggctgatacaatgagatcagcagggtgttatacttcatttatattgatgcagtttattttattaataattataatgatctcaacgagagtcacgaaacaggttgaggaaagtatataaataaaaggcacacctaccatccacagtcagtcctttgattgtagtctaattaagactagataatgattgaatatcattgtccctgatggtggttttgtagtacagacaaattaaaaaggtggtatacttcctgatgtgaaagaacccactttgggagaaaagacaaaaacatcatcaccatgaacattaattggggtcagtgttggaaaaatgggaatttattctagctttcctttcttcacgttagccctgtgggctgaagttgtacattttttaatttctcttgaaaattgcacagttactgcccactttgtgcttttagattgggtaaacagaagcagtaaattcccagtagctaatgctttgctgtgtaaaggtggaaaatccgtttaaaagtagtcatataaacctctattttctggaatgtttctaagatattagaattggacacatccataaaacagatttctctatgaggtcagcaggatgccatacttctttccatgcactaaaaggcacaccttggttctgaaaggcttaatagtctcaaaaagtgaacactccagtcttcactctgtatagattcactcccagggagagaagggattctactagtgagcagaaaatcaattgctgagtttctgtagctgctttaacttttacttaccagtaggacgccattttctctttgggaaccccactggcctaaacattagctcccttttcaccagcagggtcaggcccttgctgtttctgagttaggagttttatacaatatacagaaatgtccttatttttaaacatataattgcatataaaaatgtgttggtattccttagagatagttgttacaagagaaaacctacaaggaagtaaactgtaattgaccactgcctgacccgttatatggctgtatttaagttttatcctccataaaataattatgatggctttgtgtgttaaaaatagctatttatattcatttgagtgcaatacttgttattctctgccctggttcagtcataggagccctgaaaagcttatggcctgaaggttttgagttctgagttgaacaggataaacactcctttgacttaaaggggaagatgacctttaccattgtagaattcctgtaacaaagttgctgttcattaagtatcatttatgaattccaaaatcaatttgaaaaccacatgatatatttttaataattctagtacacgacatactgtagaaaactgctcaaattgagagaaaattaaactagaaataactaccagttgactgagtacaacttttagttgaaaacagtacagttgtccaagatgtatgatacagtaccaaacggttctcaagactttttgtcctatatattttttttaattagaaaactcactttgaaatttttgacctgtcaaagtgaaagcatatcttgaaaaacaataaagagcaagctggttaaacattgaaaaactgtgaaatgttgaaagcctccccggtgagtaggaacctcattttattacatctgcgacaaaaaacaaatgaaaccaaagatctttgacagtcatttttttataatttatttttagtaagtcatgctgtatattgcgtcttttaaattagggtgtatcagacaatacttagactgttctgtttagaaacttagaaaaccattttttaagggggaaaaagaccaatatgtgctacattaaataatcatctaaaaataaaaagcaattttggttctgctatttcctaaggcttaattaaaccatatatggccaatacagtctagtgactaaggaacaacacataccatgatgtcaggtagcagttttctttctgtgagatgctacttggagggaatatgtttttaggactaacaaagcacctgacaatttattgcaatgaacatattaataatcatttagcaacatacaagtggttacatatagtatgctcttggagaaaccagttatactttgtgtagccgtttcctcaagaaataatgcccagtataatttagaatggccttagaacatttaaaccagtggtgtgctgaagacaacttgtatcagctcgcaagagactggtaaatggtacaaatcactgacctacctccctctcagaaaaaaaagtgattaaatattcatcagtgtattactgaatttttaattatatatagtttaaaaacgattggattctacatgatcttattttgaatgaatatccatctttttattcttactgtggactctcagtgtaagttcctgaaatcaactaaatacatttataaaaataatttatcttaaaaaacatgatccatctatccttgtgcatatttgctattatgtcaaattgtacctcctagttagagtgcccattagtatacatgcatttttattatgccagtgtatgtggaaacccttttgctccccccaaaagacatgctttatcttgcctttgaaaatagaatttccagttgattagtttttattgcaaagctgcctttcacactttcacattgaggtaattatatgcgcctcatattgttttttaaaaaagatgtttcattcattgctttccaaaaaaaaaaaagcaaaataatttatttcctctgaagagggacatgaatttcagtgtttattcatgaagtttacaattgatatatgtattataattgtcctagaaacactttttacaataagatatctttgtaattacgcacctaggataatttggtataaaaagcagtgatattaaagagtgaatagtgtttgcaggtcatagagctttgctctagtattatttgctttactgcaggattcaacataaggcaggtgtcttgtctcatgaagtttattatagaaagagtccttataccatattttcacttatgatgtcgaaacttagaataattttattcaaagaatatcctttgagctccaataacacaaatcaggttataggaagtatcaccctggtacagaattgttcacatactcatttgtcattatttgaagaataaatgaatgaatactaagagcaaaaattagtggcataaatcagaaatccattcattaataaaggagaatacctagcatgtacttgaacagttagggtagacttcattgctttggtaagactttcatgaacatggagtttataagtggaaagacaagaaatgtttttggtagaagaaattgcataagcaagcatgctgaggtataacttcaagtacatttaaagttcagtaaggggccaggatggttgaagccaagattccctgaagttaattctggagagttggaataacattacgtcataggagagactgaaagttaatcctgttggtcatggggaaccactgagattttaccaaaacacttgatttagaaagattcttatattgtgtcaggagtgaaattagagtgggaaaaggaagcgaaagcctggactggttgacttagttccatgagattctctgctatttaaatgtgtcctcagtctccctgctgaaatctaaagaataatctgaaggcaaaattattcccaagtacgaaaatgttttagaccttcttcctaggcaaacatatttctcaattccatgtccatattacagagattgagtatagtagagactcagttttatcacttgtcaacattaatctgttgattgaaatagtaaaaatgtgaagaatttgattcaaaataattttaaacatatacatatactaatatttactaagactctttgacatgcataatacagaatcagagtcatgaaagtaaatgcgtaaaagaaagaaaatacgcaatgggtggttgaggaatacaaagacttttaatagaagtttcaggtatttcagttctcagagggaaatgggaatagctagcatttatccagcagtcctatatagtagtatagaacttgtcatttacagatgtcctagctagggctgctccacaacaataccatagactgggtgacataagcaatagggatttatttctcacagttctggaagctggaaagtccaagatcaaggtgctgatagatttggttccttgtgagggctggcttcctggcttgtagatagactccttctctcttcattctcacatggcggagaaggaggactctggtatcttttcttcttataatggcaccaatcccaccatgaagtcctgcccgcccttatgacatcatgtaaatctaattatctcccaaaggccccacctccaaataccatcacattgggggttagtgcttcaatatatgaattttgagggaacatattcagtccataacaacaggtgttaccatatttaatatttacaacgatccaatgaaaggtactattcttcccatttatacataaggaaaccgcgatagagatagctttaaaactttcccaagattagtggctgcagggtgagggtgttgagaagcagccagggtttgaagccaaacagattcctaggaaaaatattcttaactcattctctgagtttaagtagggtattagcagtttaatgatgatggggtaacagttatatgtaagtatgagtgtgtgaatgtgtttatctgtctatctgagtgaatgagagagtgaagaggcagggagagagagcataagcaataataacagaaggtaggatagtaatttaccactcttactatgaggtgtgggtgtactgttctagatgtgtaactaaaaggaataattttaacctgattattttcatcatacccacttggtggtcattttgtaaactcccacagctcttgtaacagtatatctcaatagtaaaaaagtctttgaaatctatattgggcacgctgagtaaagtgcatcttttttcttccaggaatctctttctaacagtggagaaaccaactggtgaagatcaataaagaatgcttgttttaaacaagagtaacttatgcatacatatgcatacacacacacacacacacacacacacacacacacacacacacagagagagagagagagagaatataaggaagaataaaatcatcttattttacaaaacaccagctgtgttccagtgttctatctattgaaaatgagaaagtatttgactaaaataaaaaaagaggaaggaaataatttaaaaatggaccaaaaaaaaaaacagtcaggagaagaaagctatattgaggaaatcctcttgacagctaatattatttttagcattactaatttgacttccttgataatatcagcacttttactattacaatcttaatgacttgggaaatgcaagctggatagaaaatgtcaaactggaaaggaaaatttcaaatgttttgctttgtaattaaggcctgacaaatataagtcaattttagcataatagatagattatcaagtagggacatttagctaatgttagaggtaaaaaaaattataatttatatttgaatacattctgagatggcttcagtgtgctgacatgttttaaaaagtgtaacaagtcttaacaagattccaggaggggatacacacatgtggacacacacatacattcccaactatctgtaaagggccagagagttcatattttaggattttatgggccacacactcttgatcacaactacttatctctgctgttgtagcatgaaagcagtcttagacaatatataatcaaatgagcatggctgtgttccaataaaattttctttacaaaaccaagcaaagagccagattttgcccccaagccatagtttgataagcacttatctaatacatattcatatgtttcatatagagggatagcttttactagcaagcagtagtaataggtgtgtgcatcattttaagcccttaaagagctaaatcatatccaatcattcaacctttaaaaaaatttgaaaattcatatattttatattttatctgatgcaaccgttcctattaatatttaattcaaatgaaagttgttaaaatgaagtggcattttcatattcaaatctactttaaatgtattcatgcttgtcagtgcctcaaatagaatctgtgaaaaattctcataaaatagatcctaaattttgtcaaataaacttggaaaataattgcagaatacttatttaccacttcccatacatgatttagcttaactaaggtgccgatatctgtgtatgatagcaagttaggtagtaggggggttggcatttatcttaaggagccacagtgacactaataattgatcagaaatagtcaagttcaaaggaagcacgttcaaaaaagatagtgaagtttctttaggtacaagacggaaaatggttgactctctctatacctaatattaaaaaaaaaaaagaatctatggtaattttcttttcttctattcttttttattatttttatttttttattttttattttattttttttttgagaaggagtcttactctgttgcccagactggagtgcagagtgcagtggtgcgatcttggctcactgcaacctccacttcccaggttcaagcgattcttctgattcagccacacaagtagctgggactacaggcgcctgccaccatgcctggctaatttttttatttttaatagagacggggtttcgccatgttggacaggctggtctcgaacttctggcctcaagagatctgcgtgacttggcctcccaaagtgctgggattacaggcatgagccatcacaccaggcctacagtaaatttttaaaaagcattttaattggtaattttacagtaacctgggatgcagaattgaattgttttatgaattaatctccaaggagttacttgaatttgttctctctctctgtctctctctctgtgtgtatatatgtacacatacatgtatatgcatatatatatgtatattctatgtagctctatatgttttgttccattagacaacctggaatacataaatgttaaaaaattttttgtgaaacagtggcccacattaaaaacggttctcatttttgtttgtcattcctcagaacaaaacagtatttggtggttcaacaaaatagaaaattaattttaaaaatagagaggaaaataaatttaaatatgatttttcccagtagtcctataatttatcttaataagaaaggagtacaggtttcaatgcagcattgttctaagactttttgtgcatatcagaatttggattcatgtttttttaaaaaggaaaagaaacacttgtcgtggaaaaagttattcagttagtcaaagtcaaaataacaaaataagaaacgtcaagtaagtaaatataacctgggagttctgaaataaagataacaaaatgattttatcaagtatctaaagtctatcatttctaaagtgggtaaagctatcataaataaagcagaattatatttacttttctaaatactaaattatatgcagtatatgcatacaatttgctttatttaagaagatggctaacttatctgattctttctttatatgttttagattaattttctagagttgactctcactcaggtctaggcagaaaattattggtgtggaaaatatgcccattccagtgaggtcatctattacatgtgcatgtaatatatggcagcaggtaattgagacaatgtctctttgagatggcagtccccttgaagtcattgccagggaatatatttctctttaattttttatgagacaatttagggaggggattttgtgacttatcagttccagaaattatacctagcaatacagaaaatgatatgttttttcttgtggatggtacagctttgttaatttttgattttgagatgctttagggtagagaccaggcttatcagctcaatgagaacatgtgtttttgtatgtttcattcttggccatatcacaagtgcctataacagtgcctggacaagagtacatgctcaataaatacttttgaatcacaggattaacctttacattgccgattgccagcagaaacttaggagaaagccatggtggataatcaaaaagtacgattaaattaagtggaaagagcaattataaataaataactaccttaccattccccacagtgggtctgggaattcatccttgtaaaaccacggagagtgttcctctgagagtgactacagattttttttttttttttttttttttttgagacggagtcttgctctttcacccatgctggagtacactggcgcaatctcggctcactgcaacctctgcctcctgggttcaagcaattctcctgcctcaacctctcaagtagctgggattacaggcgcccgccaccatgcctggctaatttttgtatttttagtagagacagggtttcaccatgttggccagagctggtctcgaactcctgacctcaagtgatccgccacctcggcctcccaaagtgcagattttgtttctcacataatgagaagctgagtgcaatctatatgctgtaagaatatcccattcctactcaatagtgtctttatgactattactttaaagaaatgaagtaaaaggtagttttacttcacatacaatatgtgaagtaaaatgtagttttggtttacatgtatatatgactatatgataatacttcaggaagtcattaatgaggaaaacgattccaagacacatacataatcggattttttagctattgtgtttgtagcttactttcaacattagtaagcagttgtaagagaacagccattaccaattactgtaaccgcagcattacacagggagaaatatgactgttgaccttgaaatgagtataagatcatccccagtagaagatcacagtccaacaactctcaactctggctgcacattgacatcatctgggggagcttttagaaaattttttttattagatctaggccctaccttcggagactcttcactgtttggacgtctgtacatttttaaagcaacccaagtgattctattgtgcaattatggttgagacgatcgaatgctcttcaaattgttttactcagataaatttaaaggaattttgaaaaaacgtgcactatctcccatatttcaactataaaacatttcagcatatgtttaaacagtttcaaagaatatacattcctctgcatcatctatgtgttctaaatatattttggttgaatctttgaattgggtatttaactcattttgtttgtgggaaaagataacattaagacagaggcttgccctgaatttttttccttagacaaaataaagatctgtacctttcaatattttctttaagatatcttcaatggactatcccaaatgctcagcgcattatttaatggtccttttgtttgatgccctggagggttttactccctggagcaatatgctttgataagatttgccatagtgaggtacgtctttcttcttcaaagtaagaaaagtgtggttagataagagaataggcacattatcagatcaattttagatgtgtctgaaagctgaagatctggaaatagattcccttaaatatgttcatgtctgtgtactccttgaaaagtcctcatattttagtgtatgtacctcagttggaaggtagctggattaaacttggagctggtagttttggggaagacagagacaaggggacaggcatgagaattggccaatccctggtgggatctccaaactgaccagcaggttgataggttggttgggaataaggtgagaactttttaatgagggccatgtgtgcaccacatatcatagcaaaataggagttcaaaactaagcagacaagcaacaatctaagcacaaatttataacagcagaagaaccagagttggagagaaacgagggaggtagccaggaatcaagaggaaaaaattctgaagggcaaataaagatgggagaatgaagtagaaaaattgttcaaaaatcagcaaagctatatggggaataaaataatacaataaacatgactacaccaccaatgagagatgccatcaccaaagaggtgagaatacatgaagctcgcctgtcttccgtttgatttttttttttttctgtgtctgccctttggagtaggaacaacttctcatgcatagtagaggcaaaaaccagcatctgatagttccatgtcttcagtgtggagtagaaagcaggaaagagtgggtagatcccgagtgcacaggaaatgcacttatgttcactgaaaagccatacagcatccaactatagatgacattggctggaaatatagaatcacaaaaattattcacagatcttttttttgctgaaatcattttaaataaagtctgacggggagggagagcatcagcataaatagctaatgcatgcagggcttaatacctaggtgatcagttgatagataaaggaaaccaccatggcacacgtttacctatgtaacaaacctgcacgtcctgcacatgtatcctggaacttaaaattttttaaaaaaagaaagtatgtgggaaaaaaaatatcttacagagaccagagatttttttcttttcaatacatttctttagtttttgttttaaccaaaacagagttccaacagttatctcttcagtaaatgaaagcatctccttaagctttaagtggtacttgaaattttaaaagaggattattttttccaactcagtgaggttataatatacactccaacaactttataaaagcaagagaagtagagtgttaattgttaattatatgaaagtgttcaggcaaaggaacttttaccttgaaagcctttactctttagcatcaaaataagcttgaaagttctatggtatttagggaggatattttaaatttcccctacccaagaaaactggataaggattaatacaaaaccccctccagaatattaatttaattaagtagttatccaaagtgttatcacaaatacatgatgtgagttcacacttcaggcccttacatttttatattgcatggcatttgtctttttaattaaaaaaaccccacagttctattgtattgccatggggtttttcatttaattttccatttaaaagtagttttatttctccttttaatttaattaaaaacgttaaaattgttagggaaaaaaagaagaaaatcctgagtcatcactctttccttccttatttattcacattattgatgaaggtctgtctagaacaaaccactgatagcacattatcctttgaaaggcagtgaaacaccgaaaattggagtttgctcactttgaggatcatcgaaaacaaacagctgaaatatttttttccttttagaaaattaaaaaaaaaactgatatgaaatttcctctatttagaagcccatgtctacccaaaaatagaaaaaaatgttttctcaaaagcccggaattagaacatcttacgacatcttcaactctaagttgaatttcattaaaatattttgttgcacgtttttgaagtggcaaacatcttgctttttggaaatctcagttttaagaaatgaaagaggtaaagagtatttgaattataatcattgtctaagccaggatcagttttctggggtgggagtacagagagatgcatcgggtagggggctagtggtcatggctaactgttataaaacttctattgatgccacccatttggatgacatgagattggatatgggctaagacttttgttgaaaggaacgttgtttacttggaagtgttccagtaggcatttgccagtcacagaatacaagaaagaaaaagggagtcattcattttatttcattaaaacatgtgttgaacatctactaaatgctgtaatctgtgctaggtgcagaagatataataataaaaccagccaaaagcgtgattctcatggtcgccagattgaaaaggggcttatcagttacggaagactcaatgcttccaaagctttaataccacccactttttattgaccgtttattaacccattttggctaggaaagggagtgaaagaatgtttacatgcatatttatatcactatttacataagatattttttctaataacacttgaaattgcgtttttaaattgttttatggaagaattttgagcccaagctggtacggtagcttactcctgtaatcccaacactttgtgaggcccaggtgagaggatagcttgagcctggaagttcacgaccagcctgggcaacatagtgggagcttgtctctacaaaaagataaaaaatttagccatgcatggtggcatgcgcctgtggtcccagctactcaggaggccgaggaggaaagatcacttgagcccaggagatctagtttgcagtgagccgtgattgcaccactgtactccatcctgagcaagagagtgatgccctgtcataaaataaaataaaatgaaatagtaatgtataccagcttttatttacctctattcttttttttttttttggtccaaagcatgtgtttcctttaattttttttctttaacttttattttagatatgggagtacatacacaagtttgttacatgggtatattgtacccaggtagtgagcataatacccaataggatgttttttgacccttcttccccaccctaagtagtctgtagtgcctattgttatcatgtttatgttcatgtgtgctcaaagtttagctcccatttatacgtgagaacatgcggtctttggttttctgttcttgcattaattcacttaggatagtggcctccagctgcatccatgttgctacaaaggacacgattttgttcttttttgtgactgcatagtattccatggtgtaccacattttctttatttgatccaccactgatggacacctaatgttgattccatgtctttgctattgtgaatagcatgggtgaagaagatacaagtgcatgtgtctttttggtagaattatttgttttcttttggtagaattatttgttttcttttggatatatatttagtaatgggattactgggtctgttttacattctttgagaaatcttcaaactgctttccacaggggctgaactattttacattcccaccaacagtgtataaacattctcttttctccgcagcctcaccagcatctgttattttttgacttttcaaatagctgttctgacttgtgtggatcatatcttattgtggttttgatttgcatttatctgacaattagtgatgttgaacattttttcctatgtctgttggctgcttgtacatcctttgatctcgaactcctaaccccaagtgatccacctgcctcagcctccccaaagtactgggattacaggcgtgagccactgtgactggccttgtacatcctttgaaaagtgtctgttcatgccctttgtggtttttacttgttgatttgattaggaatcttaagttccttatacattctggatattagacctttgtcagagcatagtttgcaaatattttctgccattctgtagattgtttactctgctgatagtttcttctgctgtgcagaagctctttaattaggtcccagttttcaatgtttgcttttgttgaatttgcctctattctgaaaaattctgtcacgtaccataaatattttgttgtagtaagttaggtaacacatttaaataattagctcaacatcctgaaatatggactactgccaaatggatacaagaatatatacaaagagagttctactccttgactgcccagtcaagttgcacacacacactgttcagatgggtccttggactatgtcaaatcacattgaagtaaacagtagttggtgattagattaggatgaaatataaaatccataaaagtaatcgcataaaacttttaaatggcaaaactgcaattacttttgcaccaacctaataaatagtttctctttattaggacatgcagatataataattagcctttctctgatcggtatggtctagatcagagatcagagaacgtttttgttttttttttttgagacagggtgtcgctgtgttgcctaggctggtcttgaactcctgggctcaagtgatcctcctacctcagccttctaaagtgctgggattacaggtgtgaactaccattcccagcctcagaaaacttttttacgtaaagggctagattgtaaatgttttcagttttatgggtcatgtggtttctgtcacaactattcacattctgtcacaactattcacagtcatgctttgtagcttgaaagcagtcacaaatactaagtaaataaatgcatatggctgtgtttatataaaacatgaggggatagatttggcgtgtggtccatagtttgccaaacactatctagacaacataaaggttcaaaggaggaggatatgacatcaaattggggcaatgagaaagtatttcattgaagaggtagcacttgctattattcttgaagcctggtagatgaggtaagctgacattgtggggtgatttctggtggacagaatgtggatagtttaagaaattgaatttttatgaacactgagcatttcgttatggcagaaatatagactctgtgtagaggagtgactctagatgagttaggaatgtagatttgttcatgttttagagttttcagtaccaggatgaggaacttgtacctagcttgacaggcaattatagaccattaaatagtttatatcacaatgggatttggtagaaaccacactggaagacagtcattctaggagtggtgtgtggaataaattagagaagtaagggactgtaaacaagcgagcggattggaagagtgtcataatagcttaaaaaggagacaatgagggccccaacatagtcaggtaagaggatttctaaaaaagaggttgttgaggtaaactgtaacattctaaaaattatttctttaattgacaaaaatactgtatataattgtgtacaacatgttttgaaatatatatacattgtgaaatacctaaatctagataattaacataagcattacctcacctacttatcacttttgtggtgagaacacataaagtctactctaagcaattctaaagaatctaatgcattgctattaactctagttatcgtgttgtacagtatgtctcttgaacttatttctcttatctaagtaaaattttgtatcttttgaccaacatattgccccccacagccctggtcgctaccattctattctctgcttctaagaattcaacctttttagattccacatataagtgaggtcatgaggtatttgtctttctttggctgtaacatttaaggatgaacaactgggaacctaaattatttccaagctgtagtcccaccatatgcaccagtacttttaacggagcctgcctagttcctgtttctagaaaactattcagtaaaacagccgtcttctatgtattatgtatttttcctaagtcgttacctagggactagaaccctgcctagatccctgtgcccagtgcttcaagccgccttaactatcttgtaatattggcctctatgaatttttaagtagcagaatcagctcccctgagattagtttatatctccccacctggagtggactgcatcttgggtctttgctcaactatcactggagacattcacatttgctgggcggcattgtgccgacccatcatattgatctgtaacgtttagcctgtggttgggcaatttcttcctgcaactattgtatcccactatgtcaaacaaacatcaggtcccatttctacttactccagcctcttgtaagcaactacccatactacaggcctgaatactgagatttgccatacttcagctttttttaaaaactgaggagtaagaattatagacatttgagctactcctccttgtatgtgtactaataccactatgcaacttgtctattaatattattacatacaatttgaaattatattcaaaatagttaacagcctggtcattgacccatcaaaacacttgccagacataaataactgcttgcttaccagctagaaaaatcagccctgcctgtgacacagaaataaaccttcacaaaaacactaaagagaagagctaaaactatgaaatgtccaaaagaaaacataagagataatctctgtgaccttggagtggaccaatatttcttaaatatgacacaaaaagcatgaacaagataataaatattcatgttaaactttatcaaaattaaacactttttttttcttcaagagatattattaagacaacctaaaaccaagccacagacttgggaaaagtattttcaaaatataaatcagatgagggcttttatccagaacatagaaaatgtataactcttgataataataagaaaaacacatttaaaaaaatagcaaaatatttgaatagacacttctcgcaagaagatatacaaatggccaacaagcacataaaaagttattcaataccattagtcattagggaaatgcaaattaaaaccacatagaaataccacattgcacccactagaatggctagaatccaaaagactgacaatactaaatattggcaatgaggtagagaaactaaagttgtcacacattgctggtgtgaatgtaaattgatataaccactttggaaaacacttttgcaatatatttttaaaattaaatatactatggatatactatatacgtaactataaatacactatatacatatataactatacaaaaatgtactgtgtatatatgtggaaatatatgtatattgcataaaacccagcaactccacacctagatatcttcccaagaaacatgtttatacaaacacttgtaatttaatgtttagactagcagtattcagagtagcccaaaactgtaaactctccgaatgtccatcaactagtgaatagataaacaaaatatgatataggcatacaatggcatgctactctccccaaaaagaaataaattactgatatatgcaaagacatggattgatctcacaggcattatactgggtgaaagaatccagacacaaaagtgtaggtattttattatttccattatatgacatttctagaaaggataaaactatagagacagaggcaaaatcagtgggttcctgggaccaggggtagaatcacagattagctacaaattggcatgaagaaactttggggtgatggaagtgttttaaaactgggttattgtgatagttgcacaagtatataagtttactgaaactcattaaactgaacatgtaaaatgggtgaattttattattatatgtaacagaaaagctgttgaaagcatagaatactgttatatgaggagattatttctgtttaaaggtgatttttctagaaagattttataatgtctaaaatataaaactggcacatcatagaatgagtacatataagtaaaactttttttttgcaggcatgcatatgtgaaattgtatggttctatttatggcaaacagaaggaaactttttacagtgaaactatgttcatagttttcaagggaaaaacagctccatgaaataaaatattgcttggggagttctttcataccgcttgtcaccagcattctcactggcttataagttataattgctctgtgataaaggcgtatgctttccttctctcttataaaaattttaatgagaacttggagtgaactctcactgaacctattttcattccaaaaatcttatgattttaatcttatgatcctcctgagacctggcactatggtctgtgacagcatgaatacttcataattattcctcctgtttgtagaaaacaccatgggcatccatcattccctctctcccctgctgcctccagggagtcacagcctctagcaaggtcagtaattgcagttttggttgacagttccaggccagctgaagcaaatccagctggtgaagactagccacaatggatattgactgacttcccttccttctttcacctcatagtcagtttggccttaaaactcttccttagtgatgtgatagatggacttaaatcatcccacaagagattccccagtacagagaaaatgaatggtttctctagagccatgtgtatatgtgtctgtcggtatttgggggacaattgatctaaccgtcctggggtaactgaaaggtctttcccttggggataaggaaaagactgtattggagcttgacatttaatattgtttggcatctcacatctctgtagataacctgcatgaaataaaagattcagccatgtgaattaagatggtattttggaagtggatatgcttcatttggctaacatcgaaaattctaataacagatttgccctgtgcatagaaaaaatagatgctttagatgtcaagcaaataattaagcattaattttttactttattttatgacaaatgcatagagagattcacacaagaaataccaaaggaatgccagatgctttatcaaaaaaaaaaaaacccacattatgaatccaaagaaagatagacaaatagccttcatagtatgtaatattggatggtatagctttacgaaaaagaagataaactttcatgtgaattgctggtgaattccagaaaagaaatgactttcgaaagtggtataatacctttaactctctaacttctcaccatgtggtttactcatagtgtagaccatgactaaagtaccggcagaaacaaacccaattaggcatggcctattgtatagatactgaactagtctagtgtctttaggtttgtaataagtcagggtttatttttttcttgcttttttaccctggtcccttgtttctggacttacttggggtttaaaagatgtatttgcttaagaataacttaattacccattctggataaaaatttaatggaatgtgttagaaggcttaagtgagatattaaaattaattgaaatcacgacccccacactctttgacacacctcccattatgaggtagattgtgagcggccttatagttactccacttaatagaataaagttgatgtgatgttatgtaacttccagactaagttagaaaaggtcatttagcttctacttggttctgtctagagacatactctgggggaaaccaacaccatgtaaaaagctgtcccgtgaccaccatgttgtggaggccccgtgtaggaatttcagccgacactaccgaccaacagttagcctccacttccagccctgtgagtgagtcatcttggatatccagcccagtccagtctttatgtaactacaaacctacctgatatttaactccagtcccctgagaggtgccaagtgagaactcctcagccaattccttctcaaatatttgtctcacaaaatttttagaatatctttaatatatgtgtaatagtaaaactactgtcactcagtaattttgatattaactgtatgtttattttggatattcagtttgttatgtgtctatttaaataattattgaatttctattaggaacacttgttcagcctatctaccatgagacttaaaaagcctaaatcacagtccttgccttagaagaatacaattgtcagtggagtagatgcaggatcatcaagtatcaaaactctggagcacaccattcatattatagtctatgtaaatggtctcccttgagttgtgcaatgggatgtcactggaaagataagacataaagtgttattttagtaataaccattcttatactggtaagcttctcaggattggtatatatgagtggtaaggaatactactaaattttatacttttccaaacttctttacagtactctgttgttgacaaaagtgaaaacaatttagttagaatgtaaaagtaacaaagaagttttaaaggaatatataatgttctgtcataaagacacaggcacatgtatgttcatcatggcactattcacaatagcaaagacatggaatcaaactaaatgcccatcaacagtagaatgaataaagaaatgtgctacatatatacaatggaatactatgcagccataaaaaagaatgagatattgtcctttgtagcagcattcatgtagctgtaggccattatcctaagcaaactaacacagcaacagaaaaccaagtacctaatgttctcacttataagtgggagctaaaccttgaggacatatggataaaaagaagggaacaagggcctactttaagatgaagggtggcaggagggtgaggatggaaaaactacctattgggtactatggttattacctgggtgacaaaataatctgtacaccaaacacctgtgacacagaatttacctgtataacaaacctgcaacatgtaccccttatcctaaaataaaagttgaattcaatttaatttaatgcaaaatataatcaaaattttagtctgggagtagtggcttatacctgtaatcccagcactttgggaggtcaaggcaagaggatagattgagctcaagagtttaaggccagcctgggcaacatagtgagtccctgtctctacaaaaaaatacaaaaatcagccaggcatggtgacatgtgcctatggtcctaagtactttggaggctgagatgggcggatcgcttgagcccatgaggttgaggcagcagtgagccatgattgtgccgctgcactccagcctgggtaacagggtgaggccctgtctcaaaaaaattatattgcactgtatgcaatactttgtaaatgcatatgctattcttctaatgcttttagacacttcagtgcgtgtcatgagaatatgccaagttgactaactataaactgatggttcccaaatttggctatacattgaaatcacctggggagttttaacaaccaactgatgtctggttcccactcccagggattcagatttaatggatcgggggtacagaatgggcattgggattttttaaagatctgaaattgttttaatggacagccacaaccgagaacaactgatatgtatttcttcttttaattaggtagttctcaaactcaactgcccattggaatcatctgtggaacttggcaaactattagtgatttggttccatttctagagactctgatttaattgctctggggtaggtcctcttggtacttttaaaaatgctcactagttaattgtgatttgagatccaccaataggatgctcatactgggtttacagattaatgtttttctgcatatatgtgtcactcagcctcagttaccacatcattactattgggacacagctcaggttgccaaattcagcaaataaaaataacttttcctggataagtttgaatttcagataaacaacaaatacttttttagtgtaagtatgtctcatgcaatatttgggacatacactaaaaagtaagtttttttaatttaaaattcaaatttaaccagataccttgtattttatctggcaactctaaacacagtataatttaggcaagagacagagcaaggcccaaataatgcattatatgaagtgtgaccacaatggtgttcaatccatattccaggacagaactaagatattcttattgtcccccagctgccacagagtaaccattctatcccataatactacttttaggcggtctcatctgtagcatccctcttatttattgagcaaaagcaatggacagatgtaggagacagacagaaaaaacctgaaacctcctgtcccatcagtgttaaatcttttggcaacagagagtgttaaatctattggcagcataagctgaaatcatgggactgaaacttatgacttaaaaaaagacaaacaaacaaaaatcctgtgggtttctattgtttttacttatgcaatttctcaaatattttcatgtaattatagaagagaaaaaaaaacagattagtgctgaagttctgatcactggctgaacttcatagccttagcagccactgttaaacttcgaggttctgtcgcatttatagtgacagccaattccctcagagttacacagcagttgctggcaagtataatctcacatttggcaaatgcttgcatttctgaagctcactttttcattggttcttctcaacaatgctgtgaagtaggcagggaagttatgatatccattatataactaaggaaaattagaatcaggaaagtgttgccttgacctagagtagtatttcttaacgtgtggtcctggacaaactgcctcagcattacctgggaacctgttagagacaaaaattctgaaaccctaccccaaacctactgacttagaaactgcaggataggcccagtaatttgtgtttttataagccttctagtgattctgttgcatggtcaagcttgaaaacccctgccttcaggggtatgtggtcccagctcaaacattactaatactaatgtttatttatttaatttatagtttatttgtccccctggagtttaaaggctgtgaggtcagggatggtgtcacactgcctaggtatataatagatatgcagcaaatattgcaaaataaattaatgaagactagaacgagtgaatgcatgaatcccacatatgggggcttccattgccatgccttgccttaaaagaagtgtcctgtgcttagaaaattccattgcttcgctcattctctcttttgaagaatctcagctaatgggaagaaaaatggttgactgcatgaatttatccacaggcatattgagactagatatttcccttgaccccttagtgggacttgcgaaggggtcgctcacttactcagcctgcagcactcaaaccccttgagggagggggagcacacaggtgagcggatgtgggagagccagggccaagtgcctttgggcaccggcaggaatgaaccttgtactggcctgtggcagagtaccacgtagtacctggaaggcaccttagtttatctagttcagtcctctcattgtatacataaagaaggtaaatttgtgagtggtaaagtctgtatctacgcaataaaatacttcaatagctggggctagaactctgatgcctttattccctttaatatgcaaaggttttgagtacagtgtcctgtgaagaatgcttgaaatctcaccatggggaatgtcaccagtgcaattctgctgtcttttatttttatttttatttattttatttttttagatgcagttttgctcttgtcggcccaggctggagtgcagtggcacaacctccgctcactgcaacctctgcctcctgggttcaagcaattctactgcctcagcctcctgagtagctgggattacaggtgcctgccaccacgcctggctaatttttgtgtttttgttagagacagggtttcactatgttgcccaggctggtctcgaactcctgacctcaagtgatccagcgcctcggcctcccaaagtgctgggattacaggcgagagccactacgtctggccaattctgctgtctttatttctgcttaattattacttttaatttcattattttattacaaaactttaactttttatattgaatggtattattaatatggaattttgtatttataaagtaaagattgaaggaagcgtatttactgctaatggaaagtatcgcttactttttccttcaaagcaggaaaagcaatgtgcaaacatgtaagtgaaggaaaaatccaaccaaatctcttacccgagtatctacattaatattgtttggtgggtgagatatttctgcaattctgcagtattaatccatccttctttattatgtccaccgaaggtgtaacactgattacagtatgttttagggaaaacaatcctcctaggcatagtggcgataattcttcgacttttttactttgctgtcttggctcatcacggtgacctttaattcattttctcttgtctggtcttctttgcagacactacgaagccactctgtggtgtctattgagctaaagtcaattaatcacagggtgacttttaaaaaatcaagattaataataggttatttcatagccagaatgcttgattaagatgggcacatttgtggttcccctcatggctagaaataatttagccaagttacaatatcttgggcaaatttttctctcttataattttcccaatgagaactgctcagtttaaatggacttccctaagcttccatcaggggttctcagaagggttatacaaaatcactttcgttagctactgggtactcctaaatggaagcatctttgtaaagccatgtagcattggcacctcttcacaaaaacttggggggagtccgtgaaaaaaataacgggaagtctgtctttaaagataataacgtctgcctccaacattttacacatctcagtcatgccctgtggtgggagcaaaagaattctcttttctctttagtcttgtgccaaattttcttttcctgttggcctgaatccactaatgtccttggtaggtggatcctggtgtattaaaagattcatagcatttcatatttatattctgcttaacaatatgatggtacaccttagcagtttagcaaaatggcaaatctgtttgcataataaaccatataatgtgctgcatcatcaatttgactttgctggatgaacgaagagaaccagttggctctgatgaagttgagttttacaggtcaatgcaccatccatattaaggaaatccaggacaactatgtacatatatattgtagctagaggctgaatacattttgtacaatatttcatttgctgttataaaagaaaaaaatataagcttgggtacagctaccatagaaatcaatttttaggttttatattattactgcctttctattccccaggtgtgctttttcatagcatctccatcctaaacacaattgcctttgaagtaccaatatatctcttagtggatgacaatttccaaactctactcagaaaatacagtgcaaatcctggtataatataatggaactaccaagagttgttatggggctacatattttctgttctctactctcttgagatcttagcaaaatcccttcttggtaaccttggcttattgaaaagggctaatttatttggcattaatcagaagacatataccatctctcaactagactctctccacaacgttcctttaaaatttttaatctagtgaaaacagggggtagctttattctgtaatagtaatatggttcatgatatggagactgcagaaagaagactgtaaagctgaatttcactgcaagaaaatcgtgacttcaatacttcaggagaaaatcttgttgttcagtttgctggaattaatagttattttacctgtcaaactgtagtaccatcgaagtttcaccagactgtctagaacagactaatttgaagaagtacaatttcccaagtaatgttttattctgcagtccctctcttcagggcaacacacccatgtaggacctctcccactgctagtttagtcatgtgaaagagaatacctcttgttgttgcaagttatttcatcatcatcttgctaaagaaatgtctcactctcctaagtctccaagatcttttattggccagattccatataaggctttgtgttctacatttgtgatctagggaatttaaagcttttcacttctagcttaccagaggcttctgtatgtggtaaatcatacattgatataaaaagtaaataataataatcataataatagttatggcttatgtaacctatctttctcaatagttattggaccatgataagtgatacctcaataccacataccccttcacccaccatccactatctctcatacccttcataaccaagcatctttttttcttatacaattttattaatggagatacaattcacataccataaatctaccattttatttatttttaaaatactttaagtttaaagtttattttatttaatttattttagagatagggtctcactctgtcatggagactagagtgcactggcatgatcatagctcattgcagcctcaaactcctgggcccaagagatcctcctgccccagcctccagaatagatgggactacaagtatgcatcgtgtctggttaatttttttatttcttggcatagacagggtcttctctatgttgcccactctggttttgaactcctggcctcaagcaatccttttgctttggtctcccaaagtgcctggtttattgacatgagccactgtgcctggcctaccattttaaattgtacaatttattgtttttgatatatttacaaagttatgcaactatcactactgtctaattccagaacattttatcacccccaaaacaaaccatgcacctgttcaccaaaaagtgactgaagcaggtatcaatcaatagaagtttatttacccaaagtcgagaaagtaccttggaaaatatacaaatcacaggagcatctgtgatctgggctttttccaaaggagggggtgggggaacttcagtatttgaaggggaaagagcaaataggagggaaaagaaagggagagagggtagcccctgaggtaaatggctaaattctagtgaggctctgtttagcttcagtaaatctacattttacatgtgaaaagaagaactagaggaaaaagtcaattaggcatttgtctcagggtaggcagagggttgataagctggcaattgacattgtcagggttagatttcatagaactgggttttagggctagtatatataggaagggtatgtatcctggaagatttaggtgctcacgaggcaattccttgtgagggaggccatctggggagacatgtgcccttctatagttatgggaaactggcttagagatgaggctatgacacggtgttgctgaattacagctatctgggaacaaaaaggaaggcagcattgtgattccgttcccaagcttaactttgcctttggcatagtaagtttggagtcccaagattctattttctttcacatatccattagcagtcactcctctttccccctccccctaggccctggcaagcacgaatctactttctgtctctatgaatttgcccattttgaatatttcatataaatggaatcatccaatatgtgactttttgcgtctggtttctttcacttatcatcaggatttcatggctcatccatgaaatgtctcagtactttattaccttttatagatgaataatattccattgggtataccaaattttgttatgcacacatcagttgatggaaatttacaattgctttcattttgaggctactatgaataatggtgcatagccagtcatcttgatagagttgtctatactcactttctttttctcctcatttcctatttactcttcagcctactccagtttgatttctgctccagtcacttccctaaaatggctttctctggtgtcaccagtgatggctatacaactaaatcctacccatttttcagtgtatgttgctacctatatctcacagctctaatttgacactgtagtgtagaccatgtcctgtcttcccttgatatgtatgaaagtacactcttctggttttcctcctgtcaccatggctgttgcttctctgtctcttttgcagactcactttttctccttggctagtaaatgtgggatttactcaagactgagtccttgggcaccttttcttttcactcacaagacccattctaggtaatttgacctccacctatgccttcaacaatcatgtatgtgcttttaactacaaatttatgtttataagttagattttggaactgtatacctgtcaaggccagactaatttatttaccctgaatatataaccatcttacatttttttattttcttagaggatgatttccattactcactcagcttgacaaggcacaacatttttaaaaaatctttctgatggataataatcaaatagttaacagctctggacactggctgcctgggttcagatccaaagtctacacatactccccgtgtgaacttggagaagtcacttaacctttctgtgtctgttacctcgtcagtaagatgggtacttttcagggttgatgagatgataacatgaaatgtaaatacgctgaagattttagaatcatgcctggcgtgaactaaatactttaaatgttcaccattttccctctgcctcatctcccatctctaattcttttctttatgtctaaagccagccagacacacagcttcccggtgctttagatataaaggctaaaatgtgtagcctggcctgttgtattagcttcgtagggctgctataccaaaataccacagactgggtggcttcaacaatatcagttaattttctcacagttttggagactagaagtgtgagatcaaggtgttggtggggttggttctttttgagggccatgagggaaggatatgttctaggcttctgtctttggcttgtagaaagccattgttatcttcttgttgtgtcttttcacatcttcttccctctatgtgtgtctctttgtgcaaatttttgttttataataaggacatgagtcagattagattagaggcccaccgtactccagcatgacctcatcttaactaattacatctgtaatgacgttatttccaaataagatcacattctgaggtactaggggttaaagctgcaatatataaatttgagagggatgggacacaattcagcctgtcacgtttggttagtcttctgccagcctctccaggtacatttttactctatgctttctcagcctctcagctagccatccacacagtagccttcttttaaatgggccacaatcttccagcctttccagacctctttctaaaagatatttcttcagctagaacactcttaattccatctcactgccccgccccccaccccccacgacccctcagaacacaggccattttgcatggcttatttctgttcatcattcagatttcaggtcaagatcacttagtgaggaattctctcatcttctaggctggatcaattggattatgaatctatcaaagaatgtaacccctaaagcatttatcttgcttcgtaattgtacatccattacatgtctttttttcaccctgcctatttcaccctgaatgatttgtcttaccctttgatctacagatccttttgagtatataacaggaactcaatcagtatttcttaaatccaaacattacttaagtattgctattttgacaaatcaagatctttactattcactgtaaacagctacttttttcccctcatttttaacacctcatttcctctaataatattgcatgtactttgacatcctttcacttgactgcatccttttgcttgagggaaggtttaagaaaggacgcatttttcatcaggtgttctattcccaacacagaaaagttgactgaatagttcttctttgtttgatatttataatgtcaactgattattatgttcaaggtgatttccaagaataacagacaattagagtcaagccatgtttctgtcccctgaaatcctgaacctatgtgtgttggctaatgtgtgtctttgtatgtacatttttacttactctccaaaaatgtaattgaatgtgaaatttttaactagagccagaattccgtagtaggaatcccaacttctacacttactagctatgcaacctggagtaaactgcctcaggaagtaatagtatttgccctgtagggtgatagtaaaaattaaaggagctaatatttgtgtctggcacggggtatgttaggccattcttgtgttgctataaagaaatacctgaggctgggtaatttataaacaaaagaggtttaattggctcacagttctgcatgctgtacaagcatggcatcaacatcgaagctcaaaatcatggcaagaaggtgaaggaggaagcctgtttatcgcatggtcagagagggaataagagagaaagaagggagaggtcccagactcttttaaacaaccagatctcatgtgaaactaactgaatgagaaagaactcatcaccaagaggatgttgctaaactattcatgagacatctgcccccatgatccaatcatctttcagcaggccccacctccaacactgggaattacatttcaacatgaggtttggagggaatacacatccaaaccatatcgggtagtaagcaccaggtgagtgttatctagtagaaggaggaggagaatacatagaattaacaggactagaagtagtaatatatgtaaagaaatatttcagcacttagaatgacatggtttatccttttatatgcctcacaagaaagaagtctcttttgctcacctttgcatcctcaggacatggcaccatgcctgttagatgctccagaaatatttgttacgtgaatattcattaatttattctttcatttcttaattcatttacaaagagttgctttcattgttttagatttagttgtttatgcttattgtaccagtgcctatttatactacactgcaggtctggaaaaatattacattttaaatttaatttgggtgttgatttggactcactgagcctctgaatacaagcctacttgagacaagtatgtaggatgttcattagttctcaaatacagttgatttatattttataacttgaagtactcctgctttttagcatctatgtgtgaattagcatataaagatatgagtaattgttttaatgaaaatttcacctctgcaccactctactgtgactttattgtgaatgcaattaggtttaccatagcgttctccctgtgagcctgtagataaggcatggaaaaattatttcttttactataatcctcctgcttaaatatgataggaaggcaccaatgaatctaataccattaatgttctctctgaactgaaactccttaaatcataaaatatcacataatgtctttttattaaaatattgacattgtttcaaaatgtgcatttcagagcaagttttatatgcgttcctacaacatatgggcatgttcttcatttggtctttcaattaacatgatgattaagacgaagcgcttatttctgtttctgatgtgttatgtccctaccactagtcacgtttcctataataattcatcacacgttatgaagttttttttttttatgtagtttcttttaagctttcctttaatatatatctgatgatggagacttacatataacagagaagttttcttttggaaacttagcatgactatattttagtttcattagaaagaaagagaattaaaggatggatttttaagaataattcattgtagagttgctatactcaagtactgaagcactttaggactcataagggcatccgtgtcttgcataataaagcagccaagatggagtaaaacgtaaaagcagacatcgaggtcattacctaatctggatggattagccatccagatgcctgaaggtcaaggactgaacaagatatctcaaggtacctacaaattctatgatttcatgttattaggctactgagtataaccagagacaagatggccatgtggttggaaatcatgtagaattacaggttagctcataataaaggcaaaaacaatatgtcggttagaaatttcaagtataagtgaggctaaaagtattttgtgaatggcatcactccatcttttataagataaccctatacatttttctctgtgtacttctattgtaaatgtatagttctattatcacacttgccattttacattattgtcgtgtatttatgtgatgtaaatagttataggtaagtcttatttatctgttctctgtaggacctagcagggtatctggtacagtatgtatcaataatcattagattaatgaactaataaattaaaagtgttataccccattagtaacaaatgacaagtcccaaaatattattttattcaaagtatttgatgccttaatattaactgatttgtacagcccattatacattccaagagggcaagggcagtattaaactgcatccctgaacttaacacgttacctgaaacatagcaggcactcaaaaatactcgaaaaaacaaaccaataatagctttcatttatatagcacttcctatgtgccacacattgttctaggcactttaaatacagtgactcatttactttttacccatattctttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatcccatattcttaactaatacaaaatatgggctctctacatggtatagatcagctgtactttcagtaaatctgtgacttgatttgaaaatggaaaaaataggattcatctcctaagatgttctgtgaatattatataaggcagtgtttgaagcatgcttggcctagcgtctggcatagcagaagttttcaagatatttttactattaagactattattattgctgctattattaaccatctcctccaatagttggcataagagaggttatacaattcagaagacaagaatagagaaagcgaatgctatttgtgtcatcagctatttgttgtgtttacatttctgcccctcatctctatatcctcgtaagcacactccatcttccaagtattcctaggttaggtggcatttaatggtatgtgtagaccctgaagatttgattacattgaaaacagcaatagctaacacttctttagtgcatctctatgtcagtcactcttttaagtactttatatatattaacataaaaacccaaagaggtaaatgcactattattatccccattttatagaagagaaacttgagatactgagtagttatgagaagttacgtgacctgtccagggtcaataagctggtaagcagagcagctggtaggtgaacccaggcagtctggctacaaagttcctatgccatgttgctcagtacatttaaaacttctgtaccaaaaaaatcataaacaaaattttaaaaacagatggcagagtaggaagttgaatttaatagaaaaatatctatgcaaaatacataaagacttgcagcaaaccaaaagaacaaaccacaagtaattcacagaagaaatacaaatagttaaaaataaccaaacaacctcactagcctttaaagatatgcaaattaaaacaagataattttaccctcacaagcaaaaataaaacagaaagaaaagagagcaaaacaaaaaaggaaagtaaaaataggactttgttagtattacctactcaatgtctgcttggtatctccacagggatatgcaatagttatcataagtttaacacacccagaattgagcatctgattccccttcacacctgctccttttacagacttctctatttcagaaaacgtcagctccattcaactagttgcttaggcaaaaatatttagagccctctttgactcctgtcttcctcacaactcacgtgaacccatgagcaaatcctctcagctccattttcaaaatttatccaaaattctgccgtgtagttcagcacctccactcttgcctctgtcatcctgtggctggatggctgtgtccccctgttacatctccccctgcttcagcccttgccctcctatagtcttccgttcaacagccaatcggccagtcgttcctttatgtctcaagacagatcatcactagtccctggtcagaacacccccagggtctttccatctcactaaaagtaaatatagagtccttattaccgtggtcttggagactctgcagacttaaccccatccccttctttcagccccaactcctgcctctctcatcacattttccagccctcttctcccaggtccttctctccactgcgatgactgccttgatctttcttatagttggtttctcatctgctttttctctctgccgggagtgttctttctcttagagctccatgcagttcacatcactgcctccccgtctcaggtcaccgcctgagtagagctccccctactgactgttcctgaagatagcatcctgtcctcacacccttcactgtccgccattccctgcattattttgcttcatcctacttaatattttatatattaaattgttaatttgtttattctcttcttaccccttaaactccttcattgactataatatctgaaagcagaagtttttttttttctttttctctgtctctcactaatgcattcctagcattagcccttagcatgtagtatcttttaaatgaacaaaagaatattcagcatcagctgggctctgtggctcacgtctgtaatcccagcacttggagaggccaaggtgggacaatcacttgagcccaggagtttgagactagcctaggcaacatagggagaccatgtctctacgaaatacaaataaaaataattagcaggtgtggtggcacgtgccttgtggtcccagctactcgggaggctgaagtgggaggatcgcttgagcctgggaggcagaggtagcagtgagtcatggttgcgtcactgcactccagcctgggtgacagagcgagaccctgtctcaaaaaaaaaaaaaaaaattagcattgtaagtgttgcaaaatgtataggaaagtaaattttcacaactttcttggaggattatttgacactacctatagcaatttatttatttatttttaagtttcaatagtttgagaggtacaggttttttttggttacaaggattagttccatagtggtgaattctgaaattttagtgcacccatcacctgcgcagtgtacgctataatgtagtcttttatccctcacccgcctcccaacgttcccccccagtccccagagtccattatatcactctgtgtgtctttgcatcctcatagcttagctcccacctataagtgagaacatatggtatttggttttccattcctgagttacatcacttagaataatggcctccagctccatccaagttgctgcaaaagacactatttcattcctttttatggctaagtagtattccatggtgtatatataccgcattttctttattcactcgctggcccatgggcacttaagttggttctatatctttgcaattgcgaattgtgctgctataaacatgcacatgcatgtgtctttttcatataatgacttttttttttcctttgggtagacacttttacccctctcttgtttggcttcaagccaacaacttcacagaaatcaatctttctttgtcctcgtatgttccctcaatccctaacaaatgttcgatgaccacttcttgtccaaattcaatggctttattgctgttctatatatttctgaccataaaactccatttagtactgtcaatatcaatatttacttttgggggcaataaattagacagtttattaattgaagcatgatatatgtatacacacacatatacatatatatatatatatatatatatatgcatacctttgaatggatctatttatgtacaaactaccaatggaatttggactcacaacatcggttataaccaaaagaatgtgccatcttggcctgatctacccctcctcttttgatatccttctatgcctattcttattaaaaagaataaaattgttttaaaagaaagacaattccactcattatatcacttaatgtaatccttgtgttggcacttttgcctttcattgatatagtttcaaccataataatatatgtaatgaaagtttcaaacttttcagaactgcctatttttggcggggagaggtaatgtgtactaaaggtaatccatattttatgtaaaaagtaaacacaaagaagtaaaaatcagttgcaatctcatcatctctacacatctcttattagtttgatgtttattatctccttttttccattttttcatctaatggagtctgttttacaagctgattttttatatagtacataatagttaatgttattaacataatagtttgctattatgtatactttcatgctatcattttatggctgaatgaaaatgccatttttaaccttgaaaaaaatcttttacttgttctagcagctttcttagttatgttttctttattgcaaaagtaaatattaatagcatccatccttaatacaaattatacttggtgactcagtcaatttaatatataatccaattttaaattttgttgttgttgaattattagatgtttaatgataaataacaaactaaaatattctaaaatcagccaataatttaagtttgtctttacattctctgcttcatttggctaaaatgaatacatctttaaaatgactagataaaatgatagtcatttgtcaattaatgataacctttgaggcttagtatagaagatatattgacaaatgggaggcatgtgccaaagctttttgcattaattgcatcagtatgataactttagtcactacggttccttcaaaatgtattcacataggccaacaaaccttcagtcattttaaaaaagcagtagcatctaatagtccaaggcaatagcaatccatgcacttctgtgacagagagggtgtttcaagaattttggcaaagactcacacttgaggaccaaggcactaaaggtattctaagctcagagagccaacggccattgcctgcttagctgaaatgaggtgctggtgtggagaatctgccctaggttgtataagccttgcacagcctgcttcaaaagagagaactggaggagatctagaggtgttctgagggatgtggtgttataaagagagtccattttaactctgcctcacccctttgtgggcagagctgttaaatggcctggttgctcctgtttttcctgcctcgtggaaactaaccaccacttaagaagtgcaactaccctgatgtgagaagtctacttgcatggtcatgacagaagataactaaatcacaacatctttgtaaattatcacatcatggcctctaactataggttggtgcaaatgtaattgaggtttttgccattggaagtaatggcaaagtaatatttgcaggcaaattgactcacaaaaggctgggcttctgggacacaggaacaattaaatgaagagggaggaaaaggaaaacatttatatgtatatgcttcacctttttaaaaaacaaccgagaatttgttaacattcatattatacttttaaagcattttaatttttcctattctataatacctgaaggatatggaacaattacacataaacatacagaaaattagtttaaaaaaccatccatgttccttctactcatcattaaccactatgaacttggaatataaccttcaaggcatctttctgttcaatttatgtaaatatgtctgattatacacaggtgattagcacagaggcagcataacatattaatgaagaccaaagctctcaagacctattgttcaggttcaagtctcagcatcctctcccccaccatcccttaccagctgtgtgaccttgattcattttcttaacctccctgtatcttatacatatgggtatgatactggtgtttactaatcatggggttgttatgaggatatttaatcacttagacttaagctttctaaagaacttaaaatgttcctggtacatagtatgcacaaagttagtgtttattaaatagaataattacatttcaaaagaaaaatcaaagaataggataaacagtattttaaaacatgctttcttaagaatgtggaataaacattcctcatcagtaaatacacatctatgctattgatttttaaaagctgcatagaatttcattttgtggataaagcatagttcctgattttcatacatttatgtcattccattttttgtttataatacatttcaacttttattacgggactttccaaacatacaaaggtagatcatacagtataatgaaccttcctgtacccatcacccaggtacaataattaccaacacatggtcattccttgtaatatattttaaatactcattttattccatcgattctgataagactaagataatggtcttaaagtgaagagcttccacatcttaagcaacaatattagggtatttgtgtttacgttagaaagacatgccttactctgtcctcaagataatggcttttatctgatgccaaagttaaaaagatcagttcctttattcaactccagtgaacatccttcattatatcttgtttccttctgatatatctgagaagaaaatggaataatttagaagatgccagtgggataaaacactatattcctaaatatagtgcagttttcagagctattttagccactgtaattgaaatcctcttgttctccactgacatattttggaagcccatatgtttagagtctgaaatttcattccaaaaatgatagaaagcctcttgatctcagaatggagagttactgaactgaattaaaatgggcaaaggcttcagtaaacttgaggaagtaatgtatggccttccacgtggattaatttcactctctatcctgggaagtatggtacccaggtagcccgtgtgaaaaatatcatgttggtgatgtccgtatgctaccatattagagacaaagtcatacgttctgcgatgctattttctaggcggtttgtttctttgcattacagtagtatattcggcaccacacagaagttaaaattataagagggaagtaaccttccttagtgagactacaactgtgaagctataactaatagacactaagatagaaataaattattcttatgatatataacataagcatgagcatgtaatattgttgggagctctagcagaaagtactacagtagtagtagttttttttttttttaagacagggcccggctctgtcactcagcaggctggagtgcagtggcacgatctcagctcactgcaacctctacctcctgggctcaagccatccttccacctcagcctcttgagtagctgggactacaggcacacgccaccatacgtggctgatttttgtattttttagtaaagactgtgttttgccatgttgcccaggctgctcttgaactcctggcctcgagcaatccacccgctttggcttcccaaagtgatagtactgcaggcgtgagccactgcacctggcccagtagtccattaaaaaaaaaaaaaaaaaaaaactcattgagcacctactttgtaacaggtactgttgtaggtgctagggataaaatatacttgtttctcctactggatcttgcttttcttggagaaagaaagaaacacaatgtcttagtccattttctgttactataacaaaataccacagacagggtaatttattttcaaaaaagtttattcagctcatagtctggaggatgggaattttaacagcatagtgctggcatctggtgagagccatcttgctatgtgataatatgtcgaagggtatcacatggtgacagggcaagatctttcttcttcctataaagccaccagtcccatcatgggggctcacccttttgactttatctaatcctaattacctcccaaaatccccgcctccaaatacgatcaacatatgaatttgggaattaagtttccaacacataaagtttggggaacacattcacaccatagcacacaataaacgagcaaaaaatactatattagatcataataagtgacatgaagactgatgcaacaaaataaaggaggtaggaggtaccagaggggaagaatggttattgttatttcagatacagtgttccaggaagaaactggtatctgagtagagagttaaaggaagtgagaaagtgcatgttgaaatcggtgacagaggtaaagacaggtgcaaatgtcctgaggcaggaacatatatcatgggcatattctagataaggctttggcttccttatgcttcctttttagtggggaagacagaacgcaaagcaaatgcaaaataaataatatgcagtcaggttgagattagtgttatggaataaaagaagagagagtaaacaatgggggaaggaacaacattaagtaggataatcaggagacttctctggagagatgacccttaccctcagacctaaatgatacactacaaaataaatgcctgtacaatcactaaaggattaacacaaactgaaggtaaaaaccattgtgtaagcgttttcctgaattcaagaattagattattattctgaagctattttaatattgggaaaatcttgttagcatttttttctgacaaagttcaaataatgatttctgaaatttaattctacctaatactaggtgtactttagaaaaataaccaaaatgagctgcagaagtattttactttattataataaatattacagtatgcatcatgaaatgaaagaaaaataatcctttgcctatagttttattatctccaaatgagtagaaactgaatgatgcatttggcaaagcacataaaacttcacttaagagatgtctgttaatacttgctgagtggaaaataatagctagcatttgtttgaacgcttgatgtgtgccaggtgggacactagggattttacaaacactaatccatttaagactcatacacctctgcaaggtatgtagtactattcttcctcctaggtagcctgagtcagtgtcaaagaggattctgtcttgggtctatgtgatttcaagtactgtgctcctttaaccccactcttaattgtgaaaatctttatcacaggactctgaaacttcctgtgattcactttctccatggtgtccacagtcctttcatgctatatgtaccacaaatagcatgaaaggacttccttttaacctaaagcctttttacaattaacccttgcaatttacgctttttgatttttgtggttagtgtctgttcttgtcaaaattgtgaattagagcaagtttctccttgatgtcatcacacttctttgaagtcatcaagcatttagttctcattaggcagaacaggccctggcgactcaaagtgtgagcaggagccagcagcatcagcagcatccccaaatctgctcaacaagagtattaacaagatccccatggaatctgtaggcacattaaagtttgagaagcgcagcgttaggccagcatcagcaacacttgggaccttgctaaaaatgcattatttgtacccgaagctccaggaatgtggcccaagaatctttgttttaacaagccctgcaggtgattctaatgcatgctcctagagagttactctttctcgggattgacatcagcaataccgacctgttgcaataaatcagtcattctcaagtctgtctgcatatgagaatgccctggaaagcttgtagatcccaggttccattccaatatagttggtctcaactatattccaatctgcaggatgggaccatggcattagtgtgttgttcgtttgtgtttgtttgttttcctgtgggctcctcagtgttaaaaatcattgccatagaattagaagatcagtattttaccactctcaagggatttactttttaggagaaattcgaatctccccaaaatagtgcccaaaggactaatctaaacacctgagttaccttcactgactatataactgccacttctgcccttcagcatgacactatgtctctttcctcattgaaaaatacataaaaggggaaattgtaacctctctattcccattggactattgttgagatgaacaaatgagtgtgagagtaggcacttgagaattctcaagtgctatacaaaaaaaaaaaaaaaaaaaaaaaaagctcgtggtctatctgagggtgggatgcagctctgctctgatgtgtaattatggataagtgatcagaagttcagaagttctcagacatcacagggactgcagctttttatttgtttgtggtgtcagctgaaaaagtgctaatgagatacactggggacagcctatggaaaataatctcatgaaatttttagaaaaagggagtatctatgatgatagttctgaaactccaaagctgtgctcctcagactttaatgtacacatgaaactcttggggatcttgttaaacaatactgaatcacaacaacaaattgtgattcagtaagtctagggtgagggctgacagtctgcctttccaacaagctcccaggtgatggcaacaatgctgattcgtagaccacacttttgagtagcgaggggctaaaacatacacaataattaggcctgttattttgcagatgccagtgtgattaatgaatcctgcctatgataacattcacgagtctgccctgaacatttttctgttcttttaaccctgattgcctttgccctgtagctcacatatgatctgtacctcctctttcttgcttacatataatagagcatattttatatatactcatatccagttataattctctaactatgagcaattgttttgttgagttttgttgtcagtgttcatatcataaattgcctcccccaaccttctttcatctctacaattcctttcactcttctttttgaactggcctgtgagtgtgctgttcttgccagattaaatgaatcagtcaatgggaatcttattcttaagtgtattggatcagatatgtacaagtgttgctcatgaggagagaaaagaagatgggcgtgcatgctattgattaatgtagtcacagaaatgcactggtcaatatgatacaagctgtttgcaaccgtaatagtcctgtgctgaggactattaaaaaactgaattggttaccactataaccactacagttatgcttttatttgggtaaaaataatctagcatgttgtggtttagcaacagaatgctgaagaacaccccgatgtgatgtttgaaggagaaaatccaatctattcagcctaatggtttgctacagtagttgaaaaaggcataaaaaatccaatctcctgggtagatgtagctcattgagtggggcatgggctggatttccatacccatcattccttggctagttctcttctgcaggacgtgaccttcacatctcatactgagtattgtgtaatcatcttctggtatctttcttctcttatgtccctttactcattattctttgttccccttttcatctttagtcttcctaagggcttctcagtttttttcacaggggtatatagatcagaaccaagtcctttcctaagcctgtgtctttatttcacaattcaacaaggaaggacactacagatcacatagctcacctccatacatcagagtataggccttactgatacatgcacacatagaaacaacagaagctggcggagcatggtggctcacgcctgtaatcccagcactttgggaggctgaggcgggcggatcatgaggtcaggagatcaagaccatcctggcgaacatggtgaaaccccgtctctactaaaaatacaaaaattagccgggtgtgggggcgtgcgcctgtagtcccagctactcgggaggctgaggcaggagaatcacttgaacccaggaggcagaggttgcagtgagctgagatcatgctactgcactccagtctggtgacagagcaagactccatctcaacaacaacaacaacaaaaaaacagaagccaataaataaattctgcagatctattgtgcagcatggtgactatagttaataataatgtgttgtgtattggaaaattgacaagacagatcttaaatgttctcaccacaaacataactatgagaggtggtgcatatgtaactatgagaggtggtgcatatataactatgagaggtggtgcacatataactatgagaggtggtgcatatataactatgagaggtggtgcatatataactatgagaggtggtgcacatataactatgagaggtggtgcatatataattggcttgattgtggtcattatttcacaatgcatactgttaacaaaagatcatgaaatttgcaggggcaaaaaggagagctttactttcctaaagaaatttgtaggtgggggagacgcccctttgggacagagcaaaagtgtgctccaaggagacactggagagttaaagattataatggcaaaaactgcaagactggggagagggatcagagtcttgattagatgacatttaagcctaaaaccacaaatctctctttgttttctgactctaggtggtcagtggttggtcacatgaggattttccagctgtagtctattttgagattgataacaggaactggtttagcttgattgcagaaaggggagtctcgtgacatttctgcaacattttttgagaacacagtgtatgtgactacctcctcatcttgctgtggcctcccagttctgctttaacttgagcatctcagccacagggggtttattttatctatatgttggggcataatttgacaatacatacttcaaaacattacattgtacactgtacattatacaatttttgtccattacattttggtaaagctggagataagaagaaaggcaagggggtaaaaggagaaacggaatacaagacaagtattaatgaatattttactacatgtaatgtttggttaattataagatgctaagctaaacaaaaaatgattttaaaaatgtcatacacaaaaattattaaaagttttattagatttccattaattcatctttaatgattttacagaatgacaaatgtgatgttttcttcattttaacccagtgtacaagtaatacattttttcttcaaagagtagtttcttataaaaatgtatagttttgttttaattagtaatccaccgaattacatcattataatgttctttataaggggatttattttctattatttaaatttcctctgataaatttttattgtgatatctgccaccaacatcttatagttaaaatagtatgcaaactaatggtcgtgcagatagttactagtataggcttaatactatgcaatacaaggagatgctttcattaggccaatggtttcttatataaaaattacttctttaaaggtctgtacagctagcagaatggcatttgaggggatttaggtctcagcctaattattacctttttagagctaacttctgtgaccaacacagttaaagaagttcaaagatcaccttatttaattttctacataggacttattaatctctgataccatgtggtggtttcatccttgtttaacagtttttctgactctcaatttcaagagggtaggacacttctcattttattattgtatctttaatgtctgtgacaattccaggcagcatggtacataggaactctataaaaattattgaataaatgcatgaatacatggtcaatatattaaaataaaattaaaatttaaaaaaaaagccataaaaaggtaatttgagactgggcacggggcagtggctcacacctgtaatcccagcactttgggaggccgaggtgggcggatcacttgaggccaggagttcaagaccagcccaggcaacatggcaaaaccccgtgtctacaaaaaaatacaaaaattagtcatgtgtggtgacacatgccagtaatcccagctacatgggtggctgatacaggagaatcccttgaactggggaggcagaggttacagtgagccgagattgtgccactgcactccaacctgggtgacagagggagaccgtctcaaaaacaaaaacaaaaaaagataatttgacaaaaatggaagtcgctcaccaaatactttgaataatgtacctactgtgattttgtatttcaagctacaaaataggaaagacattgttcttccttatttttgtttcttttctaacctttttcttttattattctataatatattggcatttcctttagcaaagggagttgtttggccttgcatccttcatacaaatagcaaatatttacacatacacacactcatcgctatgtaagtcccttgaagttcaagtacacagttactcatctgaggtatgtgtgtgtgtgtgtgtgtatatatatatattctgagtgtgtattttgcagctctagttttttataaatgtgtttctcacccctcgtagtcatttgtatgcacttaatgtaattgtcagaagttataaataaatatgtggttgttgtattttcatcattaggttgtaaattccttgtgggcaacaagcatcatataatgaagaaattaaagaaatcagaaccattacattgaaaacatgatgctttcaaatacacttttgaatgttcacctcagtgttctaattaaattctaatttcggtatacatatctccttatctgaatgcctttagcaatttgaagtgactgagtattctgattcatcccatattcaatggaagcatatcaaaattgtctgccatttaactgtgctatcacaagctataaataggacactactctctgccaaaggtgaattaattgtgataaagctatcttgataaaacttattcctcacttaagtgaaacatgcagtacctgattaatttctgcaacagctgtgttaaaagctctgcacttaatatcaaacttctacttcagtatatgtcaccatttttacagaaacagaaagtcccttgcatttgattagcctcaaattatggctcattgatgaatgcaaataatcaaacaaaaaaggactaattgtatagaacaagtaaatattatacatacagtgctcatttgcctacaattacacaggtaatgtctctatttagtttcttaatttctcattatgagacaattgcatctcatctagcagtatttaattgcattgtttctattgctagaataatagcatattcctttttttaagatgttgaatgacaaataaatttagattgtaatcacttattgttccttctctaagcaaaatcgcccaggcgtttcagttgcaatgaaaagttttattttctactaatgatggccaaaatgggagcattctagataagtctgtatcctgtctatcaccttcttcttcagttgtggtcataaccatgatcttaataagtctacttgactaataactttactattttctaaaggtgtcactataaaatcttacaatatttaacctcacataccaaacccctacaataatctttgtttctatttgtaactttacgtgtctgcattggtaaatgtcaggtacatttggaatgacaaacatgcagttacactgagtctagtttgtagtttcttatcctaattctcattctgaccttaacatcaaatcctctactatgagacagcagtattaaataaaactatcacctagcttctgagttatcttgtaagcataagtgaaatcttattcacaaccgtaagtgaagtcttgtaaccgtaagtgaagtcttatttacatgtttacatgtgttttttatgcttcgtgtattttctaaatgattcacttgctcttagccttttgcaaaaagtataattttttattgctgccgtaataaatacaacaaacagtggcttaaactacacaaatttattatcctatagttccataggtcagaaacctggcacaggtctcacttggctaaaatcaaggtatcagtagggcctcatttatttctggaggctctaggaaagaatctatttctttatctttgtcagcttccagaagtttctcacattccttggctcatggtcccttctgctatctttaaaggcagcagttatcagttgagtccttcttacgtggcatcactctgactcttctttcattgtcccttttctccctaactgcagctagaaaagattattcatctttaaagactcatgtgatcagtttgggaccatctgtataattcaggataacctccccactttaaagtctatagccttaatcacattttcaaagtccctttgccatgtacaaggaaatattcatatattttagtgatgaggatgtgggcatctacagggggccattattctgcctactacatatggtctcttattatttagcatgtctagtgcagttgtgtggggatgctggacttcttaacatgtgacattagttaggcttatgaagtcaagcattatagacattgcctgttaatgttgaagcaagcttgaacagagccacgcttcatctctagccttggtttgcttgtttttcctttcatttattattatttttcagtgaaaattgataatagagctgccttttctttttgcactggcattattgcattgcactactgaagaaatcactaaatctgtttattttacagaaaaagattgagggtccagttaaatttgtgtttattcaggacaatgagctctgtttttctcacttgggaattctccctcttgagacagatttcccaggtacgaccaagagttaagagatcaaagttttgtctggtgagaacagaacccaaatctctaggcaactcttgttaactaattttggggataccacagatacagattggagaacttttagaaattcatatcaagtttgatttatttaatattcatatttaatatgttacatgaatgtataatccaatgtaaatacgatttatttattatggaattgtttaatacatgacatgcttatagttataccgttaaggaatatctcttattttgcaacattttacttttttcctctcccaagtgctttgtgaatttcactaaataaatcagggtaaaatgcatgtagtttagtctaaaaatacttaataatccacccagagggaaaatatattttaatgcttgctgcataaccttaataaacagagaatactaatgtgcacttataggttaaagtaatatgtttaaaaatcatttcaacttttattttagagtcaggggatacatgtgcaggtttgttacatgggtatattgcataatgctgaggtttggggtgtgaatgatcccgtcacccaagtagcgagcatagtacccactaggtagtttttcagcccttgtccccttcccccactccccacactagaagtccctagtgtcttctttgtccatctttatgtccttgcgaattcaatgcttagtatcatttttttgaaacagagtctcgctctgttgcccaggctggagtgcagtggcacaatctcagctcacggcaacctctgcctcccaggttcaagtgactcctctgcctcagcctcccgagtagctgggactacaggcacgcaccatcaggcccggctactttttgtatttttttttttttagtggagacggggtttcaccatattggtcaggctcgtctcaaacccctgacctcatgatcttcccgctttggcctcccaaagtgctgggattacaggcgtaagccaccgcgtccggctgcttagtatcatttataagtgagaacatgcaacatttgatttttttgttcatgcattagtttgcctctagttgcatctatgttgctgtaaaggatatgatttaattcttttttatggatgtataatattccatgatgtatgtgtaccacattttctttatccagtccactgttgatgggcacctgggttgattctatgtctttgctattatgaatagcaagatgctggacatttccttaggttttagatggtttcttttgaaatgtatattgttaggtttaatcagtcctttgtatatagttgccttttgtgagaaatacagtaccaggtagcttgatataccattaaaattaagcatatagatttacctgctgtctctaatgccgttatgtgtgacaattcccatatgaggtaaatttaatgagttcgtttcttttaatatctagactaactaatgccttcaggaaagtatgaaagtatattgtgtctctttagtgaattccctttagataggcttaagatagccatatggctctaaacttactaaatgcagaaaatttaacttagctttacttctttcattcttaggaaaacagtcttcattttgttgattaacttccatttaaatgcttattttatactgtctttatttggactatgcttcattaagcctcaatttccatttaattttgcttgtgtcttattgttcgagttcctatgtctcagttcactaatgaaatgttttctaacctgtgaaaattcagaagagcacaaagatccatataaaagtacatttccagtttctaaaagaaaaattaaggtctactgggactctggtacactgcaaaacataaacactattcttactccaaattatagtcattgaggtctttcaattcccagctcccatatgttaaatctacctatctgataatgatattagttgcaaatgctttattgcttccctttgtatcctgtttcagtagctgttccttgtaaccttatcttgacattttcaaattcggtttgaaaatacaactagagtttaccattatttatggaaggtaaatgttaactgacattatatttacatttaggatgaaataggtgaatgctcaggtacaaataaaactaagtttatttatttctctgcttaattcaaaaggtgtataggttcaggtcatagcatagtttagggcaaagaaagtagaaatgagaacacagaacgcaggaatttgtcagttttgtgcatctatctcgtaatctaatctcagctaatgggactttacatttaatcacctttccagaccaagtctccagacccagctgaagttgctgttcatccatgcccaaatctcttttgctgacctcctaatcaagattctagtgtgttagcgataaggtgtggcaggcaataacccagtgatcactattgcttgtttcccccgacagttgtgccctgtttacacacttgagtttctctccttagttctgatttagagccctcggccaggttctcgaaatcactagtgatcttgaattcaaccacatggcttgcattctagcccttgtgcccaaacaacatgatcgaatcatttcaattgaaatacatactatcgctattgcactcagtctccatccctactgtctctgtctctgtccctgtctctgtcttcctctctctctctctctctgtctgtctgtctctccccttgaacaacctggtccttaattccaggcctattctctacaataagttcagacatttttctgcagtccctaagtaggcaaatctgaagacctcctagaacatccagcaagctttgcagttatatcatactgcagctatgaccatgcataacctttatttgacttttatttgaaaccatattttaatatactgtatttattatagagaagtttcttacattcaatgtttctaaatttacctttcacctatatatggtagctccctacatatagaatattaaaatttactgaagtaaaaatgtatttttttctcttttaaagccaccataatttgatacaattaaattatacggtgatatagtttgcatatttatccccatccaaatctcatgttgagttgtaatctccaatgctggaggtgggacctaatgggaggtgtttggatcgtggagacagatccctcatggcttggtgttgtctttgcatcagtgaatgagatctcacaagatccagtcacttaaaagtgtatggcatctccctccacactctttcttattccttttttttttttttttttttgccatgtgatgtacctgctcccccttcaccttctgccatgattgtaaacttccagaagcctccccagaaggtgagcagatgccagcaccacgctccctgtaaagtctgcagaaccatgagccaattaaatccgttttcagtataaattacccagtctccagtatttgtttattaaaatgcaagaatggcctcatacctgtggtttaactgagcacttaattcctttattattttagtgcagatgtctccatttttttcctttgttcatgaaacttttattgggaaaatgctaaatgagagttttactactatgaccacggagagtaggatgcacttgtgcaaagtctgggacctccagaagcttgcaatttaatcagtgaaacagactggacataaacaactctcttaacttctcagtgattggaaatgcaaacagtattctatttaaaaatgccatctggctttcataaggtttggaaaatacttactacttttaaacagcaaatcctccaatatttgaggtttgcaatgctaagcccatagggcatgaggcaacataaccctgatatgagtaattttgatgaattctccatatttagaagtaaattgtgtatcttgataataaattttataatttcattattgagtttcttcatacattttggaaaaaccccacggccctctgatttatttatagctgatttgtcagttagatgtaaaatttcctgcatgttgatcacataacttgcttttcctgtttgatttttttgtcctctataatttttttcagctcctaggtttatagatatttttaatgtagcccatattataataattcaacaattttcaacatctttaaactatgatttaagtatattttgctcattaagaattgctacctcctaaatttaataagaagattgaaagaagaatagctgttgacagtaattaataatattcttccatgtaggagctacatggcaattaattatttttcaggaaattcttttcacttttttgttaagaatatttcattatattatttttcagcactgtcagttttctaacattcatgtagctgttaatttattcataacttgaattcattttcagtgtcattcatgcagctttggctttttttcagcttgcttatattattttgtatatgaaaaatggataactttttgactaatttccttccacattaaaactgtgtagcattcttttctggttctggagaaaatataataatttaaggagatacattatgccatttatttcaatatattttaaaaccagtttattttcatgctatctaaactgctaactggttcatcttaaatttggtgatcctctatagtttaataattgtcagaataaagtgtttgagtaatcaagaatagagctaacaccaatccattagtttatatggtttgtactgattaacatcatcccattctgccatgggccttctcacaaaaatcttaatgagaaagagagacagagacactaaaacagtttagtgagaagtcaccaaaaaatttcttactagttacttggcacgcaataaggttgtccttgccaatgacgctaaccatgatgacatattaatcaatcaagaaatggtcatttatatcaataaatattcagttcttctattatttctcctttgacagtcgtgatttttctgtcagtctacatcaccattgcttccagatgagcctcttttagtccctctctatggtatgcccaagttctattcttcctcactctaggtggctgcaaacagttcttccccctcttggccatgtgtgaaggaggatggaaatgtgatttctgtaaaggctcctgccatttactttgcctgttacattgtctggcatttgcttcatttctatttcatttcttttcattgccctcttcattgtctcttactctcctttcttgtttttgcctcttaatctttattgatttttttctttatttgattccttacgcttagtcctcttcttctgtcattcttaatgaattcattcattttctattgtttcaattgttttctttttttttgttttttaaattgtggttttttcttttttaaaaaaaattttctctttagttttcatcatttaaaaattagcacagatagaatattccttagattaggtgcacacaaatattgaatatgtcattaaataacccgttattttatattatttgtactgattaacaccataccattctgtcccataaattcagaataaacatattgttttttgtatgttgtatgtcgtgtatgtataaagccatcttataagtttcactctgcatatgcctaggttacatattttggcattaagaatatcattaaaagccaactgtttttgagaaaacttttaatgttgggatgtaaaaaataaaccttattgaattcatcataattaaacagatgaatagcagcaataaattcagatcctgaataagaatcaaaccacaaaggttctttgttgactgaaacacaaaaatatgtgtgcattaattttattcttttgtaaagtgttactctaaataaaattactggagataatatcttgggtctcaacaatatcatgctttgcaaagtatttgtcactgctaattgaattttgtgtgtgaatataatgcatatctatacaaatagaacagcctctaattgaatctgggaggatttgaatattgtttgagtgttggccagtctactgacagatttaatcaagaaatggatatttatataaaagaattgtgcttaggagtaataacccatttagtcacagattcagtgttaacggattgaaaggtttgtggtatactctggctctatgagttttaatgaggcttcgtttcctcactttttttttcttttattcaggaagtgttaatgtagcatgcatttcagccttatgattttgtcaaatataatgtttatgttttattcattttggatcccctcctagaactgttattcacatatttgctactacacacatatcagatgagattcattgcagaacacacaactttaggctatatgtcaaatacgaatataaaatacaaatacataggtcagttcatttgtcattcacatttaaaagtggaaggtttaatataatcaattctctaatcccggtacaactgttcccccaaatctgttgaacccagccctctttctgtttgcttcctcaaagtaatgtaatggattttaaaacctatggtaaataaaccagtagaaattgaacttgtctattgaattataatctttgctgtttatttccttctaaacaagtttttattgatatataatatctgtacatattttgggggcatatgtgataatttaatatattcatataatttgtaaagatcaaatcagtgtaattgagatacagtcaccttaaatatttgatctttctttatgctagaaacattagaattcttcttttttctttttctttttcttttttttttgagatggagtctcactctcttgcccagacctggagtgcagtggcacgatcttggctcactgcaacctctgcctcctgggtccaagcaattctccctgcctcagcctcctgagtagctgggattacaggtgcatgccaccacacctggctaattttttttgtatttttagtagagacagggtttcaccatgttggccaggctggtctcaaacacctgatctcaggtgatcctcccatctcggcctcccaaagtgttgggattacaggcgtgagccatcgtgcccagccagaattattcttttgtagttattttgaaatatacaatagattattgttaactatagtcaccctactgatttatcaaacactaagtcttatttcttttatcaaactgtgtgtttgtacccattactcaacttatctttatcccctctttcccttacccctcctggcctcaggtaactgccaatctactctgtatctttatgagatctactttttcagctcccacatatgaatgagaatatgtgatatttatctttctgtgcctggttaatttcacttactaatgacctccatgttcatccatgctgctgaaaatgatttaattattttttatggcggaataatattatataatatgtacacacaatacatggctgaataatatttcattatattatgtatatgtatatatgtcacattttatttatccattcatctattgatgggtacctacactgattccatatttgggctgttttgaatagtgctgcaataaacatggaagtgtagatctctctttgatatatttgtcttttttcttttggatatatacccagtagtgggattgctagataatatggtagctctatttttagttttttttgagaaccctccatacagttttccataatggctatgctaacttacattcccaccttcctctacatccttgccagtgtttgttagtccctgtcattttttaaagaccattttaacatgggtgaaatgatatctcattgttgttttggtttgcatttatttgatgaataatgatattgaaaatttttcatatatctgttggccatttgtatgtcttcttgtgaggaatgtctattctgatcttttgctcatttcttaatcagattatttgtttttttgcggttgaattgtttaaactcctcatgtattctgactattaatcccttgtcagatgggtagtttgcacatattttctcccattctatgtgttgtctctttactttgttgattgttttctttgctgtgcagagctttttaggcggaggtaatcccatttgtctacttttgctacttttgctttggttgcctgggcttttgaggtctcacacaaaaaattctttgcccagagctatgtcctggagcatttccccaatgatttttttttctagtagttttatagctttaggtcttagatttaagtttttaatccattttgatttgatgtttgtgtatggtgagagttagaaatcttttttcattcttctggatgtgattggttatccggttttcccagcgctatttattgaagagactctcctttccccattggatgttcttgttgcgtttgtcaaaaatgagttgtctttaaatgtgtggattaatgcctgtgttctctattttgtaccattgatctgtgtctatctttatgtcagcaccatgctgatttggttactatgtctttgtagtatattttgaagtcaggtaatgtgatgcgtacacctttgttcattttgctcaggattgctttgcttatttgagtttttttttttttttttgtagttccatgtgaattttaagtttttttctatttctgtgaagaatgtgattgatattttgatagggattacattgaatctgtaaatagctttgagtagcattgtcattttaacaatattaacaatattaattcttccaatcaatgagcatgaaaaatctttcattttttatgctttttcaatttatttcgtcagggttttatagttctctttgtgtagaactttcactcctttggctaaattgattcctagatattttatattctttgtagctattataaatgagatttctttcttgatttctttttgagattgcttgctgttggtgtatataaatgctattcatatttatttggtttttttgtatcctgcaaatttactgaatttaccaattctaacagttttttggtgaactctagttttttctaagtataagatcatattgcttgcaaaaaggctaatttgatatcttcctttccaattttgatgcctcttatttctttctcttgcctagttgctctgtctaggacttccattattatatcgaataaaggtagtgaaagtgcgcatccttgtcttgttacagatcttagagaaaatttcaattttttctcacttagtacaatattagctgtgggtttagcatatatgcattttattattttgaggaatgttccttctatacccagtttgatgagaatcttttttatcataaagatatgttggattttatctaatactttttcagtatctattgaaatgatcatgtggtttttgttctcatgtccttgtatcgtatttattgatttgtatatgttgaatcatccttgcatcccaaggatgaatcacacttgatcatggtgaatgatcttttaaatatgttgttgaatttgatttgctagtgctttcttaatgatttttgcatctgttttcatcagcgatattggcctatagttttctttttttgttgtgtccttgtcttgtttttgtattcaggtcttacagaatgagtttggaagtattttctttttgtcaatttttttgaagaatgtaaatagaattagtattggttcttcttcaaatgtttggtagaattcagcagtaaagccattgggtcctgggctattccttggtgggagacatttgattatggctttgatctcattaccagtttcttcacattttctatttcttcatagttcaatattcataggttttatgtgtcccagaatttatccatttcttctaagttttccaatttcttggcatatggttgttcataatagtctctaatgattctttgtatttttgtggtctcaattgttatgttttctttttggttcctgattttatttatttgggccttctgtctttttttcttagtctagctaaaggtttgtcaattttgtttcttttcaaaaagccaactttttgttttgtcgatcttctgtacttttttgccttatgtcctaccattaccagagggtctcctatattccagggttttgtttgtttgtttgtttgtttcaatttcgtttgtttctgcttagatctttattatttctttccttctactaattttgtttttggtttgttattgcttttctagttccgtgaggtgcattgttaagttgtttatttgaagtctttctacttttttgatataggcacttattactatgaactttgctagtagtactgcttttgctgtgtcgcatagattttggtgttgtatttctattttcaatcatttcaagaaagttttcagttgcccttttaatttctttattcattcattgatcattccagagcatgttgctaaattatttttatttttatttttattttattatttgagacagggtttcactctgtcacccaagctggagtgcagtggcacaattacagctcactctagccctgacatcctgggctcaagcaatcctctcacctcagcctcccaagtagctgggactagtggcatgtgccagcatgcccaaccaatttttaaaaatttttgtagagacttatatttcccatcttgcccaggctgctcttgaactcctgggctcaagcagtcttcctgcctcagcctctcaaagtgctaggataataagcaggagccaccaagcccagcctgaatcctttttttttttttttggtatagagtcttgctctgtcaagtgcagacttgacagagtgcagtggcgtgatctcgactcactgcaacctctgcctcctgggttcaagtgattctcctgcctcagtctcctgagttgctgggattacaggcaccccgagcctgaatttttacgtgcttgtgtagtttccaaggttcttcttgttattgatttctagttttattccattgttgtcagaaaatatactgatgtgatttctacttttctgaatttgttgaggcttgttttgtggcctaagagatggtctaccctggctactgtttcatgcactgataataaagaatgtgtacttggtaacagttgggtgaaataatttttcaattctagatagccctatttggtttagtgtgtagtttaactgtgatatttctttgtcgattttctgtctggatgatctgtccattacttatattgaagtgttgaatcccatacttttgttttattgcagtccatctctccttttaaatctattaatgtttgttttatatacttgggagctctggtgttgggtaaataggtatttataattgttccattctcttgctgaacagaaccctttatcatgatgtagtgaccttcttagtctctttttacagtcttttattttcagtctactttatttgatgtaattatagctactgctactcttttttgtttaccagttgcatggaatatcttttcccaacacttcaatttcagtctatgtgtatctttataaatgaagtggaattcttgaaggcagcatatgggtaggacttgtttctttatccattcagcagctttatgccttttaattggataatttagtccatttacgttcaatgttattattgataagtaaggacttactactgccattttgttgcttgtgttctggttgttttagaactcctctctgttcctttcctattgtcttcctttatggttaagtgatttttctctggtagtatgttttaatttgttgctttttcttttcggtgaatgtattattggtttttgctttatagttactatgaggcttatgaaacataattataacattcttttgaagagacgacaacttatcttagataaaaaagaaaagaatagaaacaaataatgaaaatataaaaataaactctacattttagctacatccccccacagtttgactctgttttctcaatttacatagatttatattgcctatctcttaacagcttgctgtaggtattattattatgaaagatttgtcttttgggcttcatactacagttatgtatggtttacacaccaaaattacagtattagagtattctggatttgtttttgtacttaattttaccagtgggttttacaccttcaaatattttctttttgcatgttagttttttttcagatcgaagaactctcttttgcatttcttattaaacagatcgggtcatggttaattctctcaacttttgtttttctgggaaaaacattatttctcattcatacttgatggacagttttgccagataaagtgtttttgaatggcagttttttttttctttcagctctttgaaaaatgtcatcccaccccttcctgtccttattgagaagtctgttgcttatgaacttggaactcctttatgtgttatttgcttcttttctcttgctgcttttaggatctggtatttgtctttgacttttgagagtttgttgattatacaactttgagtaatcttatttgggtcgaatgtattttgtgttctctggccttctcatatgtggatatttgtctcttctcatattttagaaagttttctgttattatttctttgaataagctttctaccccttgaccgactccctcttgaacacaaatagtttttagatttggtctttttaagtaattttctatattttgtgggtgagctatgcttctttttattatgttttctcctctggttattttcaaatactctgtcttcaagctcactgattctttcctctacttgattcattctgctcttgagagcttctcatgaatttttcagtccagcagatatatttctcagtgccagtatttttgtttgatttttaaaattatttctctttgctcaatttttctaataagtttctgaattcactagaaatttttctgtgttatcttggaaatcagtgaatttccttacaactaccattgtgtattcttgttcagagagttcacatatcaccatctcattaaggtcggttactggttccttgcattgtccatttgaggaggtcatagttccctatttgttgtttcttgtggatgtatatctatgtttttggatttaaggatcagttatttattccagtgttccttgttttaatttttattggatgtgtttgcttaaagattcttttaatttacctgttgatttgattttctcttcttcttcttctccttctccttctcctcctcctcctcctcctcctcctccttctcattcttcttcttctttgtgcgtgcgtgcatgtatgctacttccttttcagcaccaggtggttccttaagcacaggtttgctttggttctagtaaaccatcagagtgcttcctgtcctgaatgagggaggtatccaaggggatattgcagtactatgggaaggctatcttgggtttcatgcccagggacctgtggaacaaacttcctacagtatagtactgctgaatggccacctaatttgttgtcttttttttttttgctgagttacagagtagtttccagggctgagaatggtagtctcacctcccctttgtatctctggctgtcctcggggatatttctgtcttcaggtactcctgatgtttccagtgggctgaggcagagacagttctgcccagaaacccaagatggtggggaaagtcattgctcacctcaatctcactttcactagtttggaaaccatgagttgtggggacatttttttttgcatacttggtgccaggtagattagaggagagggagtgtcatggatgtgaaagactgattctcttattctctgtcagagtttcttcacttctctatggccctaagaactgtctcatcctcatatttgagttctgggatattgctggtaataatctcagtgttgtgcatttgtttttggttttctgttgaggggaggaagtaaagccagcttagctctgcatcaccattatgaaaccagaagtctgtgcttatttattattattattttatattttattttttctttctttctttcttttttccttccttccttccttctttccttcctttctttctctctccttccttccttccttcctctctctctctccttccttcatttctcccttctcttccctccccttctctcccctcccttccctccccttcccttccctttccctcccctccccttcccttcccttcccttccttcatcttgctctgtttcccaggctggaatgcagtggctcaatcatggctcactgcacccttgacctcccgggctcaggcagtcctcccatctcagtctcccaagtatcagggactaaaatcgtctctacaattaaaaaaaatgtagagacatagccttgctatgttgcctaggctggatgtgcatctttattcttaaaaaaacaacttacggaaggactcaaaacatatgataccctcaaaagcttccattttagatagtacctatagtgtgttcaagaagctagctaacattctgttgttttctttactgacaaatttaagccaaagtttctaaatatggcattttacatgaggaataagtaggatttagctgtgcctattccagtattgataatacttataatctttaaaaaatagagaaaagtctattgaaaattgtaatagctgggattttcatttactttttttttggacttagcttttgtggtagaaaccacatgacaattagtctgcacaaaatcactgtaaactctatagtatgtacttggagagaacttgtttccttagaaatgctataagatttagggactttaagaaacattttcccacatgacagataacaattttggtggcaaatcttcattgtgaaatcaatctcctccttctactgttttttttaatacttaaaaacattatctggatttatatctctgtcctatagaaagtatgtcaagtgtacctgtggttgtcactcattaatgcacataagaaacacatgaaataagtggattcctgatcccagctcaaatacacttaataagagtatccgactttaggaagcaggatttttccagtttgtggatctgagtctcatgtgaactgttaggtaagaataattgtgatgtatgcaatttgtggacttaactgttcccaaaaagaagggtgtctgtctgaaaggctagcttaaattcaatggttactgaatgaaaataattatttttgtaagatattttctaaaatgtgattggtttatatttgacaactatataaaacaggatttctgaggctaaaattgaattgcatatttggttccaagcctcctaatacccaaagaaaaaaaacaatgaatattatgtgctttacattgtctatataaatttttgaagacatccaggatcatttacaatttctccaagaatattgagccttcataaacttgaaggattgaaacattagaggtgagtcagccctcactaatcccttaagatcaaccagtatgatatggaataagtctttatgtgagaaaaaataaaaataaaaatagaattgatggaggactagagattttgatgctgtaactccttggcagtgtcctacaggtttctaggtacagtcttgcctttctttgattgctaaatgatatttatgtgttattagtcttaccacttttttatatggagaagtcaaaaattagtactctacaaattctaagagtaacttataattctttaaattctttaacatttttgttctgttacaataacatttactaagtacttgcaataccactttatgccagtcacttggttcatatcctcataaaaatgttatagggcagaatatcagtcagagttctaccagggaaacagaacttgtagaagctatatattaagagatttattgcaaggaattgtaccacacagtgatggtggctgataagacaagttcaaaatctgtacggcaggctgtcagaaaatgtagtctggaattctcaggtacaaactgaagctgcagtctacagatggaatttcttcttcagaaaagcctcagctctgctcttaagcccttttactagattgaatcaggcccacccagattatccaggctaatcttccttacttaaactgattatggactttaatctggtctacaaatattttctcagcagcacctagattagtgtttggttgaattaatgggattgtagcctagccacattggcatgtaaaactgaccatcacaggtatgaacttttattgttctaattttacaaaatcaggaaactgactttgaaaaagttaaagtaaattgctacaattgagaaatgatggaacattgaacctaagtttgtccaaacccagaacccatattataaaacccagatggaaagttggcatttgactactaaactattaaagaaatgaatgctgtgtgtgctctggtgcacacacatgcacacacacgcatgcgcccacacgcacacacacacacaccactaccactgccatacagctattcaggaaaaaattataaagggatatttagtacatttgaatgcatgtattaatattgcggagattgaccagcgttttcattaattccgctaggttaattttccttttggaagccatgaaaaatgatctgttcgttataaattagagtaatcttggaagtaatttgacagtcaatcatcatttaataaaattgaaataaaatgtcaagagtaaactgtaaaagacaatgggatcactcatagtaattactgtcagtttaaactgaggaaaacagaatctgatttttaccgttatcagaatgaggtagttagtaatgaaccacaaatgtgaatctgtaaagtattgcatttaatttgttggatttctgcatattggcttaatggatgagtggcataaatttgtaaaaacagttactctcaaacacattatacaatagcacctaaggaaatatttattattctgagattactgattgaatttgtgatacattttattctgctgtgtatgttcagagatagctgtaaagtatgtatctactttgaaaaacaggaaagcctagatggaggacattggctgtcaacagagtgctagaataagcagaaagaaaaataaagcggaaacagaggtacaaacactaaaaaattctttgaaaggtggcatttgttctagagtttcacattttccaatgacacattattttaacttgtccatgaagttgaaatcatttgtgcaagccttgtttcataatttcactattttacttttgttcaaatatcaaaatatttcccaattagaccatacatatacttgcatagcctccctcctttcattatcttctttgtaaaaccaaccatttataatgagcaagacaatatcctcccttgaaaatgttcactttccttatactgtgtctctactcagcatgtgacattgcccatagactgcaaaaaccattctatctcttctagatcacaaactaccatgccatccttaggtcttactaccctccaatacaaacactttcttctagtcatacggggcctttcattcccaccatacttatcctacatatttccagaccaaccaacacctctgctcacattgtgggcctaacagtacactcctgacttcttgccatatatgtgaatactgtcgatctagaagcccagatcctgtaagatttctttattaagcctggtctctttctctactgaactcagataggagatcaaatctgaaagaagcttgaagacaacaggcatctgctgcttgaactccttctttatagtcgagtgagatgatctctacccatggatattatgtttgaaaacctctagtaaaggagaactcattacttttccatcaggttcagtctttggatagttttagaaagtagaaagttcttgtatgtaactattatcatttcttctttacttagctgttcctagatactagactataaacctctttatagcaagagtgtgttttttatttcccaatacttaacacaatactgggcatgcagtagatgttaaaaatactttaaaaaataaataaacctcatttggggttctttcactttcttaaccattcatctctgtataaaccctggtttgcgtatgtgcctcagagcaaatgcacaggtatagtctgacctttctaatccacaatggtctgcacagcctacttcttactcttttctagaaaagcagcctatgttcacattttccaattttccatagcttcataattgctgacaaaaatttctttatacacaattaaatccaaacccaagtattactacttataagacttatttttatttttaccccaagccatatatttcttaccaagtttttgtaacattggtgttttaggatccacatgtagaatacattttattcttattaaatgtatgctattaggcctatgagtctccccatcaagtcctttttgcattttgactctattcttccttattcagtaaacgagccagatttacattactgacaaattgtataataatttctggtgtgaccatattcattttattgacttaaaatattgaatagaagatgaaaacggctggagacctagcattacaagtcagtctctcaatcttggtctgtctttctctctccctctttctcttaaaattgagccattaacatattttagagtcccttagccagttcctatcacataaataaaaattggtgggatgagattcatgataggaatataatgaaatgacatgcactattaaaaataaatggattgatactagaaatgtagcatgtccaatgtaatcatacaacatttcgggggttacatagcacaggcatgttcaaattgttagttatctttattatatatatatataatctctctttctatttagcttcttaattatttaattacaaaatcgagtcttacataaatctgtatatccgtaacatgtaatggtgtaccttatgcataacaggtaaccaactgattgtggtttaatgtgaaaggactcaattgcaatgaaaaagaaagttatttagctacagttttcaagagtaactcccaggaaagaaaaataggtaggataagtactaagaaactctttccgaagctgagtgtaagatttcaagaaaaacgttcaaaaatattattacttcgttctaaaataaaatacattctgaaaaatattaggagccatataaaataatgtaatgatgaatcatactctcaacataaaacaaatgatcagtactttctaattttctataatttgtatgtcaaatctcgttaatatttttttaggtgtgttgtactgttgctgaggttgttttattatttgttttggagaaaaagactgtttagaaggttaaactgatgaattcacagacaattatacaagcttgtgctattaatattgttaaataattgcatacaacttagcacttgagcaagaacaagtgttatttgttactgagtctcttcctgtgatcaggtgattagcattacatattcccaagaataaatgattccacacctcagggatcaggaaaataaccacactttcacagtcagaatgtagataagcgctgtcttgtaaactgtagtaaagccaaacatttatagcatcttttaaagacagtcttatgatctctgaatggttttcatctattagaaattctgtactgtttgtctgacttaatgactcatgaaaatataacctaaaagtgaaaatactgagaacataaaataaataatggttttaaatcagtagtgatattgtcaatttgtgttagtggtctgtacttgcagacaagtaattgggctctcttgtcttaattttgtttcagttaccaatatcactatccaatttcagcagaaaatgtcagcattaaaatatgttatttattacaaagtaatagtttttattgaggaaaatttcaaaaacacagagaggtgtgaaaagaggaaaaaatatgctgtcattctatcaccttgaccactaagtagaatgaaaataaatggttgttattagcatctatagagtgtctttttgcaaaattttgattatcacctacataatgcttggtaacatcacttttaacaatgcattctgaacacttttatgccattagaaagtctcctatcatattatattatttttaagtaataaaattatatgctacagcagaatttatttaaccaatctccaattgatgggcatttaagttgcttttggtctcttgatgaagtaaaaagattgttttaaaaattcctttttaaaatgattgcatacagttctgagcctggtttcgtgtaaggagtgtatatttgttacataggcattcaaaagagcacacttctgttatctatttaaaattgtagaatcatgttaatgtaatgaaacaaatggctagctagaataagatggaaacttgtagatgcctgcattaaatcatagatttggactttgaaagaattgctattgcatatgactaatgtttcttagcatgaaagttgcttattttagaatagctggaactatttatcagtgcatttgtaaagcacaggtaccttaaaatggatccaatatctgttcatatcctcaattaatgtaatacatttttgactaaattttatttaaaaagaatcaacagaattgatacaaacaatgggtaaagatgacaaacttttttaggtcaaaggtagtcttttacaatttctggaagcttctttaaaatgttatctatcttgcctggtttgatttgacatatgaaatatatttctctatatattttctatgttttggggcataggtgatgtgcagggttacgttggttcataatattatcacaattttaatcaaacccaattacaaaagaaaaatgataatgatcaccttataatttatcgtaaaaattatacatatatatttgtgtgatgtttgatagatttgctcttatgtaagagaattatgaaagttagatagaaacagccttctgaaatataaaatatttgtcctaacttttcctgaatagcagaaactaagtatactaaaataaatgtcttcaagattttcttcacacgttcctcagactttgttttaaatcagacactttcagataacatatgtttaatgaaaacacaatgatgtgctgagttttcattttaaaatgtttttacttaaaaatagaaaagaatttggagaaagtcaagttgtattgttttgttttgtttgagacagagtttcaccctgtcgccaaggctggagtgcagtggcactatctcggctcactgcaacctctgcctcctgggttcaagcaattttcatgcctcagcatccccagtagctgggatcacaggtgcgcaccaccacgcccggctaatttttgtgtttttagtagagacagggttttgccatgttggccaggcttgtcttgaactcctgaccttgagtgatccgcctgccttggcctcccaaaagtgctgggattacaggcgtgagccaccgcacctggcaagttgaattgttatatgcagctatatttatccaagttgcacatatttaatataagcacaatctgattaaaaaaaatcaaagttcctgtctaaaacctaaagaattgtagtgaaatcaatcaagttgttgagcttaactgaacttctttaatgccataaccttgatattcactatttcctttgaaatataatattcccttttgcattatttatgcaaatgccatgccagtgtagtggaaggtgtcacctcagtgcagctatagccagtaacatttcctgttctagtcatagaaactttcatttattcatgttgatttgtaataattctcagtcaatttttcctgggtgaagacatgaatttgatgaaacagtagcagcagaattattgttttggatgtattcattaattttttagttaaactttctactttgagataattgtagatttacatgcaattgcaaaagacattacagagatctcatatatcctttaatcagtttccctcaatggaaacatcttccaaaaatttcttacagtggtaacatcttgatagtacaatatcaaacctggatattgaaattgacatagtcaagatagaaaacattttcatcaccacaaggattcctcctgttgccaattagtagccataccacttcccttctgctgtcactctctccttatctctggcaaccactaatctgttctccatttctattattgtgccaagtcaagaatgttccataaatggaatcatacagtttgtaacctttttcactcagcataattctctggagattcacctaggttgttgaatatatcaatagtttgttcctctttattgttggtagtattctctggtatggatatatcacaatttgtttaaccacttacctgatgaagtatatctggattgtttccaatttttgagtgttacaaataaatttgctaaaacagagcctcactctgtctcccaggctgtagaacagtgttgtcagtggtgtgatttggctcactgcaacctccaccccctggattcaagcgatcctcctacctcagcctcccatgaagctgggactacaggcatgtaccaccacgcctggatgagttttgtatttttgtagagatagggtttcgccatgttgcccaggctggtcttgaattcctgagctcaaacaatctgcccaccttggcctcgcaaagtgctgggattataggtgtgagccactgtgcctggccaaatcaattaattttaaattcaaaggtgatatgatgccctctttgtccttctgattttcagtgttttatgaattgattttagttgtttcagtggattaattctacagtatttgcaacagaaagtataacaaagatctctgacaaggtcatgcctatattgggctgtaggaaatacttacttagctacgtattttatacaaaatactggctactagaaaatgtagacatattaattggttgtgaaaaaattatcttgatttactgtaatggcttttatttacctatgtattcttaaaaatctatggaatgtgttctagatacaaaatagtatatatgccatatagagagaacttacagaattagagaaatgaactcctatgtatcagttatgagtttcaaaaatagagtagtacatcaccatattgaaacaccttggagcatggccttctggatgttatctcccattcttcttttggaggtcaccactattctcaatttgatatggtttggttttgcccaattttgttatataaatgtactaatctgattatattcactgttctatgacttattttttttacttatttcacagattatactatgatggtggcagtatcattatttattaatttccattgctatataatattttattgtatgaatatactccaatttaatgtatctcttgtattcttgatggacatttgggctgtttccattttttttctattattaacagtgttgctatgactatccttatacttgtttcctggtgtagatgtggaaaaatgtctccaggttccatatatatctagcagttgaacagctgagtctatatgcatattttaaagtatattaggtaatactaaattattcttcaaaagtggtgtaccaatttacatagccacaagcatgtgttctctcacatctgtaatcaggccctcagcatttgtttgctcacttttatattattggtcttaagcttattgattcaaaagagtacttcgcatattttggatactaggtgtttgacagtaatacatattgcaaatgttttctcccaacttatggcttatctttttactctctttatggtacctatgatcaaacgaagcccttaatttaatcacatttattatctttttcctttctagtttgtactttggaaagctttttgaattttactagggtttatagcttaagttttatatcagtaaaatgcttaccagaataatgttctttatcttgaatagtagcttgcatttatctaaaaattattaggatatatatttcataataatttctatttatagacatatatccttatgatttttatataaacacataccaaatgtatatatatatatatatgtaacaaagtttcttttaaggtttttaatttcagctatcgacctaaacatgcataaactaccttttcttttaaaatacattgctgtagttagctcctgaaaacacttctacttcactgaagcggtgatgatttttgtgaattttcagccatttgtctttgagttttctctttgaaagaccctgagactttattcagtgatatgagagaaactatggaattgttaatattttaagacatcatcatattcatgatttattgttctttgcacaattgattccaacccaaatgtcccatgaaataaaataacacactcagtgtgatttgttttactaattattatatgtagcaatcacttgactgtatagatcaaattttactttctaaaagctccttccattagtgctaatgtgtttgtccctttcaaaaaatacatctagtaatcattgggcaggtggtgaggaggaacagattagaaaatggttcctctctattttttaaatgatgaagtagaaattctgtcttttatgaacttctgctgtttggtttctaggaaagtatatgcttaattgttaaaatattgaagatcttactgttaactctaatttttccagagagaagaggaagaggaaccgtcattggttaaacgctcaatataggttaggcaatattctggccatatgacctctaatattcttcattcatgcattaattcattcaacaaattttttttgagtatgttctatgtgccaagctgtgttctaggaatcgaggtaaagcagtgaataaaacagacaaagaggcaaaaatcatgattttggtagagcttaagcaataaatatgacagattactgccttagaggtatctagaaattgagaaatgctatacaaaatagcatatggctctgcttgtaaaattttaatgtgcatgtgagtcacctggggatctcgttacaatgcagattgtgattccataggtcttgggtggagtcctaagatgctgcatttctagcaagcttctgagtgatgccaatgttgctggtttgggagcacagtttgagtagcaaagagtatatggcaagtgaggtgggggtcgagcgtggagagtgggagagaaactggctgcactttaaaatatgatgattagggtgtgccttattgaaaaggttataagtgagcaaagatatgaagaaggtgggggaatttagctatacacttatctaggtcaatgaaaccagccagtgcagaagggtgttacatgggagtgtgcctgacaaggaggtcagtgtggatggaatggcatgaatgagaagagtagtagtagatcggatttgagagacagtgggaataaagtagatcttgcagggcttcggacaccattataagttctttggcatttacgctgagatgcggaaccactccagaattcggagcagggaggtgacatgctccaacgtacgtatttaaaaaatcactctaactgctgtatagaaaatagactattataaaacaggatagaagcagtgagaccagttaggagtctgcaaaatatatggtagctcagacttaagtttatagcaggtgagatggtgagaagtgctaatattcagaacacattttgaaggtagagcctagtgaacttattgatgtcttaaaatatgcatatacacagatgtaggctgtgaaagaaagaaaggagtcaaggatgactgcaaggtttgtttgttttttgacctgagtttctagaaggatgaagttggcatcacctgaaatggggaagggctaggttttcaggagcatgtcagaggttcattctctgtatgtgttgaatcccatgtagccattagatcttcaaatagagatgtggagtaggcaattgtatatgagagcctggaattcagcgaaaggaccgtgcgagaggtccaaattttctcttatatcattcttaaaacaatcccttgctgctcatcttttatccacattttataattggggaaacatgttcagaggatatagcaaacattcagtttgtaagaggtggagcagagccccaggacaatctgtagctccaaaggccacactgctgttctgcttcaatagtaaaaagaatcaacactggtcactgcagctggttatgtgtttacttagagcaagtcgaaaatatttttaggcagaaaaattgagttggcagttcatctttttaacttccctacttggctactatagacagattttgttaagtcaatgcttggcagctttccatatgttctagagatgcgtgttcatctgggtgtgacagttttttctaagtcacttctgccatagcttgttaaaggtaagaaaaccatgtcttcactgatcttggggtcctagcgaagaaatgtgtgctttctcagtgttggaagggtagagaatggtaaaatgaacattggtggcctccctgtcccccagtggaattccaaggcatagcctaaatgatttctcagaggtccccagcagggttgattcccggttgctcacagcagtaacctgttcattaataccatttattggcttttcatgcatccttgcctcacattcctcattgttcacttcttaggatcacctcccaagtgaattgtctgaacctaagtccatgtctctggctaatctaagaaaggtgataatgtgaaatgtgcttaactggtctatccatgatagttctttctaatttctacaacagtgcctggcaagcagtctcaataagtatttgccacaccagtgaaggactgttattttccttaatgtttattaagtaatagtagtagttgttactattattttaggcaaatatatttttaataggacacagataaattcccctttgtcactaacactgccaatcttagttctttccttacgttcccagaaacaagagttcttaaaactttggtatgtatgcttctgctattttgacttttacctaaatcacatcattttatacatgtgattatgtaatttgcttttttcactcaaatttatgattttgagttctatcgatgctacatattttctgccttctatctgattaaaaatttcccattctgttttcttcctttatggtatttagcgtttttaaattctatttctattttttagtggttccttgtaagtctttaacacaaatatttgaatttacattttaagaggtactaccagtaatgagctaagatttttatcattgcttaaattaatgagcctttctgttcttaatggccaaatgtaggccatagtttaccttgtctcctagctatccctgtttacttccgtgttttctaggattttagtttgttcttgctcccaaataacaaaaggcttattattattattattatctttattggatcttataattaagttttatttctttcatttgcttattgaactcctttctttaaatatacttttcatgttggggaagtgtctgctttagtcactaggctatgatacttaatctaggtcttaacaagtagggttttgccatgaagagggagaaaggatcagtatgcaagggagtagtgtctgaatttgctttgtatgtgccggaatgtctatgagttaccctttgaacacagctttgtgttgctctcatggtttgtaatgtaatccatggtatggtaaatatgtacatcaaaaataaactaataggaaaagatatgaatatcaaattagaaagtgacccaaaatgaagtgttatctaagacaatacatttaatatgtaaaaatacacatagattcatttgaaaatatttgtcgtatttctttcaaacctcatccaatgtcagcataaacaaatataacaaactagttttcaaattaaatttaaaaatataattcttcatacctggagcctcggtgagtaggcattatgcctgaaattttcaatgtcgatggaccatagatctgcctaattactcctagagtcattggagccaaattgctgggatgagccatcattcccccatccccctttcacaccaatgtgattgtatgccttaattggttctctagttattcatgttatatgatctcaccactaccagtgcttctctattagtacctcagtcttcttgttagcattcttaccaaaagattatcagaaaatccaagttactaaaaacatatctaaaacacaaagcccgtgaacagcacatgaaagctggaagcccttgcacttccagaatcctgcttgcatgcctttcagatcacttacagtagcagaaaaggtgtgcaccatcacgctcagctctaacttgctctcttttgtatatgatgcggtaatcctggctcttagtgctttgggattttggtgatagatgtcatcaccagtaattccacagtccccaaagagttcaactctctcaatcaaatcttaagccatattgttggctccctataatactttaaattctactgtacatttcttatagtgtaatcatgttaaagagggggaaataggcttttttcctcttctcaatgcataatctttttaaagttatctattctgatttctcttgaggtctctttccaattacctgcaagtttgcttttactgtggtgttccctgtattgtgtgtgtcttattccttctgcaagaaggaagtggccaagctgacagattgctaatattaccattgtctaattacagctctattatgtctgtacaacagaattgcatatcatttaagaggccactacagcatttatcagtcgttgtggattctagcctaacttgaccattcatttatttttaatttatttttatttttgccttttttgagacagtatctcactctctctctctcacccagggtggaatgcagtggtgtgatctctgctcactgcaacttctgcctcccaggctcaggcaatcctcccatctcagtgtcccgagtggctgggactacaggtgcataccaccacacttggaaaaaattttaaggtttttgtagctacgaggtcgcattatattgcccagactggtctcgaactcctgggctcaagtaatcctcccacctcagtctcccaaagtgctgagattacaggtttgagccactgtgcctggccttgatcattcatttagacttgcagtctgtgccatgggaaatccaaaagctccaccatgacaaattaactccctgttacagacgtagctgttgtctctccgtatctggagaccctcagagcatttttaaaagcatgacattttaaatgttaatttttattgcccagcaaagttaatcacacctatctatgaagagttaatttccaattaaacagttctctgttcactatctataattccctcaaaggaaccaatcatacttaaagggattcagagcctgttatatttcttatcgtctattttcatgagagtatgtacttattataccagatttctggcatttagtgttatagatatgcaaattccattttaactccccttaagatttccaacacccaaatgaacaattaagttttaacttttcatctgtgttctctctctctctcatctgtgttctctctctctctctctctctcagcacatgctgttaaaactttagtttatgctataggtccttgtagcgacaattttagaaacacccctttcttgtgtttatactattataactttggggtctctaaaccaattctaaatatgcattataattataactttatatgttacattcttatcctacttttgtcttaagataatttatgactgaatatttttgtggcatcataatttaagctttaattttactaaaatgtgctttttggttaacagtaaacagttaatatgctatagtctcctggaaacacacgttcacatagctttttatgagccaggtttttggtaattcagcatatactttactattgaacttgcattcttaatgtgcaatctgatcaagaaaaatatcctctaatatttcttttgggttccaagagcactgtcccctttcccaagtactacattttacctgaaaaatatatgagaaagtatgagaattcttgagcctaaagcatttaaatttgattattttcaaaatttgttaagtcatttcaaactgaaattgaaaataaaattaatttccaaatagtaaaaggataaatgaaactaaatactgttactgagaaaattagtccatctttagggcttcaaaaaacacactgaatgtagctttcactgattatatacacttttaaggttgcactttttctaggtgctaggcagaaaatggagcctgaaaaatatcaaattgcagcatagtaaatcacgtttgaatccaagttttaagttatttgaccagtactttattctttgatgagccctgaatatatttttctcagccataaggtaggcatcatgcattcctaaaattggagttgattttctatgatagtttaatttactagctgctcagttcttctaactgtgcatgttatatgggaagattatttttttatttctttgtaaattcatgtcagatctacccatgggaggaaaatgattcctaactcttctccatttcttttagtgtttattcatatgctgtttctgtcttttctttttgcctttcccctagctgaaacaaggatgaatctataaactaaaaaaaaatctttttctttgtaatattagatagacatattatcaataatattatataatctattgcaacaatcaagtcaccattaaaatgtgtagttttctgagtgtttccaagtatgtaatgtaggacaatgctttaagtctggtttattctcatttcacttggcttttttttttttttttgcatactttgagtatatgttcttaagaatattcttaaaatattttccaagacacatttatgtaagctaatcaaaccatgcaatagataagaactcaatgttttagaactctgtcataagaagagatatatttgtgtatgtgtagatacacacatacatttagcacattttcagagacatatacattatggatttttattattgatttaaattctttataatatgcaattacagatatattttatatcagcttaagcattttaattgcaagatttctgtttaatttgtctgcaaagtactcttttttttctggtcatggtaaatttcatattctttgacaatagcttttgtttattactagaaacacttctcttgggctaggttgttaattaactgtcatttttgtacagggtgtaaaagagatatggaaagaagggtacatgagcaaatggaatttcacacattattaactgttttagtgtcttcaaacttcaaaaacatatattaatatttttgtaccacgtaagttcatcagaagcctgactttaatctctgatttattatatttgaacactgtgaagaagcagtttaacactgaacgaaagtgtcgtaatgcagctttcaaagtggccattaaagacagatctctgcttttctattagtacattttctaagatgactatcattgccattgtagtcagctttgtgtacctttatagagattccagtataaacccagaaacatagagcactgagagaaataatatcagaagtgtttcacctttggctactattgtaaattgacaaatgacattattgcttttagatttttaaaacaaacacactaagtagaacatatgcatccaaatcagtagggtcatttcaaataagtcatactttttgttccagtgattcattagcccaagtacacttgaagttcccattttagaattgctttcacaggccagtttatgaagcagaaaataaagattcatttctttctggttaacacctcatttttggccaaaagtgatatagcccaatataccacgaataccttactgaatctgatgcccaatgaattttaactgtttttaaagttcaaagcaatctttaaaagaatgaagactttcagccattgaaactgtctagaagctgagctatgatatttgaaggttcagtatttacaaatggcatcattactttttctttctagagaaggcactagaaggggggctttcatcagaaatacctggaggttttagagaaggcagattctgtctggaaagtcatgggaactagaggcagggtgccatgctatgatcagtcaagtctctaatctctaaaatgtatttcgaagacacagtttgagcaggttgaataagctttttgtcttgtaggcccaggatatactgcgttaccaaagtccaagccccacaaggaggttattcacctgcccataggtccattagaagtcatctgctgatgtgactgtattggtgatgtggaatattaacgtggaacagaaaactccatgggaaggcttagtgctgggggagagatataggcaaaagagatggaggaaagggttgaaataaggatttgtttagacagttcactggtggtgatttattgggtgtgttttactgctaacccacacatgaagcccctgacatcttggctgaggctggtaatttttttctgacaaggatcagcagaaatgaaggtgccatagcttccagtgctagatatagtagctaaacattatcttcagcagagatgggagttcagagtgtcattgtaaaatacatggaaatacctaatgtaaaggagtctaatgaatgaaagaaataccaaatgaatcttcacagagggaggtaaaagaaaagaagataaaatcaaggctggtgacaaggaattattaaaatagaatatgttattgtatatatttgcctcagagtttataattaggagtccgttgaactctgtttcaggatgtcttcatcatttctttaaggatttaaaatatactgcatctagaaataatccaaattaaaattgatttaatacactccaacaccacattataaaaatcattcactatgaccacctgggtttgatattggaaaatctattaatatcaatcactatattaatagatctaagaaaaaaatatacccttactccagtaatgctaaagcctggaataagacaggaatgaaattagaaaagataaattagaggcataagaactagaaaagaagaagtaaaattccctctatttgcagataacatgatagtatacctggaaaaccctagagaataaatggcaaatgtagctcaaacaatgaaataattcaacaagctagcaatatgtaaatttgacagacaaaattcgacagctaccatatgcaaaattaataatgttaaaatagttggagattagttagaataaattacaaaaatctcacaaaataaacagaaaagataaaataggaataaaattaacagaaaatgtgtaaaacatataagaaattataaagcctttctgaaagacacacagaagtagacttgaacaaatagaaagacattccttgttcttcaataggacatcacaacatcattaagatgccacttctctctgaattaatttaaatttaatgtgatgccaataaaaataccaacatgctttgctatatggagctaggcaagttgaaactaaggttaaaatgaaaaaataatgaacaaaaatatctgggaaaaacactaaaaaggaaaagctatgactagccctaccagatattagcatgtactacaaagcctcaacaaataacagtgtcaatagcacatgaatggacagaccaatggaataaaatcaaaagtcctgaaatagaaccaaatacatatagaattgtaatatataatagaggtgacatctcaaataactggggcaaagttgaacttaataataaatggtttcgtataaaagaggaaattagatgtcttcctcaagccatacacgagaataaacttcaaatgaatcagaaaactaaatgtaccaaggaaaactatacaggtactagaagaaaatattggtgaattattttaggacttgcatgtagggaaggactcttttttttttttttttttttttttttttttgagacggagtcttgctttctcaccaggctagagtacagtggtgcgatctcagctcactgcaacctccgcatcccgggttcaagtgatttccctgcctcagcctctcaagtagctgggattacaggcacgtgccaccacgcccagctaattttttgtatttgggtttcaccgtgttggccaagatggtctcgatctcctgacctcgtgatctgcccgcctcatcctcccaaagtgctgggattacaggcgtgagccgctgtgcctggctgggaaggactttctaagtatgactaaaaattcaaatgccacaaataaaaagattaatacattttactatattaaaaacttcgcatgacaaaatcaaaagccaaaagaaaactggaaaaaatgcatatattgtaatgtatatcacagataaagagttaatgtccttaatatataaagaacttttaaaaattaagtgggaacacagatcctgtagaaagatggacaaaaatataaatagacaatttacaaaaaatatataaatgatccttaagcatatgagaagatgattgctttcactaacaataagtaaaagcaaattaaagctattttgaggtacagttctcacccatcagattggcaataatatgaacatttcacaatatactctgttgagaagctgtagagaaacaagcattctcatacagtgttggaatttcgaaatgttctgaaacaaatggagggggaaatagaaatatctaataaaattacatatgcaatcccactttgacctagcaatctcatttctagaaattagcctgaagatatatctcctacaatgcaaatatatgtacatataaagttattcattgcagcattatttgtaattgcaaaatattggaaactacgtaatagtcaaacctaagatatcagctggataaactatagtacatatacacaataaagtactaggcaactaaagcaataatgaggatctcttgatgaactaatattgagtaatttctaagtgaaagcgaagtaaaagaatgtttttctactatgctgcctttgtgtgtaaaagaaactgaaataagaaactgggcatcactttagccaagtgctcaaaattagtatgtttgttttctgtgctgtgtaaaaaattaccacaaatttagcaacttaacatagcatttattttttctttcagtttctgttggacagaagtctgggtatgacataactggaatctctctcagatccttaacacttgacctcctccataaactctctcacacttacaatgtctgatctctggaagggcttggcccctttgaagccagattgggtaaagttcacccaggatacgctccttttttattaacgcaaaggaaaccaatatgggactttatttatactgcaaaacctcttcacctttgttatataacataacttgatcaagggagtgaaatccaccatctacccgttattcctagagtagggattttacagggtttatgtacaaaggcatggggatcttggagcccctctttgaattgggcctatgacagttaatatcaccaaaaaggggcaaacagacatcttgtgtgtgcctccagatgcaatactcttggcaggatataacaccactgagaaggatatgacagcactgatacagtattcccacccaaactgtataacctgaatttagtcataagagagcatcaggcaacacaaatcgaggtacattttataatataattggtctgtagttttaaaaaaatttcatggtcataaatgatatagaaataatgagaagggattccagattaagagaaactaaagagacatgacacccaaatgtagtctataatactggattggataccaaactgaaaaaaagatattgttataaagaatattatttgatcaattaacaaaattagaatatgaactacagttgaaagtatttgggccgggtacaatggctcatgcctgtaatcccagcactttgggggtctgaggtgggcggatcacctgatgtcaggagtttgagaccagcctggccaacatggtgaaaccctgttgctactaaaaatacaaaaattagccgggtgtggtgatgcgcgcctgtaatcccagctacttgggagcttgggaggctgaggcaggagaatggcttgaacccgggaagcagaggttgcagtgagccgagatcgtgccactgcactccagcctgggagacagagtgcctctgtctcaaaaaaaaaaaaaaaacccaacaacaacaaagaaaatattctattagtgttattagtgttagatttcctgagtttgatcactgaactgtggttatataagagaatatcttttgttcttaggaaatacatactgaaatattaaggggtaaaggaatataatatgtacaacatactctcgtggttcagaaaaaaatactatatgtgattgtgtgtgaaagagagagaaagggaagagagaatgataaagcaaatgtggcagaattttgaagattggtgaatatttgtgaagtgttctttggattgttcttgtaacttttctgtaattttgaagttatttcaaaataaaaatcaaattaacaaaaaacaaaaaataaactacacctaaacatcttagcagagggcctgcctggcatataagttctcagtaaatggcagttaataataatatcactattattacctaattcttgcttacaacttgaatccaatcaaatgaacctatttattgccactaccttgggggtttttattgtatttttggtttaagaatacttagtatttttgtttaaagtctaaaataattttataatataaatgtgtagagtaactggtaaccagaattcctgcaaatttaatgccactgcattaattgattgttttagttttggttccccagaagctgacccctagaacccaagacaaggtttcaagttcacatagtttatgtgagaggaaataccaggagatgttagatgtggggagatgagaaagtgaggagaaggaattgaataaagggttcattattaaccaagttaccactgtaggcaaaagggacttaatcctggtggggaaatctaggagacagtgtaatacatgcttcagactttgcctgcccaaggagggatggaggtagggtatttgtacactgacccccatcggtcattgactgagggcttctggagcatgcaaattaaattctaagcacttccagactgctacagtatcatatcagattcctttaggcaatgggttgcaagagctgacatgtgggagacagggctggatgcatgcaaatgatgaattctgagggtatactggtaagtgtctcacagaatctgctgctttggtgaggcagaaatctgctgaatcagtctccctggtattccaggaagcatgtggagtgattgcagctataattatggtgaaatctacactggaactaggtttctaggaacaaacagatctgaactgaattattattttttccagttgctagctgagcgactttggatgagttatttgttcgaacctttggtttcctcatctgtaaaataggggcagtaacagtttgtcttcataaatttactttagaattaaagacattatgcatttgaaaggttgggcctagaaaatactcagtaagtgctagttttattatgtttgcatctcttatagttactattacttttcacttttaatcagtctgttagagatgattgttcttatcttgaactataagatgcactccaatctgctagattaatttgtaccttggctttaaaaaaatctgttttttttttaatagccattgaagactcagaacaatagggactccaatttgctacctgttcttgaaaatgacaatcagttacttaggaaagcaactttgaaaaatacaaaggaaagtcagagagattggaaccaaataatgaaggtcaagcatcatcaaaaacacaagttgtgagtgacacataaagggaagaaaaataagcatcgtaaggactggattagccatgtttagtatgcttttgaaatatttatgaaataatcacagtttaactgtttaattgcatgagctagatttggttgagtacaagcagaacactgcctattctttctcacttcctctttaaatcaagtcatggtcttgtcctttcctacccatgaatgaaaccgaacgcagagtccatagcttaccagtctcaaagtgtatttgtttcctagggttgtcataagaagataccatgaaccgagtggtttaaaacaacagaaatgtattctcacagttttggaagtccagaagtccaaaatcaaagtgttggcacagccatgctctctcttaaggctcttgagggatgattcttccttgcctcttcttaacttctggtggttgccagcagtccttcactttgttagcttatagctgctttactccagcctctgcctttatcttcacatagcattctccctgtatctctgtgtcttcacatggttattttgttaaaaggactccagtcttattggattaggggcttaccccactctagtatgacctcattttaacctaatggactatatttgcaatgaccttatatctgaagatcacattctgatgttcttggaattaggatttcaacatatcttcgcggggagagggggggcgcataattcaaccaataacacatagataattacagtctaagcccatcagtattcaaaccctaaatcttctccaaaataaacatcccccctttcttagctgaggaccactttgtgcctgaaaggctgcattggagtgagagtgacccgagtgtttatttccctgccccaccttgttctgtccctcctcctctctctctgacaaggatatgactgagtcttccaagattagagtaggtagaaagcgtgagctaaggttgggaggaaatgagaagggagaaaaggatgaagagttattttgattgatggaattattttggctttggtgtcctctgaggcagcagattccaaattctgattcttactctcattaggttgttcccttgcctcctcagaagcccacttactctctactctaaatatctctcacttgtagctaaattgatgcaggtagggcctctgacactaataaccaaatcttcagacccttggtgtctcattctgttgcttagttgggatctctgtatcctccaggcagtcatcttgagtggaacctttcttgaaatgaataaaaatttcttccccaggattgacactgatccaacaataaattcatgaatctgtcctgtgcagctgggtcgatctcataaagcatttattggtcaaagttcagccttaaacagttgtttcttgaattttcaagaggcagataccagtgcccatgatggcctttcaggtttactttttaaactcttcaagcatttcttatggaagttctcttacttaacttgcagtaaggtgaagcacctctcttccctaccccattgactcccaagaagcgatgggcaaatatggagaggagattgtaggtattacaggaatgcagagcactaacaactccctctaaagaaagccactctgttgaacatcttcatctgtccaaagatttcttaaactcctatgaacagcctagcctagagacataacagtctaataaaaacctggcagaacttgtcagaactcatcttttaatattttctaaatgcattgtttttaaagtgcttcactgagatataattcatacacttcaccactcacccatttaaagtacacagcacactgttttttagtatattcagagagttatgcaaacatcactacaacctaattttagaaggttttcatcattacaaaaagaaactccattcccattagctgtcactcctcatatctccctcttcctagccgtgggcaaacattactctactttctgttcctgaagatttacttattggggacattttatataaatggaatcatataccatgtggattttttgtgactgatattttagcataatatttgcagggtcatccattgattgtagcatatatcaacatttattttgatttctaaataatattccattgtatggatatatcacattttattcatccatcagttgatagacatatcaattgtttctgctttgagctagtagaaataatgctgctatgaatgtttttgcacactttttatgtggacatatgttatttctcttgggtatttatccaggagtggaattgttgggtcatatgttaactctatatttaactcttgaggaactgctagattgtattctaaagtgactgtaccactttacatccccatcagccatgtgtgaggtttcctaattttcaacattctcaccaacactcgttttcgttttttatttatcatatccactctattgggtgtaaattgattgtttcatactatcttagcttattttcatagataatccatttgctagagttggaatgtgttcccacaaagttcatgttttggaaacttggttgtcattctggtgatggtgggaagtggggcctttgggaggggattaggtcttggaggctccaccctcataaatagattaaggttgttattgcaaaagttgctttgctataaaagcaaactctcttgcatgtactctcttattctcctgcccttccaccatgagatgaccttcaccaaaagctggtctcatgttcttgtactttccagccttcagaaattgagccaaataaacttattttctctgtaaattacagagaaatttacagtgtgtgatattctgtaatagcaagagaaaatggactaagacaccattgcttctctttaggatgtgcaaatagtttgtgcttgctttatttttctgacttacgagccctctgttaaaactcaaaaatcataagaacagtgacatttaacattcagttaaaatgacaacaatttgaccaaaaggcattagaactctatgcctagagttatcgtaataccatgtgcacaataaaatatgtatatgtcataaggaataaaaagtggagtaaacatgagataatctgactatattctgagtgctagatgtctatgagggctttcaggttagttgcttgttttttagtaataaacacaacagtaataatgatgataatacatagcctatattgctccagccaggtgtggtgactcatgcctataatcccagcactttgggaggccaaggcaggaggatggcttgagttcaggagttcaagaccagcctgggcaacatggcaaaacctcatctcgacaaaaaagagaaattaggccgggcgcggtggctcatgcctgtaatcccagcactttgggaggccgaagcgggcagatcacaaggtcaggagatcgagaccatcctggctaacacggtgaaaccccatctctactaaaaatacaaaaaaattagccgggcgtggtggcgggcgcctgtagtcccagctgctcgggaggctgaggcaggagaatggcgtgaacccgggaggcggagcttgcagtgagccgagattgtgccactgcactccagcctgggcgacgagggagactccgtctcaaaaaaaaaaagagaaattaaccgagtgtggtggcccatgcctgtagtccctgctacatgggaagctgaagtgggaggatggcttgggcccaggaggtggaggttgcagtgagtcaagattatggcactgaactccagcctgggcaatggagtcagactctgtctccaaaaaaaaaaaaaaaaaaaaaaaaaaaattaactccctttattcctatgagaaccccactgaatagacactattatctttaccagttgtcagatgagcaaacttcccccagataataagattaatactacctttttacagattaagtaaaactagggggagattgagaggatactaaaaatatctaatgcataaaaatgtataaggttaaggacaattgttttgcctatctctgcccagatcttctcagatcccttttgaagatttttgttgtctaccctctctctggtttctgtgctctcacttttatcaactagcactaaaggctctttgtggggtaccatcctagggctactgaagctgtacccactcctccaggtgggagatcaaaagcctgggaatttcctgtaaattgttggaaattttcctactgataaatcctttcatgtttttactggctttccctggaagcattctttgtttggaatgagtcacttgtacacaaatcttgatctcagggttagcttaaggagaacacaagaaacagagaaaggaggatctcgataaaatattgaactagtacttagtatgtgaagaaaatgagtgatagtatcaaggtaaaaacaagaacagtagaaaattatcttaaaccagggggaattgacattagaaacaaatggattgtcatgatttgaaaatgttagaatgggctatttactcagaaaaagcttcaaacttgctttctgagaagactttataaatgtgcatagctattttcctgggttagtttaaatgtactgcagtccttctggaactgaataactaaatcagtggcttcccagagcctctacagctctaatagttgtataagagcacaacctatggttgtaaccaatggttaacaatcattaacctaaaaagtaaagcctttttgattatgcattgtgctaagggctttagaattattgttaaatggattcagtccctgctttttaggaacttaagagaaaaatttttaaaagtaaataaaagaaatctaccgtttatggtgtactactaagaagcattaaaacaagtatgagaatcacttcagagaaacattaatgaatttacaaatatcagtatttcagaaaagtaatatctactttgattttacaaatgagatatgtatggacaagaaaaatctattcatgacatgtctactccaaatagcttcattagtatttttcaggcgaaaagaagtaacaaaatgaaaaagaaaaagaaacattacactgcattgaggcaaaagattaagaaataagtttgtcagaaaaatgtgaaggtttgatgcttatctttgcagtaattttaagtaaaatgatgaagaaagaaaaatgtttgtggtgagaatattaaaaaaaattgtaggataaaatcccattatatcactggggaaacaaattaatatttcctggtaaagagcttgatgctaggatctagtgtcagaaacttttcttaaataaatactttttcttcttgaacctttaaacatattttgaactaagcaattttgaaacaaattttattcaagtttcttcaagtaataataaaaggaaatagttatcaagtatacaaataactgatctttaaatatatatatatatatggatattaggaaaatatttgagtaggtgggtaggtgttagaggaagcaggaaagataaaatacacacccttgataaaattgtattatataagcaactgcatatattgctttttattgcttcatacaattttattatataagcaatggctttattatataaacaatggcttatataataaaattatataaacaaaggcttagataataaaattatataaacaaattttataattttaaaattggcatgtagagtacacatataatttccttaaaactgtgttattactttccatcaatcacatggatcatgaagttgttttcagttcttctaaacatgctagaaatgtggtcagagactaaaaaacaggtacaaatatattgttttcaaactttacctgtgcgagtacagaataaagacatatttggatatgcagaaacactgaatattttctttcatggcaccctttcttagaatattatttaatgatattgtctatcagaactaaagagtaaaccaaaaaagaggagagcagtgaagagaagcttcacaattatagctatttgttgggtcccaatactgagcaatctgtcccagttaaaaaaggaaggaagacttcagaatagaaatatctgggtgattttattctaccctttattatttggaacaatataaggaaggaataaatgcagaaaataaaaggataatagaataacaagcatacaagatctcagcacccccttttattggagtaaaaggactacctgatgataaaatgcaaacaattaagatcaaatcaagagaaaacagatcaaaacaaaaagttggggaatgatgaatatttggtaaaaaaaaaaaaaacaacctggtgaagagctgtgaatacaaaaaatacaaaattgaaaataaagactatgagggttgtagttgtagaacagaatgtaaatattataaactttgaaaaagtgaatcaatataataaaaatgggaacatgttgaaggaggcaagaagcttattttctctcctttcacagcaggaaataaatcagtctgacttaaaattgaaatactcattttagaatatcataattgtagcaaaaccgatttcttaatgctgttccatattaatttttcctaaacttctaaaacatgtaaactgaccattaagaaactagtaattatttcacttcatattatttcttaatttatttgcagatacaattacattaactatatttcattcagaatatatgaccgtgtttactaaaatcatattttatctttatctctctgtatggattttagagatagctgggaaaatagttacctgatctttattgtttcttgtccatactttaatatcactttaatattgatttttatattaaaaatatattattttgtaaaataaaccattaaaaaaaaagccaattactaaaagtaacttgaaagtcagtacaactttgtataaagtccctagaaaaccacaaagtaaatttgatttatattatagcaaaatgtgtaatatatataatcttaaaggtttttcttttcttttctttttttttttttttttggagacggaatctcgctctttcacctcaggctggagtgaagtggtgatctcggctcactgcaacctccgcctcctgggttcaagcaattctcctgcctcagcctcccgagtagctgggattacaggcgcctgctaccactcccagctaatttttgtatttttagtagagacagggtttcaccattttggccaggctggttttgaactcctgacctcaggtgatacacccacctcggcctcccaaagtgctaggattatagggataagccactgctcctggccaaggttttttttttttttaaagcaatttagtaacctcccaaattaccactatttcttattttacaaatgtgtagtcttcacccctcttttcagctagaaaacaatttaccttaagtgtatgatcactgtcaaaaatgttagttaactaatagaacttcaacataaaagattataaattaaaagcacaaaatacaattttggcaagatataggtcactcggggatgaagttcagtctaaatagctgcctttcttttgcaagatgcttcagattttgtaaactccttttgctcttaaaagaatatctggtggattcatagccaaaaatctaccagacatgaaaagagagactggtaccaatttcaccgaaactattccaaaaaatcaaggaggaagcattcctccgtaactcattctatgaagcaagcatcatcctgataccaaaacctggcaaggacacaatgaataaaacacccaaaaaactacggaccaatatccctgactaatatagacgcagaaatcctcaacagaatactagcaaactgaattcaatagcacatcaaaaagttaattcaccaagatcaagtagatttcattcctgggatgcaacgttggtttaacatactcaaatcaataaatgtgactcactcataaacagaattaaaaacagaaaccatgtgatcatctcaatagatgtgaaaaaagctttcaataaaacccaatattgcttcacgttaaaaaccctcaagaaactagacattgaaggaacatacctcaaaatactatgagggtcaaaaattggatgcatttcccttgagaatttgaacaagacaaggatgccccctctcactgatatggtttggatctatgtccccacccaaatctcatgttcaattgtaattcccaatattgggggtgggtcctgttgggaggtgattggatcatgggggtggagttctcatgaatggtttagcaccgtccccccttaggactgtatagtgagtgggttttcaggagatctggttatttaaaaatgcgtagcacctccccgtctctttcttcttcctgctctgccatgtgaagtaccttactcccctcttgcgttccaccatgattataagtttcctgaggcctccccagaagcagaagccactatgcttcctgtacagcctgcagaactatgagccaattaaacctcttttccttataaattaccaagtcccaggtatttttttatagcagtgcaagaatggactaatatactcactactccaatgtagtactggtgctagccagagcaattaggcaagtaaaagaaataaaaggcatccagattggaaaagaaggagtcaaactatatctcctcatggatgatattattctacacctataaaaccctaaagactttgccaaaaggctcctggaactgattgacttcaataaagttttaagatacaaaaccagtgtacaaaaattagtagcatttctgtacaccaataatattcaagttgagagccaaatcaaggaggcaaccccattttcaatagtgacaaaaaataaaatacataggaacacatctaaccaagaagatgaaagatctctacaaggagaactgtaaaatattgcaaaaaaaaaaaatcatagatgtcacaaacaagtggtgaaacatcccatgctcatgggttggaatagtcaatatcattaaaatggtcatattgtccaaagcaatctacagattccacactattcctatcaaactaccaacatcgtttttcacagaactagaaaaaaactattctaaaatgtatttggaaaccaaaaacagcctgaatagttaaagcaatactaagcaaaaagaacaaagccagaggcatcacactacccaacttcaaattaactataaggctgcagtagcttaaactgcatggtactggtacaagatcagacacatagaccaatggaacagaatagaggaccctgaaataaagccgcatacctacagtcatctgatctttgacaaagttgacaaaaataagcaatggggaaaggactccctattcaataaatggtgctggggtaattggctagccatatgcagaataataatactggacccctgcctttcaccatgtacaaaaattaactcaaaatgggcaaaatatttaaatataagagctcatactctaataatccaaaaagaaaaactaggaaacaccattctggacattggccttggcaaagaatctatgactaagttctgaaaagcaattgcaacaaaaacaaaaattgacaagtgggacctaattaaactcaagagcttctgcacagcagaagaaactgtcagcagagtaaacagacaacctacagaatgggagaaaatatttgcaaatatgcctctgacaaaggtctaatatttagaatccataaggaatgtaaaaagttggacaaactaaaaacaaataaccccattaaaactaggcaaaagacgtgaacagacacttctcaaaagaagacatataagtgaccaataaacacatgaaaaaatgctcaaaatcgctcttagtcagagaaatgcaaatcaaaaccacaatgagacaccatgtcacaccagtcagaatggctgttattaaaaactcaaaaagccacagatgctagtgaggctgtggagaaaagggaatgcttataaactgttagtgggaatgtaaattagttcaaccactgggcaaagtgctttgacggtttctcaaagaacttaaaatggaactaccttgctccccagcaatcctattactaggtatatagccaaaagaaaataagtcattctcccagaaagtcatatgcacccacatgttcatcccagcactattggtaatagcaaagacatggaaacaacctaggtgcccatcaaaggtggattggataaagaaagtataatatatattatctacgctatggaatactacacagccataaaaagaattaaatgttgtcctttgcaacaacgtgggtgccgctggaggccattatcctaagttgattagtgcagtaacagaaaaccaaataccacatgttctcacttgcaagtgggagctaaccattggatacttatggatataaagaaggcaacaatagaaactggggactactaaaggatggaggggttcaagttttgaaaaacgattgggtactatgctcagtacctgtgtgagaggatcgttaaaaccccaaacctgagcctcacgcaatatacccaggtaacaaacccacacgtgtagcccctgaatctaacataaaagttgaaaaaaatgacataaaattaaaaaataattttgatacagaaaagaacatctgggaatggaatatatttgcttttaatatatatctacaaaagtaagcaatgatctctggtaaagtcatgaggcacggtatccttactggctgggataagagcatgcatcagaaaacaccaacatccaaaacatccaagctcaaaacactaatttatagccatctagatgcttttatattcagaattattatagaaagaaagcctaactgaaatcaggtgttctacatgcttttcattcaccagtgaaattagtccaaatagtgtgagactgaaaccagggatatcagctttcatcatcctgggaaagctcgtgctgcttcatttccttccacttcttgctttccagtcaggtctctggttagcagtccatgcagcccataattatgaccaggggtactaagcatgactttttcactttcaataggcctgcactttacagcaagtagttctgagattattatccaaaaatatctaataaccttatacttggaccaatgggcttgtggaataatttgggttcagataaaactacttcttctatctaaccatatgtcagaatacatagcccaccaaaatctttctaactctctgaatccctatggagagtaacacatagtttagcacttaatctttctctaattatttcctacatgctaattttatctccacaactgaaaagtaaattccctgtgtgcagtaacatgccctaatctttatgaggcagtaccataaacagtgttgagcatatttgatgcctgtttaataaatagttgtttatgattatccgatattaagacttagactcctgattgggagctgctttcagttaacataatacagaaatgaaacctcatgtcttttaggaaacatttctagattcctctccagcctcctctgaattactttaacgcttgatttgaatgactaaaactggaacatctttagaaggaaactagagttgtaaatccctgggaatgacttagggtaaataaacaaagacataactcaggtccagaggccaaaaactcagagttcatgttttcaaatattggccagtctgtctttcatacagctgtgtcagctaattgcccaatagcaacctttttgtttgaccatagcaatctgttcgtttctctctctctctctctctctctctctctctctcagcatttactgatgactgtaagtatctttaggtatatttatcttttctctgagtctgcagggtcccttatgatactcagtaactgtgctctcttctccattgcattcttattgctgagtataatgcccagcacttagtaggtgtttaatatatacgttggaagaatgaataattggatggatgaatggatggatgagagatgaaaatactgcctaatgaaagaaggtatcccatcttattaaaataagtagccctccttccttggattgtctggtgttctaaagcgttttttaaaagacatatatgagattaaacctaatctaggctctctccctgtgcgaacacaataattgaaacacatgactttagagaacaaaatgtgacttgactagctgtctgaatcatttcagggtggcatttaatatctttttaaacaaaagacatatatatatatatataactcaacagtcatttaactttctctgtttctcaattctcttatctctaaaatgatgataatatttgcttctttgtacctgtttcgtagttgaattaaaattttgacccctgccatatgattctgcagcccttccacatctttctgcagatactgacataaggtagagaggtcagggaaaggaccattgtagtgacctagtgaggtgtcagcaatgggacgataaggagtagacaatgtaagaaattcatgccagagtgtgggggtgggaatctatagaacttaatgcagatctcaaaggaaacagaagagtccaaatgattaacattgggtttcaaaatccacaccaaaaaaagattttaaaagttgattctttgttcacatgtctcatatatgcttatacaatagcagcattcaaaagtattttgagtcttatagttacatagatatttttacctaaatttctcctgtagcaagggttcagggactttgttaattttatactttttagcttgtcacccagccctttgtttcctctctctggatgtgcagaaagattttaaaatctatccctgccaaacaattctctttcgtgggaatttggtttaaaccagttctgttgctatggtacctagttttcagttaatggaaaaatacaaaaccaaaataatactgaatttgcagtatatatgtccccactcattgcatatcgacttattcatgttgattggattcgtaaacgatcaaaagttgctcagtgctataaaaaaagtatctaacctacttagaattcacatactgacacttatacctttcaagtgttgtgtgtatctgtgtgcatataaatggtagaagagatggcatggagcagtaagagtttttggaggtgaagaaacctgacattgaatttcagcttagccagctaaaagctaattgactttggacaatcacttattgctctggaccttttttccaatctacagagtgggtattcgtaatataactacttttcaggaatgttattaaaattaaagcaatatgttttaattgcctagaacaatgcctggtacttagcaggtttgcagaagcctactagtgttttcaaatgtggagatgatgtgtgtgtgtgtgtgtgtgtgtgtgtatgtgtgtgtgtttgtgtgcatttgtgtgatagggtgaattgtaaccccttaagactcaaatattgaagccctacccccaatacctcagaatgtgactgtatttggagagattgcttttaaagaggtaattacgttaaaaatgaggtccttaggttaggctctaattcagtctgactgtcatccttataagaagatgaaattaggatacttggaggaagcaccaggaggaggcatgcacccaggagagaccatataaagacacaacagaaaggggaccatctgcaagtcaaggagagaggccttagaggaaaccaaacttgctggcaccttgatattggactcctagcctccagaactatgagaaatttccattgcttaagccactcagtctgttgtactttgttactgcagccctggaaaactaatcctatctatctatctatctatctatctatctatctatctatctatctatctatctatctatctattggacaacaaatgttcgtaaaatagaagtgaaaataacatgctagttttcctgagtctttttctcttcatttactgcctccagtgtatagtttgttattatttactttttactaataccttacatggtataaagaaacacaagtcttaaatgtatatcccaatgaatttttgcatatgtgcacatccatgcatccactacccaaatcaagacttagagcattccttgttccctagcagcctctctcatgctcctccaggtaaagagccattcctcttccccacagtaaatacttgtgacttcttgtgttttatatattttgaacttcatataaatgagtcatacatcactcttttgattctggcttctttcacatagcgtcatgtatgtgaaatccattcattttgctctgcgttaaatgttcactttattcattgctgagagcagtattccattgtatgtacatcctccaatttatttattcattttggtgtcgagcatttttgtagtttccattatttataattatgaataaagttgctatgaacattcttgtaactatttttggtggacaaaaccactcttttctcttgggtaagaagtacatgggaattctataaaatgtttctatcttaatgttacttacaggataaagtctatttttctcccttctgagtattgctttttaatctccctactagaaattctcagtgcttcttaacccggggcaggcatttttgctccccaggggatatttggcaatgtctggagacacttttggttgtgacatcttcggggaggatgctactggtagtgggtaaaggccaggattgcagcaatatcctccaatgtgcaggacagccaccaccaacaaagtcaattatctggccccaaatgtcaatagtgctgctgttgagaaaccctgtatctagaccaatagaatttaattttgtatttttactgagtaggtattcattgcttgaccaacccacatattctttctgatacatcttttttagaacccttaggaagaaagagtaatggcagcagcattttccacccttttctattggggttattaattctcaaaaactatacagcctgactttagtgagttcaaggcatcagagcttgtctttatcaataaatatttccagaaaagggaaatagcatgtgtcctttttaagatggtgatgttgcattctgcgaagaaatatatatataaatatgacataaaaatatacatacatatattgcaaatgccatttctttgcctctatttagaaccagctaagatagccaggcacatggatacttgttctatttcaaaatgtctacagaagattcttgaaattcttcctgtcatttttcccagtctctaaaaactgtgatcaatccattcccctgaccgcatgtcatccattgttttctcaggcaacctcttctcaccttcagagtaactgaaggtatattatattcactttagttatcagaagtacctaaaagaaaaaaatgatcaagttatttccatttccatgagcctgagccttctcctctcccatattcctgccagttcttgcttttgaaaactgagcttaagggcaatattgtaacttgcactttttgctgattttatatcattcatctagctataggtctgacagaggtgattacttagctctccaaataggcaatgatgtgattgccttcatttatttcagtgacattgaaatggaggaatgatatttgttggctttgggctttaaagacatgtggtctgctatatttttggctgacagctggaactagtagtgcctgacactagaaaaccaaaaaagtcagcatttgcccttttcattttgaaaattgaaaatcacaggtaattaatcatattaaatgtgaatgtaacccatttcattgctataaaatcacctcttcaattaaaatttttttataaataattatatttgtgcagcttttagcatactaactttttcgtgagttgttttgtaacttacatattaatatgttttaactctgcttccttaactgcattactcattgttattgatatttgatgtctaaggtccgtgatgcccaaagtcttactatgtttgggagagtcttataaaatgaaggactgtctatattaaaataacaatgagaacctcattgatgataagtgatgtaaaaagagagaataactaatttttcaaaatgattctcaaagaaaaaggtactttctatgattatagaatcatggaaaaatgctggaaaagcttagttctacacttaagctcttgggaaatattttatttaagctgataaccaatattatagagaaatgacaattttggcctattttaaaaatactttcatcttcggtagcattatctaaactctaaatctataatatgtcattggaaagaaaagggttccgtgctttcttaaagacaatttgcattttagtaaagagcactatatcaatcagttcactaaataaggttccaaatatgaagaaaagcaagcataacgtgaagccataacagtcattgtttttaattgtgatcaataatctgtgtcgagaacaagtttttgttaattctagaaaaaagatatgacagacaagttgtccttaaacataagagaaacaagatcgatttcatattcactgtcactgtgggtgacattcttctgaataagatttcaaaataaatgctgcaaaatttcaggataaaaaatagaacattagcattaatcatattcatgctcacttctctattttctccacctttgccttctacagtcttcagctatacaggtgatacgcttgttccatttcaagtcaaatgacaccattagttaattagtgttgcaagtctggcaaatgagatctgaaacgaaacacctgtcctttgaccctaacttgttccttgcttatgcaaatgaagagagcagtttaagcattttaaatgttttatttctcgtattatgctgcaggttttatgctgacaaggaacacttaatgtgtgtgaaactagttctgatcatctggtttcagctttttatttattgaatggattttcagtgctgtcattttctttttacctgaagatcacataaaggttgcacaggtttacgtttgcgcataaggaccagtttggttttaagtttagctgtttgagtaacttcatgaaataaattagaaatatatctgttaaatttacccatatgttaaaatagcttttcggtttatgcattatgactattgcaatatgccacactaatatatgaacatttctataactaatatatgtttttaaaatagaaaattaaacgtgaaaggttttttatgaaatatatttatcagcatgaatctttactcactgagcaccatttaataagcatactgattgtaatgattgcattttctccactaaagttctcaataacaacccttggatataaaaataaattcactttcgttattttaaagcaagtcaacaaaataaaattattttggataaattgtataactgaattttcataatgatttatctcagtaagaatagaaaatattattactgtgcagataaggtggcaatggaaatccaatgagaaataaaggctatgaacattgaatgcaatattgttatctgtttgccttgattcatcaaggggtttccaaaatgtttttacaaagttcttattttcaataaatcacatcataaataaaacctcattaacatgaatagagggttattgccttgaaaactgtctattggaattcttggcgggaaagtgagactagtagttatttatttatgtataggtttttctttgcatatacagtagtctctcctggtccctggtttctctttctgtggtttcagttacctgaagtcaactataatctgaaatattaagtggaaaattacagaaatgatttctaaaatgtaaattgcacatcattgtgagtagcatgataaaatcttgcattgtcctgcttgtcctacccgggacataaatcatctctctgtctagtcaccatattcaagctgtacatgctacccactctttcatcatttagtagccttcatggtatcacagtgcttttgttcaaatgaccctttttttacttcataatggcctcaaagcacaagtacagtgatgccggcatactgttgtaattgatctattttattattagttatcgttgttaatatcttactgtgcctgatttataaatttgattttatcatatgtacatatgtataggaaaaacatagtatatataggcttcaatactgtctgcagtttcaggcattgactgggggtcttggaacatatatcctgtgaatagggagggactactgtgttttatggaaaaatggaaattatttttattagaaaagttttaacaaaaggagagcagagcaaatatttcctgtaacagtgggaaacttgttttgttatgcatatggctttctaggtagaaagaatgcttttggggaattttaaataagttgggatgaaaacttgacttctttaactctaaaagatgctttgaagttttagtttttagtttttgtaatgccaatcgtgtaagataaacaactttgaaaccccatatttcagcttatcaaaaatatttaaaatgttcaatcccaccatttaagaattattatatacagaagtatgcattatacagtaattcctactgggaagcttagagcctttagatatttccctctcttaaagagtgggagaaattccaagttataattttttagtattacatatttcagtgtcaaaaaattctcatgaacaactaaatgtacagaattctctttgatataccaagatatgattttacaacttcttttaatgtaatacattttagtgtctaaaaagcatcactaatttaattttagaaattcttttcttttcttttcttttcttttttttgagatggattctcactctgtcgcccaggctggagtgcagtggcgggatctcggctcactgcaagctccgcctcccgggttcacgccattctcctgcctcagcctcccgagtagctgggactacaggcgcccgccaccacgcccggctaattcttttttgtatttttagtagagacggggtttcaccgtggtcttgatctgacctcgtgatccgcccgcctcggcctcccaaagtgctaggattgcaggcgtgagccactgcgcccggcctaattttagaaattctactcaatccaagtaaagtatatgtattccagacctctgccctattaaaaatggagaatcatattcccaattaaaaaaattataagcacaaaggtttctttaaaaatccttaacttttttttttctgttgacttcttcacttaactaaataaataccaattaaaagtttgctctcatggcattgtacagttgatggaagtgggtcaaatgagtgggagctattttactggtccagggaaaagatgatgatcacttaaatttagatggtgcaaaaggaaaacaagaaaagtgcacagattttgtttgtgggtgattgtttttactgtggtaaataatcgcataacataaaatgtaccatttttgccatttccaagtttacagttcagtggtataaagaatattcacatggttgtacaaccattactaccgtcatatcttcaaaactgaaactctgcacccattcaacgtcttcccacttccactccttctagccccaggcaacaaccattctattttctgtctctatgaatttgatttctgtcggtacctcatacaagtggaattatacactatttgtctttttgggtactggcatattttacttatcataatgtcttcaaggcccatgcatgttgtagcatgtatcagatttgcttctttttgaagctgaacaatattccattgcgtatatatacaacattttgttcacccattcatccataaatgagcccttgggttgtttccatgtcttggctattgtgaatagtgctactaggaccgtgggagtagtggacagagttgaaatatattttgttacgtgctgatgaattgaatatgaagactaataaattgtcagaaatacctatccaaaagtatagaatatgatttaaaatttttttcttctgaatatcatatgatcttttaggatactaactattacataatggaagctcaataaatataattttataaattagtccatgaaaggcatctttaaaaactgctttaaatgtctgttaatccgttagggtatcaattttattggccttatttctgcagtttcaaatttgctttatttaattttctcattaaaattgtttatatttaaggtatatagcatgatgttttgatattcatgtacgtaatgaactgattactacaatcaagctcattaatatattcatctctttaaaagatgctttcttggggttcaaaaaccggtaccccacaatatggcactttgacatgttggactaaagaaacattctcaaggtctctctttcaccccaccccacccctcccagcatctctcaaccttctgtctctctcaaagcacaggatgaaggttttctctgaagttcccttatcagcctgaagcctggacccaccaaagaagaaaacagttacctctggtcccttccctgagtttcattaacttaacacatattgcaggaagaaagacaagtctgtcagcacacctggacagactttcaaaaaactatcgtcttctatttcattcccattcaggatttcaaagagaatcatttaccagctattgtctgctctgcaggcccaataggctttgttccaggccattgtatgttttccaggttcactcattttcccttaaaaatatttactatccctcaaattgccacatttcctccacctcccctccccttatgaagaagaatatataaacatttttaccccactgtgttgttgggtcattctcctgtgattcccctttgccatgcacattaaaatacattttatatgccatttctcctattaatatgccttttgtcagttaattttcagcaaaccttcacaggtgaagggtcaatattacccttggcccctacagttttaacttatttttcaggagacgcacatttgtttttttgtgcatgggtacgtaggtttctgtgatgattttactaactaaatgggacaactatatcgttacataccatggtttcactcattcttttaaaattatttttactactctagttaaatataaataccataaaatttgttattttaaccattttaaaatgtatacttcggtggcattagatacattcacattgttgtgcaacagtttcactcgttttaccaaattgaatgttttgtctactggccaggatttattgattgttgtaatgaaaatcttttcactcatagtttagcaatccttttgtaaatgccctaaatctgtatttattgtataattaaataccttagcaaatacttttaaactgaaaatcccggtgtactaagttcattcatgtttttcactctcctttttttttttttttttttttttttgcatttcagtttggcaagtttctattgattaagtgtcaatagacttttcttggttgtgtcaagcctactgatgagctcatcaaaggcattctttatttctgtcataatgtatttgatctctagcatttccttttgagtctttcttagagcctctatctccttttaattactcatttgttcttgaatcttgcctactttttcctatagccatcaacacattaatcacacttattttaaattctctagtaattccaacatcaatgtcatacctgagtctgattctgatgctcgctttgtcttttcagacaatgttttatctttcttttttgtgtgccttgcactttttgttgaaagccagacattttgtcttgggtcataggagctgaataggcctttagtgttaggatttatgttaatatggctaggagttgggctgtatttaatgatttctgtagctgttaggtgcccatggcttccgtttcctctagtgtgtttgtttttagcttcccagttttcttttgtcttccctaagaagtttttctcagatagagtctgtaacttttggttctttcagctgtaatccactgtcattatactggggccccgttagtttggttgtagagtgttgaggagaggaagcattctatcatcataaattaaatcacagtcttttagtgggcctgtgtccctggactgtgaaacacactcataaacgtttcttagctttttgcttcccctcttaggtgagacaggaaaaccagagggagctggagttgggaaaatattcttctttcagatgggataaggctctgataaagctttttcctcctggaaaataggactgtattatggagaacactcatactctgggcatagttcacaatgttttctcatcctgtccccctgccagaaccaccagaggatcaatcttggctcttcactgtgagaacaggaggggtggggttcttagaggtaaagtacagataactgtagaggccaccaggaaatttctgactctcatactaatccacattcagtttccagcaattcataaaaattacggtttaaggattcttacaagtttatggatccagtggccttttttttttttttattcgagggaaactaattgctgctttgactctgtatttgcctgtatctctgcatttcagtgtggaagtttgctttgtgacctcaattttctgatggatccaagaaaagtcaatgatttttagtttctttggctttttcttgtaagcatgacttcctagctctttacatgttggagctcttgggtggccttttaaactactaactagtagaatggaatgcagtaaaaccaacaaaaacgatggaacaacagagcctggaccattaatcgcgccatccaatctagagtagaaaagacaatgtaagtaaggcaagtgaccttttaggtcctaaaagcaactttatcaccagcccctgtaaacttttaggaaaaaaagattcaaaattataataaataatattcatacatatttgagtgagatcaatgatctggcttcttaaattcttcatggaatatcaattttgacatttctttggctcatttccacagtggctgaatctgttctcagtcagaaaggaaactcgtattttcttttttcaaactttgtaattttccaactttctaatgaaacattgtaggccttcattagaaagattacctcagactaacttactgctagccatgtccttcaacagtgcacctaagataatttattgaagtatcttctctcagatggcaaatgtttcttcattcactctcttagcattttaagttccacagtaggagctatgtaagtctcctaaagcccacaatttttagccctaaagagcattaatgtccctctaatatacagttgatccataatggtgtgccttaagctttcttcaaaaattgcctcaaaaaaaaaatcagtgatgtgaatctgcacttactgtaatactgtggtaactgggagtgggccatgtgtatactcatgtacataaacacactacacattcctagtttaactatttgctaaccctgtccattgattttcacagtatatttttttctcctctcaatagtttttaaggcttcctaaaatacaaattgaaataaccttttgctgcagatattatggaatccaggcaggcctgcaagtctgtgcagagtttactctctggcaataagactgagaatcccctttaacaggccctgccagaccacctgttatatttgaataattcacaaacagcttttcccattaattcatgccaggcctctaaatataatccaaaataagtcatgttataaggcatttggattagaaataaagtcattataaccatatgcctgcatttataaatgtacttttagacaacatagtaccattctaaattttcaccacaggatctgtttgacctacagagatatttgggtatctctaacttaaggaaaaaggccgtgaggcaaccattttaaaatacttacagacagtgagtttgaagaactttgaacttgtagtctcctgatgcctcactgatacatccatttcaaggcagacaattgccttccttaagcccaaagttagaaaaaatgaacaggacagtttttcaggttttgtctcaattcctgttcatgcacagtgcaatttttgccacactatcctcatctcttgaagagatggctagccatttcttctgtgatgtctcaaatgtgcttcaaagttcattgtagcccttataacactgaaacctacctgtgtgcacatctgtctctttcagttctttaaatggtatgagaacatgttaagattagctctataatgagtcatttctgcatccctcagatccctggtattgaacttgacacgtaatttgtatttggtgtggttattcagtgagtaattgacaaattcaatgatccatattatgcatgtcacattttagcttcccttaaagaaaagtttttaggaaaggaaaagaacactggggaggggggaaacaaaattaacttggccatgctgagaattgcaggaatgtgcactatgcaaacaagttaagtaagcacagtgtcttccttacttccatcagagaccttgcttggctaaaaagcaagagtggagcccactctctgtattcatttgcataatttgttcacactctgccttagccacagaagtggaaagcctttcctttcctggtagtccctaggacatgtcatctacctccctcgtgagttgtaatatggggaggactggaaggcacagcttagagccccatggtgtccagtcaggggaacatggggataatgtgtccattcactgacactagcgcttttctccaatatggttaacagtcgaaatttgattaaagcaagttaggaaactccagtaaggctaattttctcttgaactatatatggtgtctgttggcaagaaaacaagagttacacatttaagtaggttaatatcaactgagaaactcttaagaatcatagtttaagatcaggccaggcgtagtggctcacgcctgtaatcccagtactttgggatgttgaggaggatggattgctcgaggtcaggagttgagaccagcctaaccaacatagtgaaaccctgtctctactaaaaatacaaaaattagctgggtgtggtgttgggcacctgtaataccaattacatgggaggctgaggcaggaaaatcacttgaacccaggaggcggaggctgcagtgagctgagatcgtgccactgcactccagcctgggcaacaaagcaagactctgcctcaaaaaaaaaaaaaaaagaaaatcatagtttaagatcaaagttgaatgtatattgtgatgagtctacagtgtgggaacaactttttgaaaagtgtaataggtttgagaaaaatggcttaatttaaaatatgtattttctattatatgtgcatgatttttatgaagatatattctcagaattctttaaattagtggttctcaattcagtctatgtatcagaattgcttgtgaagctttcaattaatacatatggatacctaaacctaacccttgattctgattcatttagtctggagaaaggttggacattttttagcaactttgtttttgatttaggattgaatatcactgccccaggattatgaagaaattcatcatcatcctaaaaatattatagtacttcagccctttattatagtcatttttccataagtggcaaataataagaatccaaagaaacatgttgtgtatgcgtggggccatctcgatacagctgatgacaattaagttgttggctgtctggttttaaagatatttggaaagacaattccttttataagaaaaccaaacaaattccagccaatgaatggtcttaggcggtcaagaattttattctggcttactgacatcctcaagatctcaagacacagattagactatgagaagacacagtaaaatactccatctttattcttagagattctattctgaatcccacttttttcagttttattgagatgtagtgacaaaaaattgtatgtatttaaagtgtacaacacgatgtttcgatgtaagcatacattgtgaagtgattgccataatcaagccaattaacatattgatcatcttacatagtagccatattttgtgtgtgtgtggtgagaacacttaagatctattttcttagcaaatttcaggtgcacaatacagtattattaactatagttactagctgtacattaaattgagataacttattcatactgcatcactgaaactttgtacactttgatcaacatctccccattttccctactctcagccactggtaacctccattctactttctgctcttaggagttttaatttttagattccagatataagtgagattatgcagtgtttgtttttctatgtttggcttattttacttagcataatgtcttccaggttaatctgtgttgtcacaaatggcatgatatccttttttttaaaaaaaaatgctaaataatattttattgtgtgtgtgcatgtgtgtgtatatatatcattttctttacgcatttatctgtgaatgacacttctattgtttatgtatatttgctgttgtgaataatactgtaatgaacatgggagtgcagatatctctcccaatcactgatctcatttcctttggatatacacccagaagtaagatgctgaatcatatgataattctattttttcattttttgaggaacctccattatgttttttgtaatagttgtacaaattttcattcccaccatcagtgcacagaggtctctattctccacatccttgccaatacttcttctcttttcacatttgataatagccattgtaacagttgtgcagtgatatctcattgtggttttatttgcatttctctgatgattagtgatattgagcaccttttcatctacctgttgatcacttgtatgtcttcttttgagaaacatatattaaattctttagccaattttaagtaggcttatttgttgttgttgtttgctattgagttgtttgagttccatatatatttggatattaaccttttatcagatgcatggtttggaaataaatttttcctgtttcataggtagtctcttcactctgctaattgtttcctttgctatgcagaaacattttagtttcacacaatcccacctgtttatttttgctcatgttgcctatatttttggagttatgtccaaaaagtaattacccagaccaatgtcaaaaagcatttcccttatgttttcttccagtagttttaaagcttcaggtattaagtatttaatcaattttgagttggttgttgtatgtggtgtaagataagggtccaattttatttttttgagtgtggatatacaattttcccagcatcacttgttgaacagactgccctttccccattgtttcttagcatgcttgttgaagatcagttgactataaatatgtggatttattgctgagatctttattgtgtttcattgctctgtatgtctgtttttatgtcagtatcatactgttttgtttactatagccttgtagtgtattttgagatcaggaaatgtgatgcctccaagtttgttcttgctcaaggttattatggctattcaaagtcctttgtagttacatatgaatttggggaaatgctattgcaaatttgataggcattacattaaatctgtatgtggctttaggtagtatggacatttcaacaatattaattcttccaattgatgaacatggaatatctttccacttatttgcgtccctggaatagatccaactcagtcatgttttaatttgctggtaaattcagtttgctagtattctgttgtggaattttgcatctatgttcattaggaattttggcctgtacctttcttttcttgtagtgtatttctctggcttttgtatcagggtaaggctggccttgtgaaatgattttgtaagtattacccgcttttcaagtttttggaaaagttaacattaacaaaaaattggcattaattcttctttaaaagtttggtagaattccgcagtgaagccatttgatcctgggcttttctttattggaaggtttactttattactgattcagtctccttacttgttagtgttctgctcagattctgtatttcttaatgattcagtcttggtaggctatatgcttttaggaatttattcattccttctgttagacagtctactttgtgatttgacaatgtattttcagtagtatgctttgattcctttctcttagattttgtgtatctactaattttttttttcattgtggttaccatgaggtttacataaaacatctaatagttagttatgtctattttaagctgacaacttaattttgactttgtacaaaagctctatacttttatttccacctttcacattttatgtaattgatgtgacaatttatatctttttatatcatatattcattaagaaattattaaggctctagttatttttaaaacttttctcttttaacttttatattggagttacaagtgacttatgcaccactattacagtattattctgaatttggctatgtacttacctttaccagtgagttttatatttttatatgtcttgatgttactaacaagtgtccttttatttatatttgaataagtatttttcgcatttcttgtaaggcaggtgttgtgatgatgaactccctcagcttttgtttatcttacaaagtctatctcctcttcatttctgaagaattgctttgctggcatagtattcttggttgacatttttttcctcttgtactccggatatataatcccattctcttatggcctggaaggtttctgctgagaaatctgctgatagccttataaagaatccctagtatgtgatgaatcatttccccttattactttcaaaattctttgacttttgataatttgattataatgtcttgatgtaatctttgagtttttgtatttgtgtacttttgagcttcatgaatctaaatatctatatctatctcaatatttgggaagttttcaacaattatttctttaaataaactttctgcccctttctatatctttctggaactcccgtagtgaatgtatcggttctcttcatgggaagctctaaattctgtaggccttctgtactattttttatttctatgtttgtttctcctctgactgtgtaatttcaaataatctttcttaagttcttatatattttcttctgctttatcacgtctgctatttatgctgttcattgtattcattatattcttcagctccagaatttctatttggttctttttttatgatttccatattcattgaactttttttgtgaattgtttttctgattttgttcatttgcctatctgtgttagtttgtacctcactgagctttttgtaaagagttactttgaattatttgtcaggcagttcttagatctttatttatttggtgtcagttactaccaaaattgtgagttgtttttgttgtgttatgtttccttgatttttcatgttccttggagttttgcattgctgccctcacatgtgaacaaggagtcacctcctccttcaatccttactaactgacttcaggatacaaagactttcattagtcagcctgacattctaggggtctcgcagacctttactatggatacacctgccccactcctcttgtttcctcttcaagaagaagctttatgtttgaatgtcttctcttgatcctgcaaagccaggctgggtgctgactgcctctcttttgtttttcctagggcattgccctgaagtactcaaagttaattgccttctcccagtcccagagagttaagccagatgtctgtgtgtgcttgtgcatgatttgcagaggctatgggtagggatggacagaagggcatgcagagtgcttggagacacatacgagaaagttaaatgggtccacaagtgttgcatcttttgatgttcatgggcagggttcatggagttcatgatgcaatgagtagaaacaatggccctttgtttagttctttactgaagttgctgtgagctctcaccccttttccctgttcttagctttcccaagactattcaactgagccagtttcttctgtgttatgggtgaagtgagataaaagtaggcctcttgggcaacattctgactagctatgctttcactttcccctgtgaaacaaatcgtgggccaagaatgtctctcttggcactgagctgtgtgctgccttgggaaaggggtgatgcaagtaaaatgaaactgttttccttaccctcttcaaggtaatcgtggatcatttttttctcccatggtgcgttgggacctctcccctggtccctgggctctacctaatatacttttgtctgtgggtagttgtcaaaattggtgttgctatggggataagaactgaaaactcttatcccaccatctttctaatgtcactcttctctgaatggattacattagaaaagaacaaggtgttcaccttctttaatgatgtagttacaaggaatctacctctgggagagacagttatgttttcataaatcctaaggcaaaacattagatatgaattctttttatttttatattttctttttctttttcaattctatctatctatctatctatctatctatctatctatctatctatctaatctatctgtctatctatctatctatctatctaatctatctatctatctatctatctatctatctatctatctatctatctatctatctatctatctagtagagacagggtcttactgtgttgcccaggctggtctcaaactcctgggctcaagtgatcctcccacctcagcctcacaaaatgctgccaccatgctcagccagatatgagttctttttctaaaggaagggtttatttaaaaggagtcatagaccatcactggattctagtttcctgagagacatagagggtactctggcattgaagagagacactagaaggatggacatttttggaatgtttaacaagtctctcactttacagcatcagcagcagagagtgttaagcttgaaaaaataagaaaaaagtataaaattatgatcttagtgaattaatgacatattgccaagacttaggccatcatttatatattaacattaatgggatgtgaatgtttataataaaagacaaaaagatgagcttaaagaaattagacctattacccaaacataaatatttacttttacatgttgtcagagagtatttgtacctgtcatattgctgttttgcaaattagagagttaaattgactcctttttatagatattctatttccgtcctaaaactctttccatcactaaatctctcactaaactttgtggtgttacataatcctcactttctagttagtggcaatcataaaaacagataaaaaggctttcattattaggagtggcatggatgaagtagttgatactattggcaagatagaacatgacaaagagagcatgaccattatgacttatgcattaagtgaggtgttttgggctctttctggctatgcaccatatggtaaggaaatgatatctctgtcaggatagactagattgtaatgcagtaacaaatgaccctacttaaaaaaaattattgttatttgaatatttgcaaaatttaaggatcatgacatcatgatgaacatctatagaaatacatagctctctacctaagtacaaaatagagatatagagataaagtacaactgattcagatagttaaattattatgctattatttaatgttctcatgtgcagttttatgtattccagataatctttctaaataacttatgtagacatttatattttggtcagtctatttttttatttccaagtaatttaatttttgtcccaattgaattttaagaatagagctaaattaaaactgttactcagagctttttattcacttttatgttaataaagggttccttagagatgatatacctagttttctgtaagtggtttttattttcttggtaatctacaagtcagattttaggcaacacctgttgaaaaaaggttagggcaccatttacatgtttttcaaattgtaaagttctaatgcaggtttctgcagttagaatattcatgacacaaactgtttcaaatacaacttaaattgagattcaggtttaaatgttgatttatgaaagttcttctttaatgaaacttgtttttatgagatctctgaattgcaagaagtaggacttcagctttggaactgaaatagctcttggctatttgttttaatcactttccacacaaacctcacttctgaacggtcatcttatttagagttattatcaacttacttgccttagtgctgacattgttgatggattcgaagaagtgaaattggcaatcctgtatctaatgctagtgtctttggaacaacaaaaggagtttcaaagggaggctgaaattgaacacttaatattataaatcatgatatatgtatttttttgttttgtcttgtcttttactttggagaggggtttctttactgcatggacagttgtattcattaaatatatagaaaggtcatggctttcctaaaactttgggctgttctttaaaaattaatcttattctcatcaggagtttgtcacttctaaactgatctgagttaatttattggaactgtgagtaagagacattacataatttgggcacaaggagagaatctgtgtcctggaacttgctgatggcaccttcaaaggtgacccagttgaccagaaagtgttgatttccactttgtaattttaaaaatatatgacaatcaaagggcatttcatgacccaggagggagtggaagtagcaaataagcatgattattgcaaaagcttactagattgagtagaaggaatatgcactgctgtcaaaaagttgcaatgtaaaatagtcaaaactttttctatggctctgatgatagcaatcaacaaaatgaggaaaatgatgtggcaggattcagaatctgactaaggagtactaacagagaaaattatcatgttcttggctttagagacaaataaatgggccatgtgggcccaatcttttgtaacttaaaaaatgggaaaagctacgggagagttaacgttaccattttatgccttaagtgagatgttttgggctctttctggctacaaggtttggaaccacaattggattaatggtagttggctttaatggtccgtgggaagctaaaggttacaggcaatcatttcatcagcctcctggctggcctcaatggaaataaaattgtcagactgtaactttaaggaggctgagttagcaaatatattaatttcctattgttgttgttataaattattacaaatttagtggcttaaaacaacacaaatatattatgtcacggttctataagtcagaagttcaccatgggtctcactgggctaaatcaaggtatccacaggaggctgcaggaaacacgtttctttgccttttcaggcttctagaaactccgtgcattccttggctcatggcccctttttccatcttccaagtagcagtatagcattaccacaactacttcactgactctgcttctgtggtcatactgccttctctcgtctgtaacctgaccctcatgcatccctcttttcatttactgaaaaagcaatgactgtgacatgactaaataaagaaaatttatcatatttcttaaaataatgtatcaaaataattgtatttatcaaaatgacagcaaattaaaaatttaaaaagaaaacagataacaaatcaatacgcagggtatgaaattactccagatgaaatgaatggacaagtgattagaaaataattatattcatggttgctcaagatataaagagatagcagttactaaaaaaaaaaaacacaaacatttagagtcgctaaaaatctcaaaagaacacaactagtgagtgtgtaaaagaaattctagtcaatatgtataaaacaaaagatcactattcggaatatgcagatacctcttatttattaataatgaacaaatgacctaatagaaaaatggagaaaatatttaagcagataatcaaagcagccaataagcacatgtagtttttcagcttcactgttaatcatgaaaatgtcaattaaatatatatgtactattttctactcaccagattgcgtaaattctaaattgtcagacaattgaaaggttgatgaaaaatggctacaattttgcatattgattaaatctaaaaactaatcacccagaaattaaaacttttggtatttacccttgagaaatactaatacatgtatataaaaagacgtgcacagagatattatttatttttatggttgtttgtggtagggaaaaattaacatcaaaacaaacataaaggccatcaaaatggagtaaataaataaaatgtggtaagacatgtaatgaagaaatactattctgaaattaaatgaaatgcactaaatgtatgtttcaatatgtggggaaattttttgttgttgttttttttttttgagacggagtctcgctctgtcgcccaggctagagtgcagcgtcgcgatttcggctcactgcaagctctgcctcccgggttcacgccattctcctgcctcagcctcccgagtagctgggactacaggcgtccgccaccacacccggctaattttttgtagagacggggtttcaccgtgttagccaggatggtctcgatctcctgacctcgtgatccacccaccttggcctcccaaagtgctgggattacaggtgcgagccaccgcgcccggcccatgtggggaaatttaaaaaagatagtgagtaaatgatatgaaatatttatgtaaactaaagcacagcctttctgtagccagctaggtggtccgcacctataatcccagttatttgggaggctgagaccagaagataacttgagtctaggagtttgaagccaccttgggcaacatagtgaaactccatctcataaaaaaaaaattaaaacacaaaataacactagataatttgattggctacatattcatatgttcagaagtttgaaaactaattgagggataaatagcaaatttctaatagtgtttacaccagtgtagacgaggagtggatcatcaaaggaggtgaggatagaagagagcctggctagatgagtgatatctctaattattttctgtcgaaatatacctgtattcatattttcagtagtttgtgaagtatgcacatggggggaaatgtgtttatgagtaaactaaataaagtataaaaagtggttaattctggaagctagcaatataggttattaatattatttcttttttatgtgttttctaagtttgtaaatattttatcaggataattataccaaaaaaagtagttttaaaaaacagtgcagcagattaacttcagaacatacagagccactgggcaaattcctgagcagaggaatttatatcaaaagcaggatacagaggcaaagagatcttaaaaagacagttaagagatgagtatagcttttgaagctccaacatagatctaactgattattcataagaaattaataaagagaataaaaagaaggaatatttgaattgataatgtcaaataatttttcagaactgaaaaataagagtagagtccactgtttaaaagtatgcattgaatgcccagtatgataagtaaaaataaatccacctatagaaatcaaggttaatgagaacatcttattagataccagaaagaaaagacagactacctacaaaaaaaaaaagacaattagaatgacaccaagcttctcgttagcaaggagagatgccagaaaacaactgaggataaaatatttcaaccttaaattctatgcctacctaaacaattgttaagaagacaaaataaataaattttctgatgttgactaactaagacaacttctgtccataaatttagtggagaggaaggttttttaaagcaccagcaaatgtgaaaccaaaagacaaaaataggattcatgtaacaatgcattttttcttcctcctctcgaaaagaagttaaaacttctatattacagtcaattgaatttccagtaattttccttttgagaacaaataaagtaaggaaaatctttacattttgcctcctgtttcttgataaaatgttaggaaaagtcaaaataagtcgaatatttgatgaaattgatgcagttcatgtcagtatgcagtaattggaagccttggaaccctatgtaggctgacatagaaagcaatgtaaaaatggcacgtgaattttctttcttctttctaaaaagaagagctagatttttagataggaatacaaatgcttcatttgttcataggttatcaagattttctttcatttgaagttttgtttggcagacatcttcctttgaaaatgggagacttgtggaggtttcaaagggacttgtgaggaaaaagttttggacagaaccagaaactggctggattgagagacaacatttttatacaaatgcacattgaaagggaatgaaataacccttaattccaacatgatctgtttcagattactaaaggaaatatattatattgtatggtatataatgagcactcaacaattttatgttgaactagtagcaattatcttgtgctcccgacccactaagcttatttaaagatcaagaataacagattattcttgatttaaagatcaagaataacagattattcttgatttaaagatcaagaataacagattattcttgatttaaagatcaagaataacagattattcttgatttaaagatcaagaataacagattattcttgatttaaagatcaagaataacagattattcttgatttaaagatcaagaataacagattattcattagattatttatgtactagataattaattcagtttaatataagaataatgaaatagattaaaagagagccatgcatgggttaatgatattaaaatgtcacaaacgaataattataccaattgtgtacacaggagctttttgagaaaaaagtagcggattttatgttctgttgaaaactgtaaagttctatataaatgttatttcaacagcattgaaatggtgattttctgagaaaattttctgtactagtttaactaaattatacatggagatcaaatgaattctcaagtgggcctatttattttgaatcaggaattatataaaatatggaggacattattaagaaaaatagcatttaagactaggcctaattaatattttcaatgagggtaatttcataggattgaagagagaataggatttttataactgaatatggtataatagagaccaagagttttctggtcattcattaccaagaaaattttaattatgtggaaaaaagcaaaagaacaagaaagtcaagaggatctgaagcagagtatttatccagcccagtgtcacttgattaaaatagagatgttgtagtcctttagaatgtccatagagacaactgaaactgacctttaaaaagtgttgactataggttttgttgttactgagctttgatagccactttaaatcccttctgatgcaatttatgccctcccttctttatcaaaaaggaaaaaaattgtttagtagataatatggaaatatgcctcatttctctacagtctagcaccactgaactagaaaatataaggcatttatattttctagtttggtgatttcgaccattgaagtgttcttcattccacgctttggaatggaaacttgaaaatgatgtaggaatatagtataaacattctgactagagtatgattgaaaaaaatgtaactagagtggttttctcttttctgtagactgttctttcagtgcacctcttaatatgattatggctccaatctcagagagcctgagaaacttgcccaagtccacatggctagaacataacatgattcattcagggtatattaacaataaggtttattttcgggttaagaataagaaaatgccttatattttttgagtgttcgtttaaagtccacagtcaaaaaatattatatgacttcatcaaggcctaactctcttcactttatcacattgcttcaacaatagactgttaaggcagtggaataatctgggatgattaattttcttgtaatcattgaggaccatgaataaaattgcaaaaaaaaaaaacaactgccattttttccatttatatttttaattagaaagcaggcatttaatgagaaaaattcacgtttgccttgcaactacttatggtcgcgttaaaatgtctatcaatgtaggataaatggaaacatgttaagatttgattattaagctttgcttaattaatatatttccaggaaaatatcagactactgatttgggctacaaataacactgcctggttttttgtagccaggtagtgttatttgcagctgaaatcagtaagtttgtaatttagaacctgttagcctaataaatcatcatgtgttactatgaatatgtgaaggcatttaactaaagtctaagtatgatccatcatatggaaatacgtgaaggcatttccagtctttagtaaggacatggcaatgtcactatcatatagaacagtggaatggctattatttgcctcatcagacggatgcattcttaataaaagataaattagattgaacccataagcggatgtcaggaactgtgagatttacattttagaaacatttcctagaaatatcatgggaaaacttatcaaatggatttttattatcaaaaatagctgagaattgttcgtacatctacatatgctcatgttccttaattctaaatttgcttcagaaacaagtcagtaatttaaatgacaaataaaacattggaaaaatattttcaatgcatataagctaatttttattttaataccaatagacattacatgctttcttagaaaaagaactgaatgtgaaaacgaaacagtttaatctctgctctgatatcacgcatttcactggtgagtctactatttttttctcatacattactacttaaaagtatgggagtttgataaattcaacaaaataccttttattgtagccttaggtggcttcctttgttttctcagttaagaagaggacattaatgagtatgaaaacatctaagattgttgctttatttactaaatgctgggctgattaaatagtaagtctgccaaagatcacagccttgaacaaaaggcatagatgcatatcacagagtaccaggaggggattccattcctattccatttgagtctcccctgacaaatgatactgagcactacgttacattgattcacttgcccacaaaaggttgtgataagagtgtctaatctttatgcttgaattgccttattgtacttgtagaaatgaaagcagaagaaaatatatggaaaacagattgtgtatcttatttgtcttctgtccaaaggatacatttaaaataatttgtctagccaggcgcggtggctcacgcctgtaatcccagcactctgggaggccgaggcgggtggatcacgaggtcagcagatcgagaccatcctggctaatacagtgaaaccccgtctctaccaaaaaatacaaaaaattagccagacgtggtggcgggcgcctatagtcccagctactcaggaggctgaggcaggagaatggcgtgaacccaggaggtggagcttgcagtgagccgagatcgcgccactgcattccagcctgggtgacagagtgaagactccgtctcaaaataataataataataataatttgtctaaacagagttctttcttcagtgtgctcttcacattttaatgctgatttgaagcctgtaaccattaaaattaaaatggaaagattatactttaagagtagaatcctcaaatgcatatagaagtataaacctaatgccctttagcaaagtctaggaggcatcaagataagattagttcctagtagttactctttgttaattaactccctgaagaaacctgagaacatttgatattaaagaaaatatagtagttcattttcagatagattgaagttttccttgctcttctaatagatgtcttcctaatatagtttccataatctctaaatatcataccctgcttttattctcttgtatatttcccctcccatatataaagtatataatgtactgagaaacatagaaataattgcaatatacaatattcctagttacatttcagtaattgttttgtggcatacagttacatattctttctgggagagtgtgatgaaggatatagatgaaagattggtcatttcagtgccaaatcatcttagactttatgtcccttcctccctacaatgtcaccatcctctgtaacgcttttctcagaattgagactccctgaaggtcttagagtttaacgatgccctttttgtccattagtttatttaataaatgattattgagcaactatatggcaagtactgttcttgattgtaaaatctggcaaggacctttaaggtcctcccagggtcttttatcttataagttgtcaaaaaggcttagtagtaattattttatttgagttcacataaggatattacaaggttaagacttttatcgtgacaaaagtttttgtgttttatttttcgtgtctctagttatttttgtttcatttttattctcaaaccagttttgaatcaagggattttatttttgtccagcatttcactttaagacagttagagtttcttacaattcctgtgctcatgaatgaaaattaaagcatataatcattcaactaaagcgtattgcttgtcatcttaaaacctattttaggatgtgaagtattatttattgaaattttaagttagcagtgtttgacgtagtttgtatcagatactctccaaagtcattttctgattaatggagaccatttaaatatataaataactgatacagaatgaatagcactggctattacaatttctttgtctttaaattcacaggagaatggtgttgcctaagaattgttggcattttttaatgaaaatttgtttatacatttacataataaaattaaaaccctttttcaaaggcacttgacatttagaggcattgtttaaaaatattttccagcatcttctagattttacaccaagtgaatgttctgtttaaaaatggttctatggtcaaacaagtttatggaatgatgcctgcttattctccctgtagaaattcataatgcccatttctgtatcagaaaaatcttagagaatcttgcttatctttatgtttccctttagaaaatgaaaactatttcaaacattttattagtatgtagaaaatactatgacagcagaagtattttatcagtctttaaatttttcccaaatagcaatacattccagttgcatgcaaatgtaaataccttctctcaattgcctgaaattaatacattaaaataacagaaaaatagtgttatcttagtctgtttgggctgctataacaaaatactttagacttgtaatttacaaacaataggaatttatttctcacagttctagatgctgggaagtccaagatcaaggcaccagcaatatcagtgtctggtgagagctctctgcttcatagatggtggcttgttgctgtgtcctcacatcatggaaggacaaacaaactctctcaggcttcctttataagggcattaatcccattcaggagggttccaccctcatgatatagtcacttcacaaaggccccacctattaatacatttgggattgcatttcaacatataaatcattgagggacacaacattcagaccataacaagaataagcttggatttggaaagaatttgaaaaggaaagtaggaatacaattgactttcccaagttcataggtagtaacaaagaatgagcaataatcaagatgcctttgttcttatctttccccaactcaaataagttatatataaaaattcatttcttactaggtccattatacttgtctatctcttgaaaacttgagtgtcctaatgaaatgagacttctattttgtaagatgagagaaaggtgaggcaaatattctgaggcaccttctagactgcagagcaacatgcactgagttttttgaaagatttaccagttttaaaaaataaatgctgtcttgttcttcatcatcctcccatcactggcatatcttggtaaaagtgagatgttatcagtgagagccctttaggtagatcctcgtaaaagttaccattttgagaattgtatttatgattgttggtgtgttaacaaaatcatgttgcaagagaaatggacttttggctaactgcctagctctattatcctagaaactagttaaatggtatatgtcaactattttatgataaaaatgtcccccgtggatggatgagatgtatctaggttggaagaaccataaatacttgagaagaagtcacagctttgggtgttcctaggtgcagggactcttgatatggggcatatcccttgaaggtctttggaagctgtattagtccattctcacattgctataaagaactacctgagactgggtaatttataaagaaaagagatttaattgtctcatggttccacagactgtacaggaaacatggctggggaggcctcaggaaacttataatcatggtagaaggcgaaggggaaagcaaacatgtcctatgtggctggagcaggaggaagagagcaaagagcgaggtgctacacaaccagatctcctgagaacttactcactatcatgagaacagcaaggggaaaatctgcctccatgatcatgtctaaattgcatgtcagattgtaattcccaggcccttcctccaatactgggaattacaatttgacatgcaatttagacagtgacacaaatccaaaccataactttccgtccctggcccctcccaaatctcatgtccttctcacatggcaaaatacaagtatcccttctcaacagtcccccaagtcttaacttattccagcattaactcaaaagtccgcagtctgaagtctcatgtgagacaaggcgagtcccttctacctatgagcctgtaaaataaaaaacaagttagttaattccaagatacaatatgtcttggctattagcattcggctcctctttacttatgcaaatctctgcagccagcttgagtactccccagaaaacaggtttttcttttctaccacatgatcaggctgcaacttctccaaacttttaccctctgctacccttttaaatataagttccagtttcagatcatccctttgctcatgcatatgctgttagaagcagccaggcaacatcttgaatgctttgctgcttagaaatttcttccaccagatactctaaatcgtctctctcaagttcaaagttccacagatccctagagcaggggcacagtgctgacagtctctttgctgaagcataacaagagtgacctttgctccagttcccaataagttcctcatcttcatctgagaccacctcagcctgggtttcattgtccatatcactatcagcattttggtcacaacaatttaacaagtctctagaaagttccaatctttccctcagcttcccatcttcttctgagccctccaactgttccaccctctgtccattaaccagtcccgaagctgcttccaccttttcaggtatctttatagcaatgtcccatttcccagtaccacttttctgtattaatcagggttctccagagggacagaactaataggatatgtgtatatatcagaggaagtttattagggagaactggctcacatgaacccaagtcaaagtccccaaaagtctccaagctgggaaaacaaggaaatagtagtggctcagtccgagtccaaaaacctcaaaagcggggaagccagcagtgcagccttcagtctgtggctgaagggctgacagcccccagcaaatcactggtgtatgtccaagagcccaaaggccaaagaacctggagtctgatgtccaagggcagaagactccacaagccagcttatcccaccttcttctgcctgctttgttctagctgcactggcagccagttggatggtgcccacccacattgagggtggatctttctctcctattccactgactaaaatgtcaatctcctctggcaacaccctcacagacacactcagaaacaataccagctagctaggcattctgcaatccaatcaagttgccacctaatattaaccactacagaagctgtcagtggtgttgtcctgaatgacgttggcctgtacctgttagggtgatagctcttctaaatcagaacaatttccccatctcaataatgtggatctgtttccttgaacctaaactgtgtctctgagggtatagcttccagagggctgtgtgagctgtcatacacatgaaatgcagcaaggactcttatggagaggacctctatcacctgacgtagtttctgagaagactcatggcaacagcgcctatcatagttttgagtgtctgaatgtttaattaaatctacagtgaccccttggagggtgattgaatgatatttctctactctccaaatatgcaacttcgttcttaccctctgcatcatcatttataaaatagaaagactagagctggttttctccaggtgtggatctctgataatcctcagcagagtcacttgggatacagattctcaggtctcaaccaagagaaattaaatcaggatctttgaggttagggtcctgtaatcttcttttttaacaccttctcctccccatggtacttgaatacacagctggacaagatgctcattagtttattttctattttagcccttgaccttataattctaatgatttgttcctcccattctacataatgtcttaatgcaattcaaatctcatttcttcagaagaccatcaaggaataaataactgggagtttcagaaatggcaacagtttagggaaaatctctgtagttaagtcaggtttgagaaacccctggaacaatttgttgtaattgtatacttttttaaagatccttttggtcccctgtaatccttatgattattaaaacatacaggtccttagcaccatataacgattctgtttaaactgttggcttttcttttttttcaacatgctatcaccattgtcactgttgccttgactgtagggtagtgacttgctagaaggtcagagattatattaggtcttaccaaacaagtgaaaatcaatattttcactctctttaggagaatgagtttcatatatactcgagatgaaagaaaaattccctttgttgttctgctgaagttgtcaagccttccattagtctaggttaagtttctggggttatgaatttaattttggtttctaatattgatttatatttcataaagactttgttggttacaaaaaaaaaatcctcagtaaatttttctacttcaagggcagtgctttagtttagaaaaagatgtgtttctcagtgatttagtttccatttctggacttaacaataatgagtgaaacaggaaattttgctgtgaattatgaaaggttattatacagtatttccaagccactcaaaattatgcattcatcttaggctcttaaatttaacaaaactgaatgagattcaatactattttctctgttttatcaaaatgttattgaaagttgtttaagattttatactcctcgagggcacatatcttttgtcatctttgcattttcagtagtgtttttatactgcagataatttatgcacattttataaatgagtgaacaaatagatgttatgaaaaaaaagtactgttatcagattccaggataaagtaaaaagcaatatttagcaatcctccatatactacaatgccctacccaagcctgttaattccactcctcatcctcatcctgccacaaacattttcagaagtcctcagacatctctgctatattccctaacttgccccaaactcccgtgatccaaaagtaggcttccctttctcaattaaacttccctttcgctcagtaccccaatctgagcttgctatcctgcggagagttacctgggaaatgaagagatgcagctgtatgatatatatgaacaagtttacccttactggggagatttgtattttaaaagatggtgatggaaaactacagtgatatatacatgctaacttttcccaatgttcaaatttcaggtagtgggacatatggcaaaggtatttttcaatagcaacctaaagacctctcagggaggtgacctccttttctgcctccaagtattgctggttctgctataacctgatatgattttttatttatagagtgctttttataagttgccttcttcaggaaacataaaagagtgggaggggaaatgaataatctctcatgcttttgtatcagttattatcaactttggctgtacattagaatcacctggggagctttaaaaaaatccttgtgtccaggccatcctccaagccaattaaatcagaatctccagggatggagcccaggtatcagtatatataaagttcccaggtaattagattgtgaggcccactaatctaaatgaggatgaggaatgcagtagatctctgatgcttacagaagacaatagttataagaaaaagccatgtgagaaaaattggaaatggttgaccctttgggaactggagagcaaagacagtggctactgagctccaaccaagtgttgcaccatgggagggaaggagcaagatgattaagaggatcagccctagtggcagatcccctgaggttaaagtacttttctgcccttcactatgtgagtttgaatgagtgtcttctttgtacttgttttcttattagcaaagtgaggatgatgattatacctatctcttaaggttgttgtgaggattaaatgaaatcataagcataaatcacttagcattatgttgggcacgtaacaaacatattctacacttttgaactattttgttatgatgatcaactttgaaatactagagttcacttgtcttcttttcagtaggaagttggcttccaatctagggagagagaaggaagagaagcaagagctagggagatgataatcaaatggttctgagaatgatcttaaatttttaagatttttaaatttttaaaaaggctttctatccccttgttcccaccctcagccctcaagaatttcttactgtctttatttcctgccatttcttgttcttttataatcttgtacctctagtttcactatacatcaaaaagatgggaagtgatatgctaacataaatgggtgaatttgtagatgtatcagttgagattttgctgtgtagtaaactacctcagaacaaacaataattattttgtagcttaaaacaactattttgtttgtgcctcattaatgaatgggcaatttgggctgtgttctgctgggtggttgtttttatggccttactcatgtatcagtgtcagctgttggtcatcagggacactctttatttcaggatggactggctgaggctgggatgaaggggttgactgagccatgtgtccctcattatataactagttaaccttggcttatttacatgatggaaacagtttccaggagtggaagattggaagcttttaagatcaaggctgataaccagcactgcatacttctcccaatttcttttgggcataaaaaatcataaggctagcgcatatccaagggaaaagtaagatgagagttgcttcaaagcgttatggccattttttggtaatctttgacaataacctgttgaaataaagcaaatgggaggaaatgaggtcacagtgaggctgatagcattggacatataaaagtcatattatagataggctttggcagatgactgggtatgtgtggtgagagatagaaaaaaattagtggaagttgcagacttagtaattatgagaattgaactttgattaactaaaataggaaagccagaaggtgacaaagtagcacggaggcttacctatatattctcttacagaaaactttgtactgtattccttttctaaaattgcttttgttttttaataaccattttttcccaagggcaagatgtgttttaaaattcattagttaaggactcaaatgaccaattcgatttttctacttcttagttgactccttcatgaacttttggaataataataaaatgtataaatagtgtatgtactttatgctttaaatgaatattcctctaatatcaactccaaagcaggttattcaaagtatgaaaaccaacatatctaactctgtgctcagaccaagatttgtgtagcatctctagagaatctgagagaaatctatgagaataaaagacagtggcactgagacattatctttacatatgtgcttattgaatctgtatagaattcttctataaaaattatagacttttttgttacagatttgctctcatgaatttaattttatattgccttactcttatattgtcactttatataggccactagactgtgaaataaaatcagataaaggtagatgttttccaccactaccccttctccccaatttagtattcacaattattttgctatagcaagatggtctctcctttttactggtattttccctcagaaagtcttttttttttttttcactttgacgtgcattacgttaggtactttaaaaatagcatattttcctaaattaatagtctttaatattcatttataaatacccagcaccacttaacctagtgctttaaaaattgattattatttattattgccattacttaaaatgtgcttttaaataattaaatgactttttaatattcccctctctctctcactaacttgaatacattttaccagccttgatttgtggagatgtctccacatggatagctagctctactggacaggatagcttgtgttactagctcaggcataaataattatttacttttgttctcttacagtattttcctgatctgttactttgctacttccatattattgctgcataataaactatctaagtactcagtggtttccaataacaatccttaattctcactccgttatccgtggatcttctgggggttggctatctgtaaggggcttagctgagttagactctaagatgtaggttgagtctcggtctgtgtcatataactcattctctttaaacccatcataggtttgaacatggtatggtctaggaagatgactctgacagcactttttctctttgccaatttgaacgcagatgactagacatctcaatgtataagatgtgaaacaggaaacaacatgcaaatatacctttattgacttataacagatgacagcaattccattttcctctactattgcattttctactctatttgtgaatgtgagctttcctcatcaatttatagaatctctgtatgactcattctgtcttaatctaaaactgaaataactttatattgtggaaataaaatatcttacatctcaatgtagtctaaaataggttaaatgagatggttcttcctgagcaagcacagcaggtctgcaatacatcttctttctccacatacattatgtcaagtattcctttagcatttatataagttgtatatgtcacacagatatggatctataaatgcaaacagagcacagatgctggcacgatacacacttaaaattgttttatagcttttggattttatttgtgtcgacttaaaagcaaatttataaatattttttatttaagtaaaagatgtgagctgctattaacactgaaagtgattttagagatcatatattctacctcccacattcgtcacattagggagtacaattcagatgtgtcaagtggcttatcagaggttggactgtgagttagtagaagacctggaaatgaactccagctctcctgactacccagttggctttttccatcctattgccatatctcctaggcctctgccaggacagagtgccacagaactgtcagatggggaaatgagacacaattgtttcctggattctattattgttgagatttttaaaaatgtgttttaattcctaacctagctttgcaggcacatcaaagctgagtgcatgtccttccgaaatcttccctggtatcctgtaatggacactgattttttttttaaatcttcgaattcttgtaacacttaaacattttggtgtgaggatagtaaaatcattaagaataggaagcatatctcttgctccttctgcaccctctcacagagattagggcagttctggctgtttaatattattgacaactccccagaaagatgaacacaataaactgttgattgagcacagccaagtttactagatcaactacagtaagagagagcaccatctgaatggagtcttggtaatgtgtcaaaatatgatatttttaagagtttcaagcccaggctgtataattttagggttggtcttgcaaaatgggtagttagttgaggcttgggctgagtttatgtcctaacaggtttgaatgggtgagaacaacactacaagaacccatgatatgattagtgatgggtaaggtattccagtatttttagtgcaagacgaggaaagcatgcatcttcccagaattgcttaacgtgggaaaacatagtggtatcagtttttaatatttgcttatggacaggtcattattacataatcctaaaaatgaaactgggtaaaccccaagttatatgtaggaggcatttctaaataacactcagaaattggaaactatgtaattaatcaattaattaattaatttttggtatacaaatatagctctattaaactaatgataaagatagcatctttttttttttatttttttatttttttatttttatttttattttttatttttttttatcatactttaagttttagggtacatgtgcacattgtgcaggttagttacatatgtatacatgtgccatactggtgcgctgcacccactaacgtgtcatctagcattaggtatatctcccaatgctatccctccccgctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaagatagcatcttaaaaggatacattgggcatcagattcaggaactagaggcagaaaatttatgggaaaggattgcaggcactcagaagtaattgtggcacaacaaagtgatctctgtgccatatcatttgtcctacagtgcatgctttctagtttcctttgccttgacttcatagtaacctcctagatagagtctaagattgctcctctggcactggtcccttgcttacttgtgcttggcctgtctgttgctgacttcatctcagacttcagcctacagccctgatccctgccttcagtccatatccttggtttggtaacttgtttatgcggtcttcccagtatgtaaccactgtccatactctgtccatatcactgctccaaggtggcttatggtactatatttccaaaagcctgctaaaggtcatcactacagcaattctcctttttctcccatcatcaattttctcttctctactgaatattcctgaaaacatacgaacagtccattgtttttcccattctaaaagaaagaaaacctttcttgactccaatttccattatatttaactccttattatctcttttccataattgcaatatgcctaaaatttcttcaatttctttaattaatttatctcctcccattcttacctgaatctaccccaatcaggccttcaactccaccgctttgctcaaagtgtactggtgaagttgagtcttgatttccatgttgctaaattcagtagtaattctcagtcttcatcttacttaaaattatccaggctggagtgcagtggcaagatcatggctcactgcagcatggacctcccaggctcaagtgatcctcccacctcagcctcatgaatagctaggattacacatgtgcaccaccatgcttggctggtattttttattttttgttgagatggggtctcactatgttgcccggtctagtcttggctcctggactcaagctatcatcccgccttggcctcccaaagtgttgggattacaggcatgagccatcatacctggcccatcctacttaaaatttcaagaacacttcacacacagctgatcaatctgttctctgtgaaacattttatcctcttagcttccaacataatcacttgcctgtttttccttctaggtatctaaatgctcattctcagatttgtttttcttactggtttctcttaatttcctcatcttcttttttaaactgtattttattgtgttgagaacacttaacatgagatctgccctcttaaaaacttttgaatgtacaatacagtattgttgactataggtacaatgttatacaacagatctttatcttatttaactgaaactttatgcatattgattagtaattcccatttatccccacctctatcccctggaaaccatcattccactctgattctatgaatttggctattttagatacttcatgtaagtggaacaattcattatttgtctttctgtgactggcttattttaattagcataatgtcctcaagtttcattcatgttgccatttattacacaatttccttctttttaaaaggtgtattccattgtatatatgtatcacatcctctttatccattcatctgttaatgcacatttaggttgtttccacatcttgctattgtaaataatgctgcgatgagcttggggtcattgatatactgatttccttttctttgaataaatacccagagttggattactggatcatacggtagttctattttcagtttcttgaggaaccttcaaactgttctccataacagctgtaccattttacattcccactaacagtgtgccagggtcctaatttctccacaaccttgccaacacttgttttctttctctatattaaccatcatgacaggtatgaggtgatgtcatatgtcattttgatatgcattttcctgatgattagtgacattgaacatttttctcacatacctgttggccatttgtatgtcttctttaaacatctgttcaagtctttagcccattttaaaaattagattactagtgtgtttttctgtttgtttgtttgtttgtttgctattgagttgtaggagttccttatgtattttggagattaactctttatcagataaatggcttgtaaatattttattccgtgctataagttgcctcttcattctcttgattgttttttgttgttgttgtcgtgtaggagcttttcaattttaagtagtccctcttgtttatttttggtttggttgcctatgcttttggtgtcatattcatgaagcaattggtaagattaatgcatgaaacttttcccctgtgtgttttcatagtagttttacagtttcaggtcttatatttaagtttttaattcattttgagtttatttttctgtatagtgtaaaacaaggatcccattttatgctttcatatgtggatatctagtttccccaatatcatttgttaaatagactgtcctttctccattgtgtattttcggtactcctgtcaaagatcaattggttgtatatacatggatttatttctgggttctctattctgttagattggcctatatggctgtctttatggcattaccatatcttttgaatactgtagatttgtaatatgttataaaatcaggaagtgtgaaacctctaacattttctttcaagactgatttcatcgtttatggtcttttatggttccatatgaattgtagaattttttttacctatttctgtaaaaatgccatggagattttgatatgaattgcattgaatctatagattgctttgggtagtatgaacgttttaacaatattaattcttccaatccatgaacacggatatctatttgtttgtgccttgcttattttttttaatagatgttttgcccttttcagtgtacaactcttttgcctccttaagtttattcctaagtattttgttgtttttggtgctaatgtaaatgggattattttattaatttcttctttagatattttgtttgttagtatatagaaacacagctaatttttgtgtgctgattttgaatcctgcaactttaccaaattcgtgttgtagcaggtttttggtggaatctttaagattttctttatataaaatgttgtcatttgctaatgggaacagtttttttctttcagatttggatgctttttgtttctttttgttgcctaattactctggccaggactttaaaaccatataatttagtctgcagacatcgttagccatgaaattcacaggtcttatgcaaagctgggactgctgaaagtgccatttgaattttaagaaacaacagaggagtttagtcagttattctttcatgtgttattgaaactcagttttgagtgccatctcaaaactaacagaataaaaagaatgtgggaaaattctgtatgtactcaatctcaactttcctccttgaaagttaatatttagtaaaatgtagtctgaaagaaggaagccactagaagtcatagaaacagagagtagaatggtggttaccaggggttgaggttgtgggcggggggttggggggcattggagtatgttggtcaaagggcacaaaatttcaattagataggaagagtaagtttaaacgatgtattgtataacatggtgactgtagttattaacaatattcttgaaaattgctcagagtagattttaagcattttcaatgcaaaaaataagtttgtgagttaatacatctgttaataacttgattagccattccacaatgtatatgtacttcaaaacatcatgttataactataaatataaacaacttgtatttctccatttaaaaaataataaataactatttatagaaaaggaaaccactgggctcccccttgcactattggtcttatctggggaaactgttagcaaaggcgaaataatatgccagatgttccaaatggatacgtgataccaacaggcttctgttagaaactatctcctgcctacaatccaccaactgcagtagtgcttttgtgtcctgcatgtgtactgtcgaatgccaaattatagctccattttccctcagcttttctctattcaaactattgcaggaagttcacttgtacattttgttttgttttatccacccagtgctactatttggctccaattctaccataagcacagatatatccccatgcactgaaatcttgtggcaatgcttacagtggttaatatttttggattatcttcaaaatgaaagcagcacactatttttaaattgttcttgagaaccctcaagcctcaatttgaaagatactgccctagagacctaacataaacatgattctctttttaacatgcaaacattcattccttcagtaaatatttattcagcacctactatgtgtcaggcattgtactttgcactggagattcaatgggaagcaacaatggataaggctgttgccctatgaatttatggtgtaatggataaggctttccttgaataagtcacaattataatgaaccaggcagctaaggacatgttcacatttttatgtagtatgaacagctgtagtacctcaaattgatagaagctatgagttatatgcaacttaaacttgaagtatttttaccactgaaatagtctagaagctgttcctgagagattaagttgttttgcattatcattaccttgtcatcatcagtggtatgtggatgtcatggttaaaagaggaaatataatttcggaatttgtggcttctcagtagagaacacatttaaggaatgatctctaaactactatactacgatggaagagagagttctaagaagtgaaagaggataacaagaagattattaggaggcaacaaagataggcttggcctctgttgatattttctagtgataagtgcctggggatcatctaggtgaagctctaggcgaatagtcagaagttgttgatgtctggtaagttatattaatgtaaaaccaggcaccagctgatttaaaacatacataattcaatagaacacttctatatgttaatcaataacatcaggtctgatcatttaggctacttgggttctatgttatttggagcaagccgtgctccagatcctacgagacaggtacactgaggatacctagcagagtccagctctgctactcctatggtccttgaatcatcctgatggacataattggtaggcatgttaagagtgccgaatcttaggccacatttatactaagtcagaacctgtattataacaagatccccaggtatttggaagaaccttaattaaagtttgagaagcacagatctagtaaactgactctctcttagatctactgataatgcattttccaagccattgattctcatatcaattttacctttttaactcattttatagcattctctgggcttatcatttttccctcattcaacatcactttttaagatccttcattcatactttcatgcattcaatgtattcatagttagcgagcatcttctatgtgtcagtcactgctctaggtgctagggatagaggagtaatccaaacaggccatatccctgactttatgaagattttagattatcatattttccatggcactcctattttcaggtattctttatgatctcagatcattgctcttgatttttggtataaaatgttatgtagcatgacagaataaagttgattatactgagattgaaggaacagaatgctttgagtcatcacagacttttgttacagtcctggatatactatagcctactagctatgtggtcttgggaaagttacttaatctcttcgactcaatttcctaaactgtgctattatatattaattagtaggataaaataaaataatatatattaaatgtctagtaggatatgtggcctaagagactttcaataaattggaggaagaacaactctggctgttcttgtattgctataaagaaacaacagaccaactaatttctaaagaaaagaggtttaattggctcacagttctgcgggctttacaggaggcatggtgctggcatctgctcggcttctggggaagcctcatgaagttcacaatcggcgcagaaggtgaagggggagcggacacgtcacatggcttatgattaacgtatagaagctttctattgaattatgtatgttttcactcagctggtgcctggttttacattaatataacttaccgggcatcaacaacttctgagcaaggagcaagagcaggaacgagagagagagagggaggtgctacctgcctttaaacagatctcacgagaactaactcactatcgcaaggacagcagcaaggggatggtgctgaaccatttgtgataaatccactcccatgagccagtcacctcccaccaggcccactttccaataccagtgattataattcaccatgatatttgggtggggagaaatatataagctacatcagagcttatacaagaaacagcatgaacttgcttggggccagtttattaaatccaatgaagctctattagatacaataaaattagacactttagaaatgtacaaaaggcctaaatttgggtagtctcatgccttcccaagggcaggtattttccctcttcctccctgcctctcccgagtgattccttgcacacgtggaagggagatctggcaggatgctgaactagcctgacgctatgctggtcatggcctccatgtttcctgtgaaacccacaagaatagttgagcacaattcttaataggatggcagtgtctcttgctgacccgcccatgctccttgactctgcagagggcttgtaacaggggctcatccaaggtcaacctcaaaactccacctcagacatcaaatggagtctgaaagagcccaaggaagcctggctccttatagaagtcacagtgatcattggagttgatgactgcataaactataaggtgaccacctgacgacagagtagcactaacctgacatcattaactcacctaccacagcttctctggcctcgaaggaatttttctgcagtactgtgctgtgaagtattcaggaattatgttttgtgctgtaacgtgccatagccataaaccaaaataaagtttttaaaaatgagatagctacttaactaacctgttaagatttaggctaatgattagttctctggcattacacatcctcgaggcatgcaccgtagggtaaaggacaccagaatatgagatatcagtggtctggacaaacagatacttttacttcagagcagtgggaggggagatggaagtgttagtaccatcctgtgatcacataaaggtgactcttcacctgcagttgctagggagaggcttgtttgttactcaaatgaacaggaaattaagagatgagcttagttaatgctaggaatgcttcatggctctctataagtaagcacaaacttgtggggtaggcattgtgacaacgaggtgcctgtaaatatgaagttcagtgcacatgatgtggcaaaaaagacttctgcgattcagacaagcacttcttccaaagagctctaagcacaaccctgacgctgtttccttcattctcaggacacttctgtgaattagccaaaggtcaaacccagtccttctgcttagacagaggtagagggagagcaagtcaccagtcgggaggagcagagggggcaccatagtggggactgcctggctcgtccctctgcccttgtcttcttcctctgccgggcactctcctgtctctccacagggctgagcaggatgtggttctcacagccagtggcctaagtgcccagcagtcaccggagaaccaggcccactgaaccttgggggaagccctctgctgttagggaaggagacagatgcagctgtttattaagggtgaccctgtgcatccactgtgcggagcagcaatttgcaggcccaagtggactcaatctttgggaaaacacagagctagatggattcttattactgccatttcacacaggaagaaacctgctcacagggagtaagtgaaggtccaggatcacatggccagaaagtggtgaacagggatctccaacccaaatcctctgacctgctattgaatctggctgggcagcctctggccagctgtctatgaaaggctggcaggcagcagagtgtggccctagaggatctgatgaacgggtgaaaacctaaaatggggaaactcacacaggatgggttcattttctacaatgcttcaggtgacaccatttttctaagttttaacttaacaaagaacatgagagtgttaataagaattgtatgttcttgggtacatcacgtgggacagaatttacatagaatatatatatatatctttcaaaacatatattcagccattgataactctgttgctttattaaatattatgattcttagattagttgtatcatctgtgaatgagattgataattgtgtttgcaataagatatattcataaattccattcattaataataaccattaagaactgcttgaatttcatgtcttagaccatatagtagcttatatgtaatattatcatttaattcaccagtgtccacagagaggacagagcaacacatgtcacaggaagaatcacaacactatttgataatccctgtcttgggttcttttttggaatgaggtggggtatatataaataaatagtaaatgaagtcaacatgaccatgcttttgtatatttctttctggtttacctcgtttcacctctcttttcatatgaaagttcttgctccattaagttcatatcaactgcaatgccacattctctttcccattgccatcaccttctgacctttagaagttccctatatgaataatgccttcagcacttttgtcatcgttttcagcttcaccccaactgccagcatgattctgagattttatggtgccgagaggagcccccctcaccaatgtcctggcctcacaggccttgatttcctcagagccagtgaggcagtcctctctccccttcctcctcagccagctccttgcaccaggcccacagtttacactgtcactgtaagaaattgctggccttctctgaatctctggtttaaccatcccatgctgatgccaccttctatccctctttcaaggtctctggaggatagtgttcctcctgcagaaggtgatccacgctgcttacagggaacttcacttctgttcttgcagagtgggaaacaagtcagttttgcatacccgttggagctccaacagttcttttccccagccatggtgtttgctaggttttgctcagatgggccctgcttggttgtcgtattagcctgagtgtctaaggacaccagtgttcattcctccctcctcctccactttatcccattctccagcccctcgttagtcaggcttcatgactcctaaactttgtgatgtcattggtgacactgggctctgatcagatcttggcatatggttcctaccaggttcgtggtggaaacctgattaccctaatggccgaatccacttttagaaggaagccttgactttctacattgtaggaaagtaaatgagggtttcagtggaaaactttgccttgtatagagtacatcactctaggttctctgacactaaccttgcatttgtctttgagctcatttctatcattttgtaagttgtaggtcactgacagacatgcttaatatctcgtacagtggaggttcagttgtatctcctttcatgttataataaaaccagttttgcctccatttacacgttcatttcaatatccttgatcaatattctagtatgtattctttatattcttttttgaaccagccacaatttctactcatttactcattagttaaatagactctttaaatacatgttcatttcatatctgtatgagtatcatgattttactctgtttgaaaaatatttttaactgttttggaagtcccagtgagatgcccaatgtattcgcttgccagatccagattatctttaatgacaagaaattgcacctcctatgtggttaaaacccaaatgtgtcttttcttggccctctttaggtgaatccaaagcaatgagagaacattgttcactctctatttttctagctttaatttccctctctactaattttgtgtttctctttggttttgtttcatttacagccaataagttattctcctttgttggcagcaatcgttgtgaacttgattttagggtctgacgatttggagatccctctaagtagataaatggtgtatagaaatctaatgactgttgagtgaaagagaacagagaatctggcttatctttctttttgtctgtcttttttaaatctcaaatcagtgaagaattccatgtcctcttacaggaaaacagctcttctatctagactggggagtttttctgtttctgtgttgaattttgacccatgtctgaacaagaatcgaagctataagttgtacttctctgtgcctgtagggataccttcacctttgattgtgtgaatgtattgtgtttcttagttccatgtggtaataatatatattataaagtctctcaaattaaaggagccctgttctgattggtatatctgaatacttgcttatataaataaaaattgcctaaaattctctgaaataaatgaaattgaactaatactttaaatgtgctagaatacaatatatatattcttcatgaaaccattcagaaccataataaaaaatttaactacacataatttaaataaatatttggcaaaaatgaatggtttactttagaatttattaaaaacagctatatcttttttgatgtcagtgttattacaaaagtgtgttttttaatgagttggggattttttatttgtatttatttatttacttttaatttattttttatttcaataggtttttaaggaacaagtggtgtttggttacatgaataagttcttagtggtgatttctgagattttgatgcacccatcacctgagcagtgtacgctgtacccaatgtgtagtcttttatccctcaccaacccccaccctttcctcccagtccctaaactccaatgtatcattcttatgcctttgtgtccttatagcttagctccaacttatgagtgcaaacatgcgatgtttgattttccattcccaggttacttcacttagaataacagtctccagttccacccaggttgctgcaaatgtcattatttcattgttctttatggctgagtagtattccatcgtatatatacaccacatttttcttttccactcattgattgatgaacatttacatttgggctgattccataattttgcaattgcaaattgtgctgctataaacatggtgtgcaagtatcttttttgtataatgacttcttttcctctgggtagatacctagtagtgggattgctggatcaaatggtagatctacttttagttctttaaggaatgtccacacagttttccatagtggtcgtactagtttatattcccaccagcagtgttacagtgttccctttatactacatccatgctaacatctattattttttgatttttttgattatggccattcttacaggagtgagatggtatcacattgtggttttgatttgcatttccctgataattagtgatgttgagcatttttccgtatgcttgttggccatttatatatcttctttggagagttgtctgtttgtgtccttagcccactttttgatgggattgtttgttttttcttgctaatttgtttgagttctttgtagattctagatattagtcctttgtttcatgtaaggttgtgaagattttctcccactctgtggattttctgttaattctgattatttcttttgctgtgcagaagctttttacttaaattaagtcccatctatttatctttgtttttgttgcatttgcttttgggttcttggtcatgaagtctttgcctaagccaacatctagaagggtttttttcaacgttatcttctagaatctttggttttaggtcttagatttaagtctttgatccatcatgagttgatttttgtataagctgaaagatgaggatccagtttcattcttctgtgtgtagcttgccaattatcccagcaccatttgttaaatagggtgtcctttccccagtttataaaagtttttgtttgttttgtcaaaaatctaagtatttgggtgtgtttctgggttctctattctgttccattggtctatgtgcctatttttataccagtaccatgctgttttggtgactatggccttatagtatagtttgaaatcgggtagtgtgatgcctccagatttgttctttttgcttagtcttgctttggctatgcaggttctttttttggttccatatgaattttaggacggcttttctagttctgtgaagaatggtgttggaattttgatggaaattgcattgaatttgtagtttgcttttggcagtatggtcattttcacaatattgattctactcatccatgagcatagtatgtgtttctatttgtttgtatcatctatgatttctttcagcagcgttttgtatttcatttttagaggtctttcttgtcctcggttaggtatattcctaagtatttgattattttttgcagcttttgtgaaagtggttgggatcttgatttgattctcagcttggtcactgtcggtgtatatagcagagctactgatttgtgtacattaatttgtatcctgcaactttgctgaattcatttaccaattctaggagctttttggatgagtctttaggattttctaagtatacaatcctatcatcagcaagcagtgacagtttgacttctgtttactgattgggatgccctttatttctttctcttgtctgattgcgctggctgggacttccagtattatgttgaatagaagtggtgagagtgggtatccttatcgtgttccagctcttgtgcagaatgctttcaacttttccctgctcagtattatgttggctgtagctttgctatagattgcttttattaccttaaagtatgttctttctatgctgattttgctgagagttttaataataaagggatgatggattttgttaaatgctttttctgcctctattgagatgatcatgtgatttttgtttttaattctgtttatgtgttatatcacatttattgagttgtggatgttaaaccattcctgcattcttggtatgaaacccacttgataatggtggcttatctttttgatatgctgttagaattggttagctactattttgttgaggatttttttttttttttttttttgagactgagttttgctcttgttgcccaggctggagtgcaatggcgcgatatcggctcactgcaacctctgcctcccaggttcaatcgattctcctgcctcagcctcccgagtagctgggattacaggcatgtgccaccacacctggctaattttgtatttttagtagagacggggtttctccatgttggtcagggtggtctcaaactcccagcctcaggtgatccacccgcctcggcctctcaaagtgctgggattacaggcatgagccaccacgcccggccttgttgaggatttttgcatctatgtttatcacggatactggcttgtagttttctttttttgttatgtccttctctggttttggtattagggtgatactgacttcatagaatgatttagggaggattccctctttctctgtcctgtggaatagtgtcgataggattggtattcattcttctttgatataattcagctgtgagtccatctggtcctggactttcattgtttgcagttcttaagttacatttcaatctcactgcttgttattgatctgtttggagtttctttatctttctggtttaatctaggagggtttcaaagaatttatccgtctcatctagattttctagtttatgcacgtaaaggtgttcatagtagccttgaataatcttctgtatttctgtggtatcagtagtaatacctcatgttttgtttctaattgagcttatttgcatcttccttcttcttttcgtggttagttttgttaatggtctgtcagctttatttatcttttcaaagaaccagatttttgtttcatttatcttttgtaattttttgtttctgtttcatttatttctgctctgatctttattgtttcttttcttctgctgggtttgggtttggattgttcttgcttctccagttccttgaggtgtgaccttagattgtctgtttgtgctctcgcaaaccttttgaggcaggcatttaatattatgaactttcctgttagcaccgcttttgctgtagcccagaggttttgataggttgtgtcactattaccgttcagttcaaataattttaaaattttcatcttgatttcgttgttaacccaatgaccattcagaagcagcttatttaacttccatgtatttgcatggttttgagggatccttttggagtcgatttccaattttattccactgtagtctgagagagtactttatataattttggttttcttaaatttactgagacttgttttgtggcctattatgtggtctatcttggagaatgttccatgtgctgatgaatagaaagtatattctgcagttgctgggtagaatgttctgtaaatatcttttaagtccatttgttctaggttatagtttaagtccattttttatttggtgactttctgtcttggtgatctgtccagcgctgtcagtggattattaaagtcacccactattatggtgttgtcatgtatctcatttcttaggtctactagtaatcgttttataaacttgggagctccagtcttaggtgcatatatatttaagattatgatgttttcctgttggactagtacttttagcattatataatgtccctctttgtgttttttaactgttgttgcttcaaagtttgttttgtctgatataagaatagctacccgtactcctcacttttgctgtccatttgcatggaatatctttttcctcccctttaccttaagattatgtgaatccttatgtgtcaggtgaatctcctaaagacagcaaaaacttggttggtgaattgttttccattctgctcttatgtatcttttaaagtggagttttgaggtcatttacattcaaagttagtattgaggtgtgaagtactattctattcattgtgctgtttgctgtttgaatagcttgtgttttcttttcattgtgttattgttatatcggtcatgtgagatttctgttttggtgtatttggaggatttgtttcaagattcagagctccttttagcagttcttgtagtgctggctttgtagtggcaaattccttcagcatttgtttgtctggaaaacactatctttccttcatttataaagcttagtttcactggatacaaaattcttggctgataattgttttatttaaggaggctaaaaatcggaccccaatacttgtagcttgtagggtttctgctaagaaatctgctgttaatctaataggttttcctttataggttacctgatgcttttgcctcacagctcgtaagattctttcctttgcctgactttagataacctcacgattgtgtgcctaggtgatgatcttttgcagtgaatttcctgggtgttctttgagcttcttgtatttggatgtctaaatctctaataaggctggggaagttttcattgattatttcctcaaatatgttttccaaacttttagatttctctttttcctcaagaacaccaattattcttatgtttggacatttaacatagtcccaaacttttcagaggctttgttctcttttttgaaattcttttttctttgtctttgatggattgggttaattcaaaagccctgtcttcaagctctgaagttctttcttctgcttattcatttctattggtgagactttccagtgcattttgcatttctctgtgtgcccttgatttccagaagttgtgattgttttttatttatgttatatattttgctgatgatttttccttttatatcctgtatgatgttttttatttcagttagacttcacctttctctggtgcatccttgattaacttaacaatcgacctgaattctttgaattcttttactggtaatttggagatttcatcttggtttgcctccattgctggtcatctggtgtgatctttttggggtattaaagaaccttgttttgtcatattatcagaattgtttttctggttccttctcatttgggtagactgtgtcagagggaagatctgggactcaagagctgctgttcagattcttttgtcccgcagggtgctcccttgatgtggtgttctcccccttcccctaggaataaagcttcctgagagccaaactgcagtgattgtctttgctcttctgggtctagccacccaatggagctactgggctctgggctggtactggggagtgtctgcaaagagtcctgtgatgtgatctgtcttcaggtttttcagccatggataccagcccttctctggtggaggtatcaggggagtgaagtggactctgttagggtccttggttgtatttttgtttagtgcactggttttgtgttggttggcctccagccaggagctggtgctttcaagagtgcatcagctgtggtaatataaggaggatgcaaacttgccctggagacacgtggttaagtattcaggtttttcaggcggtgggcagggccatagacctcccaagagattatgacctttgtcttaggctaccagggcagtagagaaagaccaccaggtggggggcagggataggagtgtctgagctcagactctctttgggtggggcttgctgaagctgctgtgggggatagcggtgtggttccctgaccaatggagttaagttcccatgggattatggctgcctctgctgagtcctacaggttgccagagaagtcaggaaaagcagacagtcacagatctcaccccgctcccacacagctaccagtcctaaaggctggtctcaatcccaccatgcccctccaacagcactgagcctatttccaggcagctggtgcccagggctgagaatttgccccagaccatgagcctccctactgaaaaagcaagcagactcacagtttttctggtgtctctgggagcctgcagcagtgatcgggttccttcaaagggtctgtggattctctccacaaaggtgtaattttttaacttgggtatgtttttcctgaaagtaaatagatttactaatcacctaaactagcatacttctagttattatttaaaattatgaggaatataaattcatgtttgactaaattgaaccattgtgatgacagtcttttatttccagttataacatttagtagtacgtcaacttaaagaaattttccaagttgtttagataatccttagattgatattgtattagttgatgaacattaactggatgcctagatcattcctatgtaagataaaatactgaaatattaattattaagcataaattgaaatttgtatactttggctttttagtagtaaatcccacagagaggctgtattttaaggtctatcagtgaacatgttcctttctgccatgttgagaattctatagggaaattgtgctgctgtagaaacctgggctgtatgggttccccaaaattacagaatgttcacaattacccaccctttagttttctttataaaacagatgtgactttgtataaaagtcataattaataatatctgaatgagactctgctaggagtcttaaaaaaatgagacatgctttgattaaagtaaaagaatatagaatgcttctgtctataagtgaaatgacttttgttccagaataagaaagaggatggtgaagggcaacacaacatatagagatctgtttgaggttcacagaaagtgaatctgaaagggaccacaaatttgtgttaaaattttgcaaaacctggttcggttttgatgggtgtattcataagatttccaaatgcaaacctagaatttggtttcttttcaaatatagtcacagtttctttggagtattcatttgtttgtttttttgtttgtttgttttttgttttttttgagacggagtctcactcttgttgcccagtctggagtgcagtggtgcgatcttggctcactgcaacctctgcctcccaggttcaagcgattctcctgcctcagcctcccaagtagctgggattacaggcatgcaccaccacaccctgctaattttgtatttttagtatagacggggtttcaccatgttgatcaggctgatctcaaactcctgacctcatgtgatccacctgcctcggccttccaaagtgctgggattacaggtgcaatccattgcgcgtggcctattcttaataagaggttgtaaaagtttgctcttcacattagaggccaatttgcccaaatagcagagatgctatatctcactagaatgacgttccacactgtgtttttgactttgtcatgctcttgattattctcttaaaaatacaaaaaaatacaaaaataaaaataaaaacccacaaatactctcattactgaaagtgttgagtttttgtttatgtaaatattgtattgtcactttgattaataggcagccaagccacagccattcgtacactaagacacccatgatcccaatcttaagtgttcaaatctcctggcaaattttaattttgcctttctcaaatcaaatccttaatggaaaaggaaataaaaaatataaaaccttcacagtgtctttggcacattaaggtttctttaatatttcccaggctatcttaaagactttcccctggaaattcacaaagatttcttttatgcctgatggaaggagaagtaatagaagtaaatatgttcatttgttatgttactattgatgagtttcataattgtccaattaaaagtagatgctacttaatatctaggactaccctgaatttgcatatatcatataatcatcatttgtgaatgaatgagaaagattatgatttttgataatttatttcagtggttataatcaaattttcagataaaatagtgaacaaggccaggtgtggtggtgggcgcctgtaatcccagcactttgggaggccgaggcgggtggatcacccgaggtcaggagttcgagaccagtctggccaagctggtgaaaccctgtcgctattaaaaatacaaaaattagctgggtgtggtgatgggcgcctgtaatcccagctactcaggagtctgaggcaggagaatcacttgaacctgggaggcagaggttgcagtgatccaagactgcgccattgccctccagcctgggtgacaaagtgagactctatctcaaaaaaaaaaaaaaaaaactgaactaaatgtttaataatatttatgaaatgtagcctatgtcactagtatgactttttaaaattatttaaagagattttattttgtccagaatcttggcagtcaggaatcccaaataaatgctgcaactgataagtgcatcattgttagctgatcttaggaaaccatcacaggcatttcaactgtgttttccaacatacggatttgtttgttgaaatgtagctagtcaattttcatttttccacaagtcaaccagctgatctcgcagcccaatcagtttttttatttttatctttccaccaccccccaccacctccactgctggaatacatttgtagagaagttttcaaaagtttagagtttaagaattctgtttctagattgttaattgtgcatatgtgagaattatgggagatgacactgatcctgtttggtgaccacatcacataataatggaaatgtttccaaacataccattttcaaaatattttctccataataaagtttattttttaaagctatattttcattgttaaagtgaaacctccattttgagtaaatagagtatatgtcatttatttattgatttaatatattctaggaagtaaatcactgacgaaaaggtggcaacttttgaattactcctcatttttatgaaaagaaaacatacataacttctgttaaatttgacaactctttgaagtactctacagtgagtgaaataaccagtaagcctccatatggcctgagggatttccatagtcactcttcatttaattgcagagtattgtacagattttacagatttttaaggtaatgaaatccataaattcctttacatggacaatatatcaaaatatgttaaagatgtacaaatgattgaggccacatcaacctctttcccctttcaaacttctactttctcctctgaatagctgctatgatgtgaatgtcttataagtgtctgatgtaaactgggtgaggatcaggatcaatctatatatgaaatattagcaaaactttgaaaactttttgataaaatggatagaggaaaaccaaaagctcttaatattttcttctagtattccaatggatttgacttgtgtgcctcatttttggaagtcagtggaataaattgttactttacttttattttatttatttatttttttgagaggtagtctcactctgtcacttatgctggagtgcagtgatgcgatctccgctcactgtagtctctgccttcctggttcaagcgatttgcctgccacagccttccgagtagctgggattacagacgtgagccaccgtacccggccccaaattattacttttagatgatcacttttcacttcctgttagtggcatattagtaagagtttctgataccataggaatgtacaacatacaagtcatttttgaatattccagtgacataaactcttcagaccatgaacccaaactgagaatggaatagaaagtgcttttttaaccctaaagtaagaagacttcctacagaaggtgctgttggttgcctatcatatttcccagctttgcctttcctaatacaacccgtatttttttcaggatccaccctcctcccataacccatgtgctttcagggtgggctgacccttctccacacccaggccaacatggtgtaaaccaactcatccccaacgtcagtgattcattttggaatggatacgtattacagtttggctaatgaaatcagaggcatagactttttgggagatgcttctgtgctaaaatttcctaagtcttaaacacacacacacacacacacacacacacacacacacacacacacacacacacacacggagggagggagggagggaaggagggagagagagagacagagagaaagagaaaggtctcttttcctcttttgtatattatcaaaggacatgatgcctggagatgcaggtgaataaggctgaagatcacagaatggaaggaagccatcatgtctttagacttacagttatgtgtattaataacttccccttatttgtttaagtagctgaattgaggttttctgtttggtgtaatttataacccactaacacatcataacttaccaatacatggactatatactgttatatggtaaggcttcactcattgttattgagtattattcacctacatttttttttaatgtgcttgtttggttttcctacacatagcaccttcaaagcgggaatccttaagattaatgccaggatatcagatattagaggatgttagaggcaaacaaatgactgtgggggatatgaaagctgacaggctacttttgaaggaagaagatgctaaaaagaaaaagagctgggagacacagacttatactgtaatacacaaaatggatactcgttattatggctttgagacatcaagggaaaagttgaattatcctttttatataaagactgagaagtgtatattttacaaagactttcatcaaaaaattctaaaatgtattaaatgtgtaatgttttttgaagagggaagttatgcagaacattgttaggcaggcaggatattctttatttctcccaacacctagtacagagaaagggatgaaggacatacttaaaatttgttaaaggagtaaagagatggatttcgaagacaaatgatatataacagaaacatttccaaaaacactgttttcgaagtgttttctccgtagtaagaaacctagctctataacctaaatctattttgcagtttcataacccatctaacatctgaatgattacttctaaatatttttctctacttaattttctatgatgtctgttccccaatttatcttctttggatgtttaagaaaaaatattacaaagaagttttgaaggttttcctttttaagttatgcatagaaatgtacctgccaaatttcgaatttcttgtcaaatttcattcatgtagcaagatgagatttcagggtcacagtgaaagtctatgaatgaaaaaaaatgttaaatattcatattagtgatgcatggggtaggaagtagtggggagcggtcctcctaataggcagacaataaagggggaacgtgtttgtagaataatttagaaacaataaggaaactaacaggtgatctactttttatcaccgtacaccagcaattctaaacaatgtctgtgatgaagtattttccccccaaaatattctactggtctatattctaaacaactgatgtggctactgtttgttttaatcatctttatgtgaacttcaaattcgcacattattggtcatccatgaataaacatttaactctacatagcagttaacttgaagacctcccaattgcacatacagtctctaccacacagactcaactacatgcatttattttcagagtaaattcataatagtttggaattgcctgagctacctttgggagaagttactgtattccaaccagtggtactagatttttttttttctttaaacaggagaattcatgtaatgaatgatggcacagtaactttaaagataaagacataaaacatgacttgcttaaattttgacattgtatgacacccctttagaatttttgtgttcagaaagttaaacagtgaagcaggatgtgacctataaggggtagtatttttgtttgtaaggagtacatttttaatgaatgaaatatgttactatattggaaaaagacatttacagtgaaaattattttattgttttgaaactaaggaagaaattcagaaaataatgactatcactgagttttgcatgatttttagtgacactaattttatcatgtagaggaagagggtgttaaaatatgattcactttcgtagtcgggtaccctattacttctctaggtcatccctcctatgtaacatgcacactgttaaggcatgaattaattattttggaagtcaacttaccaaataaaccagtgctaccattttctagtctccatggatcagtttgagagccatgaaaaggattaaaatgatccttacaatatacagatagtcttctagtaagtcatgacacactgtaattaagttgtaactgttagtctctctgcttgttcctttcctatcttgaaatgaatatgttcaagatcaaatatgaacaagcatttactcagtggaagatgaaatgggtatgatatgaatagattaatgacatcacatgtgccttctttgaagaaattaattatccaaatgatgttagtgacgtgaagcctcctgggggcacttctcattctactttcagtaatgagctgtatcctgtcaacttactcagcaaaattcacaggaatgcatgtttctctttcatgggacacttctctgggacttaatgattccacactctttctctttttctactacctttctggattttcttctctgtctcctttgctggctgatatttgttttactagcctttccacatgagagttttttaatactatgtcctagacttcttcctcatctcatgttatattcttatcaaagataatctcatgtatgctcttgacttcaaccagcatgtatgagtggatagcgtcaaaatttctatctccagtctctccataaactccttgtagtcactaacagttggagattgccacctgactgtctcagggacacttcaaactcaacctttatgtttcaattatctattgtcgtgtgaatattatagctaaaacaatgaagatttattatattttaaaattctctgcactgactgggtggtttttaatgctccacttggtgtgggctgtagagttactcgtgcatcagatggaggctggactagttggaacctctaagatgtcccctctttccacatgatgtctcttccatcagggcctcttcatatggcctctttctttaacaagttagcctggactttttaatagcattacagctggatgtcaagattgcaaaagtagaagcttccaggcctcttaaggccttgtcccagaagtggcacagatcagggaagcccattgctttagccaagtgcatgtacctatgaaaatcttaagttttagagataaagtaggtattaccatcatagaaggggtttcaaaaaaaaaaaggaaggaaggaaggatgggagaaagaaaggaagaggaaagggagaaagaaaggaagaggaaaggaagaaagaaaggaggaaaagtaggaaagatggaaaaagaaaagaaaataatctcaaatcagcttcttaaaataagaggaggaggccgggcgcggtggcttatgcctgtaatcccagcattttgggaggccaaggtgggcggatcacgaggtcaggagatcgagaccatcctggctaacacggtgaaaccccgtctctactaaaaatacaaaaaattagccgggcgtggtggcgggcgcctgtagtctcagctactcgggaggctgaggcaggagaatggtgtgaacctgggaggcggagcttgcagtgagccgagatctcaccactgcactccagcctgggcgacagagcgagactccgtctcaaaaaaataaaataaaataaaataagaggaggaacaaatattcagcaatcagcgtcattgacactgacacttgatcagtgtctgaagtgagagcagctgttaggaaatcctacttctatctatcaagaagggtttatttaagaaaatagatgacatacacgctataattatcaatatagtttcttccatgggctaccaagtccaaagtattattgcttttgcataatttatgctgataaccttggaatcatggtttggatggtttaaacctctctctccataccaattgaatcattcatcaaatcatatggaatctccctatgtgtaacctcccgtcaagtcctccattttaatttctgtcaccactactctgctgtattttcctttcgcctcaaatttgaggtattataaaaatcttataatggcctatcccggatctaagctatcttacacattaattacacagattccccattgcttatgtaatacaggccaaacatcttagcctggcattgagtgttctctataaatcgttgctttaactttatttctagctcccttatacacaaacttccctataaggccaactggatgagtttcctgtatttaattggtcaagctcttctccacctgaattgttcttccctcatactaattttcccaaatcctgccttctttgtgtgtcttggctcaagtaccatcacatatctttctggaccaccctagccttcaatgatcatcagtcatctatgttcctcttaaaatcagagccaattggcttttagtgtaaaccagtttactgtttcttaaggtttcacgagtcttaaattaggtaacaaagtcttctggaatgcatcaatataattagtcaaaaataaatgttcaatgtatttgttttctttacttttgaggaaaaaagaaattaacagtctcggattatgtatctcctttatacaaagctgctgtctgccaccaaacttattgggaatgaaatgaacagcataagaatctgcttttagaaccagagacagggcagatctagggatccaggtgtcaagaacctcccagtattttcaggtattgaccatcaggatgaattaaatcttaccatttttttttatttttctgatacattttgttcataaattaatttgaagagagagtgattggcagagcttcaaccacacacactttctacttgaagtatgagggggagtgggtctgatgaaaacttgaatgacttcctatcaagactagtgagagagaggtaattctccaaaacagactagtgaagcagttatcagaaaagaaggaagcaaatgttaggcaagcatgtaattctttctttatattaaatcatatgacttacctgtgtttaatatattcagagcctgacaatgagagagaataacttagaaagcaagggagattagttccagtagaaagactaatatttattttgttgagatggtaggaagtgggagtagaggaacaattcaaaagctgttcttgactcgcttttaaactcttcatggtggccagaattgctttcaaaaatactatatttcccgtagacagcatattaatttgcatttcaagcattttgataactgttaaattatttttgtcttgaatacactattttatagtgttttataatgctagttgagctctctggaatttctaagaaaagttccagaaattaaatctcctgggtaatgtgtgaataacagaaaaggatccaatgtattctcaccaaaagataactgtccctaatgttaaaaagcaggggaagatgtcatcattttattgttaacctgacggtgaaactggagaattccctgaactccttgcaggtcttgtgacaggggtgtgactcgtttgttagtttgcgcaattgctgctgcacaaaccccttacgggatggggagcacacagatgggcaggtgcaggagccggggcaagcacttttgggctcctgccccacagtggcgtctagggttgtgttacaattaatgctcttttagcagttgccatctgcacatggctaagtgttgaggactaagctctgattttttatcttgcccaaattcctacctaaggggcctagggagtcatgccctacaaaccatgaattctcatcagatgggttttatttgaccctatatattgtgacttacttttctatctgactctggcataacattataagacaaggaaaaaatatttaaccccaaaatatatttccttgccataccttgaaattgccctgcaaagtctcttgtgggaaaaatccacattctatagagaatccctttccccctttgttttccttcctttccttcctgatccaggagataatcaactaagagccaggtacccttttaggtccaataagaaacattttacaacctgctctctccctctgaagtcttctgtctgagagcttcctctgcacagtaaaacttggtttccacagtcttatactaacctgaacattcctttccattaatcccaggtcttaggtaaactcaaccaattgtcatttaaacatttaaaccagaaaatgtttaaatttacctgtagcctggaagcccctgctttgagttgtgccacctttctgtaccaaaccaatgtatttcttaaatatatttgattgatgtctcatgccttcctaaaatatataaagccaagctgtaccctgaccaccttgggcacatgttctcaggacttcctgagggctgtgtcatgcgccatggtcactcttatttggctcagaataaatctctaaaaatattttagagttttactcttttctcaacagtgttaaactggctcagtggagagtcatagtgacagccttttgcaccctgccctcttggtacctgggtccttgtctggtgtccaggaagaatcaggtcagacatggacttgaaggatgttgaatgcagggattttattgagtgatggaggtggctctcagtgggatggatggggagctcgaaagggtatggactgggaagatgatcatcccctggagttcagctgtccttgcctgatctcctcttggaccgtccccggcctaactcctattgacattcagacactccttctcttttcttctctgctataccactctgctgctctcctgctcttctgctcatctgtccatggagcctagggtttggggtttatatgtgtacaggataggggggcatagtaggacaaaaggtaacatttggatgcaaaaacaggaatgcctgttcccatttagggctgcaggtttccaggcttgacatgaggcctttgctaaagaaccaccctcttctacccagtatttccctgcctcctgtccgtatcaattctatttaattttgtaatagagcaatgggtaatatttttgagtcaatggaccctttagtaatattttttaagtcaatggaccctttagagttaccgatgacagccccagtattctctccccaaaacatacatttgcaaaatgacacacaattttgcatacaagttcagaggatctacatgtttctgaagcccatctatggatgccagatttaaactcattttattaaaaaaaaaaaaggatattagaactacaatgaaagagcacaggagaaaggataactgtctttcatgggaatgtgcacttttcaattttgctgtattttcctaaattatctctcagctaatacctgacttcatcctttgttatatggcagcaaatctcactaaaatggaactagtacaaggatcctagactttatcactcctcctcccacccatctcccttctgtagtatgtgttaaataagaaagtttttagtgtgtttctgagacttgttcctgatttgatttcacacttcaacagtagtgatccttaattattacttaggaattactttatgatttggtaatatttaaggacttaagctacaggttacttttttaatccttaggtgacatgctacctaacactttctctctgcttattttataattctaatttgagttattagctcttaattactcaataattattcactgaaccctctgtatgtgccagaaactgtcctaggtactgagaataaacaaatgagtaaacacataagtttcctgccctctgggaatgcacattcttaatttactaactgttaaattcaccacatacttttgttaatttgtctgttttagaagtctggctaacttgtttaaaatttattgtactcattctttctgaagtggctcttctacatcagcactatcaaataaaaatataatgacagcccaaagatgtgattttaaatattctagtagtcacattaaaaatcacgtactaagaaacaggtgaaattaattttaatagtatatttagttaacccagtatttacaaaatattgttatttcaacatgtaatcaatgtaaaaatttattgatgagatattttgtcttttttatactaagtctttaaattcgggtcacatttcaagtgttcaacagctacatgtagctactgattaactattggctagatcaggccaaaatgttcaaccctagccacttgctcttcctccgagagcttcaatctctcagcatttcttatgcagagctacttagctccttctcagatcctgtctctaaaatacaataacaattcgatccctcctcaagctccttaatgtcttaattcataaagagactcttgccatgaactatttgcctaggagggcaatgaaaggttataaattcaacattgacaacaaaaacagtttgctataaatgatagataaatgataggactgaaagggataacgtgcttgggtcagcgaaacttgggtgtggtaggacaaatgggagaagctgggtttttttcgtgtgtgtgtgtgtgtgtgtgtgtgtgtgtgtgtgtgtgtgtgtgtttcttttttttttttttttttttgagacagagtctcgctctgttgcccaggctggagtgcagtggcgcaatctcggctcactgcaagctccacctcctgggttcgcaccattctcctgcctcagcctcccgagtagctgggactacaggcgcctgccaccacgcccggctaattttttgtatttttagtagagacagggtttcaccatgttagccaggatggtcttgatctcctgacctcgtgatctgcccacctcggcctcccaaagtcctggattacaggcgtgagccaccgtgcctggcagagaagctggtttttaaaatgctatgttcttatattatggaacacttacttgtcctctggtatactcaaaattatgaccaaggatcttctgagagatttaactcatctggagtaattacatccgctgacaaatgcatatatagtgccaatgtcatacttgccttgttttctcaaccttccaattcctaggcaaattgtcagattctcaaggtaatagctgtcccacatgagactctggtatgtgcagatctttattgtgacagttccttttggggcttctgtgacccaatgaagtgaaaataaagatgaaatatttcaagattttgaaaagtagtttctattaaaagttattcgtctaaaatgatttctgttttatagtatttagtgcataaagactggaataaaatgctgtaaactaactcatttaatatccttctgtgaattcgaatgagaaagacaaattgactggattaaaaggaaacattgagtaacattctgtctttagttaaaaaaagtccaacaccagcaagacttaccttcttttacttacacatatagttaatattagtgtacggtaaagcttctccacacatctaggaaagaaacaggaaaatgcattatttcctttgaaagctgcctaaacacaaatctgttattcttctgagaaagagtgatgcctatacagtaaaaaagttattctaaggaaggaaaaaacaaaatacagtatgtctgttgtttaagccaatagatgtctttaaggaaacattttcttaagaatattctttacaatagtgaggctgaggcaggagaatggcatgaacccgggagacggagcttgcagtgagcggagatcgcgacactgcactccatccagcctgagcaacagagcgagactccgtctcaaaaaaaaaaaaaaaatctttacaataatataattttcaaagttctcagaattctaaaatcttgctggatgatacatagatgtatagacatgtacccaaaggtgctctactaaattaatcactacctccaacaacctaaagattacagtttattgtttaaatgaaggatgcaaaatataggtgtatatacaaaaagcccctgttttatagctcttctaaatgtgagtatcacacacgggaaaaatcgaaaaacaaatgtaagtctaaatctccttacagagaagaaaatgtagtgtggcctggcctaatattacgacttttccaaggagttactatatatggtttaacagaagattatttccatcaaaaatatccattgcttgtgaatcttaagaacaggaagtttttcaatccaaattaagctgaagaaaaacaaaggagaggaggggaggggaggggaggcgaggagaggggacgggagaaaaaagttctctgctagcttcctaagcagttcagctctgagggtatgctttgcagcagcaacagcacacctgcccagaccactgcagcaaaggctttcaacaattcttgggaaactaagtgagggcaaagatacatggtagttccaggacatcccacagtaggatttgtctcacggaggtaactcagggaggaagaagtgagcagttcactctgccttaacagtttacatatatgaactactaaacttaaaaaaaaaagtttttcaatccaaattaagctgaagaaaaacacacctaaatagtatatacccaaagtattatgtggcataatattttaatcataaaaataatatgtatctatttttgtttctcctttatagtcaaagcactgtagaagtacagaaaggattgttctgagagagttcttgaagtagaggttgggggaggcagcctaggattcttatctgtaaaatgtgtggttccaacatcttatgcctacacttgatctcactgctagattgtgggcaaggtgctttgaagggatgggcattaaagggaccctccaataagtgaggcttaatggagtttgcagagatcatcatattctagaaatcacacatgccgtttttgtaggaacagagacagggtcccaaaagtatcactggatactggagcagaaaatgagaaaactcatcttgtgatgccaagagaagcaaagtcttcaagattctttctggtttatttctatagtatagctatcaatgttagtggcataatgtagtatttcatgttcattctgggtcactttagactcatcgtagcactgatttggaggaaaacagtatgaatgggcacaactggatgatccaggagggattcttttttttttttattatattatactttaagttttagggtacatgtgcgcaatgtgtaggttagttacatatgtatacatgtgccgtgttcgtgtgctgcacccattaactcgtcatttaacgttaggtatatctcctaatgccatccctcccccctccccctaccccacaacaggcctcggtgtgtgatgttccccttcccgtgtccatgtgttctcattgttcaattcccacctatgagtgagaacatgcggtgtttggttttttgtccttgtagtagtttgctgagaatgatggtttccagcttcatccatgtccctaccaggagggattctttagggaagccaggcaagtgggagtggtcatgtaggaggaaagtctatcccatagtacctgagaggtgtgcactaaacttgccacaggagacgatgctgactggggaactctattgagggtggcaaagcccacagtttaggtggaaaagcacttgaaaggggaatggattcattgcttttgtcatttttacctagactgttataagggcttctttttttatatctctattatcagtttttttcttttggaagtctgtcttttaagtttactcattaattgtataaccatttattgatcatttatacagcaggcactacgctgtattctcctaatacaacactaagaacaagtccctgtcctcatggagcctccagtccaagcaaccccaatgatgtgagagaactgccacaggatatataggagcatgtagcgctgactcactgtctgattatcatcactcttttaatgatgccaagatcgattagtgggttcaactggttacagcctcatccctgaattgtaaaattccctattagcctaaaggtgcccaggatttaattgttctggataatgatttcttaagaattctgaagaaggtttattcagagtttcctttcattcattgatagagctagtatttattcagcttattctaaacactaggcattatgttgttgctagagatacaaaactaagtgagccaagatgaatatagaggaaacataagtgagtaacttcagtgcaatatgagaaatgtgcagggctagatgcagagtcctctgggaacagaaaggaagcacagtccttaatgacagcaatctctggtgagtcaatgaatctctcgcagtttatttaggtcaggagctattaactgtcatgcattagtgagcagccaacagtgggactgggcagtctgagccctgtattgaaaagccggcaacgaaagaaacttcactagaggcttgatgaaccagttcttaaactaaagctcatgtgtctgcaatggacaatcctgcctcaacctcgtgaaaaacagaccaggattctctatggttatgcactactgcatttgtttctttagcgttcctagagttgttttcatcagttatttaagtaagaatgcccgaggtagtccacttcactccctagatccctattaatacatttcagttgaaaatctgttgtcccttgcctattttactgcttccaacattgagatttgatggaaagaaatcagctctcaaataagaatggtgtcacctgctgctggttcagcggcactgcaaactacagattatgcaaattacataaagatccaatctttctacccggagcctaggaagaggccttcttttcccactgggtcttatattctagagtcagccatttacttaatttcccaaagaatactgcaagagaatactgtgaaagcattatctaaaatacaacaaaagaattctgtaaatgttatctaaaatataataataagaaaaaccaaaagaattcataactaggctgaaagtattctcttaggattttaatattagatacaaaattgctcattagcctttaggttttcttccctctcccaagcactcaacaattgatttccttgcatactaggtaagtgtcctatgacacataatactttcaaatatttatatcttttgtaagataatatttttcatgtaatcctagatggattagtttcctatgactgctttaaaaattgccacaaacttagtgactgcaagccacacacgtttaatttttttcatgtctggaagtcagcagtccgaaatcacttttactggtctaaaatcaggtgtcaacagggctgtgctccctccggaggatctaggggaaaatcattttccttgccttttccagcttctagaggctgcattttcttagcctcgtcttccctcttgttgcagtcgtcccaatgacttttgtctctgtagtcaagtctctctttgcctccgtcttaggaggagatgtgtgattaaattttgcccacctatataatccaggataatcttcccatctcagaatccttaacctagtcatgtctaaaaagtcccttttaccttataaggcaacacaaattccagggattaggatctggatatctttggggaccaggaatcagcctatcacactaggtaatgaagtcattatcttaatctgaagtatctagatcctcatataatctaactcctttagtctatttgagttgttttaattttttctcaagtacattagctgccaaatttaaaattattgcagatggaactcttgtaggtctataatgtacagcttgctgagccacagtaaacagtatcatttttagctttctatcaatgtttgacatacaaaatggtcaactgcagaatgtttcagtgacttctctagaaccctattgaatatttaaaatgtcatacatcatgttgttgagtggtcttcgtggaaaaaatcatgtttttaagaaatctattccccttcgatttagtgcttgggtttgtatattccgatgaactgatatgcaactagagctatataactaatcctgatttttaaaaatttgtcttggcttccaggaagtacagactaaatttagtatataattacagtaactattcttagctagtatttcttgtataattatatattcttcaccccaaccccaataatcatttctcctactccttactaggatgcttttgataatttatcttcatttaaacaagcttattgcatgggttttctttattataatctatctcaaaatcttttttggaagcagatatgaaataaagcaaacaaacaaataaacttggaagatatatagaccctatgaattatagcccatctgcatcttttttgagtgccaaagacataagttcagctatgaatacattctgttactacaaaagcactttaaaattgtgtttctgtgcattatatagctccttagaatagacagatatatttagaggggaaggatatgctaatcaatgccactagagccagtagttttcttgatttcattcaataccttccagttttaataatttgcaactgatatcaatgatcataataaaattttaaattaaaatgtgtgagctgtttttttgttaatacttcatgcattgaagagacataaacaaagttttgaaatcataactacattttctgaaaggcttccacaggaaaaaaggcttcatattgatattattttgtacaattttttggacaattttccctccttcacattcagtttattagaactgaacataatatctgacataagtgattcatatatgggctaaataattcatgtatatcagaggccaagcctattggatatggtggaagttttgaaaccctatctttgtggaacaacaaaaaattaaatgtaagggtcaaaatgtgagggctcctttctcatttgttctgtgaatccagtttctagtggttacttatcatatcaaaatttctcgtggcgttttcagagctacacctccaataaacctaaatgatgactagctttaagacaatagtctatacagttacgtactgcttaaccacagggatgtgttctgaagaatgcgtcgttcagcaatttcattcttgtgtgaacatcctagagtgtacttacacaaacctatatgttttagcctactgaatatctaggctatatagtatagcctattgcttttaggctataaacctgcacggcatgttactgtactgaatactgtaggcagatgtaatacaatgatatttgtgtatctaaacatagaaaaggtacagtcatatttaattttaaatgtattaaagtaacccatttcctcttcccacttgactagctatttcctttttgagaagtagacattatgtttaaaaatgttttaaaatactgcaatattgttgatattattagtttactaaataagacaataaagacagaactcagacaaataaaatgcagcagctgtcagttgatgggggccgccattacttgtagaagaaaccttcagtaagcgttgaactagtggcctgggatagttgattttaagaagacaaataaaaatgcctggagagaaaaaatattttactcattccatatgagtagaaaatatcctttgaaatattatcagtgacttacttacgtcagtctttcttaacttgggttgtctgttaaatactttaatatggcttttgccatagctgggtcattgctataagttaacaaagggctgttttctatatcgctggaactctcctttgttagaaccttctttaaatagaaagaattctcttgcagtacgtggtaattgccatagattattgaaatgaaaaatggctatgattactcctaacaacttgagatgttctgcttacagtggatgttaagaacatatcttagtaatttaaaatttttcttaataggcataagcaagtttttattctttaaatgtacttcaagtggttacaactaataaagattggtatataacaatagagaagaggttccaaagtaaaaatccacattaaaattaaatttaggttacattattgcttagcagtttaaaacaatatgttccatatatacatacatgtgtatatatttatatgcatacaaaacatacatgaacatgtataagtatatggatgcagatgagtatatgtacacatatatatagaataaatgcataaaggtatataaatatatggctgcatttgtgtaattggatatatatgatacatattttatatctgtatgtcatgagtatttttctcattttttcctctttgagaataagtctaggtctatactatcaataaaatattgaaaattaaattaattacccaagtgaaaaaagaaagttctcagagttatgctgttcatacttatgggagaagtgtagattttttctgatttgcttatcttttcctttatttaaatgtaatttttactgatatgtaatagatgtacatttttaagggtacacatgacaatttaatatattcatataatttgtaaagataaaattagcataattggaatatctgtcaccttaaatatttatattttctttatgctagaaatacatgaaatattctcttctagcaattttgaaatatacagtagattattgtaaactgtagtcaccctactgatctatcaaatactaggtcttatttttttctatcaaactctatatttggacccattaaccaatctctctttatctccttctccttcctacgctgtggtaacaaccaatatgctatcttcttgagatccacatttttagctcccacatatgggtgagaacattcaatatttgtctttctgtgctggcttatttcacttaacatattgaccttcagttccatccatgttgctgcaaaagacggatttcattttttatgtctgaataatattccagtgatctgccagaactgaattttaaatggggttttaggcctggattgactttagataagcttataattatagctctctacttgtggtaatcaatagcataggcctgaatgtgttattgtattaaatatttctcattcattgacatcacaattgtggatcaaatctctgtggtttggatatttgacttctgacaattcattgttttgtctgactttaagttgtgtttaagtgattattttcttggtttgctctcattccaaattactggggaatttaactgatgaatgaaccagacatatatttaatatacatctgctgtgtgcaatatattgtactggagggatgggtaggtatagacatgtaagacataatctcttacttcaaccagaatatggtttcactgggttcctaagatcaatatgcataactgcagggacctcgtgctacattggatttgaatctggggctccagttccagtcccattccttcatggccatgtcaccttagcatgtcacttcacctatggcctcttaacagttagataacccaagaccactactatttctgaagagtatttttttaattacaagccaaatcagtatcaaatattatatttataatggttctgtgtaatttactaactcatttaccataaaatgacatatattgtactattagaagaaaattgtgggatttattaaaaacatcaatttattgtaccacacacttgatatgggcttataattgaacacaaatatatagaatatgaatatctttttttagttctgtcattagctctttgagtgagtatataagcatattcataaatgatattgtatctatatttatctatgttttaagaattcttgcagccgggcgcggtggctcacgcctgtaatcccagcgctttgggaggccgaggcgggcggatcacgaggtcaggagatcgagaccatcctggctaacatggcgaaaccctgtctccactaaaaaaaaaaaaaaaaaatgcaaaaattagcctggcctggtggcgggcacctgtagtcccagctactcgggaggctgaggcaggagaatggcatgaacccgggagatggagcttgccagcgagccgagatgcgccactgcactccagcctgggcgacagactgagactccgtctcaaaaaaaaaaaaagaaagaaagaaagaaagaattcttgcatctcaggcatggccaagaagcatattgcccttcatcctttctcaaataccatagaattggctctgacctcacctcagtttacttatgtttcttaagctataagatgatttgtaagatcccattcacacttagtatcctatggttataaagacattctcttgatagttatttgacatggtgtacacattggatcaatttctttggtgaaaacagtctcgccatgaccttgatgtgccatttgatgttcttggaaataccgttcctctactgttaacagtaaagtttcaaagaaaatagattcccagattatttcaaactcattaatataggaataatatttttaattcttcaagatgataagattttacacattttgatgccagtaaataattttgtgataaaagcaaacacctggtttgctagaaaatattggcattccgcaagcctaaattcattagagaggaattccacgtgcatcgcctctgagctgcagctcctgtgaactgaaaaaactgctagttaatgtctcagaagttattaggaaatgtaaagtacatacaattgtcagtgcttcaaaaatagagataacatcttagtccttatgtagcccccatagttagctggagcttggacatattaggaagtcaataagaatactgacaaactggcatgtaagtcaggtttgcctgcatcaggtttgaaaattattctattttagaataatcttatttatcctatcgtttctcaactaaattgatgtgtagtccatagatttcttacctttgctttatattcctttagagctgtgatgcaagctaaatcatttttggggaaaataacttcttaaacatttttgttgttgttaatgcttcggatgggcagttattgtctgaacatcatcaaggcacaagcaactgactgtagcatccatatttttttgacagttttcattgcttatgtgttccaagagctgcctacaggatttctttccttatatgagaaatattgtaatgatactcaattatgtataagagcaagattcctgacttgactaaatacaactactttagtattcactatttaaactacgtggctttttaataagtaaatcaacattaaaaagtgaataggagattgcaatttagttttcttagaaaagcttgactatttttattatctgatattcatgtcacatgtaatcacacatttgatttttaagtaatttttattggcttggcatggtggctcatgcctgtaatcccagcactttgggaggccaaggcaggtggatcacctgagcccaggagttcgagaccagcctgggcaacgtgggggaaaccctgttttttacaaaaaatacaaaaaaaaaaaaaattagctgggcttggttgctacatgcctgtagtcccagctgctagggaggttgaggtaggaggattgcttgagcctgggaggtcaaggttgcaatgagccaagattgcccccactgcactccagcctgggcagcagagtaagaccctgtctcaaaaaaatattattataattgaggtgaattaattgacatctatatttatgaaataactatgaataatacaagatggccacttgaaggtatgccctaagacaggggtctgcaaacttttcctgaagggaccagatagtacatattttaggcttgtgggatacacaaatttagtgctactactatctactatcttctgcctttgtagcacaaaagcagtgatagtcaatactgaatgcaaaaatatgtgcgtggctttgttccaataaaactttctttacaataaataaggatgggccatagtttgttgacccctgccctaataaattcattgacttggcctaattttaagaatcatataattttaataaaagtctgttaagtttctttatataatttgtaacatcagtaatatttttaagaaaaatgtaagtcatctgaaagtataacctaagtaaattttatttgatgatttgaatggaaatacatgatgattttttcttatatttgatttaaatatattgatctaaacctacctgttcttaccataagcctagctattataaaaattatacaataacttaatttttaaaaattattttccctagaatgtactggactcttggacaaatacctccttattattgaactttgggctaaatgactgcaaaataaatgtttggtcttgatttagctaagtgtcttcaaactacacaattctatatttctgtgagtgtcatatcatttgccggtaggactggtgcccttgtttgttgtgttgttttaaaactctctcattgagaatgtcacttctccaagtgatcatattctttttgaaagtcacttctagtttctatataaaaaatgtcttctaaaatcaataccagtgaaagttaatcagtgatataatgattacaggatgccttatttatcattggaaggctaagatggttatctctgtgatgatccttccatgtgatttgaaaggacagaggggtagctttttctggccatgccacttctaatttgtaaaatgcccccattataactcttatgtaagaaggcagcctgcctttattgccatatcctaaaaagattcgttagtattatgcccaagtgctcagtatttcaccagccctgctcccgtcttaaatttattatagattcgacattgtcataaagggcataattagaaaatcatctcacgtctcatctcattatgtaattgtgcataaggaaacaatcattttaaaatataaagaagaaagatttgggtcatgcagctgcttcctaaatgttatatttttatttccattgcgtctgtttttcctcattgaagtgcagagattactcatattgagatacaactatttttccgcaactgagtcttcaatgcctgctattttattagccccaaataagagatgattggaagtgtatcaatgcaagtggcaagtgagaatcagcaggttcattcttcataaacccttctgtagagcatgctcatgtttctggtaactggcttttctttctgctcctctttttgagtggttacagtggaagcaaccacatttttacaaggtgaccatatctcacccatagagatgaagacagaggtttgctcattacataagctgaattaatataagtccattctcaggattttaaagttggaactagaaaatattcacccactgaaactctgagctcttaagtaaaagtgatgcaaactcacaagctgttggcagaagttgttttctgatatgttgtttttaaaaatagaaatattattctaaaaagagagagaagaaggaagaatgaaacacacacagagagacagagttttgatatgaaaaatcaacgtcttgtttctctacagtgtttggatcagtggttccagttcaccccattactcagctggatctctgcctttgggttgtgtgagatagctgtgtatatgtttaataagctcacttttgctaaacttagttcaaatgggtttccataactttgaactgaaaaactaattgtgaagtttatttcatactctacacagcctttataatatagaatgtaaatataacgcctacgtaactgttctctcacaaagtttgatggtaaattattaaaaggaattaattactcatgagatactccccagagaaaaagaccacaaaaagttcatatgtatgtattaagttatttatttttaataatttttgggtcacttctgtgagccaggcaacagtgataagtaggcaacagtgaataaatacaaaagtgaatgtctagtttgttgggggagagatgtattaaccaaataattacccagattagcagatgattttaaaatgtggcaaatgctgtgaaggaggggtgagggacagtgagccaggtagaagaggctgtacgtgaaggccctatggcaaatgcaaacaaagcatttcggcattgataatcggaagggtttttggttttggttttggttttggttttccagaaagccatttattaattaggttggaaaagcattgtttctgtttcctgttcatcatatttagcttttatgtcagaagagcatttttgtttttgtttcaaatgtgtttcaagtcacctaaaaccctctgtccttaacattattcaagaaagtatgtaatgtacaatgttatttacaccatcgatttgtttaacgaactctctctttgtagtcaatgccaaagaaaatttcgtctcacgtatattcatggtttcctgatggattgaccagtaagttactgaagtcctacttagtgtgatgtgactgtggtggtgttccatcacattattctaagccattctcagccccatctaaccccggtggtattcagcaaaggcatacaagcccagaaccatgggaatgttcatctccatcagaattaataggaaaagacactttagtaactgtctttagtaagatacacttaggggagcagcgtgaagtaactctcttggactagcatccctctgttcttaaactgccaccaatgctactgtaacattgcagtcatattctaataaatggtgtcaagcatagaagagagaaaaattctacttttgtgacttctcctgatttctgagtgctgtatgcatgaactatttacctgtgtacacaaacagctgtacatttagttgccatggcaatgcttatctgttatctttacagggaacaaaatggtactttaaccacagttgactcatcccgtgaggtaaaattgataaagctgcctttcttaactttcagccagaatgcttcagttggcaaaagttggttgtttttgttcttcttaaagaaaggctacttgttgacaaaggcaggtttaacccccattctcaataattgatatagcctcgagcaaagatcaaagtttcctggatatcattgttataatttacacttagtaactggacaggagatattaataggatggccatcagagaaattgtgttttcctgacatgtgtcttcttggattacaggtaagtattggtgaatgcgtgacactgataactgctggtattattgatgagggactatcaatgatctgatgcatagggtgcccttgataagaaatctttattgttcatcagcatgttactgaaaagagtccagccaatgttaggtatgtgaggttaagaattccccagtcactatgcaacttggaaatagaaaggacaagtgattctaggacaaatgtgagaatccatgtatgtatttataggcatgatacccaggcagaattattaatatcctcccttgggctcccatagcactgtgtccatacttccatcatgacacttcacttcaaattaattttctttctatcccgttgggttactagctttttgaagtagatggcgctattatttttattgattatcaagtccgaagaaggaagagctcaatacatgcttgttgaataaagtctgctttgagaaagttatgctcattttgctttaatattctgcaagagatacaaagaaaagaaggaaggaaatctgagagctatcagttgactggatactcgaattggattacttttagggcaatgctcttggttgtgcctagacttgtaataatagctctgatttcaacttatctagaaaagcttaaagaaaatagtccaggactgagaaagctatttttcattttcttaaataattggcacctttgaaaggctccagaaactacagttttggaagcctctaggaataaagatttcttatttcctggacctggcatatagttttagtaaaggaaatgaattattctagatcccaaccaattgtcttcaatcaaataactccctgacagaaatgaggcaaaattttaatcactaatttaacctctgcaataaaattcctaagaaagaattttgtcaaaggcagagaaaaaaatctacagtatcaacactgaatatacaaagtgtactaaatgtttttaaatcaggaagtatgcatctttttatctttggtagtttttttttttaattaacaaaacttcaccatcaagactccactcaaattattgtaggttatcctagaagtttgagaaatacaaatgggataatatagaaaagattataaagtttgtattccatgagattttgcaatttactcttcattgatatagaaacaagtattgaaatctctaagctattcaagatagtaatatgtagtgtatttgggaaagtgaaattacagcacacaagcattatctcagtttaaaaagtaggtgtaggtggtgtgttgcatagcttaatgtttgtcttctgaagaaatgcatttagttcccattctttcttgataacctctatgttatcatatctaattctttgtgataaaatgcactctgttttagtttcatgaaccacagtcaattttgttttcctttgcaaacaaagaacgaaaagatcaaatctctctctgtgctagactgtggatctcttcctagcttgggtggccatcccaaagtcatttttgcatcttcctctcccactggcctgaaagagtcaactggaacccgttcaatgctgtttgtattcatcaacacttaatgtatcaggaggattttccaccttctttcctttaaaatattttattatacctaaatgagtatcttagtctgctcaggctgctataacaaaacaccacaaagtggataacctgtaaacaacagaaacttctttctcactgctctggaagctggaaagtcccagatcagtgtgccagcagattcagtgtctggtgaggatgtgcttcctcatagacagccctccctcacatggtgaagggagaagggatctctctcaagactcttttgtaagggtactaactgcctttatgaggacttcatccctatgacctaaccacctcccgaagactcccatctcctaaaaccagcgactctggagtgaggatttccacatatgaattttggggggacataaacatttagatcatagcaatgactatatagtaaaattctattaattcaggtttattgggagaaaggtggtttgaatttagtgggaaggacttcgttgctgtagatatctaaattcaaatcaccttattaagaattgtcaatacaactatttcactaccagtctcttattagaaatgaaacatttaatactccagagaaaatagtttctccagactttttttttttttttgagacagagtcttgctgtgtcacccaggctggagtgcagtggtgcaatctcggctcactgcaagctccacctcccgggttcacaccattctcctgcctcagcctcctgagtagctgggactacaggcgcccaccaccatgcccagctaattttttgtatttttagtagagacagggtttcaccctgttagccaggatggcctcgatctcctgacctcgtgatccgcccacctcggcctcccaaagcgctgggattacaggcgtgagccaccgcgcccagccctctccagacattatttaaatggataccacttttaaatatttaactgttctatcttttttgacatattaaatttgcattttgacttctaaaaatgtaaaatgtgcatcaaaattatacatttttggtttaaatatttgaatcataaatggccaatattgaaaatatgttttttcaatatattgaacatttattcaatatattcctgttctaagaatctgtatagtgatgggttaatacaagtaaatggaagcattagattgtgatctttaactaaacaggcactttttgtcattgtaattgccttgggactaatgtatgtgactgttacatttgtttccaacatgattttatttatttattatttgtatttattttttttccagctcttggttgtgcttagacttgtaataataactctgatttcaccttatctagaaaagtttcaccttatctatctagtttcactctgtcacccagactggagtgcagtggcacaattaggattcactgcggcctcaacctccatgggctcaggtgagcctcccatctcagcctccttggtagctgggactacatacgtgtgccaccatgcccagctatttttttctattttgtaattttttgtagacacagggttttgccatgttgcccaggctgggctcgaactcctgggttcgggcattctgcctgcctcggcccccacaaagttctgggattacaggcatgacccaccatacctggcctcaacatgattttatacctatttgaaaagacatgctatatgtcatagatattcagttaaaataaattagccgggcatggtgttgggcacctgtagtcccacctactcggaggctgaggcaggagaatcgcctgaacccgggaggcggagcttgcagtgagccaagattgtgccactgcactccagcctgggtgacacagcaagactctgtctcaaataataataataataaaatagttcagttgattacagctaattgaatcacacacacaaccacaaaactctattcaagtaatattcagtacaaaactaatggatacaaaaaggagaagatttagtattaagggtcagatagcactgccttgatctttccgagaaattataattattggcaactgaacttctaggtgttaattagtgtgacagaaaaatcaagccctttctcaccttactgtgactaattatatagttatatgagttttaatctcttcccattcaatctcaaaatggtgcctcaaacatgtatttcctcagaagcttaaggataaggcagatatagttttggttgtaacttttttttttttttgagacagagtctcactctgttgcccaggctggagtgcagtggcatgatctctgctcactgcaagctgcgcctcctgggttcacgccattctcctgcctcagcctcctgagtagctgggactacaggcgcccgccaccacaccctgctaatttttttgtattttcagtagagacggggtttcactgtgttagccaggatggtctcgatctcctgaccccgtgatccgcccacctcggcctcccaaagtgctgggattacaggcatgagccaccgcgtccggcctgtaactttcaataaactatttatttcactgaattctaggcttctgagggtgtatactgatatgtgggcagtggaaaaatacatataaaaattaaaatgttttatgttcataagatcataagaatgttattactctggtgatactgaagtccaatgaatctgaaatagcattcttaatcttatgctgacggtgtcttgttagctttgtcatctgtgtaggcaaggaggaacctcacggtcagtcacttcagcaaatctgagctttacgtgggtgatagtttcaggagtagaaaggaatcatgtcatttttttcactcttttccaaacctttatggtgatgtaatattgaacgaatttacagacactaatgattttatgtctgtcaatcctatctcacaaatatttgtctgctacatgatacccattcttaatgataacaccagcaagatacctaaccttcagaaatactctcaagctttgctactgggattgtatattagtaatatcatttttaaaaactgtcagtatctaataaggttgaacatatataattcatccttttctttcctaggtatatttccaacagaaacatatacaatatacacgagtatgttcatagtagcactattggtaataggccaaaatttttaactacctaaaggtccatcaacagtagaataaattgtgatacattcacataatggaataacttacagcaataaaaataaatgagttccgatttcacacaacaatatgagtgactctcacaaacataatattatgtgaaagaagccagaaaaaaagagtatataatatatgatttcatttacctaaatttccaaaacagtaaaattaatcaatattattagaaatcagaatagtacttacctttgctgagaagaggtggaatggaaacagaagagaagagcttctggcatgttgatctaatgttctatttctgaatctggttggtagttatgtgtgtatgttcagtttgtgacaatttatcgatatatatatacacacacacacacacacacacacacacacacacatatatatgatagattgaactcaaatatttaatttgtgcttatattagtttcccagggctgctgtaacaaattaccacaagctgggtggcttgaaacaacagaaatttattccctcacagtgctgatggccagaagtctgaaataaaagttttatcagggttgtttaattctggaggcttgtggagagaatctgttctatgcctgtattcctagcgtctagtgtctgtcagcaatctttgttattcattggcttatagatgtatcactccaatctttgccaccttttccacatgatcttccttcctgtgttctcttctcttctgtctctgataaggccactggccactggttttacccagcacccatctgggtaattgagatttttaacttaattatatccacaagggcgcttttttccaaataaggtcacattcacaggttcctgggtgacatgccattttgggggctactaattaatccactacagtgttccttccccaaaccccacagaaatcatgatagcggaaatataaaaatattgtacagacaagaagatttaagaagggttaaatacagatgagataggttcaagattttgaaagatcgtgagtcgatattacttgattcagcaaaatgcaggaattaaagttagttgccagtgcgaagcaactcaggcagtctcaggatctggagatacgaggtacttctggattcaggggtaaaggctggggcttaacatagtaaatttggttaacaatccacttaagaaagttaaagtcttagatcaatgtccccactctgggcatcaagtgaatataaccatcccatattgaggcagaaagaaaagataattacagctttataaaaaaaataaaacagagaggagtcaaagtggctctggactagtggacatgaagaattgctgagggagggtgagttactgtactcaaacaaggaagtaaagaagcagcctataattttaatggtgtagactccctcctaccacccctctatgcttatctaccaggaccctggcagttgggctcataccctagtcacgagattcttctcagcagaaaacactccaacccaagagaaaagacctgcctttggtgtgggtgtggtgatggtggtggtggcagggggtgtctccaaatgaaaatatcaaaacttccctgatctcataccctggagttcaattagcaatcaccatccttctgcacacaaagcttccattcagcttttcattacctcacttataaatagcagtggtcagccaagagttacaagatatttgaggaaagcttgcattgtaaaagacagagattttttaaaaatgagtgtacagataaaacgaactattagaaaataaaggctattcagggagatgaaaacttcaaaaaattacaatgaatattctcaaatacattaaagaagcactttataacatccagaatgctataaaaatgaacattgagggaactaataagaactcttgagagaataaaatattatggcataaatcccccagaaggtagaataaattatcaaagagatgacaagatttttttcaaaggaggattgatacaggaggtctggttaataggaattttgaatacctgaaaaaaatgagagaaatagagaagggggaaattatcaaataagtgatgcaagaaaaatttatttaattaataagcctggttttccatgtttaaagggttcaacaggtgaccagcaaaaggaaattaaggtaactgacatcaaggcatagtggccagaaatgttaggacaccaagggtaaagattctaaaaacttttccaaaggtgttagaggaaggtgatatacaatatgacacaaatcagagtaccactgacttctcaggagcaacacttgaagcaaaaatcaataaagtaatgtcttcaaagtttcgagagacaattactaattgcttttcacttataattctaaatctgaaagatcagatagatagaaattttcaggccaacaagttctcaaaaaacataactacaatgtatcatttcacaagaaagttctggaggttatatgttaccaaaatgagtgaataaactggcaaagaagagttgagaaccagacagcagggaacacattgataaaaaaatatattaattaaagagaaaacctcttgagagaaatgtgtggattataagcaacagagaaaacagaaacagaaatatatagaagaaaatcattttcagtgaattcaatcattagtaaatttagatgttaaatatgtaaatggatgcttccggaaaaaaaaaaaaacccaaaaactaaagatctctaaacaacttgctatatgtttctgccttttctatttctttgattgatatgccctttctccatcctcattgtaggtacgctagtcattcaaagactcatcttaaaatgtaatcccttcaaaaatataggaagatatccatatgtccttggttaaggagagctttcttagcatagacccaaaatacagcaataaaaatagaaattaaaatctgaccacattataatgttagtcttataacaaagtctaaagcaaaaaaaaaccataaacatgtttaagaggtaaatgacagagtgaaaaattaaatttccagtggataatatgacaaaaaatggtatgtaaaatctgtaaagttttctaagtcaacaggaaagatatcaaacgcaataaaataaactcgtgcaaaaaatggtcaaagttatagtattataattcacggaagataaaatccaattatgagaggatgttcaacttctacttttatcagtaaacaacaacttaaaacaatagtgagttcctatttttcgcccatcagattgacttttaaaatctgtttatcacgtgttagggaacatataaggaacgttttaatctcagatattgccagtaagagtatacatttgcacaaccatttttggaactatttagcaacagctcataaaattgaaaatctggatgccttattacaacattaatcatataatttattattcattctaggacacctttgaacatgaaagagagcactattaaaatgtatgccagaacaaaggcataaactggagttatcccaggccaatctcctatactgtcaccctctgtatgatccacttagtgtatagaacctagttagcttcttgtccatgtgtactatgtgtatgtaaagctactctttgtcacatagtttataacagcaaaaaaaattaggaacaggctgggcactgtggctcacgcctgtaatcccagcactttgggaggccgaggtgggtggatcacctgaggtcaggagttcgagaccagcctggccaacatggagaaaccccgtctctactaaaaatacaaaattagccggtggtacaaatacaaaatacaggtggcacatgcctgtaatacagctactcgggaggctgaggcaggagaatcgcttgaacccaggaggcagaggttgcggtgagctgagatggagccattgcacttcagcctgggcaacaagagggaaactccgtctcaaaaaaaaaaaaaaaaatttaggaacagtctgtcaaaaggaaactcaatagataaaatagataacacagaatagtaaataataaggaaaacagatgaactagatttctctgtatatcagtaccaatagacatccagtacacacacttaggtataaatagaaaattcaaaattccagaatattcattaacatatataacattatatatctcttatgttatatatataacatatatatatatatatatacacatcaaacattacatatgatgttaattgatgtgagtgcaagtataaaaatggaatggaagaatatacctccaatttataacagtggttgtctctggcaatttagaaaagatctggatgtggtttaaggagaattaagctatattaataacgtttaatttctttaaaaataatctgaagcaaatatgacagattttaaagttgatatatatgaattggagaaggtatatatgtatgttttaaatttttttgtatagtgattttttttctcaaagtaaaaacaaaataaatcctctttcacaaagctttccttgatctctttaagccaaacatctctgtgtgtcctctgtatgcctctaacactatagctctcataagaattaagctttctgcctatggagtttatctctcccattacattggaaaagcttaattgaaaaagcagtatctcatccccttttgtatctctccacagcacctgatcagatatctgttgcatagtaaatacccaataagattttattaaacacaatagcaaaggaatagaatggtgtacatagaaacacttgctctttttaggcaactctagaaaaatgttaaatttttcattttttcatgcttttcttcacacagcggacctatgtttgttttacacctatgttatgtttctattgacatacttttagaatgaatacttagaaaatatagtgctttgtaataatatacatggtcctagcatattggagatacaccagacaatctaattgctgaaccaaatgtaggctagcttggtgatcaaagggaattgttttgatttctcctgtctcatatatatctgttatttgtcctaatgctgagctctagactgctgaatgaacggtgacatttttcttggttactccattgtgccacctcacctccatttgtcactctagtaatgttaacatctgctgtcaacaccaattaacttttttttttttttttttttgagatggagtttcactccatcgcgtaggctggagtgcagtggcacaatctcggctcactgcaacccccgcctcccgggttcaagcgattctcctgcctcagcaattaacatttagtaaacaccttctgggtccatagtagaatgtcagttacttgctgctcatttaaagactagttgttaagcaaaacttgaatacagtatggcatttgctttgagtttattttttttaatttcaagtttcatggcttttgtttttccattctcataaataaaacatatgcttttattccttgacagttatcagagtttgttcagttgaacaatgcccaacttgcaaatgaatacttttgcaaatacatatggtggatatacaaatacatatgtgaattcatttggctctaatgtgaacttattgaatgtgctatgtcgagttatcttttatcaaaagaactgttagtaactgaggacatcaaaaaattatgcttgctcatacatacataaatgctatatttaggttttaatgctagcttttaaaatgtcttctttgcccgctacttacactaacaggatttccttgttcttgaaagtgaaatatatttttaagaacaggttttaaggccaggcgcggtggctcacgcctgtaatcccagcactttgggaggctgagacgggtagatcacaaggtcaggagatcgagaccatcctggctaacagggtgaaaccccgtctctactaaaaatacgaaacattagctgggcgtggtggtgggcgcctgtagtcccagctactcggtaggctgaggcaggagaatggcgtgaacccaggaggcggagcttgcagtgagccgagatcgggccattgcactccagcatgggcgacaaagcgagactccgtctcaaaaaaaaaaaaaaaacaggttttaaaaaaatttttagatttgttttttttgtttgtttgtttccagttttctctgctgtttcagacttaggactagacatgcctggctctaattgtcctcttagattgttatccagctttcctttgagacaatattttgcacaaagtgtgttctcttagctggttgattccagtgatggctggaatctatgcatagtgtggtgtttcacagttagacctgactagttatcctggcactttgaaacagttggtttcaggtacccttccacacatacatacaaaagatgtgctgatgatagcactgacttttcagagtggtcttttcatcataattaaaagttttttttttttttttttttttaaagcctgaatacacaatctgtgcatggctttgatgattctgtagttaagaagggcaggaacagccttggggaacacttactaacttggaatcatgaagaaagtcacaagcacctacagatgagcagaaaagcaagattatttcattcattttacgtccacaataccacagggactggctggtcagttacttgcgcatgttgtcaaagctaacctttaaagacagttcatctggctaaaaatcaaataccttatacccagagtattagatatgcatcagcgggtggccagggtcttaaggcaggaagtatattataggtggcctggtattttgcaggctcttctgagccagaagcattttttatcagaaaggttttggaaattatgctcagcccctggcatctttttggtcctctcttgatcgctagtccagctgttgaatgaaaagaaatgaagctgaagagacatcactgtggctacagctggtgttacggaggttggtgtcatgctacaagataacacacacatcatttttactcatgtggaaggctgccttgctgtgcatttccacggctgtcagaaagattgattcctgaaatactttgaaaaaatgctaagtactagctactttgggtgtttacccaggggcaccacagctgcctggcattgtagtatggcagctgaacagtaatcactgctatttctctgatttgtttgtgtctttgtcagcatctgagaggagggaggttcaatcccagagtggggccctcactccacagtgatctcattcagcccatggctttaaatactctctgcaatgctaatgactcccaaatttatgtctgtggccctgatgtcatccctgcatcccagactcatagatccggctgcctattaaatagcactgctttgatgtctatgaggtatctgaaatttaacataagcaaaaccaaatttctgatctgtccacccatatatgacccaacttatcatcccaccatcttcccacaggagtaaatggcaactccattcttgtggttgctccagccaaagccttgtgatcatccttgacccctcccttactttgtatcccacatcccaaggtatccaccttgaaagtggattcagtacatgaacacctctctactgctgctgtcttaatccaaaccaatgacaaatctcatctggacgattgtaattgcctcctaacatgtcaacctgcttccttttcccaatagtgtactttctcatggcagtaaaagggaatccttaaacacaaattacattacattatcttctgcttagaaatcaccagcggccagatgcagtggctcacacctgtaattccagcactttgggaggccaaggcaggaggattgcttgagcacaggattttgagatgagcctgggtcacaaagtgagaaccccatctcttaaaaaaaaaaaaattaaaaattagctaggcatggtggtacgcatctgtagtcccagctaatttggaggctgaggtggaagcatcagctgaacccaggagatcaaggctacagtgagtcacgatcgcgccactgcgctccagcctgggcaacagagtgagaccctgtctcaaaataaacaaacaaacaaacaaacaaacaaacaaacaaaggaaatcactagtgaatttcaatcccaaggttcaaaccacatctgtaaaaccataagcgatcagactgtctcatacttgtttgcttatccttctgttatttccttagccgatttccttaactcattcacctgcgtattcaatggccttttcatttctcttcgaatagtttccacctaagtgcctttgaacttgatcatctctatgactggaatgctcttctcccaggtgtttacatggcctggttcctcttttcatttaaagcccatgcccactcaaaggccatatctccttgtcagtaagatctttcctcaccagcctttataaaatatagcactgctcccaatggtctcttattctgctatattttcttaatggactttataatcctgatgtcttttcccactgagtgaaggctttgtttcgttcactgccagttctccagcaccaagaacagtgcctagtgcacaaagggctttgataagcatctgtggaaagtgcaaacattcacctgactcttctttctatctctatctccaccagctgtaaaactgtgcttagaatccctgaacattttattttaatgaaattacctctgcaatatctttagctcttcagtggaaaaatctttcaaaatccagggtctcatggagctcatgtctccatctctgacttaaatagtccatgaaacacatgattctggaaactgagattgtgaaaagcacatcttgctgcaccctccagtctttgtgtggtctctagcacttggtgccatagtgacagtgtctgggtagaacagatgtttttagtgatctgaaaatcactataaagaaaaggcatttcctacatcttggagagaaacttgaaagttcacaaacatgttaagtctaacaatttcttagacttgccatttgcttttatccactttcaggataaccgtaatgtttgcaactcatcttctgtgtctcccccaaataattcatgtttccttttcctccttgtcttatatttcaatgagtgagaagtgaggcatcttactcttattttgtattaaagccctgcgctaatatttctaacgttctcttttacgatttagtgagatttcagaagtgagagggatagttttgttctgttttccatgagttttctagttctttgagaggaagagggaccacgaaattcaatattagtgtttgtcataatactcagcaaaagccttgcctgtggtatacactcaataatgtctgttcatttgggttttaacttttttcaaatctcctcagtgttataattacctgtccttttcattagaaatccaaacctgattagcaattgtttttccagagaataagccacttgccttctctaatagtattggattggatatcaactaaggcatagcttcccaacggatgtgcagtggcacatgactgtactccacatggatttcaaatgtgctcagacaatgattcctgtaagctctcaggggcagctggaggctctagaccaatcatttctaaccacaagattgtgtattccagggtgctctacaaaaattataatttccattatgtgctacggcatgagaaatgttgagagttagtctagtccagtactgcctaactaaactatctgtgcagtcatggaaatgttctagatcttccttccaataaggtaaccacagtgcagctggaatttaaactctaaactatataaactattaggaaccaaagatgaaaaataagcacaattcagcaatttatcagactcgacaaatattaatttgaggtgttaacaacccacagtggtaccagcaggcagaaattaaattaatatatcactaacttgagaataaaggcatcaaaggaaacctcattttttaatgtggctaacattgttggatattagctggctgatgctagctatgtacgctttttctcttgttgtcttctttttgtttgacgatgtggcaaatgacagtgctgttgcctgaaaatggcttcaaagtcacacttgtatgtcttactgtattgggtttaggtgaattctggtgtctgtgttgttcttctaatggggcctggagcaatctaataatttgcatttgggtcctatagaccatatggtgtttatcacccacttctccatcttagatgatctgccagtcattgatgaggtgaaagctgtgtttggcagtgctttcatgctaggttaatcattgtggaattagctattgtttatagcactttttaatccaagcaagagtattctggagtctgtacatctgtaagtcaaaatttacaacctaacgtcgatttacaatgaggaaaagcaagttagataacatattgcatattcataaattactcctaagagataattagtacctggcctccacttcatgattcctctgtttgttagttcttatgatacaatggttgtggagatgcctatttgatcgtatttctcaaggagactctgatccagtgtgttccactgcctcattaacctctgccctcaaaatacaccaagtcaacctctgtttctttattcatgctgctccctctttctggaatggcccatcccacctttcttctcaggtacattttagccttacttatggaggcattgaaatctttaatattagtattaatgtacactagcatttatggaacacatttttttgtgtgtgtcaggcgtaatacccgccaccttaactaggtatttcacttaaacgtcacaacaggacttcaagatatattttttcaagatatatatgtttaatacctatctcataaatgaggaatctgagcttcaaatatgtgaagcaattttcataaaacaattttgtaatgaagtagagtaaggttttaagctaggacttcctgactctaaagtctttgttctttccattgcaaataaagaagacaaagaagtctattaaaggtatctaatgaaggaatctgttctccattaaccttgtactcacttgagacacagttgaaacacagtaaaacagctttgtagattgcttgcttggcttattgatttccaaatcctgttttctttttgctaccatcttacttcctgtgtcatagtggaaaccaacaaaagaattaattctttgtcaagtgtgtgaggaagagcatggtggaccagaagtcttggtccttcctgggcaaacagatacattgtcttctgcacctatacatgtccctcattcgtgaatttcgccctctgatttatatcctatctgttctatcttttaactaagaactgtgaaatcacccatatccaggactacatggctaatctttttattaaacattgtctatcatgtgtttttttttttgttttgttttcttttgtttttgtttttgagacacgtgctcactctgtcaaccaggctggagtgccgtggcatgatctcggttcactgcaacctccgcctcccatgttcaagtgattctcctgcctcagcctcctgagtagctgggactacaggcatgcgccaccttgcctggctaatttttgtatttttagtagagatgggatttcaccatggcagccaggctggtctcaaactgctgacctcaagcaatccttctgccttggcttccataaatgcagtgattacaggcaagagccaccacgcccagcctctgtcgtatgttgttgaattcttggtcatgcctattcaatcagagtgtaaattgcttgtgtgtagtatcttatttggtcttgccctatggcaccagctcaaatgctaggctaatcactggcagtttttacatattgttgattatgtgaatgattatcttcacattataactagacaaaaagagaagtaaaacaattagatattttccccagagatgagtgaaataactgaataaactaactcttgttcataaatttcttaaagaaggatgacaaatttatcttgtaaacatacaaataactggtacctaatatttttcagtggggtggagggtggagtaggatatcagaataggactctccagccattgtctccctgaagaaactttaatttgaacaactatccatgcatgaaaacatcttcaccagggctaaggaaatcaggtgagcaatcaaagcactaggttatagtgtaatgctaagaaaagacgcatcaaagagggcaagaaaaacagttttattacctctgtcacccctccacaaacccagtaagcatagcatggaaagagattctgtctgcttgggggaaagagagggaagtaagcataagactttgcctgctacaatgaaatctagcatcagtcagaattccatgaccactgactccaggctaaaacctatgtacggagcctttagaaccaacttggcacccgagaggagcctgtagcccctatgaaatggaatcaagttttggtctgcattgtggccagctgactacagtggccttgagctgtgaataacccacagtgataggcaggccttagtggctgtgggtttcaggcatgccccagggctgtgctagcctcagtggccacgggctttaggcacactccaatgctgcaccaacattggtgaccataggattctagccctatgccaagctcagcagccgcaaatccaatcttagtacagcataatttgcagtggtctagggcttagggaattccctagcactgcaatgactgtagtgctcaagggcataggaaccataccggacaaccttttcaaaatgtctggacaggcttactgctgaaagatgttttcagacaaaaccagattgtgaagggcctacttgttcagtgcacagacattgattcatgactacaaggaccaaaaataattaggaaaacatgacatcataaaatagacaaaataaggtgccattgactgaccttaaagagatggagatatatgaactacataacagaaaattcaaaatacctcctttaagggagatctacaaatgtcaagaaaataaagagaaataataaatttcaaggagtaaaacaataagtgaccagtacaataaatttaacagcaaaattgaaatgataataataaaatattcaacagaaaccctggaactgaaagatataaggaatgaaataataaatgcaacagagagaatcaacaaaagtattcatcaagaagaagaatctgtcacttgagaacaacttatttgaaaatatacggtaagatgagaaaaagaaaaaagaataaaatggaatgaagaaagcttactttggggatagtatcaaaaagaaaaagcaaattatgagtcactgacatttaagaggaaacaaaggaatataaagctatagaaagcttatttaaagaaagaaaagcagaaaactgtcaaatctgcagaaagatataaatatccagttacaggaaggtcaaaggtctccaatcagattcagtctaatcagatttaaataaaagccaagtcatattataattaactgttaaagatcaaagacaaagagaagattatatacacagcaagaaaaaaaaaaagaaaataaagggagtttcagtacacttagcagtagcagcacatttctcagcagaaaccttacagaccagaagagagtgggatattttcaaagtgattaaggaaaaacatgcccaccaaaaataccgtaccaagaaaagctgtccttcagaaatgaaggagagataaagacttcccaggcaaacaaaagtcaagggagttcttcaccaccagacctgtcttacaagaaatgccaaaggaacttcttcaagctgaaagaaaagaatgctagtgagtaacacaaaaacatttgaaggtataaaactcactggtacaagtaagtacaaagtcaaattaagaatactctaggccgagcgtggtggctcacacctgtaatcccagcactttgggaggctgaggtgggtggatcacctgaggtcaggagttcaagaccagccaggccaacatggcgaaacctcgtctctaccgaaaatacaaaaagtagctgggcgtggtggcacgcgactgtagtcccagctacttgggaggctgaggcaggagaattgcttgaacatgggaagcggaggttgcagtgagcgagatcatgccactgcactccagcctggtgacagagtgagactctgcctcaaaaaaaaaaaaaaaaaaatactctaatacggtaatgatggcgtgtaaattccttatatctttagtaagaaggttaaaatataaaaatactaaaaataataactacactaacttattatggtacatgtaatataaaaagatgtaaattgtgacatcaaaaattcaaaatatgagtgtgtgtggagttaaagtgaacaatttttttgtgtgtggtcgaagttaaattgttatcaatttaaaataacttataaaatgtttttgtaagcctcatggtaaccacaaagcaaaaaacttataatagatacactaaatgtaaaaagcaaggaatcaaaccatagtactaaagcaaatcacttaaccacaaaggtagacagtaaaagagaaataaattttaaaagcatttacaaaacagctcgaaaacagtgaaaataatggcagtagtaagtccttacctatcagtaactactgtgaattaaattgattaaattatccagtcaaagatatagagtggctgaatggattaaaaaacaagactcttctatatggtacctataaaaaaattcactttactggtaaggacacacagagactgaaagtgaaagtatgaaaaagatattgcatgtaaatagaaataaaaaacaataggagtagctatacttaaatcagataaaatagactttaagtcaaaagctatgaaaagagacaaagtcattatataatgataaaggggccaattcagcaagaggatgtaatgattatagacatatatgtacatcacattggagcacctaaatatacaaagaaaatagtaatagatctgaaaggagagaaagactgcaatacagtaacagtaggggcattcaacaacccactttcagcaatggaaagattatccaaacagaaaaatcattgaattgaaactgtactctagaccaagtggacctaacagacatatacagaacattccatccaacggatgcagaatacagatccttctcaactgcccatggagcatgattcaggatgggtcccatgttagaccacaaaacaggtgttatccagctttagaagactgaagtaatatcaagtatcttttcagaccatgatggtataaaactaggaataaataacaggaggaactttggaaaattcacaaatgcatgaaaattaaacaacatgcccctgaacaagcaattgatcaataaagaagttaaaaggaaaatttaaattttttaagacaaataaaaatggaaatacaacataccaaaagctatgagatatagcaaaaggagttctaataggaaagtttataacaataaatgcctatatcaaaaaagagaaaaatcttaaatagcctaaggttgcactgcaaggaactagaaaaacaagtagaaactcaacccaaaattagtagaaggaagggaataataaagatcagagcagaaaagagtaaaatggagatcagaaaaacaatacaagagatgaatgaagcaaaggctttttgaagacaaaatcaacaaacctttaactagattaagaagagagaatattcaaataaataaaatcagagatgaagaaagagacattacaacctagactgaagaaatgcaaaggatcataagagagtattatgaacaattatatgccaacaaattagataatctaggagaaatgaatatattcctggacaaatacaacctaccaacattgaattatgaagaaatagaaaacctgaacagaccaataacaagaaaattgaatcagtaatagaaagtctcccatcaaatagaagcccaggctttactgctgaattctaccaaatatttaaggaagtaataccaattcttctcaagctattacaaaaaattggagaggagggaatacctcctaaatcattctgtgaggccagcattacactgataccaaaaacagataaggacacaacaacaacagaaaactacaggccaatttccttgatgtttacacatgcaaaaattctcaacaaaataggagaaaaccaaattcaacaacacataaagatattatttacatgatcaattgagattcatcaaatggatacaaggatagttcgcatacacaaatcaataaacatgatacatcacattaacagaaggaaggataaagaccacataatcatttcaatagttgcagaaaaagcatttaataaaattcagtatcctttcaagataaaaactctcaacaaattaggtatagaaattaggtatagaaacagtgcacctcatgaccataaagaccatatgtgacaaacctacagctaacatcatgctgaatggggaaaagttgtaagcttttcctcaaagatctggaacaagatatggatgtccactttcactacttctattcaacatagtactagaaatcctagccagagcaattaggcaagggaaagaaataaagggtatccaaatggaaaaggaagatactaaacttttcatgtttgcagagacatgatcttatatatatagaaaaccctgaagagtccaccaaaaaactttagaactaataaacaagttcagtaaagtggcaagatataaaatcagcatataataattagtaacatttctatacactaacagcaaactatctgaaaaagaaatattattttaaaatctttatttctagtagctacaaaaatgtaaaatacctatgaatacatttaaccaagagggaaaaccatctctacactgaaaactgtagccgttttacattttacagaatcttgatgaaataaactgaagaagacacagataaatgaagaatatttgtattcacaaactggaagaataaatactgttacaatgtccatactactcaaagtgatctacagagtcaatgcaatctctatcaaaatacccatgacactttccacagaaatagaacaaagaatccaataggttttataaactgcaaaagacacaaaagagccaatgcaatcttgagcaaaaagaacaatgctggaggcatcacactacctgacttcaaaatgtactgtgatgcaatagtaaccaaaatagcatgatactggcataaaaacatagaccaatgaagcagaatgaagagcccagaaataaatctacacatttacagctaactcattttttttttttcaaaaactgccaagaatacacaatggggaaaaagcagtctcttcaataaatggttttgggaaaactggatagccacatgcagaaaaatgaaattagactattatatctcactctatacaaaaatcaattcaaaatggattaaagacaaaggtaagacccacaagtgtaaaactattagaagagaacatagggggaaaactccatgacactgttttgggcaatgattttttggatgtgacttcaaaaacagaggcaacaagagcaaaaaaaatagacaaatggaattttatcaaactaagaagcttctgcacagcaaaagaaaaaatcaatagaataaaagcagcctatagaatgaaagaaaatatttgcaaactatacatctgataagggattaatatacaaaatatataaggaattcaaacaactcaatagaaaaaagtcaaataacccattaaaaatgggcaatagacaggtatagacatttctcaaaagaaaacatacaaatagccaacaggtacgtcaaaaaatgttcaccatcactaatcatcagggaaatgcaaatcatgaccacagtgagctatcacctcactcctattagaatggctattgtcaaaaaaaaaaaaagataagttttggttagattgtggagaaaaggaaacccttgtgcactattggtgagaatgtgaattagtgcagccattatggagacagtatggaggttcttaaacaaattaaaaatagagccataatatgatccagtaattccactcctcggtatatatccaaagaaaacgaagtgagtatgtcagaaacatatgcacttctatgtatattgcagcattattcaccatagccaaagtatggaatcaacctaagcatccatcaatggataaatggataaataaaatgtatatagatacacaatgaaatactgtttagccaaaaaaaaataagaaatcttgtcatttgcaacaacatagatgaatctggaaggcataagtttaagtgaaagatcccaggcacaatatgacaagtactacatgatcacactgacgtatggaatctaaaaaactcatctcaaaaaggtagaactttgagtgatggataccagaggctggggtggctgggatgggagtgttggggaaatgttaggcaaaggatatataattatagttagatagaaggaataggttcaagtgatctattgtgcagcatgatgactatcattgatgacagtacattgtattcttgacaaatgcagagactggatgttaggtgctttcaccacaaaaatgacaactacgtgaggtaatgcacttgttgattagttagatttaaccattctacaatggatatatacttcaaaatatcatgttgtacatgatagatacatacaatgttatctgtcaatttaatttgaaaaagaaagaatgagaaaagatacttttcaaagagtattaatagtcatttttctgaattcctgtagtgtattttcaagatgaataagttttctaaagtaactgaagcatatctcattagccatcaaaaattatttttaatggcagtttttaatgtagatcttcagaaaaaaagcacacaattactgccttttaaaatagaatgcatgaaatacaattaaatctttccttgactagtcaaatcaaaaaatttttttggaatatcttctgttttacctgttatgaaaaacactaaaatccagggaaataaaagtttagaaatttattcttagtgcgtttacaatctcaatggaaagttaaatgtgtagaaggaaaagttacaatctggcctcttaaaggcgggacagaggtaaacagattgtgtttaagagtcccagaattagtaaagtttaacctacaagttgacatctgtggtagtcatggaaggatgggttaggatttaagaaggagggatacggaaggatgggttaggatttaaggagggatacagcattctagaagaaaaggaggggcattctaaatgattccaagaaagtggtaaattggggaaatggtaaaatgttcagtgtgcttgattagtagcagcttgagaatagttccagactttacaggagcatgaaaaaaattcaattcggatcacattactttcttgcttacaaaccattgttctgctgttactgagtaaaagtcttagcttgttaaaatgcaaaaaatgtgagcaagcccagccaagatgagcaaagccacatgcttgacctgcagttaaccacagatacataagggagtaaaacaaagatcattcaagcctggccctgatcagttatcttggagacctatgaccaataataagtgaccattattttaagctactaagatttgggatattttgtaactcagtagtatttcactgatgaattgtattagtgcttttctattcttctaccctaaagtaaaaatgtctttgctacttatcacattcaaagaaatgtggagctgtaatagaaacaaattttgccaggcaaataggaccatggtattgctttgggctggcatagatgcaattccatgtaattccatttcttgttataaacttggctctaactgtacaatgtatacttcagtatatggacagatgtagatgtagatactgtgtataggtatgcactatttatacctctcaaaaatttaccaaagtcttcatatccatagcactgatattttttaaattaactcttgttagtatggacaattttagctataatattcacaaacgtagagagaataacataatgaaaccctatgtacttatcaccaagctttagtaatttctaacattttgcatgtgttgttgtttgtaacaggcttttgttttgttttatttttgtttttgttttcctttcttttgacaacatgagtggtgttcaatgctactaagaacaaatttgcagatttttcctgcaatgcttgaaatgattaacctctgtttgttgccaagtaactcttgggtacgtactgatagcaaaagtaatataagaatattcacagcatagttaaatttggatagcaagtattatttaaagggtgcctgatattattgcttataggcatgtttttctttcttgtacctcttatttttggtagtaatcatgtttttaatgacttgtgatagacttgttttatgaaacaatagaaaatcaccataggacctctttagtaagcttttagagtgttgaagctacttgaaatcttctctggtgggagattattatttgctaaataattgtttgcataaactgactcctccaacagtgttagttaaatgaatcataacaattagtataaacagagaaaagtaatgatgatctaggcaagtaacttataggtgttctgtttgttgaacaaaagaatgaatggaaaattagggctcttatttatttatttatttatttatttatttatttatttattttttggctgtatccaggatagaataaataaaatgtttgttttcagtctgccttcacctatacttcttggtaagaaaggaaggatgaaaggaaatggtggattgagggaggatgagaggaagaaggaaaaaagaaaggaagtgagagaggctaattatctggaggttttttttaaaagcagtaatgccaccaaattaaagtagcttttcaatttaatgcacaatatttatattactattatattggcatttcagggtgccaagtgtaaagaggttatcttagatgcacagaatatcaaaaaaaacctgtgctatcatctcccagtgcagcctaatcattgacagaggtcaagaaagttaaagcaagtgctgaagttgaatatattaatatacaaaaatatagtatttgtattagtctgttctcatgctgctaataaagacacacccaagactgggtaatttataaagaaaaagagatttaatggactcacaattccaaatggctcaggaggcctcacaatcatggcagaaggcaaaggagaagcaaagtaacatcttacatggtagcaggcaagaaagcttgtgtagaggaactcccatttataaaaccagtagatgtcgtgagacttattcaccatcacaagaacagcatgggaaagacctgcccccatgattcaattgcctcccactgggtccctcctcccacgacatgtgggaattatgggagctacaattcaagatgagatttggtgggggacacagccaaaccatatcagtatcattacccataaagacacagatcaccaatgaaatttaattcatctagagaaatgcattgtagtagtactaaagttatttggttaactttatgttcctatattttatgcaaatacgaatttttttataagatttgggctgttataaaatgtcattctaaagaacatctctaatattttatgtaattactacaaaaattaaaaatagttttatatttataaaccttgaatttcagtggaggccatgcttattaaaattcactttctttttggttacagcattaaaggggcttctagaatgcttaccttttttcagtccactatcataatgagagcctcaaattgtatgtcatcattgggtcatgtaatcattaaagagttctacttatgagagccaataacagacatgaccctttcttctagtctgttcaggcaagcagatcaaacctcttcaaatcctacagtaaaagtttcactattgtcaaatatagcttagtcctaatgaagtacattaaatttacacaaaactttctgtccttgtttccaaacttcatctaaataagtttctcccacctccctcccacagcattgctcataatcaggaaaaatatggtgtctagtagaaaccatgttggaaaacacaaatgtgaaaaagcaatctacaggctgggcctggtgactcttgcctgtaatcccagcacttttggaggccgaggtgggtggatcacctgaggacaggagttcgagaccagcctggccaacatggcgaaaccaggtctctactaaaaatgcaaaagttatccaggcgtggtggtgggcgcctgtagtcccagctactcaggaggctgaggcaggagaattgcttgaacccgggagacggaggttgcagttagctgagatcatgccactgcactccagcgtgggtgacagtctccaaaaaaaaaaaaaaaaaaaaaaaagcaaactaccgaaatagaaaatatttgaagtatgtgaccattaaaattagaagaggtaggtttgaattctggcttctgtcctcactggacatttgtttttgaagtttctatgtctgttcctttgtagcaaactgacagttttaaataaagtaacgtaaccgcacaccccaaaacataagtgttaattttccctactgcacaccccaaaccacacaccccaaaacatgttaattttccctatgcatatgcttacttgtgatcttatatttatgttcttgtatcttataagccttaaatttatgctgagagttctagccaacaacacatctacttaatgttttgtcagtgaaattaagcagagggtgttatgtcaatatttaatgatagattgatatattgcatgggctactttgtttttaatccttggccagggccgttaaatatttattgacagttaccaaaaaaaatggtttttaggctaacttctttttgtaaatatatgttcagtaattgccaataacttccatactaactgaagtatattagtatataggaagctgttgctatgaaataactgtaatatttcaaaaactaaatgttttttatttcaatagttttgggggaacaggtggtgtttggttacatgggtatggtctttagtggtgatttctgagattttggtgcacccatcacccgagcagtgtatactgaacccaatgtgtagtctttaatcccgcactcccctcccatccttcccccaactccccagagtccattatgtcattcttatgcatttgtgtcctcatatcttagctcccacttataagtgagaacgtacaatgtttggttttctattactgagttacttcacttggaataatggtcttcaactccatccagggtgctgtgaatgccattatttcattcctttttatggctgagtaggtatttcattttatatatatatatatatttatacaccacattttctttatccactcattggttgataggtatgtaggctagttccatatttttgcagttgtgaattgtgtcataagctaaatgtttggaaatacattggaattatttctgaagttccggaatggctttgctattctacattaggtggtttattgaatatttttagagaagaacctcttgattttcagttgtttgtgtggggagaagagatggtggtggtggtcattcttcatatggggatttggaagatgaaagagtaggttactcattctttatatggattttcatcagtccttctcattttggccttgcatctcttccccgtaccctatcatacctgatctttctgggtactaagcctgtacaaggtttctaaacccttcatggcttccttcatggctgtggtccactctatgacagcccaggctgcagtttccaccactatgtatcaacagctccatgttaacaatagctttctgtctaccagaaaattgaactttcctgaccatttctgtttgaaatataggtaataaaaccacttttaatatgtggttatcatagggcagaatttttcaacctcggaattattgagcactattaacatctagggccagataattcttgcgtttgtctttcctgtgcatcgtaagatctttagcagcgtccattgtcaagtaacaccccctaccaattgtgacgatctcagttgagaaccactgtcataaaaccatgccaatgagtaatcatgcaggactgtgtatcacaaacagaataccaagaaatgtaaataccttctgcagaagcgcaagcatatgtaaaccaactcaatataatctggaaggtcattaaattacattatactatactttagaaatataatgtctttgtgatatcctgagacaagcagattatttaaaatgttctgactttcgcagtgacattgtgccttttttgtgttccaaaattttcttttgataagcatttctaaataacttgggatttatcctttttcatttatgaaggccttttatctgctaatagaaagaagaaaaaaagatatgctatgatcattttgcatactgcctcattgctagagatgctttccctcacaggatacataatttcttggaatagactattgttcctagaagataattagtgactgttttttttttttttttttggttttttgcctgtcaatagaagtgaaaacagtagttggcatgctcacctacttgattatagctattacatcaatcagcatccttttcctatgcttcatcatcatttatctcaataattatatattgtttcatttttctcaccattttttctttagcattaactatacacaaatttatttaaaatggctgaaattagtcatgcaatcagttggaattcatcctcacaacatttatgcaaaatctactgcagtaattgttttaaaagtgaaatttaaaaatattgaaccacctttatttattctacatctagtcgtactctcttttgtttaccctccatgtttttctccactcatttggtcagaatcagggtttagtgggtggttaaatgtgttctgggatctgccgtgagtcttggtgcatcaaacagggctgaagacaatgaaagctgtggcataaaggacaaatgtagaaggtgaaaaacgaatagagaccctgaaccttaacattatctccatgttgaccacggtttcctttggtattcttgagtaattctatgacgaaaataatgaatagagtattttcattgtttcttttaccttggaggtttatcaagatgttggacagcaacgaaatgtaaattccgtaactcatgtgttaggacactacttcataataaatattttttaatgagaaaaaactaaatcatgattatatccaatttgccagttaaatatgttccacacatcagtgaactaaggaagtgctggagaattgttcttagtaacttggataagcaggaccccgattgtattagtcaaaaaataaatttgggtgtatactttttattgatgtgtcatagttatacacattttggggtgtatgtgatattttgatgaatgtaggcaatgtgtaatgatcaaatcagggtaatggggatagccctcatctcaaatatttaccaattctttatgttggtgggaacattacaattcttctcttctagctattatgatatatgcaataaagtattcctaattataattttcctgctgtacaatagagtactagaatttattccttctatctaactatatttttgtacatgttaatcaacttctcttcaactgcccaaagcaattgacacattcattgcaatccctatcaaagtactaatgtcatttttcacagaagtagaaaaaaaatcctaaaattcatatggaacgaaatggagcccaaggagccaaagcaatcctaatcagaaagaacaaagttggaggcatcacactacttgagttcaaattgtactacacagcaacagtaaccaatacagaatggaactggcacaaaaacaaacacatacaccaatggaacgaaatagagttgttatgaccaaccattctattctctaccttcataagattgacttgttttgctctcacatatgagtgagaaaatgtgatatttttctttccgtgcctggcttatttcacgtaatataatgactttccatctatcttgctgcaaatgacagattttcatactattttattgctgaatagtattccaatgtgtacatatgccacattttctttttattattttgaggaaactccatagagttttccacaatggcagtactactttacgtttccaccaacagtgtacaggcattcacttttctctgcagcctctccaacatttgttattttttgtctttttgataataaatagcatttctagctgggctgaaatttctcttcgtggtttttgtttgtgtttttgtttttggtttgtttttgaaacggagttttgctcttgttgcccaggctagagtgcaatggcgcgatctcagctcactgcaacctccgccttccgggttcaagcgattctcctacctcagcctcccaagtagctggtattacagctatttgtggttttaatttgcatttctctgatgaagatttttgctgttgagttgtttgagctctttatatattctacttactaatcccgtgtgtattagttcattcttgaattcatataaggaactacctgagactaggtaatttatgaagaaaagaggtttaattgactcacagttctgcaggctgtgcaggaagcatggctagggaggcctcagggaattcacaatcaggcagaagtgaagaagaagcaggcacatcttcatatggcagagcaggagagagacagcgaagggggaagtgctacacacttttaaacaaccagatctcctgcgaactcactcactatcatgagaacagcaagagggaagtccgcccccatgatccagtcacctcccacaaggcccctcctccaacattgaggattacaattcgacatgagatttggatggggatgcagagccaaaccatatcaccttgtcaggtagatcatttgcagataatttcttccattttgtaggttgtctcttcactttgttaactgtttcctttgctgtgcaaaagctttgtagcctaatgtaatctcaattatctgtttttgcattggttgcctgtgcttttgaggtcttaaccaaaaaatctttgctcagagcaatgtcccctagcatatccccaatgtttttgtctagtagttttatactttcaagtcttatatttaagtctttaatccattttgagtttatttttgtatatggtaaaagatgggtatctacttttctgaatatgaatatccatgtttcccacaccatttattaaagagactatcctttccccaatgtatgttcctggtgcctttgtaaaaaatgagttggctgtaagtgcatgggtttgcttctgggctctctattctgttccattggtgtatgtgtttgtttttgtgccagtaccattctgtattggttactattgctttgtagtacaatttgaactcaagtagtgtgatgcctccaactttgttctttctgattaggattgctttggctccttgggctctatttcgttccatatgaattttaggatcttttttctacttctgtgaaaaatgacattagtactttgatagggattgcaatgaatctgtcaattgctttgggcagtatggtcattttaatgatattaattcttccaatgtatgatatgagtgtgggatgtcttttcatttgtgtacatcctcttcaactttcttcatcagtgttttatagttttccttgtagagatctttcatctccttggttaaacttattcataggtattctattttttgtgctattgtaaaggggatttctttctgagctagttaattatttgtgtatagaaatgctactaatttttgtatgttgattattatcctgcaacttcactgaattcatttatcaaatctaagagttttttggtggagtttttagatttttctatgtataagatcgtgtcatcagcaagtaaggataatttgacttctttctttcaaatttgaatgccatgtatttctttctattgcctaattgtttttacaaagacttgcagtactatgttgaatacaagtggtaaaagtggacatctttgtcttgttccagatctgagtggaaaggctttcagtgtttccctattcagtaagtgaaggatagtagagattagccagagcttatctcataataaatgactatgacattagcctaaaatatgaaactttccaagaccacttccctttgggggatcacaaggagatgagtcatcagtcactgccttacatttttgaaatataaatcaacattgaatagtaaaattagccttatggataaaaagaggtgactaaactgatttataaaaacttgtctctggataattaatccaccctaaacttgcttctcttatgttgtctccacatatggttaaatggtaccaccattcatgtgtttgctcaagctcataactagggatcatgccccttaactcatgaacattcgtttataattcacatctagtcagtcagtaaattttgttagttctacttaccaaatagatacttaagggaaaaaaattctaccacttccaccaccaacactgtgccgtcgcctttcagtggactgcctcaacatcttcctccctgccttcctgcctccattctgcctctctgcctccacaccacttcattctcccagacttgaacaccaaaatgccagagtgatacctctggtacaaatgctacttggggctctcttatttttaaaactctccaaagcattcctcttatacttaaaataaaacccaagtcctttccatgttctacaaggcccttcctgcattggccagtggctatctttgaattcattgtcactctttttttacatcattatagatacagtggcattctttgccctctcttaagcatgccaagtatactccatctcagcacctttgaacttgctcttccctctgcctggcataaacatcctccaggttttgctatgactcacttcctcccttctcacagatatgttccaaatgatcatcagagcaagctttcctgacagttttttctaaaatagcatttacattagtctctatctctttagctgctttaattttcatagtacttataatcacctggcattatattgtgtgtgtatcaatttatatgattattttgcatctccttctctggaatgcaggcttcatgaaagcagaagttttgtctgtcttgttcactattatagcccctagtacctggtagagaggaaatattttaaaaatattttttgaatgaataaatgaatatttttatagtttaattacaaaccacacttatcaaattaaatgaacaaaatactaagtatcaaagctagccaaatgaattccttggctttcctaaatacatgtcttttgatggatatattatgagttacttccttggaagtatttgttctgtctccttggcatgactcttaagttaccttgtatatgttgttagtttagtcatcaactgacctccccgcacctttctgttcagttgcttagtcactcctcactctttgaggctcctgaggctccatgactccgtggttagtcaccacaattatttgcaacagaaaggagaaatgttgccaaccccaaagcattagagataagtgaaaaatagagcacccctttcaccccaagtggattcacctagtaaatgttgatgttttcttctgtccatttccttcttctgcaaggaccatgagattgtgtttacattctacagctctcacaagatgtatgctccaatattagaaactaatgtttaaacattccaggccaaagaaagcaaaactgaaattccactcttgagtcattcagaggttgaagcattatgggtgatccaagttcccctgactatctgtgaacacaggcagttgtttgtcaattcttttaagttaaaaaaaaatgcacaaacaacctattgtaaaatggagtgagtcagtgcaattgcacaaagcatgttttattgtcagctgtataaatctgtgaatatttttcgtgaccagttttagttggtggatttaaatgaggtcaccaaaaagttatctctgagtatagcactcgccacagtgcatcataaatatgctctcatctatgaacatccttatgaatgactctatgtcttactcattcttttatctctaaattagtactgactattttaggtccttcataaatgcttttgaaattggattatggaggtatttataattatctagattataagctctttcaggactaaatgctatgttttgtttacatttgatccccttatagtcctgtacattgccttgcatatttaaaagtctttagaatatttttgttgaattgatttgttaagtatagatcaatccccctgctatggaaactaatgtggaaagtgttaatgattcttaaatcagggtctaaaccccttttgatcctttggttggatgtccagttcattatttcacaaatagtaatatttttcttgtcaggctatataggctgctaaatgctattatcccaaactttgatggatataattagaacagatttattttccgtctactatatgcaggaacttaatctgttttcctattaaatcctcacgacaattcatgcaggaagactatgtcacattctccatataaaaagactgagactaagagatgttaagtaatttatccaacttgccaaacaaataaggcagaatcaggaactgttagacctgtttccttgaacactaactgtgtgaaatctttcctactctaccacaatgcttctaagaaacaaagtgggccgggcgcggtggctcacgcctgtaatcccagcactttgggaggccgaggcaggcggatcacgaggtcaggagatcgagaccagcctgactaacgcggtgaaaccccgtctctactaaaaatacaaaaaattagccaggcatggtggcgggtacctgtattcccagctactcgggaggctgaggtaggagaatggcatgaacccaggaggcagagcttgcagtgagcggagatcgcgccactgcactccggcctgggcaacagagcgagactccgtctcaaaaaaaaaaaaaaaaaaaagtgaagggaactagttaaaatacattatgaaaattatatatgactttgaaagaaacattttatggtaggataagtatagatatccaaaatgtatcgaatattctcaatagtatttgagggattagtatgtgaaggattaaaattaacttttaaaggcgtgattgttcaacagagaaagatacatgtattatagacacctcacatttctctccacgttaagaactttaaaaagactcaagaatcttggcctctttaccctggtgttgtcatatttgttttaggaagatagtgttttactttttaccgttccatagctcaagtgtaaaagggatggggaaaagagggagaggctgtatccctttatgaatactcaggaaaagttaatatagatagggaatcaatcctgtacacatcttcatgtgttctgacttctagatgtttctctaactggtagctagtaagaaaaattagtgtccttaaaatgttccttctattatgcagaagctttgtcaactgagacattaataactctgtaagagaggtctgttattatttaaatgtctatagagctttaccgttgttaataggatgttctgaagaataaaatgaggtcttgaaaatacttttgttggtgaatacaaagctatgtttaatgcaaaattagtgagagaaaaatctctactataattgctgtgggtttttgtggacaaaatatgattaggatttaaaattaccctgtgcttcatatcattactgttacactttgtttagttttcaaagtgatttccatttgtgagtgagtgtgcatatgtgtgtataggtgttttcaaggaagagagaaatgtcttcgtaacacaagttgttttcttaactataaaaagccagttggcttagtcatggtctaatgctaagaacgtttcttttaaaattgtaatttgtttgaatttccttctagtttcacctttgccagtgcagaaaataaagagggtttttgtggttgtgtgtatgttcatcttgattggccattaccatagctgcatttgttttccagttctgtgttctgtcaatttaatccaactaatatttatgaaataccataatgttccagaaacattcaaataatggaaaattcagctcatattcttcctttgtgactttgtgacagcaaaattggtcaccctcaagtgactgtagaactgagctacatcttagctttagcagtcacctccttttcacagtcattttgccaatgtgtcaaatcagtggctcagccattgtggtctctggaagtttcccttcacttctatcaaagacaggcaaatcacatgagaaatgtatccaactgatacccatgataataccaaaacatgacacttacagatgatgacagattgcatggcaagagctctctgccgtaggttatgattatttagttgcatgtttccagtcttgtaacagattgcacacaccttgaggggagactgcacagacccatgcaatatttgcttgacagaattttccaaggagcacataacaaagaatggggaggaaaagatctaggaaggattctagtttgaatttgctctgttatttttggcaagccttttgatctttttgtacctcagatccttgatctctaaaataatagagttgaatcagtccagtttttttttaagttattaatattttttattaaattaaaatttatttttaaatttttattaaagttttttaactacaaagcaccgtaaggtataaggacagaaactaaagatattccaaaccctgtatcataatatctggcacattattctgtttaatatatatcagttgaattgaattggatttgtttggtcaacatcttgggtgaaatactgatgtataaggtaaaataaaagcagaactaattttgtcaaagaggaatgggtggcacaacaaggcagggaactgagcccagtgggcacccccaaactccacctactcagaggggcatggtgaaaatcataccatgttagagaacacagtttccaaatcaaagaacttaataaccgtgtaattcttcctggcttcaacattctataattccatgactgagctttaaagaattcctttactaacatctagtttgccacatgaaagtaatatgaaagatgttaaggatgttgtaacattatgccgtcaagtgggtggtgggttatgatggagaaccacaaaaccgttttgtatttctgaacaaatgtactgcatacgggttttattatctttctctgtagatctttattttttgccttactgcaaactaatgtggtatgcgtttgaacagggaacagttctctcaggtgctttctgtaaaaaactgtcaagtcgtctacttgtaactacatagtcacaagattatataaactgacataatttactgaatacaacacttatttagataccatagttgcttttgaaattcactgaaaccatttgataaccagagtctaagaaatgtagatttccaacctattaatggcaaactattttgccaatatttagtgaatataagctgattatttaggcagtagaaaaataaaatccattaagatcactttaggcaggaaataagagtattaaagattaatcagagtgatatcatatctttgagaagaatttcaaagcgattgatctcatcctattacccaaactttcctttgccctttatttctgtcctcttgttaaatagtaataaagatgaatggataattattccatgagctatgaacaaaagctatcaatcatatatgaggttgttcttccaaactaaaactcaaaactcattccttttattctctgacttggggcatgtcattcctttgtacttaatgtgttttcctttaaaaagaagaggaggcaagctgctaaagcttgaattcttgaaccctctggtgataagtatatgtggccaactcttggcaattctgcctagattagccttccagttatcaaccaagctggcatgtcctcttggcaaggaagaaagaaagccctcaaagcaaaaacatttagtttagcaatccttaaatgataatttatatacttgatacagagtagaaatttcggtgacaggtttcaagggacctaggcaattcgatgagagagggcagggcagagtgaggaggctagatgaaggagagctgactaactaaagtccagatatagtctagtttagctaggaatgaagtatgcaatggaaaacctatcttcaagatttctaatggcaaactcttagatttgtgggctgataattgaagttgacgagagcacagagcagaaatgtgtagaagcttaaaatcgaagagagtatatcatgcaaattagcaataaacactataaaatgtaacggataatagaaagagtttagactaaatggaaaatatcatttaaaatattcccttggtgtgggtgtgcatgcttgtactaatttaatgccatatctacctcacttagattatgtatgtaggaaatacttaatgtaataactaaatggcagattttgaaatgatgtgatctaggatatggaaactaggaatggaattaagaataatgagataaatttatgccaaaaaaaatcattgtaatacatgccacatatatcatgtgtagctttaattaacacagaaaaaaatgcaggacatcccattaaaagtaaaacaaagaacaaattgaaaatgctttctgaaacacagttatatgttcacaaggactgaccaatcctgatggtctaattcattagtgtcatgtgactgtcagtctggaagtgttatattttactcacgtacaatctaatagcttttcagcttgcctgaaggtgttatctgcagtatgttcatcgttacttggtagagcactttaacactactttgaaagtgaaaaatatttgggaaaatagactgtattctatcttttagttttatgcagcataactataagtctctgtattattattgttgttgtttttcagcccctctgactgataagccacccaagcttttgtatcctatggaaagtaaactgacaattcaggagacccagctgggtgagtaattccttaattctagttaatatgctgctctcgttacattgtgacagttaataagcctagattgtaacccgatgtaatactcgcagctaaatccatttgtattcatagggaacagaattagaaaatgctagcatacctagccatttcattccttacagtgcgtgccttaggacccagttggacatatggatgtaaaaactcacatgctatttagatggttattggaaaatgagataggctgatgattttagtgatggtattacagcactgtcttacaaggtttgaattggttttcaaacagacactatggaacaatttgatttataatatctattaataggttaagatgcaatttctgaaatttaggggaaagggttcaaatttattaaaataaatgtcaccattatggttaaaaaacattttaagtgtaatcaaatataatataaattttgctagttatattttggataatctattaataaaatatgaccaagtgacttttggttaagggactagcagatttgggacataaggctatagacaaaatatgtattgaaaaaatgtacaattatatacgaatcagaattctgacttatcttagaggttcatctagaaattttgagtttgatttagctatattcagttatactaaattatgaaaaatttccctcttaattataaatatatacatagcaattctgttatattctcttaggtcttattttatttgaaatgtagtatgcaggcatatgccataaactttggcagaagagtttttgtttgtagtggtgcattataaaaggttatcaaaaatatgaatttaaatgaatatccatgtttgttaaggaatttcttcttagattaatcatacaagagtgaaaatgcatgtactgtatataactaaaaagaatcagtataccatcccttaagttattaatgttattcttattcctggagtgagaatttgcatcaaaattgtaaattcattttccaaatgaagattacagatgtgataatctttactaataacatacccaaagttatagtacacaaagatatgatgatggttttagcacctataaaattattgtggtcaatggctttctagcacttgaaatgcttatatttgctaagtttaaagcatgaacatacaggatttatacaagtcagggtgttaatatctttctttgattcaagccttttgaattaatgtcatataaatgcaagtagtattataattgctgttattttgagatggaaggttacagatagcattgaaacagtgccacatatgaagcaaataggtgtactcaaattttatcatgcactttatgcatgccatggcatccttaattacactagaacttattgctacattatgaatacatttttatttataaattcccataagtagccatgctcatactgatctttcaataattcataggaagatgtatttctaaggagttatataaaactattaaacattttgggccgagaatggagggttttatggtaccagttactataatgaacatagtaaaaatgaaattaattgtacgcctttgcttgacaatataatgaaaagaattttatggttgattgttgcccattgggtttctttttactgtccttgaatttgtaataagtcagattgttctctacctcttactacactgttttacaaaatagaataattggtaaagctgtatttaaagctttaccttctcttgaacaaagtcacaaagactaaccacagcaaattaaaaatatggaaatttcttaagcaaattggaagtgactatacattcatttgaagaaatatgggcatgtctgttactaaaatgcttcaaaaaatactcttaaatcctttattgtcactcaaaaaggagcatgaggtctctttaaccactgactaaactagtggattattttaagcaacttttattttgttgtgttttatgattttggttcatagtgtacagataagtcgtttactagttagagaaattcaaccttaatctttggatttgtgagcaacagttgatttgaagtaactaccttaatagtattcttgctactttgctagcattgctagtaagtaggtgaatcaaaaagggtaagtgaaaataggaaagaatattaaagacaaaaaaggcttgagatgaggtgtctaaaatatacgttttttccaaaatatgtatttggacttttcattttcttaaggatttaatttttgccctttccatatttgacaaaactgcctattcaacaggttcaaaatatgatataaatcctaagagggactgagtgaagagtcacgggttgggagtaaagagggtggcctgcgcccatgatggggaacttataacctactctgttgaaaaccttcaacagaattttacggtccaagtattcagaggtttgcctccacttgttcccaaattgagagttgacctcagagggataaccaaactcttgtaagagttacgttataagaaaaatcatcaggaattacacaaagctaagcttgtacatgtctggtgacctaacttgagcatcctagttaagttacacacgtatccaatcaaccctagtaactgtgtgtccatagattctctagtttgctcacaaatatatgtaattcattaataatgaactttgatataatcaggaagtgcatggatttgctcttcatcttcaaattcattttctctgccatttgctagccgtgcctacctttcccattttctatatttctgtattttcttgtgtcctgttcttctaattcctccatcttttcaaactggaaagggtttgatagtggtcatttaaattcttttattgtagaaagaaagcaaaaagcactaaaagcaaagtacttaggaaaaaatcatataatggaaactaaattcatataaaatatgtaaattgtcggctttgaatttgaatcaatacgtggtcacaacctggcatttccattttaagtggcaactgtatgttatttctaaatgtaaaaaaaagaacactgtccatttacataactttcaggcatcagcaaatatgtgaatagcacttttttgggcaaaaggcccagaaatttcactgtacagttctggaagtcaatctgggaggtgagcctgagtattttttcaggctactatagtcaagagaatcaaaagacagccacaattgtcttgctaaacctgagccctgaggatgtcattcagagatgtggcctgcctgttacggccaggagcccactttcagaaccgtccaggacagagagcatattctatcgctaccagactttcaaagagtagaaatccaccctacccttgacctaatggtacaaattatattttacaactcagaattcactgaaaattatcattaattacttacctagatatgtgtatcactttatttaaatgtcagtgttgtctttaaaataattataaaggttaatggtagaaattttggggaaatagagagaagaatctttttcttacactctacattataaacgcattctgctcctattaaatattctcacaaaatatccttttaatggccgatgtgaatgtcatataatttcatatatattgctggaaatttgaattcttcacatttttgttattataaataatgtgatggtctttacctatacactttccctctgactctatagttatctcaacagaacaaattcctaaaagtaaaaatactgggtaaaaagaaataattttgttaaaggttcttagtacatattttcagaattcttaccagagaagttgtataaactcccaccagaagtatgtaataagtataaatactacttaatctttaacaaaattaataaaagtatatctttataacataaaactcttaaagatctctttgatactaaaatcacctctctctcctctcttttacctctttttctctcttcactcattaagtacaagtggatgctctttgagtttatccgtatttgaaagatctagcccatttaggtaaatgtctacccttgagaaaatatacaaacctaatcgaatgtctataatctctatccattttcttctcttgctcatcctaatgctcagctaggaccttcctccagattctatgtttcttaataaagtgcccagtaatttcgtgatgtactgtgggcacatggaatgtcaataaatactaactgacaataagttcttcacagcacaaaggacacacacctctaaattttctgcaagagaatataatgtgtagactgaactgtgtaagctgcccaaccgtgctcttatttttctttactaatttattctcattgttaagcttgttaaaaagcaagcactttttgtatctgagtgggtaataaggattcaccagatattcacatctggaggaaaatggttggggacataaagaaacttcagatttttaaacatagatcttagtaaaaggatacacattttatccaatatatgcaattttatccagtttaactataggctacttaaaataaaatgtcacactagaaattaattagcactccttggcttgttccaccatactgtagttgcagaattttagatttggaatagaccaaaggaaaatgtccatacattttattacagatcataattgaccacaccttttctgaatagttactactctgtgttagtaaacttgggaaatctttttgtttcctctctagggtgagaaaatacttaatataaatatcctagaaacaacattatttaggtgttgaatttgataccgaattctgaaagtgtcatgtaatactgttgagtctaaacattattgttttgctgagttgtacaagtgatgtaaatatgacagttcccagagataggaaagtcagtatcggccagattttctcatctacattcacgctactggttgtcataagcaaatgtaaggccattgatttgattttaccggatcatagagcatataaaggacatattttcaccaacaaactcaaattaaaaaaccgtaaaacttccctttctactacgagaaaaacaataatatcccaagtccaagctttttatggaaaatgtggttctttttgcccatttaagaaagacataccaatcagcatatttctagtgcctgaaataaacctgttagacataaattaaaccttttggacaaatagacatcgtaattaaaccatggaaagataaataaagactggtattataattatttaaactatggcattcaattctactcaatccaaatttatcatcccaaggtaaatgaaagtggtaactcttaacagctctcttagtctgtcttgcttttgaaaccaaaaagcaccctaaaaattgtgactgacctaaaaaggaatacttgtcataccactatttcagttattatcgtatatcattaaacagatgataaatcaataaatggaaactagtattcgtattttgaggtcattgtatgacctaacttacatgattctctcagattctcaaattcagtcactttttggtgacagagaggagaaataggtttggaaaaaaatacaactgcatgtttgctttaaaaactgctatctacgtagaagttgaaattcctttttatgttttaagtggtcagggccagtcacggtagctcactcctggtatcccagcactttgggaggctgaggcaggcaaatcccttgagctcaggaatttgagatcagcctggtcaatatagtgagacctcatctctacaaatatacaaaaattagcttggtgtgttggcatgcgcctgtagtcccagctacttgggaggctgaggtaggaggatcacttgggccgaggtgattgaagctgcagtgagccatgattgtgccactgcgctccagcctcggtgacagagcgagaccttgtctccaaaaataaaaaaaagttttaagtggtcaagccctagttctaggacaggtttgcaatcccataaaaaagatggacgtgaaggtaagaacagttccagtgggccaatgatatccaaaagtttggaagtcagttaaagcacttttttaaaaaaacttttattttaggttcaggggcacatttgtaggtttgttatataagtaaacttgtgtcacaggagtttgttgtatagattattttgtgacccagctgctagtacccaatagttatttttttcttctctctctctctcctcccaccttccaccctcaggtaggccccagtgtgtgttgttcctctctttgtgtccatgtgttctcatcatttagttcccacttataagtgagaacatgcagtatttggttttctgttcctgcattagtttgctaaagataatggactccagctccatccatgttcctgcaaaggacatgatctcattctttttatggccgcatggcattctgtagtgtatatgtaccactttttaaaaaaatcgaatctgctattgatggacatttagactgattctatgtctttgttcttgtgaacagtgctgcaatgaacatatgcattcatgtgtctttatgatagaaggatttatattcctttgggtatatatccagtaatgggattgctgggtcaaatggtagttctgtttttagctctttgtaaacagacaacctacagaatgggagaaagtatttgcaaactatgtatctgacaaaaaaggtctcatatccagcatctataacgaatttaaacaaatttacaatgaagcacttgttaaagtctttaaaaactgggacagagacaagtgagttttcttgttcacttactttccaaaagggccagaagggaaagaagaagaaagaaaaggcccaagaaagagtgctgtcacagagcaatgcagagagtccatttaagcttccaactcctggtctagtccccacgctggacactgacacatattatgcagattactcttttgctgcagcactaagagtactattttatttgttatcagtcagttaagaagctatataggtataaatctttgcaattctaaatgaagaactttaggaggtggagggggtctggaagttatcaggtcaaacctttttctttcttttttttcctttttttgagacagagtcttgctctgtctgcccaggctggagtgcagtggcgccatctcggctcactgcagcctccgcctcctgggttcaagggattctcctgcctcagcctcccgagtagctgggattacaggcatccgccaccatgcccagctaaagtttgtatttttagtagagacggggtttcaccatgttggccaggctggtcttgaactcctgatctcgtgatctacccaccttggcctcccaaagtgctgggattacaggcgtgagccaccacacccggttaaacctttttcatttattgatgagaaaatggagactcaaaatggctacatgttttttacataaaaaatttacaaaagcttgttattgccattatcatcatcctcatgatcatcatattatcactgttagtgtttttgttgttataattaagaggcagtgtacagtagtggctcccagttgaaatctcacacaggcctatgtgacagtttagctccaccatttacttctagtgtgaccttgaacaaccagctttcagtttcctaatcaataaaaaaggtaccaagatagtactgcttctatggaggtaatgtgagtatttgatcggataatgcatgtaaaaattaatagattacttggcatatattaagtagtcaatacatgtttgctgttagtatttgagacatttgaatgctgtaaaagagtactgtatatagaagattcttgaaatgcattttgaatgtcaatgcttatttgatcatgcttatattcttactacagtatcatactatggcagcagatacagccttcattacaggataaataagattttagaaaatttatttccatctcccctttaaggattcaatatgcatactaaatttttgtatttcaatgaaactttttaattatagaaattattgattttagattacttaattcatcaagtctagccaaatgcatatagtaagtacatagttataacagaagaaaactatctctattcttatttaaagaaaatgataatttaaaggacactatgccacatgaatttataaatgaccatcaagacaaaaataagagtaaaaaaatttctcttttgtaaacagaggaaattcaggtataatatttttaaaaacaagagacctggaaaataattttccaccattatgcctgtcaagttcttcatgaaggttttgatgatagtcatatcattttatacaaaaaaatgctgcttttcccctgacaaacactgttatcacaaagctttctaagtcattcttaatgattgaagtttactagcatataaaaatacagtcagtattgtatgttaacaagaactactcctgaatttgcaaagtaaatgccaatttatcagaaataaacctatcaaagaacattacgttgtagaatattgaaagaggttttagaataagagtatgcactgcatgactgatgtccattaaaatagaaactataaaaagacccacatcatttaaagtttgaatataaagagatacattcacccataaatttcctctcaaatttcagctaaataactaaggatttctaaattatatgcagactctccatgaaaaataactagtgcttcaataagattatgaaaataggttaccagtattttatgctttcatgttaaaacacttagcattcctgtcaaaccttactttatcaacttagtatattcccacagatttgtgggtaaattgaatcatcatcatttcagagaagtgttcccttcatttttgattgattttcgattagcagtggcttaacatgtcaggtttaagaggctctgtcccccattctcttttaagcagctaatgatcaatgaaagatttatatgcataaaggaaatatgctatttaaagaaactctgtggtgaataattttatataagaacccttttgtaactgaatgatcacccccataagttttccctgtggtaatgcagatttttacatttttgtaagatgaggttcatcgatatgaaactgcaagttgcatctccaactgatccagaaaaaggatcatccacccattaccatgtgtgacctcccgttgtttattaatggaaacaaatgtcctcattgtgactttctgcctcctctgaggaaatattacattttactcaccagcttcagaatcaacagtatttggttttaatctaattctttgaaaatatattttgtagggtagaatagttaagtaaccagaatatctcatgtccaattatgacaaaatagtttattttcataagggatatgctttgaacgccatcctactaccttatctgccttggttttgttgaaatataccctagtaggataactgcccatggtgtcacttgtttttctataactgtgatgagagttcttatttccaggtttaaaaggaacatcttgtattttgattcttctaaaatttgtatgactctcattttatcattctggcagtcacttctttttatcttaatgtattcatatatgtttaataatttcttttaaatataaaagtatgtacaatgccacttgatttgcagctttatgaatgaggctattaccaaaatgtacttaaacatgtgctccgaaacatgccagatatttacatgagtccaatacatagagtgtccataaggctttaaaacctaagccccatagcaaaacttcatgaagaggcttccttccaattcaccacacacaagttcaacactactttttttttttttttttttttttttttttttgagaaggagtctcgctgtgtcgcccaggctggatgcagtggcgcgatctcggctcaccacaagctccgcctcccgggttcacgccattctcctgcctcagcttcccgagtagctgggactagaggcacccgccaccacgcctggctaattttgtgtgtgtgtgtgtgtgtgtttttagtagacacggggtcccaccatgttagccaggatggtctcgatctcctgacctcgtgatctgcccgcctctgcctcccaaagtcctgggattacaggcgtgagccaccgcgcccggccaacactatttttttagaaatgccaaggatctttatttaattttgtaataaaaatttataaaatctcattataacatatactaattgaattatgaaaggaaaacaatcttgatttaaaaatttttgttttccaaaattaatctgttttaaaataagtcttggcttcatggtcttgtgagaagatacctcccaccgctagatctggtctacaacaagcatgacaaaaagccaggaagttgcttaagagtccaagagagtgaataattttctctcccttccacttctccccagtgaggctaccgactttctcactctctgagtgtttgtttctagtttagtaaaagcagagtacccaccttggacttgcctgttgaagaacttttatagaatggcggctctttgagtaggaaaaaagcaaagcagaatgcattgcttttctggaaaaataaaactgagtgcatcctgtcacatcaagccatcactaggaacaggatacttaacaatacggcaggtcctaggaaaatttgagattattaccacgaatattcagtaagaagccattaccattatgtgaaatagcttagggaaagttcagaaaacaaaatattttttattttctcttcttaaaagaaaaaaatgtaatgtttccgatgaacctgtatttctgatgatgatcatgtcaattatcttggcaactttaagacttcttaattaaatgattaaaagttgttactactttctgtaaatgtacctgtttttgactgaaatatttggggtgcaattagactagttttatgcactctgcttattgtatagcctatttataagtagtatgaatatttctttcagaattacatatcacatacaatattgattaaaagacttaaacaagatattgttcttaggcataaatataatttgttttttaaatcaggttcaccatattcaacatgaatgtaatttgtaatgattattattttaaaaaaaaccctgtctctatttaccataaataatatgttgtcactccaatgctctttattaggacttgctactaattacagagtgagaataaggtttttatgtaatgggagctaaataaaatgagtgaatcttatattagatgaatacatgagatttcagcctcaggagaaattgtgtgtcacagagaacatcggtgactattatgaaagacatgttcagtcaagagggaatcgtactgttgactatcaacagggcagaaagtactggattgtattttctttcagtcactatgtgcatgacctaaaatagagaactgaggcaatatatacataatttagaagggaaataatccagaaattttatttttgtctcaaatagatggctctttcaagcaaaggttaatttggggatttttttttgaggggtcaacttcctatgtctaagcaatttaaacttgaagaatcacaggatttaatacttcatagttagagctctggtcataagtgacaaatcacttaaaagacaggagtggtgctggccttaagaaggattggaataatgctcgactgttctctgtctttcttctctactctttctgcatgtcatcattttgtataggggtggagagtggtgggtctgggtgagtagaggagggcatacagggtgaaggaatacgttgctcagttcttctaaccaggaggaaatgtgggtttggaactttagtgagaacttgaagttccctaaggagaaatcctaattggcctagaatgagatacagatctaaattttggacggatcactatggcattagaggtgaggggcattggctcagtggctgttgtgtgtctctctctcctgtgatgaagcctgtatttttgtgtgagtacgtagatgtggcagttggtgggtgggtggggaggctggtaatggggcttttaacagacaaagataggggaaaaagcaatggttattatggagtccatcttttcatattccatattcaatatttgtttaacatccctggttaatccatctcattaatttagctgtcatctttattatgcctcttcattaacttagtgagggtagaatgacccatcctgattgatgcatttgaatgcagtctctcttgggctgaaaactcttccattgctcttctcccaactaatactgacatcctttcctgtgtatctgtagtgcatacgtctcaactctagacctgcattcatctctctgctgtctctaagcctgcagagtatgttctcttccagccttaaacctaaaccaaatggcagattcttagctgttaaatacatttttaggaaaaaattaatatgctttctagagctagagaatggattataaaatcaacttcacgtaatatgaataagtaaagtgaggccagatgtaatgctataaaggagaatggagaccatgctgaagtggggaaaacattttctacctataaaattttaaatttattgttaataccatcttggccaaataaaacttgtctagtgggtagttttagtccagtggcctgagtgtctgatgtcttgattggtaaatcgagagtttatactacgaaatactgctgcactgtggagccggtaggctctggattcagaatggctatcacgaaatatgaatctgttccatcatattatagattggaacatgacataatatgatttgtaatgtgtttggagtaactaataaaatctcttacccaagaagcaaggagtttagagcagcatagttaattatgaaaggagaatctccccatcaggcgatacaaaaatcatagagttagaatgaaatgggcaaattctctttagcaatctggccccacaaaaaagtagctatgtctattttgtcattacagacttgttaagttaacaaaagtagaaatgtctgttaactctcccagcagacattttcatttactcttctctgcacatttccactggatatatgtttgttcctaaggtcctttactcaaggctaggcattacctaatttacttgtgaaaatgtgccaagaaaaggatcagtgattattcttgcttcattatttaaagcctactttcatgaatgtaatgcagtcatcattcctatgtattgtcatcagagtcgagagttgggacgacagagagtagaaatcctataacaggcattagaatttttagtagataataccaaaaattgaagcagagtcagtatgtcagactctaagtttggcttggtaaaaaatcctctttgtaaattaaaaaaaaaaattaccagactgccagcttaaaaatattatgtgtttccaaatagatgagaaatgtttgaggtgataaatattccaattactctgatttgatcattacacattatatgcatatatcaaaatatcacacatacccctattagtatgtacaattattgcgtattaataaaaaggaaaaacatttgatgcaaatataattcttgtgtatgtgtggtcttaattgatattcttttaaccaagcttactgagatatttatattgagtaaactatatcgtgttcagggtaaaaatgtatatgttatgtgtctgcctgttatctagaagataaaggccactttcttcacagtctgaccccattttgtctttatagtctcatgcactctcctcttaagcccacgccactgaccaggcacccttgaccataccatggacctacataactctatcatttgtacatgctatgcccaccacctgaaatttcctctcctgcctttttcccttgtgcctatctactcaaattttaagaccaacctcaatgtcaccccaatgaactcttccctgactctactcccactaggcagaattaaataccacctctcaattgctagcaaatctctttttcacacctttattagaacatttctctcatcatttttgtacatatttttgtgtgtctatttctcttgttgcatttcggactcttagagcatgtactataatgttttcatctttacatccctgatatgtaggacagtatctgatgcacagaaataaataattcatttagcattcactcagctttaatagtcataaataaaaaccaacatacatatgtcactcttcttttagtagcatatactgcagagtaatggagtaaaccacgctaaaactgttggttttgatttaattgcctggtgtgattgaagattccccttcatggatgagagagacagatagagaaaggcctaggagtctggctagggaagtctagcaataagtcaaatcccgattagacagaggaggaaagatcagatggatattgaaggtcacaacagagcagtaggttgagtttggataaataaataggggttgaaagaacagttatatatcagttcagctagaagactggtcaagggtagagacttttcactggcgtcttgagtttcaggcagatctctaaatttagtaaagtagactccacaatcttagggccctgaatgagaaattggttcgctagttccatttatgactttattactgggcacaaggtctggtcaaatccacataggtggctaggtaggtagataggtagatgaatagatagatagatagcttaacaaacagacgactgtctacaaggagtttatgttataatctcggttaacctctggatgttccttgttccccaagacgccaagacttcctgtctttcctcacagtttcagtcatgaatgtcagctctcgttctaatgagctttttaatcacacagtcgtgatccagtaggtacagctttccttgattagtgatcttaatttatctttgctttgagagtaccttacatctgcaagacatttaagtatgttgtctcatttcatcttttcaacagcctgtgatgtctattttgcctccattttacagataatgatcaaagcttatgtgtggcacttgttgtgacacttctatacattagtgtattgaatgtgattacctgttttgctcctttgttgagttctaattgtgcacaacatgcaatactcccttaaatccataaccttcctgtaatatttaaaatggtctattcttacagactacttgagttctgttttcttccactgttaagagagtctatgtctcatcaagtagaacatctagtaataattccattgaatataaacttgtctttgaaatgtttctgtattatccagttcaggttgctaaaacaaaatgcctttatactattgcttccaaatcttaactattggaaacagtgccgcaacaaacataggagtgtagatatctattacagcataactgggttattattgttaataaaaacattttaaaataacttaaagagtgtaattggattgtttgtaactcaaaggataaatgcttgaggggatggataccctattctccatgatgtgcatatttcacagtgcatgctgtatcaaaacatctcatgtatcctataaatacatacacctactatgtacccacaaaaattttaaaaaactgaaaaatgccttatcctgattgatttataaaccacagaaattaatttctcacagttctggaggatggaagttccaagatcaaggcgccagcagatttggtgcctggccagggttctctgcttcatggatgatgccttctagctgagtcttcccatagtggaggaagcaaagcagctctctaacccctcttttataagggcattaatcccattcacaaaagcagagccctcatcacctccgaaaggcttctaataccttcgtcacctgctgataccatcagcttggtgattaggtttcaatatgtgaattgggtggggggatgaaaatattcagattacagcggtttctcaggtttttggttttgggttttgttttttgtttttctattcagttgcatgtctcttgaatctgcttctgttcatctttgcctcctattttctcattcccattttttttgtacttctgctctttcaagtacattttaagagacacttttcttctttcactgatcttcgagcatgaagttcttttcaaggcacttaggaaaatggaagtacttaggacattcatgaacagaatgtctcgagagctgcaaaagttaacgtgagaaaagctgatagaaaagttgcctagttcatcagagttttactctttaaaaagcagcaagttataatcccttcttaaatagcaagcaaaagcaagtggtctcatttcacttcttgaaatagacaaagtgaaactaataattgacttgtcaatttactacgactattaattccctgcacgcaaagttggacttcgttaatttaggattcacgttttctttctgaatataattatctgactatatacagaaaggtagtttgaagccagctagttattgtttgagcatttaaagttaaaaactatgtagacattagtaaatatccatttagaaaacctgtaacaactggatcaaaattaatcttaactgagaagttaaatttgacttacgatatttttatgacatttacagtgcatcttgctcatggcttgtaaatatatgttaactttaaagaacttgccaggagtggtggctcacgcctgtaatgccagcactttgggaggccgaggtgggcagatcacctgaggtcaggagtttgagagcagcctggccaacatggtgaaaccccatcttgactaaaaatacaaaaattaggcacgcatggtggtgggcacctgtaatcccagctactcgggaggctgagacaggacaatcacttgataccgggatgcagaggctgcagtgagccgagatcgtgccactccactccagcctgggtgacagagcaagcctccatatcaaaaaataaataaatcatgaacttggtaaggtttatgtagaaatagaggtgcttttattatgtaaatgtttgctgtattaacttaggaacataatttgcaatttttcctaaaggctgacatttaccaggtgtgaggtttcataaacactagtatcagaaaaacatttccagttgtgaaaatgattataagaacagaagtattggccaggtgcggtggctcacacctgtaatcccagcactttgggaggccgaggtgggtggatcatgaggtcaggagttcgagaccggcctggccaacatactgaaaccccgtctctactaaaaatacaaaaattagtcaggcatggtggtgggtgcctgtaatcccagctactcaggaggctgaggcaggagaatcacttgaacctgggaggcggaggttgcagtgagccaagatcatgccattgcaccccagcctgggcaatagagtgagactccgtctcaaaaaaaaaaaagaaagaaagaaaagaaaagaagtatagtcacaaggtgagcatgttattttaaacttcaatgacttaaaaaatataagtattgattttaattgcacgatagcataatattgaaaataagagagaaactgactttattctagtctgtgagaacaggttctcagtggggagataagactaagattctcatagtttattgaaataatgatcaattcaattatcaaatgcaggatagcattttgtattcagtttaataatccatcagcttttcaaataacatgttttaattgttttaatattatagattattttcactcttaaagtatcattttccaaataaagaagtatcatgatataagccattgggtagtggtcttgccactgactaattgagaatctcagtggtctgaggattttaatttccaactgtctatggcaatgattcttcactaggaatggacatgataaatacctgtagagcttttacaaaacatatgcacctagtttccttgatcccctgcctccccccacccccctaaagatttatttatttatttatttatttatttatttatttatttagagactgagtctcgctctgtcgcccaggctgcagtgcagtggtgcgatctcagctcactgcaagctccgcctcccgggttcacgccagtctcctgcctcagcctcccgagtagctgggactacaggcgcccgccaccacgcccagctaattttttgtatttttagtacagacggggtttcaccatgttagccaggatggtctcgattctcctgacctcgtgatccgtccacctcggcctcccaaagtgctgggatcacaggcatgagccaccgtgcccagcctaaagtttaatttattacatctggaagggaagctgagcaaggtctgcaaattttgaaaattcagagaaatacacatcaaatctacagtgagatatcacctcactctaattagaatggctactataaaaaaaaaaaacaaaagataacaaatgttggtgaggatatggagaataaacccttccatactgctggtggcaatgtaaattcatacggtcattaggaaaaacagtatggaagttcctccaaaaataaaaaatagaactatgatatgttccaagaatcctactactggatagctatccaaaagaaattgaatcagtaatttgaagagatatctgcacccccatgtttattgcagcgctatccacaatagcctggatatggaatcaacttaaatgttcatcagtggatgattgggtaatgaaaatatgttgtatatacacaatgaaatactattccatcatgaaaagaatgaaattctgtcatttgcagcaacataaatgaacattggggacattgtgttaagtgaaataagccaggcacagaacaacaaacaccgcatgatctcactcacacgtgaaatctaaaaggttgttctcatggaagtagggagtagaatagtgtttaccagaggatggagagggtaggaagatggggaggggtggcgagagattggtcaattgggtacaaagctatagttagattgaaggaataagttctggtggtctgttgcatagtagaatgactagcattaaaaagaatgtatatttcaaaatagctcgaagagaggtttttgagtgttctcataaaaaagaaatgatatttaaagtgatagatatgctaattaccctgatttgattattacacaatttacacatatatggaaacatcatgttgtgtcccataagtatgtctaatcatgtgtgaaccactataggaaaaaaaacctctgacctggtgggtttgatgttttcttagtcattatcatgatctctctatattctagagctctttgctctccatgtgagggagctaacagacctttctgggtgatctcatcagaaaggctgttagtgccaagaaaggaagactttataactcaggcacagagagtcccagtgaggctctgaagatcttttcaagtggaagcttgtatgacaggacactacactggggaatgagggtgggagtgaggtggagaaagaaggcacttctcagagcatagtaaaaatttagcaacaatttgagtcacttaccttactaaaaagttatctttatatctatgttagttttctgtggctggtgtaataaattacttgatggcttaaaacaacagaaatttattctcacagttctggtggccagaagtctgaaattaagggctgaaacccctcaggaggttctaggagagaatctttgcctcttccaaggtctatggctgtctacattatttgtcttgcggccgcaccagtccaacctctgcctgtgatcaacattgcctcctcatcttctctgtttttctttcccttccatctgtctcagctcttcctctgccttttctttaaggtcgcttgtcattgaatttagagcccacttggataattgaaattgatctctttatttcaagaagcttaacttaattatatctgccaagaccctttttccaaataaggtaaaaaattttacagtttctggagttgtaaaacatggttatatcttttgtgggggtgaggcgggcacgattgaacccactatagtatctgtcacatgctctgctacattcacaaaaactgatacttagtaaaagttcatgagattataaacagtgaagtatcaacaagacccctcattcaataattatcagggttgcttctctctctctctctctctctctctctgtgtgtgtctgtgtgtgtgtgtttgtgtgttctgtgttcatgtgtgttgtgctttgtggtcttttttttttttcacttgaagagtattcccatttagcccttgaagttaccaaatggggaagacattaccaaaaactatccattaacataagagttttgtggagcacaataagtaaagcaaagggaaacatccctctaaccctttcccagcaagaaaaaacaagataatcctggtagttccgagaaagcaaagaaagttagctctaactctttgtagtgaattttacagtattcagttgttctcgtacatttgtcaagagttgattcacctgcaatagaaaaggatgtctgtttacaagtggatcaatgattatatctactaatggaaaatggtagattgttcccaaagtcttcacaaataaaatctcggagataatatatctttctccgttagtagacacatcgtagtatctaaccataatgattacaggcataccttttttaaactatgggggcagtcacagtgctcagcattgcaggttttaaccttcatcagcagagtcagatattaaaaagcttatttcacgttgtatgcctgtatcaaaacatctcaggtagcctataaatataacacctactgtgtgttcacaaaaataaaaaataaaagttctcaatgtattaataagaaatcatgcatttatcaagcacttgttcaatgtttgtttgaaagtggtaggtaaataccaaaatgaatgcactgtatgagtttagggatgaagagcttatttcaaaagctcggtcaagcaaggcctaatggtgaaaatgttatgtgaactctaccttaattaaggtgtaggatttaagcagacattgatgaagtattaatagaaagacattgctgaaagaccagcattaggagaggcagagatgacagaacatatgttggcttttggagtgggcaactgttgtagccaactgaagaaattcagccaactgaactgatgaaaaatagtgctggaaaaaatagtgtagacacattacgaatttagatacactttcaatggaatatatcacaatggaatgtgtgtatgtatatacatatatattctgttgaaagtttcaatttcttatacaattaggaaagaaagagagcccaattaataaggtagtctcataatacattgtagaatgaataagaggaagtaggagccagaggtcagagagccaactgggaaactaattgtctaggcaaaaagtaatagagtaggatttgcaaaaggtcagagttgagggaaattgactttcagagaagtataaatcttattgttgtgtagactaatgctaagtaaagttgacagataggagtcaaagaaagtagattttaattatggttgagtgggaggaaggtgatatcaataataagaaaaagaatgttgtaaagaggagcaacatttgtgggaaatatgttgagtcaaactgtggttacacgacgatagtacattctgacaagtctctcccacaactggaaatatgtacagagctttagtgaggtattcgggctggacttgtatttgagagattctcttaaagaagtaacaaaggaagtcagatatttattgatgggaaggataacttactttctcatttgatctcagtattattggaataattaagcatactaattcctgaatttcttattttcctcttgaggacaggaaatgtgttttatttacctctgagtaatcagctgatagattgtcttcaaaaagttcctcttgaattactagagtttaggttgccgtgtttctgagattatcttactttttcaagtttaatggaatttaaaaaaaaatttactatatttactgttgtatcctgaaaacaaaagtatttctatgagttttactgtaatcctattatcatctcactgcttaatctttcaggtttccaaatacttttaaaatttactttaattgtttttaaatgtaatgagatgttattttaaaaactgttgattatttctacaaatgtgtcatgtccattaaaagtcactcattcataagtatatattatcaagttaatgtactagcgagacatcataaattatgcttcatctttctgctgttaattcacattattctccttctatccagggaaagaaggtactatatatacatgttattaaaatatttagaatctttgaataatttaaacaacattttaaataacagaatatggaagaaaatagaaaaaaagttaattgattcaatattttttttcaacaatttcttttaaatatatagacaaacccatacttggcatttatttggaactgtgtctgtttgcatttaaatttttgtgacctgcttaccaattttaggttttgtattgttttcttcttcctttatttatctttccatgctatattgattcctgagtgtttgagggacttccattttccagctcatttaagtgcatttcatcctgctgtgttggtcatcagcaagacacgaaaatggtactgaaatggccacataatgcaatgtgatttgaaacgaaggggaattgcacttgtctgttgggcaaggaatatttatcctgggttgctcgatgtatttagaaagtcaagagttatcaggtatttatttgtaagagtacagagaatcttgaatgctagtgattccaagacatttagatttcaggaaccagttgaattatttaaacaaacaaacaaaaaataagtaacgggaccataataaaggtgccaaatgatgttattaaatgataaagaattaagatctgctattaatgtaatatggaatttctaaaaggagcagtttaaaatccaaaacttggaaggtttctcagaggaagtgctgatcatttgaattcaatacattcaattttatatttgtcttaaaagctcactatagagccgagattgcgccactgcagtccgcagtccggcctgggcgacagagcgagactccgtctcaaaaaaaaaaaaaaaaaaaaaactcactatactgttttctgctgctaccaaattttgcatctaagagcatctgagacatagcatgattgttaatgatcgtgtcctgcctctaagaaacactacaatcataatacgttttgttttctctaccctaaaataaaatacttgagagtgaaaaccaatgcaaatgtgcaatatattttccccatatttgggaatggaatgtcctcactgatatgtgtgtgttttgtatttcatttacaatgaaggtgacacaaagaatttattctcattacagttgtatgtgtatacactgtagaatcatgttgtgaaagccatcttatataaaatataagtttcccctctctttttgcccacagccttaccccactacccagaggtaaacacctgcaactatagctgatgtttggtatttagttccatgcctcaaaatcacatgctgtactaagaacgcatttttctattttttaaaattgatttattgatttaatatgttgacttctcagtactgtagattaagatatagttctctatcaaattcttacccttcctacacaaatatgcatttcctgccttctcattctcccatgtagtaattttggctcccgtgctatctgccagttgtttgcaattatgaaaactctagcaaaagctgagccacttatagtaaatttccatctctttctctctttgatttgctttttgggacctttcctacactttgtcttcctgtcttcttactgaataatttttctaatacgtatttgtaattattaagagttttcatttttctgcatatctctttttctatagcagcctattcttgtcacatggagtcaagagcatctcttctcattctgaaaacattgaagttagttattttgtctgattttgttttgtggggttatttttctctctacataatctttatttttcccaagttcctattgtctgtttggttgcatgtttgagtctccctcatgttcaaggcttcctttgattttttgatggtccttggttgtctactcattaagtagaggtcactaaaaaaagtgcttggtaattcttagcagaatgttgattgtggatcttctggtttggttttctgctgagttgagaaatttctgctgttggtatctttaggtcttttgttttgcactggtcagattcacagagaatagtcctccaatatccagcctgtctttctgcatttgagagatgagcgggaaaaggtttcacatttggcataaaagtgcgtttcagctgcatgtttatgggtctggtgtcctgcagtgcagagactctctttcaacctctcaagagaataaacatattgtccctgtgatgacaaagaagggaaatcaatagctaccttattcataaacagacatttgacagaccctcttatttcctcccaattcttactctaccttccataggcagctggtgtcatcattcactgagcccttctggaggttctgcattggcaatcaagttgattcttagcttcaaccgctgttggattaggattcagctttttcaggcttctaagtgtgttactacttattcattaactttccagcttctaaaattctgctgccgtggtgtccttccttgttttctttgtcattatgggtttgtgcttaatttaaaatcccttcatttatatttccatgtgattttagaagggaaaaaaactctacttctgtgttgaattcactaccattacctgatagcctgcatgtgactttaggaaattggttcctgacattttatcagacaacagcataaaaactaaactgtcaacaagtcttcatagaggatttatgagcttgagcaataattgcaatactctctataagctaaactgacataactctaaatgaaagtgagcagtgtcatgtttgctattgttgatgtgctgtggacaacgtgaatgacagtcagttttaattagcccacggataattgcagtcatgtacctaagtcccattaatggtcactttttaacacctataacatggaagtagtgaaatgattcatttctttttttttttttgaatatggtagagaaggtcaactatgcttttgaggtaggaattattgataggatacttctagttggcttagcattttcatatctttttagcttaactatccattgtgagactaagcttattactgtcatgtaagattcggttaagtagcactattcatatctacaatctaccatgtggagtgatttgtcatcatttaaggaaaacccgtacatcagatataataagcagctattcttctggttaaccttttaatacatattattgggcagcaaaatcaaaacagaatctgttgtgtcatctctttggtacccaggcattttctacacaattgtaacaagactgctctggaaatagctataaatggatcctgctgagatctgctttttctcaattatcttatcctgtcaaacaagggatttttctcctcttcactttctcctccatttataaggatgtaatttcagcttgcaaattcgattttatcctttattgttagagcaagagatttcccagttttgatccagtctccacacttatggagggcccagtgtgaatgcagtatgcatatagatatcaatcagggatagcaggtcattccagccagaaaaactgatgtttttgcgtatatgtatatatgaatgataatatagggtgatggtgcctcagtctacttgtgctgctataataaaataccatagactgggtggcttatgaaccttgaaattttatttcccacagtcctggatgctaggaagtccaagatcaaggcactggtggattcagtgtctgttgagagcctgctttctggctcataaacagtgccttcttgctgtgttcttataaggtagaaggaatgagggatctctctcagggctttattttttataagggaattaattgcattcatcagagttctagccccgtgacctaatcaccttcccaaggctccacctcctaatgccattagctttgggttaagattttgacgtaataattttgggggaacaaacagtcagaccataacagatggatatggaaagagatctttagggacaccgtagttgggatggttatatctacttagaggggctggacaaggctccttcagggagacagtgttgactttgagattcaaaggatgaatataacttctccaggtggagaaatgtacaatgaccaaaaacaatatctgcaaaactcatgagcagggaaaaatcttaagtggttacaatgaagaaatgccttgaaatagaattaatgaaatttcacctttaggtctaactatgacagtatctaacatttactgaggactactcatgtgctaaacacaatgctaagataattatttcatttaaaacaccaactagattataaatcacattttacaaataaggagcttgaggtacagagaggtttcccaaggtcactaattattggagaaaatgagacttgaacccaagaagtatgatggtaagactcatagtattcagtgatatgctaacaacaactgacacaaatagttctttctgtcagctatagttgtactttggtctccagttatataatttgaagatacttgcagtcatagttcaggctgctatagcaaggtaccataggctaggtagcttaaacaacaaacatctatttctcatggttctgggggctagatgtctgagatcaagatgtcagcatgatctgtttcttggagagggccctcgtcctggttatgttctcatttagactttccttggtgcttgcaaggtggcgagagagagagagagagagagagagagagaaacagagagaatcttttatctgctcctctttttaaaaggagaataactctattatgaaagattcatccttacgtcataattacctgccaaaggccccaactccaaatgccaccacactgaggattagcgttacaacatatgaattctgctggtacacaaacattcactcctcagcaatggggtaccgagagcagcatcacatgtgggactgtggttgatgatggtgataaagatactgaaacttatgctattcttattgctaaatcatgaccacactttacattttaatggaaaacttcagaatagatggcaatgtatattttcataataaaaataaaatctcttctggtaaatttaagtacgtattggtcagttgagtagtttatgagatgtctttccctatagatcatagaattttagtgaggccttagaacagggtttctcatcctcggcactactgacattttgtgcttaatgattctttgttgggaggggttatatactataggatatttatcagcatccctggcctctacccactagatgccagtaccagtcccccagttgagccaaccaaatatttctccagacattgccaaatatcccctgtagggcaaaagtcatcccaaaacccaggttgggaaaccacagatttagagaagtctagtataatcccctcaactttacccaaaaagagaattgacgtgctgtaagcaaggtcatacagctaaactgtggcagaattttgattagatctcaggtctcctgagcccaaaatcatatttcacatataacaaactgtggtgtcttccacttaaagcagtgccttcagaacatatgatttaaaaagtacacatatatcatccataacagctcggcagacaggtagaataaatgcaatttgatcagtggaaatgcatggtgcgaaaagttatgatttgtcccaggttgcctacctagcatggaagacatcctgaacacaagacttcagatgacagctctgatgctctttccaatatcgttgcttaccgcagttggtcaacatgagcttggtttgagaaaggagcaacagaaaagtttttggggaacatttctaaatcattgctttcatttccagcactctgaccctatatcttttgtaggcaaaataataacaatcgcctttttttttttaaattggtagagagaaggaagtcataatattcacatagatattagctatttactaacttgtgcctcggcataatttttcttatacttgaatgattagagaataactgtcctcaaaaacataaaatggaaagttacattactttatgttatggatgcctcatctataaagacgtgactaccagtgattcctaaagacttatagagagttataagtgaagtcatattccaaagcctctgctgtttgggatttttttataggtcactgtcatgtagtgatatgaaataaaaatatttaactatccgcctctttccattcatcactgcactgccgcaagtgagggctttatggagataaacgatctggctttgaacacacacctggcaagtcacaatggtaaaatgtcgaccctttctgagaagtgaagtgtaagcagttctgagcagacccaccagctacgatgctgcacatttggttgtttctcttttaaaaataaactcagtctgaaagtttaaattatgtatagtttgtatagtggcttacatacaactgtaagaatgatcaaaggaaaaaaggacaaggtttgtatatctgcatattaatgttttaattttaaaaacaggtagccctaaattaacataagatgtttccacaatgtttttaactgactgaattctgtgggcaaaatgtatgtgtgtgtctgtgtgtgtgtgtttgtgtttgtgtgcttgtggtgtgtactacctgaaacgaaagttggtccaataaaatgaagttaatatctttaaaaatttggaataaattcagaaatgttctatatatactccagacatttaagtaaagtggtatttaaagtcctccttacagttatcaagtctggaactggtggagcagtatgcatctctgaccattacatctaatgaatcaccaagttctattgacaatacatccaaaatatattccaaatctgctcactgctctccttcacagccgacatgagcgcattagccactgtcagcatctcattaggagtaccgaagttgcttcttaattgttctttcacatctacacttgctcccttctgattaatttggcccaaagcaaccagaatgacctttctaaagcgtaatatggaccatggcaccatgctttttaaaatccttcccatgtctttccattgtacttggaataaaatttcaaattctaaacacgaaacataaggtccagtgtgacttgccctctcctcccctcatctttactttcaccaccttctctcatcccatcttttctaagctccaagaacacccctccatgcatcaaacttttcccaactaaagctttcacacatggtctttactatttctggaatgttctttttttttttttttttgagatgaagtcttgctctgttgcccaggctggagtgcagtggtgcggtctcggctcactgcaacctccacctccagggtttaagcgattctcctgcctcagcctcccgagtagctgggattttcccataccttcatatggcaattttttattcagtatgcagttctaagcttaaatatcaaatcctcaatgagtctttccatgatttccccaaagtatcctggttattcgctgtcttagcattctgtttcttttcactgtaaccacagtcatatatgtaactctggaataactttgtgcatggttttgtgcatggtatatacccagtggctagttcagtgctgaggacaaaaggagggaaggagtgaaggaaggaagaacagaaggatagaaggatagaaggaagggagggagggagggaggaaggaaggaaggaaagacagaaggaaggaagttgccagttcttcttcccaaaggcaaccaggattgcaattgcatgccaaaatttaattgttctaatgatttctgaactggttttgcagtgtttgtttgtttcgctttgttattctaaaccttggctttcgtcaacattagaaggaaggaattaagaaaggaagaatagaagttagaagtgggaagttcctgcatttaggattctaattctaaacttatttcttttatttttattagttctccatacagagagtagccctgtatacaacaatcattcctaacttgataactgaacataggccaatagttttcagtcttccatataaagttaaggcaaatattacgtgtacataacagaacctattaaaatagtcaaatctattatgtagcataagattatgtatctgtttatttgatttgactttttaaaaattaattcatcttttttaacaggtaatgctcttgcatggaacataattcaaaaattatgaaaggatttacaatgaaaagtctatgtgccaaccccagctactcagtttttctccacaaaagcaaccaggatttacaattgcatgccaaattttaattttgttttaatgatttctgaactggtttagtagtttgtttgtttttgtttattttgctttgttattttaatcattggcttttgtcaacattggaatagttgccttaatggtaactactattacataactcatgtgagtggaacacgtgtggttataagaattgtccagcatgctggattctattacacagttatttcatttccaaatatttgtctttcttgtaaaacagtcattatcaaatgactttgcttttacagccaaatgaggagacagttcttggatttaaagaactttgttacaatgattactcaagtacttagcagaaaatttttcaagcttttattccaaagactctcttttagaaaccccagccagaaattccaaattttcccagtgcataagtcacatcatggcaaattaggtcttcactttctcttttctgtaaaaagttactaactccctaatcaagactttgttctgacgttttgattggtctggccttttcaagtagattaaatgttattgattttaaaaatagttttcaacagattctttgtgagtggctacttctagactggcctaaagagaaaggatgacttcactcaaaagttcataaaaggagaatactgacagtcagcctttttgttcataagttgatttttaaaaatagaaatatggtaggacaaattgttgaattatttctttttactggaggctgtgggtatagtgatgaatcttcaagttggaagaatcaagaaacaagcattctgttgtccatacttggtatctctttttgtgatcttgtgttattcagttgacccattggtgcctctgttttctcttctttaaaacaagaggcatgaaccagattatctcttagaaactcccaggtttaaaatcctattgaatgaaaaaaaaagaaagaatgaactaaagccaaaaatttttaataagtttgaggcaaaagactggtttgcttttcccttatttgatatgaaatgcacatcatacaattaatattttgatctcactagagtctaatagaaattacagtatcacatcttgtcaaacacagaatcttggcttcacagtaattcagaggtcaattatttatacaaatggagttcaagttatagatttaattttcagaccaaaagtttctcacattaaaacccacttgcttcagttcattttgcagatacgaaatatgttttcttggtattatgaatctcttgttttaccctctgtttcattatgtaatcaatggatgtgaaaaatgaaggtgtcatgaaatgtcagaatctttaaaaaaatcttcaaaattatttaactgctatttaattgaagaagtttttcataggtattgtattaaattatatttatttatatctcatcagagtaacagtattacagctctgccggaagcttatattgaaagagaaatcacataaattctcatgtagcatatttgtaaagaaagaatatgttgacaactttctttttggtgacacgtcaggagttgtgagggattgaactgcctgcaattattgtttaactacatgaaattaccatttaaaaactgtccactaaaaaaataccaaataaatttgtagactcatagcaggagacattatactttattttttaaaatagctgaacttttggtaagacggaaaattccatgatttgccataaatgtataatttatctatagagaataattgtatttggatatagtaataaactctttatggagtgtgctgaatctacaaactttcaggaactttgattacaaggaccatcagagaaaggagaactgaaattttacgttacaaaattgctctacccaaattttcaatcaattgttagaataagttcaatgttgggtcatttttgtattttatgcttcaaagaaaatgaccattcagtgattcatctgggggcagaatatcagagtggttaagaagatggggtctggagccagaccacttggtttcaaaatgtggcagtgtgttttaagaaaattactttaataccttgatgttcaatgcatccatcttgaaaatgttggtagccttcatatttaacttatgggattgttgagaagataaaataggcgaatatgaataaagatggaagacctacaacagtgtcaacatctcaagaaatgttagttgttgctgttgttgtttttattagtattattcaagaggatgtgaaaattgaagttttgtctgatgtgccaataccgtatatgataattgtcatatattcaagagagtatgagactgaatagctgggaggaagcttcaaagtggataactcaaaagaatcttcatgtctttgaagacttcacccactttgagaatataaacgaatctagaatggagaggcagagggggctggccaaatttgttgagaaagagctgctgcagtgtatcccatatccttcaggtggggtgaggcagaccttttacacctgacctccaaagggtggagaagtcagtgggaccactcagagaggttaatgagcagtgtactgatgcctcatttatacctgtgagagttaaagcatgtatgaacaaggggaagagagagaaagagtgagaataaagggccacaaaatgatatccctgagggctagaggaaggcaagaggagtaaaagaaagcatgagtgtttctcacagagtaaatgtgagccacagggaaaaaaagaccatctggagacattttaagaccttcctggccaggcgcggtggctcatgcctgtaatcccagcactttgggaggccgaggtaggcggatcacctgtggtcaggagttcgagaccagcctggccagcatggcgaaaccccagtgctactaaaaatacaaaacctagctgggcgtggtggtgtacacctgtaatcccagctactctggaggctgaggcaagagaatcacttgaacccggggacggaggttgcagtgagccgagattgcgccactgcactccagcctcggcaacagggcgagactctgtcaaaaaaaaaaaaaaaaaccttcctaggaatagactctccaggtaatgtgggtccttagagatgctagttctaaggagacagtgaccatccaaatgggaggctcacacaatcacaggagttgggtgcaagctggggaccaatgacaaacccacagaagtacccagcagtgaaagatttatttgtagacatttgccgttcaccaaccaaataagaatagttttgccattatgtctctttctttactcctccctgcctctgtgttcctaagtgtggatatgacagggcggggaagctggtggtctaggtgacccattataaggtgtatcaaggacaaagggagatctctgagctttgactgacaattgaaatgttcatttgcgtgatcttagactggacactacagtgctacttataccttaaagtctggctggctatagagcatggaatcatgggaatttctgagttttcttcaagtgacatgggcagtttatccccattgactaaaactaatccttaaaaggaaagaagcccaaagttcccataagtttgaaatgcttatgctgttctgctggtttgttacaacaaaagaaaaagcaatcataaactgcatatacagagcacatgaataaatgggaaggatcctggcctaatacagcattactaaactaaatgctcatatgattcagtgcctaggctaccacatgaattaaaaatgaccttatgtaatgaattaatttccaaaataaatagaacaaagagaaaatcatcttagcatcttcttaccttaaatgagtatcggagaggtcaataataagacatgacattgtttccaaattattaaaatgatttgaaaatatatttcataaattgtaattataagtaataataatgtgcaaactctctactggattttatatatacgcactgtgttcaacattttaactattattttctgtcctgtttttgaaagttagatccaaaaatgcagtattgattcagatagaacataccgaaaaatatttattggttgatgatagcactggttcttgcacatggaatatatattttattttattaattattttcatttgtttatttatttattttttgagacagagtctcactctgtctcccaggccagagtgcggtggcgtgatctccgctcactgcaagctccgcctcccgggttcacaccattctcctgccttagcctcccaagtagctgggactacaggcgcccgccaccacgccctgctaattttttgtattttttagtagagacggggtttcaccttgtttgccaggatggtctcgatctcctgacctcatgatctgcctgccttggcctcccaaagtgctgggattacaggcgtgagccaccgcgcccagaatatatattttaatactaagttttgatttatttttgcttgattttaaatgaggcagaaatatggaattcatatacttgcttgtagataaaacatgttccactttaaaaccatgaaacgaagtttactttctttggggatattttaagtgttgaacctagaactctaaatcttgagggtcataaatatcagtcaaaaatattttcattataaataattatcttcagaaatactcttaatatcagactttttaaaaactaacaatgctagttttatggtgtcaaattttgtatttttaattttttttaagggacagggtcttgctcaggttagagtgcagtggcataatcatagcttactgcgacttcaaactcctaggctcaagcgatcctcccacctcagccttccaagtagctattactacaggcacgcactataatacctggctaatttttattttatttttttttggtggagagggagtcttgctatattgcccaggctggtctcaatttcctgtcctcaaggaatcctcctgcctcggcctcccaatgtgctggaattacagatgtgacccacagtgcctagcctgtctttttaatgtcaattatagatatcttaaaagaagtttcctattacattttaataaaatgcattatttattaattagtgcttgagggatacaatattgatattgtctgttggaaggccgactaacatgttaaaagatagtaatagaaaacctatggcagggtgcggtggctcacgcctgtaatcccagcactttgggaggctgagtcaggcagatctcttgaggtcaggagtttgagaccagcctagccaacgtgacaaaaccctgtctttactaaaaatacaagaattagctgggcatggtggcgcgtgactgtaatcccagatactcaggagactgaggcaggagaattgcttgaacccgggagacagaggttgcagtgagccgagatggcgccactgcactccagcctgggtgacagagtgagactccatctcaaaaggaaaagaaaaaaaagaaatagaaaacctattttagaactacagaaatttcacccaggttgaactaaatctagcttacttttccttaatgtactataagagaaattttgttcaaaaaataataggttctcttttattatatattacattgtcttatcttctttgatccaacttttcatataacttaattgcagttaaaccttattgcggttccatgaccatagaattctacctttcaatttttttaatttttttatttttataaatttaggggatagaagtacagttttattacatggatatattgcatagtggtaaagtctgggcttctggtatagccttcagccaaatagtgagcattgtaccctatatagcctccacatattaaattcatcgttcaatattaataaatttactatgaacttgttaatcacttttagaagaaccaatatttaaaaacccaactgtaaagaatgatagaactgtaaagtaataataatgagcaactgtgctttatacactatttcgtgtctattacttctttttttgtttgtttgttttgagacagagtcttgctgtgtcgcccaggctggagtacagtggcacaatcttggctcactgaaacctctgcctcctgggtttgagtgattctcgttcctcagcctcccaagtagccgggattacaggcgcccaccaccacacccaactaatttttgtatttttagtagagatggggcttcaccatgttggccaggctggccttaaactcctgagcgcaagtgttcagcctgccttggcctcccaaagtgttgggattacaggcatgagccaccatgcctattgtctattacttcatttgaccaactttggccctcctcctagccccatatggcaggcattttcataatcccattttacaaatgagcagactaacattcacagtcattacgatactttcccaaagccatgtagctagtggacggtggagcatacactgagactctgttctgcggaaacctgtccataacatcccttccttgctagcaatatatttatagtgagaaaacatggacttgagcttcagatttagtacttgatacctatgtggaattagagccacgtttttaacattaggtcctccccttgtaatatggagatgaaataagaatttctttgggttcttgttaacgaataaacaagttaatgtattttttaaagcactttgtattagtccattttcatgctgctgacaaagacgtaccctaaactggacaatttacaaaagcaaaagatttaaaggacttaaagttccacatggctggtgaggcctcacaatcatggcagaaggcaaggaggagcaagtcacatcttacgtggatggcagcaggcaaggagagagctggtgcagagaaactcccgtttttaaaaccatcggatcttgtgagacccattcagtatcacgagaacagcatgggaaagacccgcccacatgattcagtcatctcccaccgggtccctcccacaacatgtgggaattatgggagctacaagatgagatttggctggggacattgaaccaaatcatatcattctgcccctggcccctcctaaatctcatatattcacattttaaaagcaatcatgccttcctaacagtcccccaaagtcttaactcattccaactttaactcagaagtccacagtccaatgtctcatctgagacaaggcaagtctcttccacctatgagcctgtaaaatcaaaagcaagttagttacttcctggatacagtgggggtacaggcattgggtaaattcagccattccaaatgggggaaattgaccaaaacaaaggggctacaggcctcatgcaagtctgaaatacagcacggcagtcaaatcttaaagccccaaaatgatctcctttgactccatatctcacatccaggtcatgctgatgcaaaagatgggccaaatacttagagccaactgattgtttgacaaacccaacaaaaatatcaagtggggaaaggacaccctatttaacaaatggtgctgggataattggaagccacatgtagaagaatgaaactggatcctcatctctcactttatacaaaaatcaactcaagatggatcaaagacttaagacctgaaaccataaagattctagaagataacaccagaaaaacccttctagacattggcttaggaaaagacttcatgaccatgaacccaaaagcaaatgtaaaaaaaacaaagataaacagatggacttacataaatgaaaaagcttctgcacagcaaaagaaaaaatcagcagagttaacagacaacccgcagagtgggagaaaatcttcacaatctatatatgcaacaaaggactgatatccagaatctgcaaagaactcaaacaaatcagcgagaaaaaaataatcccatcaaaaagtgggctaaggacatgagtagacaattctcaaaggaagatacacaaatggccaacaagcatatggaaaaatgctcaacatcactagttctcagggaaatgcaaattaaaaccacaatgcagtaccatctcactcctgcaggaatgttcataaacaaaaaaataaaaaaaaaatagttgttggcattgatatggtgaaagggaacacttttatgctattggtgggaatgtaaactagtacaaccgctatggaaaacagtgtagagatttcttaaagaaccaaaagtagatcttttgatccagcattctcactactaggtatgtacccagaggaaaataagtaattatatgaaaaaaagatacctgcacatgcatgtttatagcagcacaatttgcagttgcaaaaatatggaaccagcccaaatgcccatcaatcaacaagtggataaagaaaatgtggtatatgtatgctatagaatactactcagctctaaaaaggaatgaaacagtggcatttgtagcaacctggatggaattggaaactattattctaagtgaagtaactcaggaatggaaaaccatacatcctatgttctcattcgtatgtgggaactaagctatgaggacgcaaaggcataagaatgatacattggactttggggactcggagaaagggtgggggttggtgaggaataaaatactacacactgggtacaggatacattgcttcagtgatgggtccaccaaagtgatgggtgactcagaagtcacctctataggatttatgtaaccaaacactacctgttccccagaaacctattgaaataataaaataaaataaaataaaataaaataaatatataacaggaaaaaaaattgctttttttcccagttacaaatatactcacatatattttaaattttctaaattcttcttttcactctgagcttttctatgtaagatttatttttgtgtctagtgtagaaatatactttttattgattttaagtgacaaataataattgtgtatatttttgaactataatgggatgttttgatctatgtatacattgtacaaagagtcactcaagctaataaacatatccatcttttcatcaatttaccatactattgtggcaagaacattaaaaatctattccgtctgccagtttccagtttgaaatacacactacattattaactgtggtcaccgtagagtgcaataaataactaaaacttttcctccaatttaacagaaattttattacctcctgcccccctctgcagcctctggcaaccacctttctactctgtttctataaaatcaactgttttagattctgtgtgtgaggtcgtatagtatttgtctttctgtgaatggcttacttcacttagcataatgtcttccagttcaatctatatagttgcaaatggtagattttttaaaggccgtataatattccattgtgtatatataccacattatctttatccattcatctgttgatggacacttagtttggttccatatgttggctactgtgagtaatgctgaaataaacatgggagtgcagatagctcttcaacatgccaatttcaattccttgggaaatatacccagaagtgggattgttagattatatggtaattatatttttagttttttgataaacctctatactatttccaaaattactgcactagtttacattcctgccaacggtgtacaagggttgtcttttatccacacacttgccaacacttgttatcattcctcttttgataatactcattctaacaggtgtgaggtgttattccattgtggtttcaatttgcattttactagtgattagagatgttgagcatttatttcatgtatctgttggccatttgtatctcttcttttgataaatatttgttcagatcctttgtccatattttaattgggttatttgttttcctgctgttgagttgtttgagttccttatatatttgggatattagcctgttattagatgtatggtttgatgcaatcctatctgtcttgtttttgctttcgttacctgtgcttttgtagtcctatccaagaaatcattgcccagactgatgttgtggtgtttttcccctatgttttctgcaagtagctttagagtttcaggtcttacatttaagccttttgttcattttgagttgagttatgtatatggtgtgacatatacggtgttcagtttcattcttctacatgtggatatccagtttttccaacactattttttttggagaaatcgccatttccccattgtgttttcttagcacctttttgaaaatcaattgttcataaatatatgggtttgtttctgggctttctatcctgttccattggtcgatgtgtctctttttttgttttgttttgttttgttttgtcgggaccatactgttttgattacaatagctctgtaagatattttgaaatcagggagtgtgatgcctccagtgttggtctttttgctcatgtttgcttttgctttttggagtctttgctggttccatatgaattttaggattgctttttctatttctgtgaaaaataacattggaatttcgataagtacaccaaggaatctgtagatcactttgggtagtatggacattttaacaatattaaatcttccaatctatgaacatgtgatatctttccatttatttgtgtattcttcaatttctttcattcatgttttacagttttcagtgtacagatctttcacctctttggtgaatttacttctaagtattttactgtttttattgctattaaatgaaattattaatttctttttcagatagctcattgttactgcatagcaatgcaacagatttttgtatgttgactttataacccacaactttactgaatttaagtatctcgattctaatagattttggtggaatatttctttaaggttttccatatataagatcatgtcatcagcaaacagactatttcacttcttctgttctcatattgatgccttttatttatctctcttggctaattgccccaggtaggattttcagcatcatgttacatacaagtagcaagagttggcatccttgtcttgttcttgatctttgagaataagctttcaattttttatcattaggataatgttagccgtgggtgtgtcatatatggcctttattgtgttgagattcatttcttctatatctactttgttgagtttttttttttaaccatgaaaggatgttgaattttctcaaatgttttttctacatctattgagatgattatatgatttttttgttgttcgttttgttaatatgatatatcacatttattgatttacatgatttttaatttacatatgttgaaccatcctttcatccctgggaaaattcccacttgatcatggtgaagtagtaatacgtctttgtattttatatatatacacacatacatatatgtgtgtgtgtatatatatatatataatatatatataatgttttgttctagaaacttttattgaatagtttatcttttcttcccttatttttgtgacatttttaacacttaagtttccatgtgtggatctgatcttagattactaaatttattttattggtctatttgttcctgtatgtataccttactatatttactaacaaacagttttataaaagaaatttatggaaatcttgttatctgctagataacctcttgtttgttatcttaaatttatgttctattcttgactttgctattaagtgtgaatcttcggatctgtttatcaaaatctgtgaaaattcctactgaaatttattttttaaaaattgattccaatttatagataagtttagagaatcatcacctttatctttataattctgagtctttttatccatgagcatggtgtgtgtgtgtgtgtgtgtgtgtatacacacacacacacacacacagatatatattttcccattatttaggcctctttacatcttttaatattttttaggtttaaacttctcattcagttaatcaggtcctttttttttcttttctttttttttttgagatggagtttcattcttgttgcccaggctggagtgcaatggcgtgatctcagctcaccataacttctgcctcccgggttcaagtgattctcctgtcccagcctcctgagtagctgggattaccgccatgcgccaccagtcccggctaattttgtatttttagtagagacagggtttctctatgttggtcaggctggtcttgaactcccgacctcaagtgatctgcctgcctgggccttccaaagtgctgggattacaggtgtgagccaccgcgcctagccaggtcctcatttcttcatgtgtgaattgaaaataattattttttctctgtatatttacagatataaatttgaagataaaattaaatgatgcttatgaaccaattacataaataataaggttttgtgtttattattttttaaacagaggtatgggtgtattttatgcttaatagtacatcatgattatctagattctatttaattattctctttccccccagtgtaaaagttaggatcttataattatttaaggtaattgttattcttcaacattaagaaaatcattgttgtgtttaatgatgtctggaatgctcagtaaaccatgattttttattaatcttatgcagtctttgattaatgagaaatataaacgatcatttagtcaattatttattatatcacctactaggttgctaagcactgaatcagttttaagatagttgtcttcattcagggaacaaaataaaagatggtaagaagttttgagggcccagtactgatcaatgttcttttaagtttagcagtctacagactttactaaatgtggaagttttaaacattattttattattgctgtttttttggagaaaaaaatgattccaaattttcttcttttttttttttgtggttgtaagtgacgtgaaactataggatttatttttccattggcttcttttaattaaacattttaataacatgtattatccaaaacttgctataccaactatgtaatcacctcttccttctatttttatgaatatactatctgacgactaaggtgatatcagaaaattttcactcaaatgaataaaaaaaagaatgacaatgaattgaatgtatatgcttcagtagataatttataaagaaaatttaatactctaggaatgatgctatacaagctggcgtgtcaaataataaataattttaaaataggacaaggaccttcatacactgaggaatgatataaaaatacaaaaatattttaattgtttaaaataagaacttaaatctaaaggagatacttatgatgtctaaatatgaaattctatactcaggttgaaaaattatattctataaaggcagactgaagtatattaatattgttagcagttagttgatggtgaccgtatgtaagttactgtgttgagttaaatattttatgactatgtagcccatatgaatggaagacatttgagtaaaaagagtatatttcttgtggagtctacattggtgcattgtggtaaaatataagaactactttttaagaggggcattgattaatcaaactgcattctgacataagtaactgggttgataaaaacaatctgaaaactctcacatgaaaatggattgaagggctagaagatattacactgaaaagataaatctggtgcaatggacaaatcagtttgaatacttgagtagttgttatatatgggaccaaattaagttttatttactccagaagaaccactaaactgttaaagggcaggtttcatttcaaacaaatttttttagccaattaaattatctaaatttggtaaagtctcatttgtaattagtagaggagcttcctaatttgagtagaagactgaactaggtaactgtcagccattatttaacaaatatttatgaagtacatacaatatacaaggtgttaaaaaattataaagaaagatcactgatccttaatggtatgtgattatagattttaatctataaaggaaatgtttcttgtagctatttgatacatataaagtttagagtaacttcgtaataattaatacattgcatatatcaaatagtgatcagtgtatactaattatacagttctccaccaagtagggtaggtacagacatgagaagacaagacttgattaaattttaaaaatggattcagtaattggattaatttgtttagagcaaaggattttcttaggtggaaaatgagaaaaatgatctaatgaagttgtgcttcaagagaaacaaagtgaaagagagctggagtcccagtgtgacccctagaccagaagcatcacctgggaatttgttaaaaatgcaaattcctgggtcccactccagacctactgaatcaaaaactcagtgttggcggggtggagtagcaaggtgtggtttaacaagcccttcaggtgactgtgattcatactaaatttgaacagcagtgtagactgctgttgttgtgaagaggagtttacatatgatttgtttagatataatttggaaggcaattcatggtcactgcacatcagtggaaataaaggatgcagatgctatggcttcaagtagtaatatattgactaacttatgtaatgcataactctagagaacattttaaatagcacagtgttgaaacatttgaaacaaatttattgatatagttttttttaagttaagttttacatctaacatttaaaatgatagaactaggtatagctggaaacaatgcctgtttattttcttacacagagaatgaattctttcttcccttaaaacagtgttgggtaatgttccagaaaagtaattacaggccagttagtaaatatacgctgagatagtagaatgccagatagcaacagctatatgtctgccactactggttaatcagctacagaacagactgattttttgacttaatatggcatagggactccattaaggacagaatctgcatcttaattactgaacatatcccccccactgttttcatctgtatttacgtatgttttctttttttgttgtctaatagaagacaatcagggttgtgcacgatttacaaattgcttcttcacctcctgtcttcctcttctattcaataggcttgtcaagctataagagattatgaaatttggggtagttagaaatcacagccaattcaatctcatttccacacaaaccaaagagtaataaattactttattgtagcagcttattgctttgaacctaaattacagaaaaatagcttggaaattccgtaacaaagatgaaatagtctatttgtgtaggcatacttcttacagtttgtgttaactctcagctctagcacattttatatgatatttggatatattggtttggaaggagacagtcatgatctgatggtctttctgattttgtttctctctaaccttaattgctgaacctattaaaaaccccattttaggtttagctgccttagattctaggattattcatgtgctaggtcaggaaaatacagaagctctatgtctggaaatggaagagttgccattgactcaaccttgctgcttatcctcttcttaccttgtatttctgttctgataattcaattcttgccttgtcactgatgatcaggactttccctcatactcaacaattgctctagagctctgctttgattctcagccttctcctctgttcatttcaaaaacagggaattattttcataatcttcaatctttctgtctccccagacacactgaccacatgtctatccaaacaggtatcagatcatcctctttccaggtaatctgatttgattttcctcatatacctcggggcatcctgctttgggatgtgaaggatttgtgtaaacatcttttgttgactgtttgttagaaaatttcttcattgccagctattggtaccctgctcagatgttcttaaccttcaagcacgcctatttttccagctgctaggagttttgggttataactcacagctaccaccatcacaacccctttctctggagtattatcttaggccagtggtcctaaaacattagctttcatctgaatcacctagggggcttattaaaacaaaagactggactcagagtttctgatttagtaagtctagggtggggcaagagaagttgtattcctaacaacttccaaagtgatgctaatgctgttgctctagataacacatttcaagggccattcctctaatctaaataggagcttattattccctgaaggctctttgtcctgtctctcctcagggtagaccacagtgagtgactgattgccacaagcttatacaagttggacctcttacctcaaagtgtaactatctacattgtttcatttgtgtttgaaagctgcctagtgggatcagaattaaagggtcaccatcagtaatgatattctggctaagcattcttttctaccctatcctgcttcttccactctccttctcctgaaagtactctcccaataaattacttaaataaaatctccatctcagaccatacttctaggagacgtgatatgagacttatacctgtggatctatggtttctggtctctttaattcaatctatctattcaataaacttgcattgaatgtctttgaatgtcccagaaagcatatggtatatggaagataattaagatccagtttctttaccaagcaacccaccatttggttcaagggtagataagcaaatgtacaattatagcagcatgattgatactatgctacctcagtgctgataatttgaggtcctgactgctttcatctgagctttggagagtgtcacatgcttgattctctgggacagagtctctgagatggagatttgtggatagaaggtttatggggaatattcttagagataccagtgaggaagtgagggaaacataattgtgcaaatggagaggctgggtgagagctcaggtgaaactgggaggggctctggagatggaatgtcccttcaaatttgtccagaattaaggaaagagatcgatcactagatgcaggctgcccagtaagaggagcataacattggaagaaataactctctttggctgagagatgcttgaagaggatacatacaatacacacaataaaagttggtccctggagagccttgcttgtgatcatctcagtaatatatactggcttcccaccagaaaaccatttatcctattcctcccaacaggaattttaattgagtttgctcttaagcactaaatttctcagatatcccaaatgctaaatgcaagccaaacctgagatttcctgaaaatatatcctgtagacagatgtgagagtgtttcaaaccttattgaaattactctgaggagcaatgcagcaggtaacaaatctgacacacagcaatctttagaataaacatatgcaggcccagagttcagaggctaaagtcaatttaatgagaaagctgtcactattcttttttacatgaattaaacgtattccaagttgcccaagtcacggcctaacagtaaagagtctggctgcagagctgagcatttgttttatgttgttctcagggtcacttaaaaatgaatgtgagttacctggattgaacagaattctatttagtgtattctaatatgtggtgataaaacttgggaacctcagtaaagggaactgatttgaatgtaaaattgtttattttgaagtacatgtatgccaaacactgaaattttctattgatattgaatatctatcaatattcaatattttccattaattctgttgattctatttgctattgaatattgatataacaccatttagtttgtaaagagaaatataaaatcttaatgaataaagggaaaactattgataagtcttcatagagttaattatacactcttaagacattagactcaagtaacttcatacctactgagaataaatgctggaaaaatttacaagttttattttccatatttagtgccagagagccagattacacacacacacacacacacacacacacacacacgaacaagaataaataggttcacatgtttccttgcagtaaagtctgtcctgatgggatggactctgacaatattatgaatgagtatgaaataatagcaaacttggcctctagaaacaatcttccctctgaaatgcgtgttttaaattacctcatggcaaggccagtgacattcaaggattgggaatgaggttagaaaaatggaaatgattctccacttctgggaaggtcttttgcctgattaacgttatgtaaacattttgctgaagaaagaataattctgcactttagccaccaaatcattatagaaaaacaatccagttttatgcctcctgtgctccagtccaagggtcagcaaactatggcccttgagccaaatcctgcttaccacttatttttgtaaatacgtttctattggaacacagctctgctaatttgtttacatattgtctatggctatttttgagctgccatggcatggttgagaagtgcaaccaaaaccatatggcccacaaaacctaaaatatttactatctagccatttacagaaaaattttgctgatccttgctctattgtgttttagttctgtgtatcccaggtttactgataagaattacctggagtgcctttcaaccaacagcttcttgatctcctcctttggagattctgattcggtgaatctgaatgagacccagaaatttctacctttagcaagtactggaactttgggaaataccaagctagttatttgactctccaatattctagcataccattttttatgttcaaaaagtccacattcttttcttcaaattcttcctcatctccccacataaatgcaaggtatggacgaatgtattgtacaggattgtcacggataaggtcggctagaagcagtttgtgataatgattagggtgtatgttgtttgttgagggagtactctcaggagtaaggaagttatagaagcagtataggaaagggcgataaagctacagaatgtgctctcattacacatacaccatggaatactatgcagctataaaaaaggatgggttcatgtccttcgcagggacatggatgaagctggaaaccatcattctcagcaaactatcacaagatcagaaacccaaacaccacatgttctcactcataagtgggagttaaacagtgagaacacatggtcacagggaggggaacatcacacaccggggcctgtttggggggtgggggactaggggagggataacattaggagaaatacctaatgtaggtgacgggttgatgggtgcagctaaccaccagggtacatgtatacctatgtaacaaaactgcatgttccgcacatgtaacccagaagctaaagtattaaaaaaaaaaaaaaaaaaagaatgtgctctcagctggagacatgcttcagtctgatcccatggggacctctgcagcataaattgaaccacagagttgatcctgccttcaggcaagagggctggccttttgagcactctcttcccattgccatcagttagttatttggatgcagggagtccttgaacaggggacagacattagcagcaatcattgaggcacaagtacacctgtggtaaaggcagaggaggggagaagtatagcatctggtgcagaagttatacccccaaatgaatgaaatttagacttggaatgtgccctgaagaaagacctatctacaagagtctttaaaagataattttgaaatatgttttcaagttagtaacccttcggaagtcacaaatatatttgctagaactgatacctatcatctttgaaaagtaagaggaaaatatgtatcagagagaagtgacttttccggttaataatcattgcttgttgatacgtgcttttgactaggtatttagtaagatcttttggttatgtttacctccattaggatgatatgagttccttatgaatttaaatgcatgtgaacatttcagagtcccacctggaatgcgactactgtcagacaatgtattctctctagcccctaacatttcatgatagattcactacagttgtagaagaatccttcaataaaagttatgttatgggaatgtaaaacaaagtttaaccttccataattatgatttactttccaaggaataatcatacctaccactacttgcttatcctcccaacctgcaaggtaggcatcaattacccaatccttacccaaagtcacatgtctagccaatggtggtgtcgaatattctgatgaaagagttctattggccccgctaaagagttgtggggttttttaaatctttaactcaagttgtttcagtgaacctagaactaagactttttcaaccactcccaaattattgatgcttgggttttgcaacaaatgccctctaagctctcaggataagttgggggaggaaaatgaaaacataatagggtaagggttgttctctaactattcccagaccagttctcaccttcaaactgctctctctctctgaaagatgagcaaaaaaaaaaaaaaaaaaaaaaaaatgtgacctcacaaaaggttgtgtgacctcaaaacctgccaagagtcctcagtgcagcccactctgaagacagtggaacaactcaggaaagaaggtagagtattttatagaccctagagtcttatctcatcccattctgctttctgtcttcttgaggcacagttggcttaaccttttcttgaagtgaaaactatgtgaataagaatattaacccccaaacaacttaaaagcacagtcaaccgcttcatcactggtcattagagaaatgcaaatcaaaaccatgagataccatctcacgccagttagaatggcaatcattaaaaagtcaggaaacaacagatgctggagaggatgtggagaaataggaatgcttttacactgttggtgggagtgtaaattagttcaaccattgtggaagacagtgtggcgattcctcaaggatctagaaccagaaataccatttgacccagcaatcccattactgggtatatacccaaaggattataaattattctactataaagacacatgcacatgtatgtttactgcagcactattcacaatagcaaagacttggaaccaacccaaatgtccatcaatgatagactggattaagaaaatgtggcacatatacaccatgaaatactatgcagccataaaaaaggatgagttcatgtcctttgcaggaacatggatgaagctggaaaccatcattctcagcaaactaacacaggaacagaaacccaaacaccgcatgttctcactcataagtgggagttgaacaatgagaacacatggacacagggaggggaacatcacacactggggcctgttatggggtgggggtctaggggaggcatagcactaggagaaatacctaatgtagataacgggttgatgggtgcagcaaactaccatggcacatgtatacctatgtaacaaacctgcacgttctgcacatgtatcctagagcttaaagaagtataataaaaaataaattaaaaaaacaaacaaacagaaaaacagctgacaaaacagaattgcccagcgtaactgtatttttaagttagcagcaaaaatagaattttgattttatgtcatgtatattgggaaaaaggagcaaatgatatgatgtcagttaaaagaaaactagcatagttcaagattttcccatgattctcctatgaacttgaaattccaaaccaaacccagctgagtccaaagccagtagtgctcttatcaactttccatggcaatgtcttacaattctctttaggctagggccaggggaagaatccatggaattgaccacttggcaggacattaccaaggtaggggtggctatagagatttcagccgaaccaccctaggggatgaagcaagaacacaatgaccggggcagctccaggctcacctcctccatgaagcttttccttctctctctaggtagattaggtgactgccttcttggggaaacattaacatgggttagataatatgagctattcctatatggcaacaagctaggtgaggaaaatgaagatacgatgcatctatcccatctctccagcacccaggacagagccactatatcctggcatgctgtagcacagagtagagagccctgcagcatttaggcacattgaacatacttgttgatgatattctgagccctctttcctttaaatcattgttgagtattttctgggtcaactcacaatataaaacccctgtcataaacattcaaaaaacttgataagctaccagaaatgttcaattaaggaacaaaaagaaactgaagagcaacaatggacacctcccctcctgaactccaccagagaacttcagtccatttaaaagatgaagccagttttaatctataatttatgtcaaatttcactcttaagtcacaaggttaatatttttagtagaaaatgttgattataacagaaactcaggtatctcatatgcacatactcacggtatgattaaagataatcaggtacaattttactatgagattggacaatgtttgaagaatatcaatactgttttagtgaaaagcagatcaaagtatgaaattaaaaatatctttagaatagtaatacttaaaagaattcagtaattggaatgcttatccatgttttttaatcactctgttttaaatctgactttcagttgtttcaaaatgacaggttatgttgattaggtaaattatattagcatttatttgtatttaatttctacatttcctgttaccatctttttgcccacttttctattggtatgcaccttcttttttattgtatttatttaaggtatgcaacatggtgttttgatatacatgtacatagtgaaatgatcactatagtcaaccaaattaacatttaccttcccacatagttaccttttttgtggtaaaaagggcatgctcattcttatctttttgattcatataaatgtcttatatgtcacttatattagcactgcaatacaaatggttgttttaaattgatcttctgccttaaaactttacttgaaaaattaattaaaatacttttttcagataaattctgtctttgaatgtctgtttcagaaaggtcatatttatccaagaggagacaaatagccacctacattttctcccagtgctcttaaaattaactgcaatatatctgaatcttttgtggcaagattatctttttccttctgtttttctcaaatgagtaacacatttttaacccaattttgagtgataaatcttttttgcattgttttgagatgctatttatagtatgtaacaaattcttacgtatgcttgatatgcttctagactttctcctattttgacatctctgttcttttttcaacaccacatcaggaccattcttttcgtgattattacctcgatttacattgtgatatctgctgcttcaggcctattcaaactttcttgacgatccttgcacatttaattcctctagactattttggcatgagtctaataatgtcattgggatctttattgagattacattaaaatattttgattaatttaggaacagctggcagttttacaatattaattttccattcagaacatatgctttctctatttttcgaggcttttaaaacatttctcactgtaaattgttatagttttcttaatgcagatcttgcacatttcttataaagtttattcttatgcattttataattttgttactgttgtaagtaagttttttggatcatatttctaatttttattcctgggcatataagaaagctatagctttatgtatacagtgtctattttcagactttttatcagaccggatagaatgaggatcttaccaatttcagtgtgggtataaatagaatattagcacacttgtacattccctatgattttttaaaacagtatttcctttgataatgagttattcctgagaactttacatataactctgcatgtttgttttgttttgttttgttttttgagaaagggtcttgctctatggcccaggctggtgtgcagtggtgcgatctcggctcactgcaacctgtgcctcccgggctcaagtgattctcgtgcctcagcctcccaagtagctgggattacaggcactcgccaccacgcctggcttatttttgtatttttagtagagacggggtttcgccatgttggccaggctggtctcgaactcctggcctcaggtgatctggccaccttggcctcccaaagtgcagggattacaggtgtgagccactgtgcccggcgtctgcatgtctttttgtgaatgatttactttacttcccatctgtggctgatgggacaaaagaaaaattaagagcaatgtgattaatgctaagattgaccaacagtttttagaaaattaaactgcttccacatgagataattcatgttttctagatactttatcttccaacaagtggtaagtaatgaagtagataaacttcgttgtcactatgtttatatttcaagttttctgaatgaggcaggcggtgtaatgtgtatatattattattattgtttttatttttgagacacagtctcgctgtgttgcccaggctggagtacagtggtgtgatctgagctcactgcaacctccagctcctgggttcaaatgattcccctgcctcagtctcccaagtagctgggattacagatgtgcaccaccatgcccagctaagttttgtatttttagtagagatggggtttcaccatgttggccaggctggtctcgaactcctaacctcaggtgatctgcctgcctggggctcccaacgtgctgggattacaggcgtgagccaccatgcctggccaatatgtatatactattaattaatatgaagatattgttatgcttggatgacacccttcctgttgctgaggcaggagttacaaataaaacatagctcttcggtctgctcccagatcctcctcactgtactcttgctcacattttgtccctgacagatgcctaagggccactgaccactccctcaggaaatctctgtagctatacaagcagcaggcatagaaagaaatgaattgtaagctattcttctagcactctaattagacttttcagtctaattgcaggagatgaaattgaggcagatcaaattctcaggatgactagatttgagaatcattacaaagtaatacattgacaattacaaagctagcatgctcctgagagtagaactgaaccttcctcagcctcagagtatcagatgtgaataagaatatctcatcaacttgtttcacatgcttgtccacttgttttaaaggagaaaatgcaaataaatatgctgcaaggcagtctaggtaataattatttacactctagagacagacctggcttcaaatcttgacatgtaccacttattaacagcacgttgaaaaacacatttctttaatacctagagcctccacttctagccagaaaagttaagataattatagaacctactgaatatggttgttttgatgataaatgaaattatgtatgtatgaggtctatcctgacgccttatatatagtaagcatgacataatattatgtactgctactattgtatttgctaaatctccaattgttttaaagtataaaagagtattattattttattaaggacacagagtggtattctgagaggagtgggaatcctcaagagcttttttcctggaaattaattttgaaaagaagcttgatgaaaatcttgcatttagagtgaggaagacagtcaactctgaattacataattatatatatgtactggagacacagttcgttcctatgatataagaagggctgaaaaaaaaagttactcctttatttaatcttaaactgatctggtcttcttcatgagtcctcatccataaggaaattatatatatattccttatccaacagaggaaaaataaattctcattctggcttaatctgatcatttagggcacaatctctcataaaaaagacagcttagtctctctttcaccctccttctactgttacttgttgcaaataagatgatgttcctccattatatgaggtaaaggggatgcttcctaagccctcatggttgcaaggaaaaataagtgcccttgggtatcatgtcccttgttttctgagataatatcccttgttctctagtcactgataagcttgtcagctggtagaacacacgatcggcctcctaactagatcagtgcccaatatcattctctggttcagttagattcttcttaaattggaatgtctccagactcccaagtctctgctgtttcccattcagccctctggcccatggtccatctctggcatcctccactggggcaactagttttgccactgcaggtccaccacaaaccccttagcagtatctagctagaactcaacattcctaaagatgtgtgtgtgtatgagtgtgtatatccatctatatccatatctgtgtctatatactagactgtcaaaaaatttatatggtaacttttgttctacgacagctagggtacattgtgaaagtttcaaagcagagattatgtctcatttatttttagctttccagcacctcacctgatctctgatataagcaatcaatctgtattctcttcatgatgagaaatattctccattctcactgatagcagatttgtgaccactaaacacacacgcagtactggtgtgaacgcacaaactattgaaacaacaagcacgcaacaagcaaggaaattgtcactgctctataatttggtgatgagatatctggttactttcagacaaaagaaaatgtctcataataatagggttttgtatgattcttctctttcttccagaaataaaaaatttagaaacaaaacattgagggacattttaggttaattatgcattttagaagagttccccagatatcatttttgtctaatttatttttcaaattggcatataaaattatatgtatttatcttgtacaacataatgatttaaagcatatatacattttagaatggttaaatccagctaattaacaaatgcattatacctcacatagttatcattttgtggtgataacccttaacaccctggataacttttgattcagtttctgaacttgccatgtaaaattagtatttgtactcaatcagtttcttcagtttggagtatccttatagtgatcctgggcccaaactaaaagtgcatagggaaagtagcatagtctctttccatttgcctctagtcatttttatgtactgatgaacatgtaaatgctgctgtacaaagtacaagacagggatgaagaccctgttctcaaatatttccaggatagggagaggctttaattatattttttaaagattttctaaacagaagaaagaaaaatccccattgagaggggaggcagtggctcatgcctgtactcccagcactttgggagactgaggcaggaggatatcttgagtccaggagtttaggagttcaagaccaccttgggcaacagagtgagatctgatctctatagaaaataaaaataaaaaaagagaagggagtgcatggggaaaaagaaaacaataacaacaacaagaaattcagaagtggtttgatgtgttgaggttaaactgaaacaatgccttcattgcaatgagtgcctttgacgtctgtcaaaggtggtacagtcagtgacaatgactgcattctttctggctttgggttcacagtgctttgcagtgctgtgctattcagaactaaataactgttgtcactgctctataatttggcgatgatatctggttactttcagacaaaagaaaatgtctcataacaatggggttttgtatgattctgctctttcttccagaaatacaaaaaaaagacacatttaagaatttatctctgttcacattgaggaagaaaataagctttaaaaagttttactcctccctccctatagcaatgcttgcctgactttccatcgggggaaatgttactttcagcatattctgtgtgtgaaatagacagtgccagatgcttcaaatggtcataattgtgaaggatatgaaaaaagaggcatcttcctactgcgctttattaaatgtggagggaaaaaaaccctttgggtaaattagcacttggaggatttagcaaaagtgaattaactatgacagggtcccctaacacatctatttgatgatcttgcaagtcttattcccggttacctgggatactactttgctttgggatgccatggggtcattaaaatgtgagacaggttctctggaagagaaaaatcagatgaatcttgacttacagacagtatgtcttcctaaatagtatttcttttgactgaccatacctttcccttgatgctatatttctccctcatgcgctcatctgaacaaagaactgactgcgaatttcagctgccaaaaccaaaggacagttggaaaggctttttacaagcaattggcaagtgtgctctcaaaaactgaatatataggtgctgtttttctcttataaattagtattgaaatctagcctctattatgccatgggaatataaaaaggagaaatgaaggcagaagtatgtggtgactacattaaaaaaatgagtccactattcttattcttcttcttgttatttatttatttatttactttgagatggagtctcgctctgttgcccaggctggagtgcagtggcgcgatctcggctcactgcaagctccgcctcccgggttcacgccattctcctacctcagcctcccgagtagctgggactacaggcgcctgccaccacgcccagctaatttttgtatttttagtagagatggggtttcaccgtgttaaccaggatggtcttgatctcctgacctcatgatccacctgccttggccacccaaagtgctgggattacagacgtgagccaccgcacccagccgagtccactattctttcttttctttacacataattccaaaatcaaaaatagctccgagataccagatgtctttgtggtaactcattcaacccaacttgaatgtatttggtgcctgaaacttatctaacctaccgtgagattatctttatctctctcaatgtgactgttcatatgcttcactgcaaaaatattagtgtgtttgatgacaggggtgttgtagaccccactgggggtgctatagaatctgtgtagtgttacttctataaatctgacaaattctggattttagaacagaaaatattttgttacaagtgaggcactgtgctgctttacagactttatctcactgaagcctcacaacctcccccagacgtggacattgctctgatctctagtttatagatgaaaaatttaaggattcaaaggtgaaataagttgctcagagtcactcttctattatagttacgcactattgcataataaacatcccggaaatatagtgacttgaaacaacatgttattgttaacacacacttctgtggattgactcagctcagctgagtggttctgatatgtggctgctgtcagataggagctggggttggaatcatctgtaggattattggctcacatgcctatacctcagctggaataccttgaggctggtcaagcatgtctctctgcatgtggcctctctgcatggctatattattcctcccaacatggctgcctcagcatagtcagaagcagctcctagactagaacaagtgttccaggaagtggaacctgtcagtctattaaatcctgggctcagaaactggcatggtgtcatgtctacgtttttcgatgggtagaaatagtcagagacatcatatagtcagttatatcccctctgatatctcacaggggatataactccaagtattcatgtaggaatggaggctgctcagcttgtaagtgaacatctgggacttaaatttacatctacctagtgccaacgtccattgacaatgaagtaaaacctacctgtcacccatttttccctctgcatgccaccccgacctggtggcttaatattccattttttttcagtcactttcctataatcttctacctccaccagactgttctgtaaaaaggctattctgatgatgccaaaacgtagacctgtgctttatgtatttgaaggaatgggcagggagtattcttctttcccctctcctctacttacatgacttcagtgatcctgatttcaccctcatttttaaaattttcatcttgataagaaatacctaggaaataacaaacaaggagattcaggtaagaattgatgtgaggaagagaactggggagagcattctggaacattccaactacagtgagcagctttactcctttctccaccttcccattacctccaaactctaacacattcctcctactaaaatgtagtatatttaatgtttccttttttttaaacatttgccccagctcctaacacagtgactgtattaattcccatttctgtctcagaaatgcacgtgtgaaactccataggctggcagatatgctccccagacatgtcacctatgacctgtctctagatctgccctctatccaaacggaaagtggaaaaaaatagcttggtcatgcttgttagctgataaggttttagctttggctatattgagaccttgagctgtttttgcttttgttacttaagctgtgggatctggtcaacttggagacaaatagagaaggccttgagaattgaggttctatactgatttgtgggggaataatcacaatgctgttcagaaggagagttgttgcacttgctgtctttttaggaagaatcaaagcttcactgggatttggctagctggcagtcataattttgaaccctatccccattgggccaaacctatcacatgtgtcaaaatgacatggttctttcaggggacttttgggagtgagatccacagcaggcaactctgctaataaaatccagctcaacagtaacattgcattatttagccttcctcagagacatctggcatttgtcttccatttcctttctgttacaactttaccccctggatgctggagatacaagtaacccttcttgctgtgtcttctcttattctcccaataactaagcaacttatttctatttcttaaataaatctcatggttttctgacttctccaaggtcctcttgtcaagtcaaatgaaaactactgatggccccttccaaaaaaaataagtatcattacctagaatgttcctgaattctggttcattagcacaaggtgaagacatgatgtgtcactttttagggccttatcctcttgtttcagtgatgatgctgtagtagacaagaacattttctaaaagagaattatagtcttcagggccaagaaagtagttaggccagcagtcatgaacactatgctacaaacaccagataagaacttgttgccttgccagtggtagaattgttacaaatctatgtgggagggcctttgggatcttctcatctaattgcctcatttttctattaggagattggtacccaggtaggtaaatccatcttcccacagatatgagatgacacagtaaggctataacccagccctcctgatttctcctagctcagtgactgttctgcaataatgtatttagatcagaattcctttctttgtccatcagcatatcctgagtgttttactctatccccaaattacatacccctgtgatttatacttatgtcacatcaaagctatttttaattttctaggtctcttttaaattttggtacgttggtcaagagacctttccttgatctttctcacttgctaccaacgttttcattcctaccctctgtctttattgaactgttaagcccatgttgtcaggaaaattggcacacctttttggccaacgaattaaaggcaaagggataaagtgggttctgctgatcatcatatagctttccatctagtctcaccaggcctggctgatggaggagatttccacctcagcaaagactgtaactacagcaactagtgagttgtattgtccactttatgctagctggtgaggagatccagccaatgtggaagggtttgtaagtacatacatgtagtcccctgcagaatctatgccagaatcccatagtttgggcatgcgtcaaagacatctgatgtggaggccccctcctcacctgctcagggtctgagagactgtgactctgatctaggtgtctatctggcagtcttaatgagggatcctccaggaagcaaaaatagtgcaaagtaaaagggttgatacccctgcctttgacctttattttcaatctaataaacttacctttctcaggaaaagaggtgagagctggtattttggttttggtaactagggtctggggacaaggagctggtcacgtgctctgacagaaaaactaggatttcaacccccagctgggagctggaggggagttctgtcttcctcacttactaagcatgcttgaaaaacattaagctgaatatcagagcttgattgtcctgcagatgccacccattaagacagcaagggctgaggaaggagcctgagcaagtatagaaaagaacttacctaagagatcttaaagcagaacctggaaacactggaagcaggacataaattccttttgcacagcaaagcgatcttgtgttcctggtcagtagaggctcctttactttccttcagctaatgaaccacaaaaagaagatatatatagtattgacttctgaggccagggaattttgttttctttatttttctaaatttgagtagcatatgcttcaaaacatcagatatttactatcctcaaaatgactggaaaacttagaaggataaggcacaaggaatggcctaaataggcttaaataacaaatcccactaatggagtgatggtatataatggaaagacagtgagacattagtcttctttggaaataacgtgtaagaggattttgttaattctcattacttttccttcacttggcactgtaccccacccccgcacttctaactgttacgatagctagaactaggcaaaatgggacaaagtaattcatctgatcatatctttactcattttcagtccttatctcaaaatttgtgagtgatataaaagtcacgatccattagtggctccatacccttcataatgtgatctccattttcctcgcaatcatcaactcatggcacctccctttgatctatcctttctatgccctaactacgaaattagctaaaaaatggtgtagactttcaacacacagcatgtgctctttccttccacataatgaacatccttgctcttacctggtaactcattacttgtcctatacattccacttgacttgtttctccttctgcaaggattttgtcagtgatgttatcatatttttctgatgcatcttctttatgaatactttttggagaatgtctctgttgctggtctcaggcccagggcagttttacttctctcttaggattggttcgtatttatcttatcaacgcttagtagtgacatctaccagcttttcccttttgcaatggttgccagaactctcagaggcaaatttgtcgcacatttgtaatcaagagtatgaattttcccaaatacatttctggctatatttttacaagctgaactgttctttttctcccctttactttaaaatgtgatatcttatattttatggaacctctttctggagcaaggtggccaaggaaggaaggaagagaaagggagggaggcagaggaagaggatgagaggggagggaaagggaagggagcaatgagaagggaaaggaagagaagaaaatccaaattcaaagcctactttcttcatgagtctgtcacctgaaaaaattaatcactttccctctgagctcccccagtacttggaagaagcctctgttatggctgttatagcacttacatctctgcatgtcaattctttgtcttcttggacttttttccctcctatctgactgcaaattctttaaaacaaggacgacttcttcctttttttagtattcccagcttctggctcagttcctagttcaagtaactgctcaatatatgtttattgagtgaacagtagctgaaaagtagctccaggggtttaaaccaatcacacaagttgatttacttaattggagttctgttcaagatttagcctcattctctgaatcagacttgtgaccttcagaactttatgtgtgactagtcacagtcatatttctcattgtacatgtctccaactgactttcagcaaataacctgcagctttatttaatacaaatcagatcatattaaatataattaaaaatctctccatgaaataggataagatcccattggggcatcacaaaacacaattataccttcatggcatatgctcttttttagcaaatctacttgtgagtattaaagtctgacaatcctttctcaaagttagtatcatcttttaaataataccatataccaaataagaattaagaagtcactgtattatttctatcctggattatttctctaagcagaatcatcaacattgatacataacagggatttatttgagttcaatggcaaatcagttacatcagtataacagttaattatattcattctctttaatagatgatgaaattctacaatatgaacttaattaaaagtatcccagtgagcacaggtatgctcaaagtttctttctgcgcaagttgaaacagatgcgaccactggaagatttgctcacttaggtcttccaggtcattgctagggcaattacctaaaatgtcatttgaagcattaaactaaaaatataatcatctgaagaaattattattgattccgattttctctctgttatttggagaagtaataggcacaggaaaaaagaagacagtattgtgagtaggaaaatagattatcatacagtgtttttcaagttgcaagaaaagaagcatttaataatttcttcagacaggaacaaatcatcatttaaataaagggacaaacaaacatgatttaaccttcaacacagatatgtgttacatacacatgcattcacacacataaacacaggcacttgtgggttagagctctctctggttaaattataatgtcaccgtagtcactaatcatgaccagacaccaggacaggacgcggtacagagcaatccacactccagctccccaacttgccagcaggctgctttgcagtgtttcaggaaagaagaagaaaatgagttgacatctgcaagagataatgtctggaaattcacttctacatctagtaaataactgccattctttccaaagatgcagaatttcgttgataagctatctcatcagtgacttaaccatttggaaacatctcccttcaacttactgttccgtgttctcaaaataatagtttcagcaagatcaggggaagctacccctctcctttttttcccccttcccttgctttcagcaccatcaaaatctggagagctgaatagagattacaatttgtgaaggggaaacctaaggttgtatgagagatatgaaccccaccccccaattcccaggggaaagcacctgtcttgaactttgcacaaggatctgccactgagtttcatccttattttctcttcttgctctgtattcctcatagttgaatcatttgtagtgaatattttttctaaggcatctgtatttgttttctattgccattatagtaacttaccacaaacttcacaacttaaaatattccaatttattattttataattctgaaggtcaaaagtctggaatcgaactccctaagctaaaatcaaggtattggcagggctgcatccctttctggaggctccaggggagaattggtttctttgccttttccagcttctagaggctgcctacattccttggctcatggtctcttcctccatcttcaaagctggcaatgtctacttgtgtgtttctcatgctgcatctctctgacactgactctcctgtctgtttttcttacatggacctctacaactatattgagcccacctagataattcaggataatctctttattttagggtcagctgatagcaatctcaattccatctgctatcttaattaccccttgccatctaatttaacatattcagattctggggatgtggatatctttgggggaccattattctacctaccataacatctttctggaagcctcagcttctactcaaacaagctgaccccaagctaggggccacatctcttctttgtactcatgcatttttttcagttgaagttttttcaattggaataagttccagactcattctgtccggtgtgagagtaggtagcagcatttcaagaggctaagatgcttctgtcatcccaagctttgcagagaaagggttgatggggcacagtatgtttgagattttttttttcctagcctaagaaccaaattggagatcttatttatagatattccaccaatatgtctttattttcttcacatatttttggctagtaagtgttggaatcatcatcatttacatatttcccccaatggaaaatcagttactggaaacagagacaacaaacagatggccattaggccagctgtgttgtgaataaaaacagagtagaactaagttacaaagacatggaagacagaatagacttggttctggccgttagccaggttaaattggtatgtatgtggcaactgtgctgcaaaaccaatgaaaccattatgatcagctagaccacaaagagaaagaaaacctatgagaacactgaagttgtccacaaagaagcagattctaatatgaagattgtgcatcctaaaggttatgcaagataacccattggggtgtgaaacaaactgtaagcatttttatacccatatctctatttaaaataagaacttcaactttaccaatatttaaaatacaagccaggcttgttgtcacatgtctgtaatgccagctactcaggaagctgaggcaggaggatgtcttgagcccaggatttcaagaccagcctgggcaacatagcaagaaccctgtctcaaaaaaatacagtttgacactgccacactcattggctttgtacttcagccattcacatatcacacatgtgtattaaagaatttgggctgggcgcagtggctcacacctgtaatcccggaactctgggaggccgaagcgggcagatcacctgaggtcaggagtttcagaccagcctggccaacatggtgaaaccccatgtctactaagaatacaaaaattagccgggcgttgtggtgcatgcctgtagtcccagctacttgggaggctgagggaggagaatggcttgaacccgggaggcagaggttacagtgagccgagatcgtgccagtgcactccagcctgggcaacagagactccgtctcaagaaaaaaagaacttgtttgtgactggggtatctttggttcatatgcagtcaccttaatgtggctaattgcaatactcatgaaattgctaagtagactgattattatattatctagttttaactaaattgacccttacaaaatggacaagtgcttaaaaaatatgcacgtatcttaaagattctataagaaactgcataagaagataaaactaagatgggcccgggtaagcatgaagcaaaaggaagaaacagtattcccccaaccaccagtgtaatctcttcagtcacagaaaaatgcccagtgtgatcaaatcggacacattcaattttgagcacaaaaatatttttgtattttaaatgcatacagtaaaaataaaaatcatgttatattaatacttgtttcatcttccgctctgtttaaatttttatttagtgcatattttaagatgtttgtaatagattagtacaatagtccatgcttgtactttatattctgagggtgtatacacatattttgagggtaggtattcaaatttcttttatggataagggtacacaatcaagatggtttgtagaccattgctctagaggatagagcttttggagggaggcaacaaattccaaaggaaaggtttggcatggaaaaacacttaaaagctcactgagagaagggtgtatcagggaactctagtgtaggtcataggacttgctacactaagttgcaaatttgtccaaatctgacattgccaggaagctaagtcttgcactaatctttgtgtagtacttttatcctataatagggtccatgacatattagataaagaaaagaaaataaaccataagggtctcagtgagatcttcaaaattttacacttctactttgtttttaatgcttagtaaaagaactgctgaaaaagtcattaaaaaatgagtattttgtctttaaccaagagccgggaagtatctcagaaacatatttcaacattaaaatatcaaataatcaatttttataagaagtgcatttaattagcaacttggctatagctagcacacagtgagttaatctaataatcagtgactctctggacagagtcatcttaaattcagctattcttttatcgatttaagaaatgtaataatatgcattttatagcaaatggctagaaaatttcagctacagaatacttcattctatgaagcctgattattttatggcttagaagatgttcataacttctgttccaacatgatacagaagcatccttcagaatgttatctttaagatcacagaagttaagagatttaaatttcaaagtgaatattatccattttctgttcttttttagcctacttctaggcaagccctctgatgccctcatcgtttgtttaaagtttctctttcttccaggctactttgcgaatcaattccagatcacagaggagagaaaaccttattccttttttccaccccaagctcaccttcctagacaagatttttatctacattaaatacattcgctaacccaggatagtgacctacccatagcagtggcttctgtggagctcagcagaacatagagaagtcccacaatgcttgattaaagccatcaggaaagcctgaggtaattctaaaagatcccactctgtggtacaaaatggccctagaagccaatcttctgactacttgtcattttatttcatttcatttcattttttcttttcttttcttttttttttttttttttgattcagggtctcactctgtcaggctggagtgtatggtgtgatctcggctcactgcagcctcgatttcctgggcacaagcaatcttcccacctcagcctactgagtagctgggctacaggcgagtgccaccagctaattttttgtattttttgtagaaatggggtttcactgtgttgcccaggctggtctcgaactcctgggcttaagtgatctgcctgcttcggcctcccgaggtgctgagattacaagtgtgagccaccacctggccttgtcattttgttaccgttaacactttcctctaggtctggttcccaatgcgcagaatccggggaatttgaacagggctctcttggagagttgtttcattctatgtgctgggataaaaacaaattatttttcctgctaggaatgcactaaagatccctccactgtatcttccaggaggttcatattagtatttgctttagggataatgttttggattgcaccacagagcaaagtttttggtcagacaatctaatgggactaataacagccgacctgaacattgacaattcttgcacattatcccattccatcctcacagatcagagaaacccaattaggtaacatttccccacttcatagaccagggaaggaaatttctgagaggttaattgatgtgctgaaaggcacataaagtgcccggctcagtcccacgtctggctctagattcctttttagttcttctgtattatgctgtctcttctaaatggattattaggttggtaatgttattcttagtcattctgcccaaataatgaataacagattatacatttaagatgttaaaatgtatcataattttattataactgaaaatgttcagaatttttttaaataataattttggggaaaagaaaacttccttatacattgtttcctcagtatttttttcattaggtattttttccatttggctgtggcaatccttgagattgattctcactgtcagggtcataactctctctctttcacccagcggtaaccatggaaacatatgtataacacgtcctgcttcttttaatatgattattcatgagttgccataaaaatataaagtgtatttgtttgcatatttaattgttaaaataacacaagtatttgcttttaaaatacctactcatagctctgtggtcatgtatacataaagtaccaaccattcttaaatcctaggattaagaagtgacatgttgcaaatttagagtaccttgctcttcaccagttgtatagcaaaagagttttagtcagtttagaagtaccatgggtccaccgcgtggtggctcgcacgtgtaatcccagcactttgggaggctgaggcaggtggattgcctgaggtcaggagtttgagagcagcctggtcaacacagtgaaaccctatctctactaaaaatacaaaaaattagctgggcatggtggtaggcgcctgtaatcccagctactagggaggctgaggcaggagaatcgcttgaacctgggaggtggaggttgcagcaagccgagatcgcgccattacactccaggttgcagtgagccaagattgcaccattgcactccagcctaggcaacaagagtgaaactccatctcaaaacaacaaaaaaacaaaaaaacagaaaaaaaaaaaaaaaaaaagaagcagcagcagcagcagcagtaccattggtcgaattagggttcctgtcccatttttctgcatacatttaaagtctaatgtgatatagtaagtactttctcctttgaagatcagctataatctcagaacttaatatttcacttgtatagaagttactcttaaatcagattctatgacccagacagccatccagaattttagttcgtcatctctagcttcctaataaaaatatccaagtggatgtcccactaccccttccaattcaatttgcctaaaaccaaacttgttatctttccttcagggttcaagtcctttcagaaatttcttaattcaatctccaatcccatcattctcttagttactcaggcttaaacttttgttatcctacggcattttctttctctcttctttcacgtcctatatcctataaattattcttagcttctactagcctttctatttccactgccacacttgttacattgtgctgagactaccctacagtgctttaacaagtcttctcccccagctctcatctctttgtatctgccttccagtctactccaaggtcgaactgtctaactcaacattttgcatatgaccctcaccccctcacgacaaccatttcttctaaattaaattgatgtataacaccattcaaaagttatttctttcagcttcaaaacaatcactccagtatatacattacttgccaacatgatgtgaggtgaaccacatttcttgcccacacgctgttctcatttctgttctagttcctcacttatgacttgtaaattgaaagcacctagatttctgttgttattctggatgagtaatggcaggacaaccctaaatcccaagtatttctgtggctcttttaaggaaaagaaatatacaaaaatagtctaaaggaagaaaaatataaatattctaaacattagtcttatatctgtgttacattgccattatatcagttttgcttgaaataagactgtggagattagatattagttttaatttatgacatttggcaattgtaaacaatttgtgttactttattcttttagaatctgtgtagttttccaaaattaaaattaaaattccatttctagccatagaggagtcttcttagttctatttgagtcaacaatcatttttaaagttttaatttgaaaattaaggacagatccaactaggattgtgagtccagcagacatactgtgtgagcacacagctgtggcatatctgtggaacggataagggtggcatattttggcacttgtggaacttattcccatcattttaaacaatgcttggtaggtttatatcaacagatttattttcccttcagctattacgagagtaaagcagagacctaaggtctggcatatgaatcttacaaatgagggatttttaactaggagcgactctgaaagcttcttacattcttgggacagtctgcagtcatagattgaatgagaaaagcctcatattttggctgggtgcggtggctcacacctgtaatcccagcactttgggaggtcgaggtgggcggatcatctcaggtcaggagttctagaccatcctggccaacgtggcgaaatctcgtctctactaaaaatacaaaaattagccgggcatggtggtatgtgcctgtaagtaatcccagctacttgggaggctgaggcaggagaatcgcctgaacctgggagatgaaggttgcagtaggctgagatcactccactgcactccagcctgggcaatagagcgagactccgtcaaaaaaaaaaaagaaaaaaaaaaaaaaaaaaaagaaaagccccatgtcttttcattgaccatatacgatctcttaaccagcacagcattgatgcatttcagccatctcacaaaacttcccttttatcattctgaaatgattttatctttcccaagagactgatagacaaagcagctttgtatactcacgtcctggttattgtgcattattaggaaacagataggaaagctaccctcatacagaggctatgtaaatattatttggggaagaggaaaaacacatatgggtgctaagaagataagacagtgcctctgaccgttctatttgatgtttcttaaacctgcattgttatgaaaactcaggtaaatgaatttgtaatgactactgaaaatgaaacaggagtatacttgaataagtattgacatttttttttcaggtcatttactttaagactcacaaagaacatattagctaatagaattcatggccaaaccatgatgtaaatggagctaaggtcagaattagattccttagggagctgaagaaaaaacacggctatgaccctaaaaccaatctgctgactgttttctgctgactcttttctgatgcaaagtaaatggtgggaaaaaaaaaactgatactaaaaacaaacaaataaacaaaaaaacctctaactatccaaccacctgtgcaatacaatagctttctataaaataaaacagaatggaaaaaaaatctcaaaatcatgagttgaaccaatgaaacatacgggttggttcagcattgcaaccagatgtcatcttaataaaaaccaacactattagctctttgatgattaataatagtaaataccattatcacactcaaatatgactctttaggctgggttactaatatatacaatcaacctgcatttttcccgtctttccggatttgacaggaagagtggctgtggcatggaggaagattaaaagtctaagagaacctcggatttagattctagttgcggccctgccctttcttagttgtgtgaccttgagaaaatcagctaacctctctgaatcctatcccttcacttgaaagtgtgttaaaatggcacttatacatgataattgtataaatacgtttatatatggcatatataagtaatacatatgtaatatgacagtattgaagttaatataaactaatatgatataatgtgtttatatactatttacaaattatatattaatataatgtatttatattaacataaatacatgtatattagtttaaattatatatgaaaatcttataattaaaatttttacatataattattaatatatcataaatttctatattatatataataaatttatatataaatcatatctatacacacaatgctttgtcatgtggggtcataaaagagtactgcaatcattattatgtcttcggttaactttacaatgaaaagcttcttaatcaatattaaactacgggcaaatataatgctgctgccttctaatgtaatttactttaggaaaagcaattgatgagataaaaggtctttctcttttttcatttttatttttttgagacagagcctcgctctgttgccaggctggagtgcagtggcacgatctcagctcactgcaacctccagttctctagttcaagcgattctcctcctcagcctcccgagtagctgggattacaggcacacaccaccatgcccagctaacttttgtatttttagtacagacggggtttcaccatgttggccagaatggtctcaatctcctgacctcgtgatctgtctgccttggcctcccaaagtgctaggattacaggcgtgagccaccgcacccggccaaggtctttctctttttaactttgtttgcaatacctagcttgccttcatgctgttatattaggttagcattaattttccattattggagcagattgcctacaagcacacacatacaaatagtacactgaggaggaaggagccagtgctgaagttctttttctgaaacgtaatagagcttttctcattactgcaaatacatgaatgaatgaacaacattgcaagcacagacgttgcatacattctctcatcaagcagcgccatcactgccttagtactttttgttgttgttcagcattattgatttttccaacaatcgagtttgtttgcaataaactgaactggagcataaccttcactaattagaaaaaatgtatgggtattagcttaaggaagcaataacacttcttgtacgttttctatcgaaactcagggtgatgctttgtaggagtgctattgtttcttttcccccttgtgacaatgttgttaagtatgatgcaaaaaagtccaaagaccttttaaataatttgcatccattctagaaggaagaagaactacaaaggccaggtgtgaatggatatgaaaatagcaacttagaatagaaatatctgccattactctctctgcatacctctaagcctttgtccctatttacaattgtttttatattctggtccactttgaaagtgaacaccttaaggatctttgttttaactataaaatttagaaaatattccttgattcatatttatatttgctgggtaattatcatttataaaatcatagttgaactaagaagctagaaaaaactacatgtgtgattaactgtttagtttttcaccatttctggtcaggctgtttgaattggccaatgcagatttcttcatcccagcaaagcttaatcatagaagtaatttcaattatataataaataaaagctgctttgcctcagcatattcagtgattaaaaatgagtcgttttttaaaattttcaaatctgacagtatttcttgaaagaaataatttgtgatggaaataaactgaaaatgaggaatacaatggtcattgaggtgcaaaccaatgcaacagaataaagttaacatgaaatttgaaattattgcccagaaatcaaagtaactataaaaatatagctgttattagggaaatctctagtaggaaaagaaagccagaaattatcacattagcattaccatgggatgtcattctagttcttaaatagaactaaagacgagagcatcgtgactctaccattcatatgaaggagactaaatagacaatgatcttgaatccatttccttttaaaaatcttaacagcatagggtaagtatttggtgatggattcttggctgcagaaaattcctcatgataaacagggtgctatcattaaataacacacatgctaaatgctgggaatacattaattcctccaagtccaattccctgtaagtcatcttattctctaaaaatcattgtcataaagggaattctgtgtgtgacatctgagagtaagcatgtttagaagtgtctcaagagtacctgacagtaataaaatcaggaaggtaagacaagaattatccagtctttgcagggtcaaaaatgacccttctctttattccttaagttttttgtgtttttttttttttttttttttttttttttggtgagatacagtttagctcttcttgcccaggctggagtgcaatggtgcggtcttggctcactgcaacctccacctcctgggttcaagcaattcttcggtcccagcctctcaagtagctgggattataggcgtccgccaacatgcccggctcatttttgtatttttagtagagatggggtttcaccatgttagccaggctggtctcaaactcctgaccgcaggtgatccacccacctcggcctcccaaagtactaggattacgggcatgagccaacatgcccagccctattctttaatttttaagtagctttggccttcactagcattactacagtcctatatgtaaaagtatactgctgatgaggaaaatatacctcatttaaaatgtgtgctttaaagtcgagtctctgctatctaccataccaatgtaggttttggtcactatcaagttattttcgttctcagcaagtaaaactgccatgttcttcatgatttttttctatgcatacacagtcattgctaagataaacattatttttagacatcaaaattcctagcttattattttacatcatattagtgcaattgtcaagagacaattttatatttcttaattcactttttctctttgtaatctgagttccccaaataagagaaatattaataagggtggcatattttggcacttgtggaattaactagcaatatgtaaattcctaaatagcatactgttaaaatgcttctattcttcaaactctaataatttgctaagaaattatgataataaattttaagaatttttggctaagtgcagaaaaatctgttgaattattaatacattagcaaaatgtatcatttagggaaataattttattgtaaggaaagaacttagaaatttgataataagcataatttaatgaataattttctgaatgagtcatttctttgcaataaaaagaatttttctctctacatatgtgtggagcaagtttctgtaaaggaatccaaaacttgtaaggaagggaagccaaagaattaccaaaaaatattcctgggtgttttgaggtttcataagatatttgataacatattgaatgactctctttgtgaaacatttagtagcagacagtgcaggaaaaagctcattcttttttttttttcttcgcgacaaattcttactctgtcacccagactggagtgcagtggcgcgatctcagctcactgcaacctctgactcctgggttcaagtgattctcatgcctcagcctcccaagtagcagggattacaggcatgtgccaccatgcctggctaatttttgtatttttagtagagacagggttttgccctgttggccaggctggtcttgaactactggcctcaagtgatccacccgtcttggccttccaaagtgctggaattacaggcgtgatccgctgcacccagctgaaagctcattctttactaatcatgaaaccctatattaaaaaaaacaaaacaataaactattaggctggtcttttccagtgatatagccaaagcaccatgccagcaagtgaaacataataggccctcaataaataattgttgaaatagccatatgatcagacttcacacacaaaggctgaactgagttgaggtaattcaggatagaacccactggataatcaagcacataatattggctttaattatgtagctgtttcagaattgagaggtgatgaagggactcaaacagcttgatgctctggctactgggctgtttggatggctatgtgctctttgctcttactccattgtgaatttctgaagccaggacagccttaattagatgtgagtctgatatgataaatatgttgctatggtgaatatgaatgtttcatacaacaatatttcatgccaattaacagtaaattccaaatactttgccaataaaattgaaaataccattattccattggcctgtccatgatggcataaataatgcatatttgtttatttatcaagagggctcttattgaacaccctgagctttctaacagttatctcccttgtgcagtgtgccagctcattaggaagactaaagtcacagtggagtcatcctgaaatgacttcaacacaaattccatgtaaaaagatttttggagagccatctgtcccggggtctaggttatcttttggaaattggaactaaatggatgaaaagtatagaaatgctttggtcttccaaatactttcttaatcacctctaattgtaaaaagaggaaaaagtggctttaagaaaaaatagcaaattaaattaattcataagctattttgtatgatacaggagacagacatttataaaagtaattgtgcttagttatcttattgcaagccttcatctccacatttgacttcactggcaaatgcggcaacttacaaaacaaatcaggccatttcaacgctagtactacagagcttgtttttctcccccaatcttaaagagacttcatggatattttaatgttagattttacaatttaacatattaagatatgattactaaagactaattcttgtctctgctacctccatgatttcattactgtcatgtgccgttgggacgcttataaagccagaaacaactgtagcagaatgtgtagattacatgccattagtttcactgttcataatgccgagcatattccagagtatgtgctgaatgcctccaaccttcatgaagatatcctttttccttttttccataaaaagacatcattgatggcaactagtataatggacagatcattcaaaaagcacatttgatcatcaaacattttccaggtaccaaaaactttctggaaacacacaatagaatttaaacctagtaagaaggctggatgtgaacatattgaactctaagccaataaaatgtacaataatagaggtatgcaattagtatatggagacacagttgatgatgccattaatttttctttgggaggtaataattataacatctaatcttaactgagtaattactgtgggtcacattctgctttaagtgctttaaatgtactaacagagtgagagggaatggatattatttccatgtttttagactctaagatataatgcatcttatccaaagccatggggctagttggcagtggagctaacattttaactcgggaaatatgggtccaaaacctaggtttttggcccccaggccatactgcctttctgttttagagtcatctaagaaaagtctggagacaaattgatatttttgttaaaatctaaaatatgaagatgacttcatcatttaaagaaagagtaggaagagaatttaaacaaaggacatatagtgagcaaaattaggaagaaatatgggtccaaaacctaggtttttggcccccaggccatactgcctttctgttttagagtcatctaaaaaaaagtcatctaagaaaagtctggagacagattgatatttttgttaaaatctaaaatatgaagatgacttcatcatttaaagaaagaatagaaagagaatttaaacaaaggacatatagtgagcaaaatgaggaagaaatgaaagggagaataaattgatgggaagttgcccaaagtttgagttgctaaattggagggcatgcaggaagcagcatgggaatgaaattgtaaagggagatggagcccagactaggagtcaccttgtaggccatgaaataggatttgggcctgttctgtgggatcccttaggggatattgttatactcactcttaacattatactgactccctagccaggtcaaagtacaatttaagctgccaatgaaatatattggctttaaatttttgtcaccatttttaaagtgtagtgtggaactgaaacattatataaacattgtatagacaaaagaaaccatctattctaaatattcttaagctgtttgaataatgattggtctaaatgtattcctttcacataaattatataaactccctttgaaatgatgtatgagttaaataagcaatttttatgttaaaaagttcagtaattttaaaaatgaaaatgctcttactgaagcctccaaatcatgcatactatatacaatcttttatgttgtaaatgtccatgataaaagaaaacaaacaaaacaagacatcagcaccaccaccaataaaatttcaatcagaagggatcacttggtttgaaactttatgcagctctcagatagccagactttctttgtcaaaaacattcaatacaatgtttaggaagtgtcgtgtttaacagaaaacatcatgtgctaatattaatttggaaaattctatgtggtggctgacaccctacagtgttccagtctcttggaagctattcgggaatagtgagtgttccttctaactgttttatgtgggggtatgtggaatcttctaatctccaaagccactaggcttctatcctgactcttatttcctgatatatggaccctcttcttaactctggagtgttggactttctcttttctgcccttcactggtggcttggtttagttttctggtaactgcatttcttcctgagcacatccagaatcttctcagaggaggcaatcattccattctttccttgtgacacctcaattctccatctccttacccaaagagcctcctttatgtgtcactttccctttgaaattatcttttctttcttagaaaacttttcgtttctattttaagaaaagctgggtaacgtaagaacatgaaacattaagaggcagatggtaaattgattagacataagatgcttcgtatttgtatcctctgtcctgttttccactttttcttcagaaagtagtccgtgactttgtattcatagctgtttttcactttacatatcaagaaccaatgtttgggaaacaaataattgtgagtaagtggttatattgagttgcatatcagaagatatttaattttataggttaaatttataatatgaattgctatggtataattttgagaaaaaaaatcatttttagtcattacaaatatttattaatggccacactaggaaacaaagattatgagcctcatataggatacattttttgaacttgcaaaggaatacaccatatttcattaggtcagtaggtctttccctccttaggtattgatacgcctacaagtgtaatgacgtggcatttataatttggtaaaaataattaaagttcatttttgtgaacaacttagtttttaaccaattagaatctacttagatacattctataattacatcaccctaagatatttacaatctgatcaatgctatttttcatgaggaagagtgatagaattagagccacagtctagctgatgtaattatagccatggaacgaaacatatgtgcctgccatttatctcaggtatctcattgaaaaaaaggatgagaaaagctgatccagagtaggtcactaagcatcatccataaattgagaattggttctcaaacaataactttgaatcagcagaaatccagtgtttgctaaaagctatacatgaagagttaaagtagttgatcccctcaactctagtctctgcttatttttatattaaaagtcaaatgcttgctttgttctgaaattaatatacatatacacacatatatacatatatatatacacatatgaaatataacatgaatatgtggattatatcagagcaagtcatcatctaaaactagattctagctaatatttcagcaaatatgggctaaaaacctatgtggccacaaaatattgatacagctgtgaataaattaggtataattccttctaaaattttcagtctacagtggagacagccattaaataaattatcatgtactaaccaaaataaataactgcttatcattactgaatttctgatgttcttgcaaaaacaatttgaaaaactatatgtataaatttactactgaatatggtagtcatcctttaaaagacaatttaatggcttcttggccttttggctaagatcaagtatagtatctgttcttatccatttaaaagacaatctaccataatacctgaggaagaacatatattttataataacataaatataatacgtgttctcaaataaaaattaagccttctaacaagtgattttacttttaggcacgtaacttcaaaaatatggaaaaatggacgctgggtgtggtggcccaaacctataatcccagtgttttgggaggccgaggtgggaagatcacttgaggccaggagtttgagaccagcctgggtaacatagtgagaccccatctctaccaaattattttttaattagctgggtgtggtggttcacacctgtagtcctatctacctgggaggctaaggcaggtggatcacttgaacccaggaatttcaggttgtagtgagctgtgatcacacagctgtgctccagcctggacaacagagtgagaccttgtctctcaaaaaaacatgaaaaaatgtaactacctatatctatatatcatatatatgtgtgtgtatatatatacacacacatatatatatgataatatgtaactacctatatctatctattttatatatatatatgtatatatatgtgtgtatgtatatatatatatatatatatatacacacatatatatattaggtcccacagatgtacaaatttttaatgtacttttattgtaaataaacactgctggatttatatatcaaaaatattgctgattaagacttgatggcccgggcgcaggggctcacacctgtaatcccagcactttgggaggccgaggcaggtgggtcacaaggtcaggagatcgagaacatcctggccaacatggtgaaaccctgtctctactaaaaatacaaaaattagtcaggcgttgcggcatgcgcctgtagtcccagctactcaggaggctgaggcaggagaatcgcttgaacccaggaggcggaggttgcagtgagccgagattgcgccactgcactccagcctgggcgacaaatcgagactttgtctcaaaaaaaaaaaaaaaaaaagacttgatagacattagaaagttaactgagggaagtcatcaaatccacttccttaaataggtaagattctccttcgatggtgctaattcctttgagaatacttgaatgaaaggagatgagcgttcatgtattatttgaatactgaatcaatgctttcctgagtaaccttggtgatatggtccttccacatctgagagtttattttgcatccccagatattctaccttcattgcaatttttcctccaattggtttagaaatggtacagaggaaagttagtaaaagtaatcactctaaaagtgagtcatttattcttttatcctatgtaagtaaaagaactgaaaatcaagcagttagctttaccctgtggtctcaaacatatgagttaaaagacataataaaaactatcaatgtgtccaatatatttgtccttagcatcattaatctattccttgtaaggttggagtttataaaatgagactccataaagagagagatacctagtctaaatcaaagtgtgtgcgttatgacatagtagaatatattgataagttaactgaaatcaggtaattgcgggtagattggcttaacatgtccaaaacattctgtgtaagttaaatgactggtaagtaaaatggtgggactcatgaaagttaatttaattatatcagtcaaaaatacataaaataatttcaatactgttacaacctcactctagtaggtgtttctcagaggcacttgcttcattgtttatttgtcatcattcctaataaacatatatttgagttcatgtcatctaaaaataaatggcctaccctacagagacatggaaaactgatgtaggcatacactcacccaacatttaatgacctgaatccatctcaatgacttccttttctattcaaataaccagtttggaatttgatttactaaaattaacttttgtggtattgtttcaacaaaggacagccttttgtgtgacaacctataatatttagctactaaaagacctaccatatttctctcccactgagaattatttgttatctaatatcacttatagacttcatgtaaatcaaataattatttctggctctgcatggtgtaaggatgattaaaaacttgtcaagctatcagaagaataaggccacttcccagcatggaatgacattatttattctaggtccaatgattggtaccagaactgacccttaataataatatttatgacatgggggtgggaggggagaaaccatttagaatgattagtcttatcacaatcctaaggcattagaattttcaaaagtgctgaaataattgtgcaactttaaggaaatgtataagaaggtagctaaattatcactgaagttagtgaacactatgcagtgctaatcatgtatggcttctcaaaagcatttaacactcttgacaactgtcctcttgagatgctgtacctacttccctctctgttcttcaactttttctctattcatttgctgtctctttggctgtttctctgtattttgttcctccattacatatttgaatcctgtgatttgtcatgcattatctttgcttttcattttatgtgctgttctggaaaattctactccttcaagtgcgtttactgcttttcatatattctttaggcaagatctttttcttgaccttcaggcccatatcagcacaccaggagaaatctcccactgataactcagattcatcctggataaattgatctcattatctgtcattcaaaactggcttttcataatatatggctccaaaattcttatagtcatgtagcaaaattcctgggagttattctccctcacagtcccatccattaaaatctgataagtgaactgaaatgctactcaaaactctattctgggtcttctttccccactaccctgactcatgttcccattacctgtccattatcaccattccaaaagactctctgcctgaattcttgcacatctataatccagcttcccaagtgtgtttttttaatacacagaaacgattagccgcaacagcctttaacaatacaagactgcctgaagtccaaacatactaacttgacataagtatcctttgtggtcatatgttgagcctcctttccagcctcctttagcttggtcacctttgtgctctaagtttcagctatactatgctaccaaggcatagcaggatgtttcacacctatatgcatgagcatgatgtgtatgtgcatggacacatatgttttacacaattctcactgcttataaaacacactgcatcagctgtctattgttacgtaacaaattagcacacatttaatggcttaaaacaatacacatttattatttcacaatttctgtaggttagaaacctgggcatggccatgctgggtcctttgcttcacagtgtctcatagatggcaataaaggtgtcagtcaggactacagtctcatctgagggctcaaccggggaaggatctgcttctatattcactcagtggttgttggcagaatttagtttctcaaggccttaattcctaactaggtgttggccagaggcctttttcagttccttactacaagggcttctctataggcagctgcctcataagtatggcagctgcttcaccaaagccaacagtgaagagagtcttttagcaagatgaagttcacaatcttacataacctaatcactacagtgatattccatcatctttgacattttctattttgtaggcaactaggtttagcccactctgaacaagttggaattacacaaagatgcaactattaggaggctgggattatgaggagccatttcagaatcgaccacacccaccaaccccaccttcctttacccccatcaacctgacaacacctgctcaaattattgaagactcatgtgacttaccaagacctcagtttttcaatatttcccaacaaacccaccatgaagttggttactcctttcttcatactcccagtacacctccaatattatttttcaattattgtttacatagttttctctcccgtcaatactttgagaacaaaaaatgtagtgtgttattttctactctctggtaagatcagtccaaagaaagtgctcattaaatgttgaataataattgtttaaagtaaataaaaccacagatattaaatacataaaattatctggaaacaggtaattaccccagggataattgacagctaacgatgtgcttaacatctgaatgtatcatttactttagttagagtacacatggtaatcttttgtgagtgacatcacaaagtgacagattcggatgtctctattatttttaaattctttcaaatgagaaacaactataaaatgaaatgcgatgtggataatatagtatagtggttaagatcactggctttagcatcagtcaatgggatcaaatcccacttctaccacttattaactgtatggttttggacaagttactttaacctctctgttcctttctttactggtctgtgaaatggggtctgaaattgcacctacctcatagggctgttataaagattaaatacaattatttatggaaagcagttaataaagacctagtgtgtatttgactctcagtaaatgtcaatcattattatctcctagtatactgaaatagaaagatgtccataatatgaaacttggagagatgtatgtaagttgttaattatctttaatatatacatagatatatacagttaattcatctatatgtttgtatatgggaaaattgggaagtatacacagatttttaataatgattatttccaggaattagggaagaggtgagggtggataactttatttttttattttgcagattattgtattatttgaattattctaaataagcatatatcacctttctcttttttttgagacggagtttcactcttgtctcccatactggggtgcagtggtactatcttggctcactggaacctctgcctcccaggttcaagcgattctcctgtctcagcctcccgagtagctgggattacaggcgcccaccaccatgccagacttatttttgtagttttaatagagacggggtttcaccatgttggccaggctggtctcgaactcccgacctcaggtgatccacccatctcggcctcccaaagtgccgggattacaggcatgagccaccatgcccggtcgcatatatcacttttataatctgttatggattggatatattcgtccaaaaagatatgttgaaatcctaaccccagaatgttactttctttggaaataaggacattagagacataattagttaaggtgaggttatgctggtgtagggtgggccctaattcagtatgattagtgtccttataagaagagacatctagacacataggagagaacaccactgggtaatgaagccagtgattgagtgctgcagctgcaagccaaggaatgccaaggattgctgacagagcaccagaagctaagaagaggcaaggaaggattcccctacatgtttcaaagggatcgtggttccgccaacaccttgatttggactcctaacctccagaactatgagccaatacatgtctgttgttttaagccacttagtttgtggttctttgctactgcaggcccagaaaactaacagatagccaaaataaattaattaatatttttaagtatatacaaaaaagaagagaaaagacaggcagttgcatagctcataaaattataatctcttgaagttgaagcttcaggttcattttgactcttacctctccggccatgccaatagaattattagtttttgacatcccagccaaatatttgacaagcagttcataaactaatgggaagtgctaagaaatataatatggagctatttctttctattctgttcctccatgaaatttcttctatccaatttccaatcatgcaaatcgtatcaagaaggcaagtgatccaagggttaagcaacatttgattggctgctgtgactgcatgtatctaaagagaaatagaaagcaatttgactacggtatgtgactcaagtgatatgtgttttagataagtaattagaaacaaaacaaaaagtcaattagtttctagcctgtccttcaactgtttaaaatattatagcaataaaactaatggagagttttttcctaactacatcaaagttattaaaatgtagagtcaattagaaaaaaaatataagaatgtacattcataattgttgaatactaacaactcatatcaaatggacaaactgtttgacaccaatatatgtgggaaaggtcagggcttctaaagaaatgtttctttaatgatgaaactttccaattttaattttttttaattagcatcttatagacggaggaagaagagggtcaaaaacaaagaactttttcttgtcttaatatgtatagccatggaagatggcagaagggagtgaaaaaattcaatcaatcatttttataaataaaacaaatggagaaagcagtggaaccagtaaccccaataatggatcctatattattatttattttatttgcctatctctttcacagatatctagctattcatcaagtagacattccctccaaggcacaaagaaacactgaagttttaatctaccattgtttaattctttcttctggcagaaatacttgtgttcataagaaactttccaaattaattaaacttgtttaaggttgatactggccagagactttcctgtcttccaatttaagagattttgatgaacatatgagaattacattacaaaatatggcaagacggggaaagaaaatagaagaggtgaaagaaaggagagggaatgaaaggaggaagaaagaagaaagaaaactgaaaatggaaatacaggccagacgcagtggctcacgcctgtaatcccagcactttgggaagctgaggcaggtggatcacctgcggtcaggaatttgagaccagcctgaccaacatggtgaaacccccgtctctactaaaaaattacaaaaattatgcgagtatggtggtatgtgcccataatccgagctacttgggaggctgaggcaggagaattgcttgagccctggaggcggaggttgcagtgagccgagatcacgccattgcactccagcctgtgcaacaagagcaaaactcttctcaaaaaaaaaaaaataataataataatacaaattttctctcattcatttcacaaatgtcaagtattggccattattcctaatgtaaaaaacaaaacaaaacaaaaaaacaaaacaaacaaacaaaaaatacccaccgtgtttcacattgttctgaagtagttactgttggttattattgagagtgcaaaccacccatgcttcctcttgggctaatgcagaggttaaacagcctgagaattacctgcaccatggaaatgtattctggggttaataagaacaaagtgtccatctttgagttattttaacaactaaaccctagagaccagagataaactaaaggagaataaagaaatataattacattggacagtaatgtcatgaagagttaattaattaggattcaatgagtcataacttattttgaagatgtggcattttagaaaaccacctagcttcattcatattaccctcagacattaaaggtgtaattgttgtcattagcattttaattggtcctgtaatttaatggttatacacgtggttgttgtaaggtcttttaagctgttgggattttaatatttgacatgtagcttgaaaaaataattatgacatttcccagatctgaggttggcctttgcagttaatgacaacactgcgttttcaaaatggttattattgatagtacaaatactcaaatggcctacagagctaccttcatctgtaccatagttcttttttttggagatcactgggattatctaatcagaccaacactgccaccatatttaagcagtatgtaatgtatggtagatatattgcaaaatgccaaaagaaaagcacttgtagtagtttctacttggaaaacagtattgttactaaaagttatggcagaaataatattttattaactgtaggccttgattgtcttgattgcaaatgctaggtactatattatgcacacagcttgaaatgtatgtggcacaatgaataaaagcttactttcctaaaatataaaatgattgaggaatttgatgatcacatttaaatattttcaaaaagggttattttctacccagcagtagaataattgatagataattacaaaagaggctatgccaaaattattgctaggccctttatattgagacaatggtctttatatagtgtttgatgagaaatctatcatttcccttggggtaatggccagttatttaccaccgtaacaacttaaatgactctgtttctagacttctagttaggggcacttcttaaatcttgaaaatggggcaaagcataaatttctaagatttacttggttgtcttcacccttagtacatggggtgagtttcagcttacaaacctggcctctcctctgaaactagcaaggaagaaccaagtgtcacaatatagcaggagctcttaatccgtctgcacaatcattgcgagatggggagtggataggcttcccagtcagtgcctctgatttgattggtccagatctggggtgtggacaatttcttataaagctctcaaggtgattctaatatgcatccagggctgagaaccacttcattagtgattattagatcggttctcaaaatacagcctaacattgatggactctgtcgatggcaatatcctggttgtgatatcgtagtatggttttgcaagaggttaccaccagaaacaattgggtaaagggtacgtggaatagactctgtctgtattatctcctagaactgcatgcaattctacagttatttcaaaataaaaaagtttaacttatttgttaatagtctgccagtgaactccattaaacttacttgtgactcttaaaagatgcagacttttgggccccatcacaggtctagcaaatcggaatacctgtgggtatgtcctggaatctacatttttaaacaagctcaccaggtgattttgctgaaacactgatttagctacttacatgtttaggttttgagtaatactgggcacctggacagtcctaggtaagtgagaattaggcaaactggcacactaagttccctgccctattcagtattctgctattcctgctacacttgtcttaaaaaaataggatttcatataccaaggtgttatgatgatactaaggcacactaatgcataaaaataatatataatgaattattcagtcattcaacaatttttttattgagtacctattatgtgccaggtacagttctaagcattgcttttaagaatgagtataagaataacatttgtaagcctatcacctcaggcattctgatagtacgtggatttcttatttaagcttcacaaccaccctgatgtaggttcttttattctcccctctttgcacaagaaaacactgaaacaagctgttttatgtacattgctaaggatctagaagtaaaaactttgaatctgaaatcagatttcgactgtttctttatggtaaaatatacataacataaagtttacctttttaactatttgaagtgtacagttcagtgacattaaataccttcacacactgtgcaaccatcaccaccatcaatctctaaaacttctccatctttccaaacagaaatccagtacctattatacaatatcaggggctgtttttattatacagtatatgacacccccccaccaaagaaacctttaattgtagaactttatacaaaaggtaaagaaaacaatttgggagaaaagcctctcgccagcatttcttcaatcacacaacatattatagaaaagctgctgtgtgtaagatcagccttgatctggctgtatttttattgaatctaaaaaaaagtaattatcagaactattgttataacttaacccatttgtgctgcaattgcttctcatttgtgaaatagacactaataaggcatactaatggaatctttagtgtgagtatttattaaatcactaatgtatgtgaaacacttagaacattgcctggcatttcctcagtccacccacccaatcccacccacacacagtcaaaagttagttcttatttccccgattgtcaattttgtatatatcacttgatgcacatcattttcccacatctttgtcactgattgttagttttatctagttcagtagcaagcacaatatctaacaacctgaatttatttttattgtaatcatttcaaagaaattagagtcaaatgtcctcaactgtatgtctccagtaatttcacttagaaagtttttcaggcactgaattcgttcttgagaatagagtagcattcccctgtctgtaatatttgagcagaaaggacattgcttccatgaagccttgtttctgttcttcttctgtttgttagaaaatactctgttgatggcaaattcgtgagcaatctaaatatataattaattagaagaacaaattgaaattgaccaaatctctcagagctttgaacaaaaggactcttcaaatggtcaaaacaattacttagaatttaagcgttcattgaaatgcgagacagtgtgcggtagagatacaaaagagaaaccaggctcccatgatattgtaaatgctaaccctgctccttaagcaaacaaaagtctctttctattgtcagtagctgtcttctaggacaaatagtttggtattttataaaagggagaaaaacttatcaaaaacattccatgaaatgtacctcttttgaaaaattactccttgaatttgagttaaagaattctttagaagccaaactgctgagatgatttatctgcacaaaagaaaactactgttcaagaagcatatttgaagaatatgtcattgcaaatcaaagattcttttaaaaataagtctcaaaaggaagagagggagagagggagaaagagaaagagagagaaatatataattaaagtcataggtaatttaagtttggaaatgaacattcattcactactttgttatattgtcatatggtggtaaacaaaacaaagcaataattttgtctgattttcttcgctaagaaatggaaccatttatgaagcttagcaactgatgcgaattttgctttgatggtaattatgtaacagagtggcaggggtttcacttccagataaagatggacaatgaaggtcaatttctatcctgtcgttttgaatattcagtgccagcacaatttaattgggatcaggtaattgctcagaaggctacactgagcccactatcatccctcagtgtcgctcctgcacacctacttatcctgatgttgtttgtcaaaaactgtcacaaggaatgtgtctcactgagaaaaataacctgtttgtcattgctcagagcttcaagaccatactctaaagtgataagaaaaagttttttgttttttttttttttgagcaaaactgtcttgtctctgaactgattaaattggtccatcatggtaatataagggaacattttaatgaaataaattatttatgggagttcagtgatatttgctctcctagctcttgtgcgatagtatcaagtgtacctcttactctcttttggcattgaaggatattatattagtcttgaatatcttttgcaaaatattataaattatgcaagtaataaatgtaaacattgttttaagaactagagtattgtgaataaattgctaaaaatttatcttgtgatttttctcattggcattagagagaagcagaaatttagaaactaattcgtatataatgtgtgtttgtataataaaaggaaactatgtgctcaggaacagtctgatgtcctcagaatgaaaatactcatagtaacagtaacatacatatatgtaatgtgatttataaggattgcaacattaaatgtttgtttgaattggcactagtaaattttaattaccacctatgacttctgacttctgtctattgatacgaggactaaaaggatagttaatgttattattagtattaataaaagtaatgtaagtttagtataagatttctaatctgttcaccatagacaatgaaccaaagaggaactactttgtgctacatttttatctgtctcagggcataggttcaagacaagacaatttctagttttgtaaaatgaaagcagtgatacagaagacacctatttcattccctcagattaatagtatataatactatatattatatactttacacaaatgttagaataaaaatgaagaaatatttaaaatgataggctcactactatatttaatagcattaatcctcaaaggcagtatttaatacattaatttcttaatatgcgtgcattgtgaatacatgagaaaaaggaaaaaaattctttaaatgagttcctgcaattaatatcatcaaatgatgtaaattacagttttaaaacaaaaaagcccttaaagcgtgctatgaataaagtaggaaacaaattaaattttaatctttattattattaaaataatctttgcattgttctttttctacttgaagtttcagtggttttcattgatagtcataaactggagagaaacttgtgcccacctatgatactccagaggcacaagacgccaaggcttactgtcttccagcattgcttccattttatgtctggaggagataagatatgggtgtagctgtgaaggagaattggatatgcagacgattgctttatctttatctctgaatgatggacacccaagcagttttaagggagggcctttactggctctcatttgccttgtttttattaggagacagcctctctgggttgcaataggttgcaagttataaaattcaaatgactctggatgagatgctacctttcttaacttaatttgaattgttcatatcaggagtcctttttaaggatcagtcaataggggaacaataagacagtctatgaatcttcagcatgggttacagctggaggacataaaaaaggaggttggaagcactggacacactttaaaaaaatcttgtctgggttgaaaaatgcattttctttgtctaagtcacatgttgtattccatatttagctgtagtgttgaaataataggaaaaacactgtgtcttggcaggtaggcccctgctctgagctggacccaatggtcagagcacatttttgtttaacattcagagggctgtcaagatgaggaagtccattttatgggttttctaccatgaatttgctcttcctggccaactccgctcatgcctgtgaaaagaactcaccagcgtactggagaatgagatactaaactaggacaagagccgctgctgaaaagctcatggctgatatcaactggaaactaattcaaatgactcttacaataaaccagttctccactcactcaaagtgacagtgaagtgaaggaaatcatcctttgtgtttcctttgtttcatgcaatagtttgtgtggttaattcattatagtctttgttctcaagcgaaataaaacagtcaggtgaaagaagagttttcttccttgactttaaagtggatttccttttataacaggtaaaactcagctttcaattgtttttagttctgaagttaatagcagtagttctaggctttttttttttttttttttaaatcaatggcttgttaattgtcatcccagttatttacatgtgactatagagactgcattctcccagctgccaggccgccagggctttgccactggtataatttataacacgactaattaaaatgaatttgcttgcaataaggttctgtgtgctatttgtgggagaggagttattaaaattttcagtacagtaatagtaaacttgaatgcaaagtaataataatcatacatttttaattacatgtttaatacccatttggctaatgtagaactattctgaaaattacttgggatcagcacaatgtctttttgtgcttagtagtatccaaagacatccttctgaatgggcttagcaatatgcactgtcatcaagatacagctgtttgatgacagacacacagtgtgttcctatgatactttgcacaagatcagctatgacaaatacaagttcattttgcttattgcaggcaaataatgtcctttgcaggaacttggatggagccagaggccattattctaagtgaaatacctcaggagtggaaaaccaaataccatatgttctcacttacaagtgggaactaagctatgggtacacaaacgcatatagagtaatggactctggcgactcatactacatattgagtacaatgtacactacttgggtgatgggtgcactaaaatctcagaatttgccactgtgtcattcatccatgtgaaaccagaaaccacctgtacctcaaaagctgtcgaactaaaaaaatataaatttttaaaaatgattcccggctgggcgcggtggctcacgactgtaatcccagcactttgggaggccgaggtggacggatcatggggtcaagagattgagaccatcctggccaacatggtgaaaccccgtctctactaaaatacaaaaattagccgggcatggtggcacacacctgtaatcccagctactcgggaggctgaggcaggagaattgcttgaacccaggaggcggaggttgcagtgagccaatatcatgcctttgcactccagcctgggagacagagtgagactccgtctcaaaaaaaaaaaaaaaatatatatatatatatatatagatagatagatagatagatagatatttttatatatatatccaaatatatatatatttatatatccaaatatatatatatttatatgtccaaatatatatatatttatatatccaaatatatatatatatttatatatatatgagatttccattttccaccaactttcttttgaaaaatttcaagcaagactagtacaaagaacatccatatgtcctccacccaaatttatcaatttcttacatttgctcacttgctcactctccctccatcccctttctcattatatatattatatattaatatataatatataaatataaagtatatattaatatataatatataatatatgatataaacaaattacataatatataattataatgtataaattatataatgtattataattatataaatataaattatataatgtgttatatataatttttatatatctggctgaatcacttgaaagttatttgcaagatgtcatgatactttacttctaaatgcttcatcatatatcttctaagggcaaaatattctcttacatagtcacaacataattatcccatccaggaaatttatggtactgttatctaatacacagtccgtattcacattctttacagttgttcctcactctccactttgctccaggatttaatcaagagccatacaatacattccgatgacatgtccatttgatctttaatctaaaaaagagttttcagcctttgttgatatttatattctttatgttcttcaaggattgctcccagttgtaaatagtttctgatgtttgtttgtttgcttgttttctaagtcaactcctgaagaagcatgtatttatacacaactaatcttgaatgaagaatggtcgttgttaaggacttgatattagcaaactgtattcccaagctctttgctattttacccataatactgcaagacattttctccgactcatttggaaggtgtttccatttgtatctggcaagctattctcttagttcttaataataccgtcattgaagatcttctagtatgtagaaaagtataaagtgctattagtattccaaaggaaagtataatctaaatggtgaaaggaaatagaaacatgggcaaaatcaatacagctgaataaagtttaaagatgcagaatatgttacaaggcaggttagcattaattgctaaccaagtgatatagaacataagtctatattatctgtaatttacatagctattgattttcataaggataaggcaataccacttgtctaaaatggaaaagaattatgttgatgttagaaataatcatttacataagcgtacatgtgatttcaaggacaataagctaatgatggctcataaatatgcatatttttcattgatcaaaactgcgcagtaaacttctggtatctgatcttgtaaattgttacacaacattaaggtaattaagaagagaattaaggcaaataagactgcctttaaaacatacctttgcatggttcttcatcttgaattcgataatcacaaatgtgacaaatctctgtgctaagtttattcagtttaacagttgtaaattaaaaaaaaaatcctccattatgtttatcaagtcttccaagcttttattcaccatttttaaattatgtatttatttgtacaccatttaaaaaaattatatttttctacttcatgaccccagccaaatagcatacaatgtttaactccttacaaatcatacttatttctttatagtatattgacaagttttgtgatagatcttcttttagaattcaataacctaagaattaaaaactattttagagttagtgattctaacttcatgaatcttctgattaataagcttcctcaaatgcattttaagcagaaagaaaattgctgaatataaactaaaactgctcagagaaatgctttttattatgcactttcaaatgaaagtgaatgcacaatgagcccagtcctctctttagtgttcagtacacagctcagggctgtgtattaacccagtgccctctcctttctagctatgcaattagtattgattgactgatagatagcacacttgatgttggtggtcactgaggtacgtacacctctgtacaatgcccgccaggccattgtgtgtgcctggtacgttactgaggaataacaaaacaactggtgagtttttaatcaactgtacatggaatacaaaatgtggtctgtcttcctgtgtctagctacttttacttcgcggttttattttcccagtgatgtgtacactttagatttttttcccagacataagagaaaatgtatattgtattctacttgctgttttaagctttctcttaaaaagtctatacattatatttgtgttatttaacaggcccccatacatagcacttggtatgtttaaaacacctcatttgatgctttataaatatgagttaatttgaaggaaatcatgagcaaaatctcatgcacatttcttttgtgtatgaaatttagtggaggatgtttttgtctacatatcagcttgcaggacttctgctcaggccgcatcatcttttataatacacatgaggtccaatatggcctccttccaatctatctgctgggacaggaaaaggaagctctaaatatctcagcagtaactcccccattccctcattgccccagcccctagaaaccactaatctgttttctgtctataactttgcccattccatatatttcatagaaatgcagtcataccatatgtgaccttttgtgcctgacttctttcacattgatgttttcaagattcagccacattgtaggaattattttatttctttttattactgtataatattccattatattccacattttatttatccatttaccaattgataaacatgtggggttgtttctgctttggtgctattatgaataatgctgctatgaaaattcatgtacatgtttttgtatggatatgttttcaatgttcttggttatatacctacaagtggaattgatgagtcatatttttgagggactgccaaacagttttttttttttttttttttttttttttttttttgtgatggagtctcactctgttgcccaggctggagtgtagtggtgcaatctcgactcactgcaacttctgcctcccgggttccagcgattctcctgcctcagcctcccgagtagctggaattataggcgcccgccaccatgcctggctaattttttttttttttttttttttttgagatggagccttgctctgtcatccaggctggagtgcagtggcgtgatctcggctcactgcaacctgcacctcccgggttcaaccaattctccttcctcagcctcctgagtaactgggattagaggcacgggccaccatgcccagctaatttttgtatttttagtagagtcggcgtttcaccatgttgatcaggctggtctcgaactcctgacctcgtgatccgcctgtcttggcctcccaaagtgctgggattacaggcgtgagacaccatgcctggccgccaaacagtttttcaaagtggctggacattttaccttcccaataaatatgctttcatatttgaactgactgataaaatttcaacatacaaagcatataggaatttttacttcaagttacatctgaaatggttggctatatttaaaagtagatattctgtttttaacaataaaacataatatcttgcttttctatatgactgacattattatgctagatgacaactacataattattggcaaagcacaatttgtagaattacaggaataaaactgatggaagcatgtagcatttcattcttccaaagcccagaatggaaccaaatagcagattagttgcaatattgaggttgaaactcaagttcggtgcatgtctatttcctcctcctttcttccattcccatatcaaaataaaagaaaacaaacaaaatgctttttttttaataacttgtttttcagtgtaaggaaaaaatggtacagtgtgaaagctaaagtacatactagctgagaaaacctgacatgagactcattttttaaagtataaacctgtatagtagataacatttcttgaatgctcgctatgtgccagacacaatcataagctctttcaaggattaacaacacaaggctatgaggttggtattattgttctccatattgtacagatgaggaaataaaggcacatagaggcttagtgtcagagctaataaatgacagaggtggagttcaaacctaggcaggttagctccagaatctgtgttttagctgccattctgtgctgctaaagagcgtctgttaccaccattatcctactagcaactttaaatgcattcatgtaatcattggaaacttcacatgctatagtaatttttatgcagaatttcagtaaaatatctctaacatacaacttccagattcaaatttgcagatctaccattgttatctaaagggtgttttgattgatttgtatcttattttgtgggacagcaggattcagtgagaatttccacagggtggaatcagtattgagtgccctatggaagtgttaactccattccaatatccatagttcaagcaaattgttgtttcctgtgaatgttcttcaggctgttactatatgtgcctgtcatgtcattccatgaaaaaataatgctggccttgtagtttctacaaactttactactatgagtgtcacctctgagtttgaaatatttgaagcaggagactctataagttttcagagataaaattgtgtccagaaaaatatgtccccctttgattgacgtgggtgagcatgactgtgtatcatagattatagtattccgttcactcagtttcctttcaacaatgtctcatatatttcaaaggaaaatgttgccatgtcactttagatttaaaaggttgcagtgaatgatgttttcttaaataaaagggaggaaaaagtaattgtcatgttttgtagatttaagccctgtcattgccaaaatatctgcacgtgaaatcagtagatagaatttttggtagggcttctctgttgtctgaattcccattactggaaggaaagtatgagaaaaataaaatgaatgtctcatttttcacatgttcttcagtagtttggggtcactgtttggaaaatcttaagaaactgtgatggcttgaataagtagtagagagtcaatcactttaacctgtgctatttatctattttcttctaccatcaattcccactatatctttaagagaaaaatgcagcacagaatttctgacatagaccatgttgaagtaccatttttccccatccttgaaatctcaactcttccttaaaaagtgtcaagaaccaggtatggtggctgtgttagtttgttctcacactgctaataaagacatacccaagactgggtaatttataatggaaagagctttaattgactcacagttccacgtgcctggggaggcctcacaatcgtggctgaaggcaaggaggagcaagaggacgtcttacatggcagcaggcaagagagagtatgtgcaggggaactcccctttataaaaccatcagatctcatgagacttactcactatcacaagaacagcatgggagagacccgcctccatgattcagttgcctcccaccaggtccctcccacaacacaggggaattatgggagctacgattcgagatttgggtggagacacacccaaaccgtattagtggcgcacacctgtactcgggagactgaggcaggaggatccattgagtccaggagctcgaggctgtagtgagccctgattgcaccactgcactctagcctgggtgacattgtgagaccctgtttcttaaaaaaaaaaaaaaaagtcaaatagattcattctcaattttattatgtaagtattaggatgagatatttatagtatgatagaatctgaccaaagagtatctgttcagccataaagggagtatgtaataatattgtacgttagtgataatatcaccatcaaaaattatttctcagttttcctttgagtgtacatctgtaaatgtgtatgtttgtgtgcgtggcaagatttgcagatgccaaagtcctataagtgtccttcttcccatctttttatttgaacttctgagggtctgcggtgaaaggcaataaaagcccttaacttcattactgtactttatactaaattcaaacaatattgctttatttattttaattcacgtttagatttgcattatattttgtacaagacaatgggtagaacctaatttccagttttcactggagcagagggtggaaaggaatcagcagtaaaagtgagtcctgattagtttcccctcctcttgctttagcctttgataagtaagcgccttctactttcatttccaacagcgtttaccatagaaataatacagtgctcttctccatttgctgtggagccctgtggttcattgttattatttcctcaggaatccctttaaaggtatcctgcaataatgctataatctcagagtagctttaccccttgccacctatataatgatcatttctagttaaaaaaaaatcatgtggaagagagttgataatattacaaggagaagacaattttcctgctcaaaatgtgagaatttgaaataatagatgtggagagaaatttaagtaaatatacaattaactcttaacctacaacttcactgaaattctgaggaaatattccaaggctgcataaagtgaatgaagagtttcctaccaaatatttctccctcagtacctaagtaattgtttcttttctgaatcagttgcatacacagaagtagaggtggcactaaagataaagatgcttcgaccttgttctcaccactttttttcctgttggtttccagcagtgtcatgggctttcattacttattcaagaactggctgtgctgaacttccattgctactctgcctgtacccacatatttctgtagcttggaaatttgtctttgagtttatatagtgaggatcttttatctgtcactgtgcggtagctttagcataactgcatttagatttagagattaaggcttataacttaattatgaatccaactacatacgaaagagtttaatttaaatttaatattttgattcagcacagctcaactcatgtgttcttgttaaattgtctctcattgaatttttccttgtcattaccttggacatcagtgcttttccagaattgcaggctgtagcaaaataacaacgcagacttgacttctgtctgagctaatcttcagaaagggcacaggctaatggtgacgtagacatctttacagtttgtctgtaaatgtgttgggtgggtgtgtatgtgtgtgtgtgtgtgttcatgtgcatacacagacatatacacatgaatgtgtcttgctatgctaaggcctgaacaaataaaaataatgtcaaataaatatatttacaaagcctaatctgaaatgataaagtagatgaaatttgagaaggaacatttgtggtctcccaattttatgcctcatgcacatgtaactctatatacatatatagagggaacactattcacacaacacatacaaatatacatgtaacacttataacagtgtagttatgtaagtgtttagatatgagaaactactatttataggaatccttcagcagtatctttcttgcctcctcttcctgctcttcctcctacttctcttcctccttcctctccgccacccccctccccacccccgcataaaaagggaatggtttagtcaggtaaataactaaaaattgttatttttttaaataggctttataaaggtgattttatcccagaaagaagtgtacttacacggctatgggggactgatctatgcatataaagcttttcattatcagtgggaaatttccatttgtaattatgtccatcacaacatcagcagcaagagcatatataatgtttcaaaggttagttaaggagtgtttgtgcattttgtatataattagacaaagaagtaattaatatagacttggataacttgcttgcataaacaacattaaagcaacaataatgaacactttaaaatatacacgaatatcatgttaacgtatcaattgccctacttctacctttccctagttcaaatcctaatttaaataatatttcagtgaatataatttttatacgtaaaatttcttcaatatacaaagaattgtttgttataaatttcagtgtcagaaactttaaactagaaatgcattcccatcgaaatagcgtagttaaaccttctctaccaagtactagtgagatgtttgtgtcgagaagacacagaggctgtgttggggtctgtctgcaaactaacattacacagggtagcttcatttggatgtatttttaaattagatccccactgatggtttcctttgaaataaaatgtttctcttattttaaaatgcttgaaaatcaacattataattgatggttaaatttccagtttaagcatacttttccttgttgtactacacatgaagtactgtgctttggcaatgaaaataatagaaaatgtgccataaaagtaattgaaacctaaacagaattgctgagtgggatttttgtttcatgtcttgagcatgttgcttaaggaaagcagatctaattagggaaagacaggaggcagatacaaagactttggtgggaattgtgagcagagaattggggcattttcaagggctatgagcttgagagagtcgttatatccgatttcactttccatttcctagttgttacttttgctacacctacacttattaatcatcattggggttgtttgggagcttacaagtgagttgaagagctgggtaaagaatagaaatttcctctgagttattagaggagcaaagaaggaaaaaaacaaaagatgggagatgggagaatggtgtgcttttgtgtgttaatgtgcctggggttgaagtagttacttgtgagaagcaaaaggggacaatagatcatatgctattgctcatccttttgtggaagaaacccatcaggtatccattcactcactatttactgaacagaacacattgtaagagcacagtgtattaggcgaagggaggtcactggtgaacaagagcttcctggagctttcagtctactggtatcacaagcatagaccaaagaagcacatatcataagtgctaaaagaggtagagcacagaatgagacctcatgataagggcacttattataatagtcctagatctgagggaacacttctctgagaaaataatgtttgagctgacacctgaatgctgaatgggagttaatttatgtgccgagagatgggaatagttcctgacagaggaattagcaaatattaagctgaggagtttgtgttgtattttataaatataaattaggacctactcttccttttgtctttccttattagtgtgataaaatcatcctcctagttacaaagccaaggactctgacagtaatttttgaccctactttctctgccaccttgcacccccgttacctttactctaataacatccttttgctcaataatttttttctctttctatctctaaatctcttctcctacactcaaccctcaatttaattcaggtctgagccacgtattgctgaactcacagctttctcacttccgctagaattgactttcagaagcatttgatcatgacattttcagtgtaaacctattcagtgacacagccctgcctgtagaataagacgcgtcagctttacatgttctcttgatatgatctggacccctcatctcctaccactttccctgtattcttgccacatgcacctccttgttctcttgaatatagcaggcacttagggccctgagtctctaaacatgccagcgtgccctcccttccctaatcatcagtcacaatttgtatcctctagcctgttgctttccagttatcatactcagaattaattttgcctccttccttgtaatcgtattacttttacctgcctctcccccttttcagcatttactttataactctgtcctatattgtagtgtcataaatcattgctctaactagagtttaagttcagtgaggtccaagaatttgtcttatttatttttatattttatgcttttatcattttccacagttggaaataaaaatttatagtcagacttttagcagcttcctggaactgaggcaatgcaggctggggcagagaagaaagttaaaggatacttggagaaacctgaagaaagtaatttagactattttatggtttatagtctctttttgatcagctgtgggtgccctcacaatattggttgttgagaatgatttgacagaagttatcaaaataaggagattcaaacttagtctatatgagaccaaatactcacattttaaacaatagacatttttagtaatgacatttaagctcctagatagctggatacagagccaatgttattgcatataattcaccaattcaacaaatatcagttgatgactcaccgggatcaggtacagttaaaacttgctctccactttggtcatacttgctttaattcattgctaattgagtcttaaggctcaagcagtgggtcttataaattcactggtctttattgttgaatccttctctaattttggcagtaatcacgcatgtcaatcttgcaatgaggagctatcggattttcaacctttacattcaagctcttgttttttcctgaactggctctttgtacaaataaaaacacactggcaaaataataaatgagaatccttttggacttttcagccaacaataaaatattttttataaaaatggaagtgcacaaaatggcagccatctgttgtttaaaaacaacagaactgtatttaagtcaattattgtgtaaggtctgtgccttgaaagcaagggcaaaatggtttatgttcatctcaatgggagaagattttgtgtgcttctttgtcattgtctatgttgatgtgagactggataactattactaactgaaaatagttaatcatatttaatcatggatgaggttgattgaaaaaatgtcatttttatttatgaactcacatggacatgtctaattggacaattctgattttctctctttattttgagtagctttaaatccagacatactagcctagcaaatccataaagaatctgtcatcatggaaattgctaacagagcctgaactttttcctctttccccccactcaaagtttgaaacataggcagattaatagagataacaattagaataatggtaagaagtttttttttcaaatgaagtacatcctaatgagagttaggtttttgctaaaaagtgtttttcttgatattcaataaaattgatataaataaattgtattgttaattttaatctttttttacttggtaaaaatgctttctatgtcagtcatctatattatgccaattcttgcttcattttcaatgtttattagagggattttataaattaatcttgttttcatttatactattgtataaatagttttcatttatactattgtataaataatagtattcatttatacgatatatattgtataaatagttttcttttatactattgcattttatgagtgaaatatacaatatatattctttggaagacatatcaatatcactattgcaacagatatttttccagaggttaacaagctatggctcacttacacatttcgcttaatctacattgtagtttgaaaacacacagatgtgaacatattaccaatattttgccaatataagagtccacatttctgtcttcttttataaagtatatgaggcaaacacaacatatccagactaggatgtagactgtaatttcaaaatatctaaaataggggagtgccgggggaaaatacgtcattttgaaaagatggctgtgttctctgtgtttatagttgaaactataaacctatttctacctggatgaggggtttataagggcaacattactaattttgagtctccacctctacaatgttagctccatgagcgcaggtattgggtacagctgaatcctccaatctaccgcagtccctgcctggcacataagtgatcaacaaatattttgttaaatgaataaatgaacaccctgtctctttttctttcacctaatcctggtatgtctttgctccaatcctctgccacccagggctactattttattagttgatgccagaaaactctccaatgagaatgtcccatgttcttcactgtcataccttttttagactctttgctatcatgccttaactaccaacagcaaagaagccaaaaattcagacactgagatgtggttcagccagaaatatttacaaatgtagaagtgagaatactaagccaaataacatttctcataataaaatgtagactgtaggataatattaaaacttcaaattgtacaggagagataatttgggggaaagagtgtagcactaagccagtgcttctcaaacttaaaggttcacatgaatcacttgggggtctttttaaaatgcaaatttgtatttggtagatctagaatggatcctgagaatttgcatttataagctctcagatgatgctgatgctgctgatatatggaccacactttgagtacctcgatattaagcaactgtaaactatttgtttgaaaacagccatgatttgaagctatacatgataaaatcgatgggcatttatcaacctgctgaaaaaacttagatgtctacaaatgtccaaatgggagagatacttggagtaagaactttgtagtggtagaatggcagggacctgagatatctgttgcttcaatttacaaactgggattctggaccccaaagatactcaatgacttacataagaacccacagctatgttgatgctgcacccaattggaaccaacgtttatttattcccagacccatgctctttaaaagagatcatgcacatggacataaagaaggaaacaataaacatcaggacctatttgagaggggagggagggaggagaatgaggatcaataaactgcctataggctactatacatattacctaggtgatgaaataacctgtacacccaactcccgtgacacgcaatttaaccatataacaaacctgcccatgtacgccctgaacctaaaataaaagttggagtgaaaaaataataaaaaaataaaacagatcatgctgcctcttggctattgaagttatagtagaattccttcaataaaacacttaggaagttgttgtactataaaatatacttaatttcacttaatattgagtgcttcactaaagtcagtcaaaatgaaaggaagtaatgcattcgcttctcatgagttgcatttcttgtgggtaacatatattaattttattataatttatcttcattagctattgaaaataatgctaaagacatttagaatgccttttagcgggcattactgaatattagatgatgaacagctttgttggaatagtttgtttagttcctaggagaaagtttgatttgacgactaagtaaaaaatttaggggaaaaaagcaacaaaaaagtacccaaaatcaatatcactacgtttgctgacgaagggtgtatttttagctacactgattttttaatttaaaaaaaatctacacggatccccctcaactccaatgtcaagtaagctcaactgacattatcgaaaccatcttcctttttattatcaaaaccatcttcctttttactgtgcatgtgtgtatgtaagtgcaagtgttacaaattcttaaaagaagataaaagaatgatttttcctcattatggtgtaaaacaaaattaaaaattgaaattatctaatctgcataaattagacactttatattacattggcagttttatcatatttgaaacattttgttggtctcaagatttaattagattatgtcaccaaatcagagaccacaaatatccatgggagcttaatagaactttttggattttcatgggatgaaaacagtattttcatgaggcgcagaattcatcatcagcttctcacctccattctaccctcagccttctatttccctgacccacattagtgttatgagagcaacaaatggacgtttcttccaacacaggttgtaagaaagtgctgctatcatgtgaggagtataaagggaaaatcaggcagcataatagctgagctaattaggctcagaccattaaagatcttataacggttatattattgttgttgttaatatcacctgagtattgcctcacagattacagaatgcctcctcatacattattttatatcacagattataaaaggctagcattataaataataatcatattaaagagtgttattttaatattacatgagacattgattttcagtgatgccatgtgtttccatagtgactatgataattaattgctataaaatcacaaacagtatttccttttgagagttgacaacagatgctggcattttaacaaagagtatattaaataatccacagcatgcccagaaaattgaaatgattaccatgaattaaaaaaacccacaaaactcataacaatgcttggtgatacctagaatattctggttatctgtaagttttcaagaaggccaagcaggcctctgtcactgttctttacctgccaatcacaccgataacttctatgagacatttctgtctttgagctaatcatcctctttttaacagcatacgcattccaacaggcatggaaactataatgtattaagccattttatctgcaattctcacttgttgtgatttagtttaatctgttttctttggttccaagtataagccaaaatcaggacacagagaaggggcatcttgttaataaggaaagaggatgaaatggcagaaaagtagtgactccccaggtgcaaataggggaatatcaagatgtgtcaagaaatgaataggcagcccaaaagccagatttgtatggaaccttttctgcctttgtgcctgaataataaccataattcctaaataaatcatatgactacagttgaacagtggtaacttttgtgtgtagaatgctgaacttctaaattatttttatactcttcgtcaaatgcactttaaaattaaatagttgttataatatagtatgccagcaaatcccagattgtcttgcagagtgactcagaactcttgaaaggtcactactttcgaacttcaacatccttaaaatcacttgaaaactgactgctgctggtgtatgtgacttgaaaatatattttgttgagaatatacaatgtttcttgttctgtgtcaattggctacccacattcaaacatttggagacctcccataagcatccatttttcttttaaaaaactgaagatctagcagtattgggtccacgttctgttccagctaagtatcactacctcctttggaagggatttttcctttccagtctcccaggtcttggtaaacctctatcttccttgaatacaatagatctggcacctattggcattcagtgtagaagaaatggcattcctataatttgatcaatgcactgattgattggttgttttagaaagagctgaatgaaacatttcagtttcgttgttgatccatatctatctgtctgtctgtctgtctgtctgtctatctatctatctatctatctatctatctatctatctatctatgtacctacctacctacctacctatataggtaggggaggagagagagagaggcggaacataaatcatggtgtaagttacacttttaaaaaatggaccaatttaccattgtacaattgtaaagactgcgttgaagcaattttaaggataattcagaacatatttttctaagtaaagttctatgtcttatgagagtagaaagcaatgaagaaatatacatacattttgcgtaacctagtggcccttaatgtataaatattgcatgtttaagtgaagagtcatccatcaagaatctaatctataccagaagtatacacttcctcttttatactttgtactaaagatataaatatgacgtgttccctagttctctatccattacagagtctggtggataaaaattaaaaatataatcttaattaaaatggaaggggatgaaggctataagacagtcaggtacacacatactatatggaaaaactgggcagaagtaattctgtctcatatagtctgggaaggtcccatagaagtggtcatttagctgattcttggaaaaataagtagtaatttatctagcaaaggatataggaaaaagcattataatgagaggaaatggcataagcaaagaccttgacatgtgaaagttgattttatatctataaagatctctgactgaggaatattgttggaaatgggggatagtgaaggcagatatatgtggaagataaaatgggttgatcgtgacattttttttttttttttttttttttttttttttttgagacggagtctcactctgtcgcccaggctggagtgcagtggcgggatctcggctcactgcaagctccgcctcccgggttcacgccattctcctgcctcagcctcccaagtagctgggactacaggcgcctgccactacgcccggctaattttttgtatttttagtagagatggggtttcaccgttttagccgggatggtctcgatctcctgacctcgtgatccgcccgcctcggcctcccaaagtgctgggattacaggcgtgagccaccgcgcccggccgatcgtgacattttaaagagctttcttttccttttcaaagagcttgggcattttattatagacaataggaagtagaaagtggttttacgggaggctatgaaatgatccaaaaggcaactctggctgtagagcagagtcctgattagaggagggaacaaatgaagtcagggagtttattaggaggctttaggaattggccagcgggagaggctgtgagtaagaacgaaagtgattggcaatgggaaggaatcagaagataaataactgaaagatattactgatgaagaaactttccggattggatgtgggcactcagaggatgagatgagttggaggtcggtagtctgggaaaaagtgaagaaatcatgccaaaatcaaaatcataatgtctagaaagggaagtattttccgcagcatggataacagtccctgggtaatgtataaattctctgtcataaaatactatctcccacaaatgttaattaagtatttgaaccaaaagttatttggcattaattgtgatcactgctattattgttattgttgatattatgagaagtagtatttagaaaatgtgagcaatctcatgctgtatatgcacactaggaataatgctaaaatagaaaccaaactaaacaaaaataagtaagaacaaaactccgatttaattcaagaaacatgcagattcatttttgcttggattttctttgttattctaaagaatcatgaaccaatttttttttaagtcctaactattgctatcctggagaacacttcaactacatagagtaaccatttacagaatacagttgaagtctacagctgctctggaggataaatgcctatttcttttaaacgttggctgaggccctctcgaattatatacctcacatgtgctgtatttacatcagaccaccccaaacatgctttccaaattaggttaaaatctgtgtcaccattttcatgtaacatagaaacttaattttatttatagagattttattcattttatcacatagttactatttgccttcctggtttatgattccagtttctttggaattccacttttatgtgactaagtaccctatgtgtttaactctactagatatcccatcactaaaatacaaccataccttgggattattcagttctttggtaccccactatacctcccattaggtgagtttctaatgcaagatactgaccatagtatgatgcattctgaaattgccttggctattcatacacaggtatatgtcttatatttgaaatgtaatagcattttgtatgttataagcatgctaatttgggggcctatttattgtaggagtagcaaaaaataagattgtacttttgaagactatatgtggatacatagtatcatgaatggctgctctattttgtcaaattcagaattaaaataagatttaaataaaaatagaggccttttcagtttatggattttcttattatcttaaaaaaaaaaaacatgatagtgaggtttccagctgagaggaatggttggaaaaacattttgttccagttagttaattcttccctacatgtgctctattcatcgtatccattttaaaagcaaatgaaccatctctatctcctcttgcatttgtggcaaactcttgctgtgccaatttcagattacatgcatcttaggaagaataagatgttctaatcttgattataattttaagttaaaagaataaaattagttcaatactaagacattgatacgttgcagtagtcagactgtcattacctcttttgacaaaatagaaaaacatgtctatacacaggataataagttcctgcattaaaatgcataatactataaatgctactagatttcaacgcaatcaagaaatcagtttatggaagctgaaatttgttaataaatatgctgctacttgagagtttaaccattttgcaaataattatagcaaacttccaacgaaattattttcattatgaatggagatactttccaaatgaggatataagaatagataataaacacatgaaaagatgctcagcaccattcttcatcagggaaatgtaaattaaaaccacaatgaaaaactattatacacatgttagaaaggctaaaatctgaaagactggtcataccaagtgttgtaaggatatggagcaagtagaacacataagcattgctgttggaaatgaaaaatagcataatcacattagaaaatgcttgatagttttttaataaagtttgatagtttttaaaaatataggtcatggacaaatagatgtatgctttacagatgctttatacatctatttacccataacccatagccaacattgtaatcccagatgtgtatcccagagaaataaaaatgtatgtcaacacaaaagacttgttagtgaatattcatggcagctatattcataatattccccaactcgaaatgaataaaacgtgcatcaataggtgaatggatagtggtccaaccatacaacggaacacaatttagcaataaaaagcaacaaactacagatatacataagactatggatgaatttcaaaccattctcttgaacaaaaaggccagacatagaagtacatacacattaatatgaagaccaagctctggtgacagaaaacagaccagtcatcgtctgctcatgggggaatcttctgagataaggggaatattttataccttgtagcttagaagaaatgttatagagccccaaacctgaacatggagaagtttaattttgaattatgagacaatctaagcattcaggcttcagagattttttttaaaaaggcgggcgggggggtggggggaggccacagtgtgggaacattggaaagttaggactagaagtctcttgtgaaaatagaaacaggaatgaatggaaaagcattcattcataccgtcaacaaccgaatagttgttagagtacaaatgatgagccagactgttccaggcattgagggtacagatgaagtacctggcctcatcgaacgtacacttacttagttgctgagacatacagtacacaatgtcaagtaaacatgatgaacacagatcagtaatataaaggaaataagagcacccagacaggaaggatggcacagatccatttttagagaaaccctggggaagggtgtaccaggtagaagaaagagtgaatgcaaaagacagagggtgacagagggtgacagagagctcactctgcttcagatttgtatgataagtgtggaaagcctacagaggcctgtttctgttggagcttgaaggctaccatatggtgtttgcattttaaccaaaataaaatggaaagctattgtggagtttcaagttcgagagttgcattatttatctgtgccttaaaaagatctcttttgtttaatgtgtggattgagggagggagagaggaagaagaagtagcaaataagctcgtaaagtctaataaaaagaaagcagggaggcaagttagggagttattgcaatgtgctggatagcaaatcagggtatcttgactcatcgaggtggcagtagggataaagggaagtggacagtttcaaaatacattttggaggtagacgtggaaggacttactaacaaataagatgtggaggaatgagtgaaacagacaaatcgaggagatccatgggtcttgcctgagattcttgccatttacaaagatggcaaggtctgggtgtataaggcagggatcgggtgaagagagactgtttacaaaggtgcagaaagtgtataaggagaacagcagtgatagtgatgtactcccaggcaagtaccaatgaggggtcattactatccttagaaaataagtagcaaggaaaatgaaccattagggtacttgtacggagaagccttctcctaggagatgaggtcttcagtagaggaacgcagcaagcccacagaaacctgggagaggagcctttgttcttatagctggggaacattctcattgaccaaacccaaccagaacctggagagacagggtgaatgaggggtggtgggaaatggaggatgagggggctggagtacttagagcaaatgagagtaaaactataagggcaaagcaagagacctggcacaatgcccatattctgaattctgtataatttaaaagttcagtaaacttttcctaacaatctaaattacagccaacaacatacaaattttgcaacaacatagaaacttttgttgccaagaagactaatttggaaggctttgctagttctatattagtaatgtgttattttttgaatacctagtagaggaagccagtcccctgaaaagtgtccttgtaagtagtcattatttagttaagaaataacccaccaggaaaaaaggaaagagaaattatgagatgcacaaaacctgaagacaactttagtgttatagaagatcttgagagtactagacagatggaagtggagaatgcatccgtttctttaccattaagaccttgcctaggtgtttttgacattttgagctgagataagagagtcgggttttattccatatgcttaaagtctttactaggtttgtcagtataacttaatgtttttagttaccacatgtcattctgttactacattttgctagaattgcctaacataaacagtatccttatgtttcataatacaagctattcaagggtcatattggctaatacaaactgtttagaaagtttgttttgccagaagtcactattgtcaaagcactgattttaatttttggtgatacccccatttaaaacagatatttaatgcttgcccagtatttgttgctcaatgatactttattgtctgttgctatgcactgattgattactgacagacagtaagtgcattggaagaaaccatgatttaaattgtgtgtgtgtgtgtgtatgtatgtgaatgtataaattattcagtgaagcaatagaatctgcatttattcagaaacaaagaacattcattgattccacaaagatttattgagtgactactatgtaccaggcactcttttagggacgtgtgctacgtcagtgaacaaaagagacctagattctcgtgcttgtagatataatattctagtaaggaaacacagacaacaaataatacatataataaaaataaatcatagtatgttagaaggtgatatatgctaagaaaaaaatacaacatgcacaaaatgaagcaatattcatcaaggtcatgaagcaacattatctgcactctaatctgatctccttgaattcataatggaagctgttgccgttttcatatacatcaattcttttttccctttcattttgtgataattgtacatatgtatggggtacagagtgatattttgatacacatataaaatgtgtaatgaccaagtcagtgtcatccatcaccttgagtatttatcacttctttgtgttatgaacattcaaaatattctcttctagctttttgaaaatatacattcaattatttgtaatcatattcattctacagtgctatagaacagtagaactttttcttactatatagctataaatttgtatttgttaatcaacctctacctatccatacgtcaatacttaaatggtcaaaccaaaatctttatcagaaatcactggtactttcatggttggtatgttaaagtttggatcactaaataaatttagagtaataggctgatcctaaaatttcattgataaacttgtcataattaactgtatttatgacaaagaaagcaaaacagaataatttagataattttataataaactagttcaggatatgtttatcctagctatatattggtgcatcatttgtcttactacatttgcatatgcttaaggcactgaatctggaacacaaaggaaataaatgcgcattgttcgttttttaagaaattctattcacatgggttttaatccacagagatgcctccttttagtcttgaatgcaaaaagaaattatcttttgagtgcgtgtgttagctttgaaaaaatacattcacatgagatttaattcaccttaaagtttcttttctattaaatctcatgaggaattgctgaaggaaagtttcatgatgccaagtcactaagcaaagttctccaatatgacagttgttagaaatgtgaacctagtgcagttgtccccttaagctatgggcaaaattcccagttttgaaccctgaactcattcagccaaaaaatctatattatgctagtgtctattacatgtgacttccttttgaccagctttttctatgtttagactctcacttttattccaaagtacactggaaaatagaaaaaaatcggataattctgttctgggtgatcagtaactttggaaaaattcaatttgtttgttttttttctggcaagagtttgaagtaaaacaagtttcttttcaacacattgaaacaacctattttctccagagcaatagagtttgcatctgatatcagataagtgattcttgtaatttgtctaggctttcaacaaactggtgaaaaaaaaatctcctttcatttactttccatctttcttcatgagtttcttttttttttttttttttatctcaaagtgttcttagagattgggggttgactatctagctcataataagaatctaacagaaaacataccattaagcatttgagcttctcagatcaaaatcaatatttaagaccaaaataatattatgcaagcttttctgatcataaaaagaaagatcgttagtcactttggacagaatgatgatatctttagtcattgaattaaaattcataagtgtaatcctcctgatgaatttttctctgtctggtatttttctatcaggtttataactcatgaggctaaagcaaattagtgtcaacgttttatcatgaccatttactcggtgcctttctgtttctttacgaaaataaagttgctttttaatgttttggtaaatttatataatttctttggaaacatcaccactaggatttaccatgaattacagcaatatacttagtgctgcttagaaaatatttcatccctttccctgttttttgtgtaggtttatgtccttttaatttctgtttaattccccttatttaaagcctaagtctcaaatattcatgattcttattgcgaactataaaatatgtgcttaatgccattatccttttaaaatcatcttgaatctttatagtttaatcacacatcttgcctgtaactaaatttaaaactctctggtaaaacaaaatgcctaaacatcttgtataatgatatgcctttttagcaatggttacacttctggctttataaaactatattacttagctttttaagttacatatgtccattatatgtatctaataaaattaaaccggattttagatattgaacatttttaaagccaacaaccttggtgctatccttggtttttcctctcctactgcctctgatatctaatccatcaattcctattagttttatctcaaaattgaccctgtctctgtccataagtcttctgtcagcctctttattgcaagcttccccactggtctctcattcattctccacacagcagcgaaagccactactttacagtaaatggtgtgaatcattcttctgcttaaaactgctcaatgacttcctggaatcaagtccaaactccttatcatggccgcctaaggccagtatatataactggaccttgcttctttctctgatctcatgtcctgccacttccctttcgggtcgcgtaccaagctcattttcatcttggaaccttgactcttggtcatctctctctactccaaagctctttctctgcatcatggtttctgccttctcatctctaaggtctcggatgccacctccctaaagaaaccatcttgcccgatgtagccccaagtcaatctctcttaaatctctctattctatttattttataccagggagcgccatctgaattacttgtttatttatttgtttgcttctccacctcccccaaccccattacaagtttcaaaagagctcctatctgactcagtgcaatatccaacatcctaagttggatcctggtgtataattcatgctgtttacagatttactgaatgatagtatattaatatgtcaagattcatggcaggtatcaaaaaattaatttattgaagcattcagtctcaaacattttcttttttttctttttatctttttttttttttcagatagagttttgctcttgttgcccaggctggagtgcaatggcgtgatctcggctcactgcaacctctagctcagagttcaagtgattctcctgcctcagcctcccgaggagctgggattacaggcatgaaccaccatgcctggctaattttttgtatttttagtagatatggggtttcaccatgttggtcaggctggtctcgacctcctgacttcaggtgatccacccgccttggcctcccaaagtgctgggattacaggagtgagccaccatgcccagccttcttttttttttttttttttcttttgaggtgagtctcgctctgtctcccaggctggagtgcagtgttgtgatctgagctcactgcaacctctgcctcccaggttcaagcagttcttctgcctcagcctcccaagtaggtgggactacaggcacgcaccaatacgctcagctaatttttgtatttttttgtagagatggggtttcaccatgttggccaggcttgtcttgaactcctggctcaagtgatttgccctcctcggcctcccaaagtgctgagattacaggtgtgagccaccgtgcccagccatgtctcaaacattttcatcttgtgaagctatttaagtttcctgaaaatcacctcactcttcttgtactcctcttccttaaaaccaacccaatggtctcaggcttttctgctcattcaagtcacatttcctcccagtaaacttaattttggtaaaatattcaacagttcaggagagatacataaatcatgcttgaactgccttgcaaatagcaaaggaactgactggccatgtgctatgatttcaagggttttgggaagcatctacctccaactactggtcctcactgagtcttgaaatcccacatttagagttttaatttcttttttttaaattaaacaacagaaatttattttctcacaattatggtggttggaagttcaagatcacagtgttggcagggttggcttcttctgactgctgtcctcattagaattttatttaagttttgactcatgttaagatagaaatactctcggaatgattaatgctttaaacttgtccagccacttagatgtaaggtctgaggatcttaaaaggtattttgggaaggaaaaaagagcaaacgtcagaataccaggaatctaaaatacaggcagaagagccacctggagggtggggaccattcggaaatcctgatctgcttgtaaggccggtgttagtctaacctatagcattctggttcttttctggctcggctcctactgtaaatttaaacatcccatttaatcattatgcaaaaaaaaattaagagatttagctgggtgatctctaaacaattctagatcagtgattctatactccataattttattcacaatcaaccctttctactactcacagatgctagaaaatattagaaagcagatgtaattaaatgttcacaccacaaaaatgagaactatgtgaggtaaggcatttgttaactagttagattgacccttgcacaatgtatatatacttcaaaacatcatgttataaacaattaaaacataattttaaaaagccagtatgatttctacaaatacaataacatgggaccaaacagcaacagacctcgagttcaccacatattttatatatttataatttcacatatactcacagtgtttcattccacatctattcccaaacttgaatgcatgtgcatgcacaaacaacatatacatcacctccttcactgagaaattacagcaccattatttattcaaaggcactaactctgacaagagtgaaacagaaggtacttctctattatatagtgtctattttctgattttctttgttatatttcattgtatttattaatattaggttaagcaagaatgtacaaagccatagcaggttgggaaggttatcaagagaccacctattctttttcttcaattcaatctcttttcagattaatcattcttggctattctgttttttaagtaatttactttttcttttcacttactcacctaattaatctattaacagagtgtcaacaattgctgtttcactaaaccagtaaaagacaactgctttggtgataatgttttattttcaagcaggtcatgattatacttatcacattattacacttactacatttattacttatcatatttattgcaataatcattatcacaaaaatgatccattgattctaactctcaggaggcactcaataaatatttagtcaatgagtgaataaatgcaatattggaattaaaacatactctcaacatttcaaccaaatgctttattacaaagcatgggggaaggaagcatagggttggactttgtgcactgaaacagttatatattttccgtagcactaaatctttttctcattaaaatgcatataatgtgcagctattgctccaggaggacctgctgtatcctgttaaaattaccgtcaccaatctgtggattagctaacagtaggggaggatatggctgatgtttgtctgtgtgtgtgtattttgatgattgaagaaaagaagtaatggggattaacattctgcttttacaagtataattgtaagtttaacacagggacaactttatttttagtgtaatacatctgtgaattatgaattatgatatgttcaggtcatgcttttttgcattcattttttacttttatggagttggagtaaactaacccaatctatgaatgaaattcaaaactgtacttgaaaatgaaggaaaacggcattatttttcaaatattgagtataaattatcacaacttcgttaaaaaaaaagatactttagaagtatacttaacttagtctattacttctccaaatagatgttttaaatgttttaagcatctgctgtaaaaattaacctaggccaatttggatattcagcaattatcacgttattagagcaaagtttggtagaattctacaattagagacaggtggatgattcatggcaaccttttctccataatcttgctaccaggtggtatgctaaaattaaagcaagcctgagattaaatagaccaaattctgtcaaatgtaccaacatttagtcgcaaatagggcacaaaagcagttattgaacttaagccttcaagttctcagtctcaatctgtaggaacttccacaaatacccttccaagagaggttcattatgaggaagatcagccagccttctgagttacatcagggacagaatcttccattaaatcgaatagagggtagaccaaagggagtttagacctagacctagtgtacttacctgatggtattagacttctagccttgatgagtcttatgcctcattcatgataaggctcataaaatctatatagcaactgaacattttgaacaccactcatttcatcaacaagtaatgatttcaagcatgccttttgtgaattaatgaaacctctctgtagattttgataatgatacttgaaattcttgggtggcatttttagagtacagattctggattagggaacataaaattctaaccaccttaggagtaggaatcaaagttaatatacagatacgtaacttacagtgaagtattttaaagtaaattagcacatctgttgcacaatagctttccggataggtttgaactataatgttacatccacattacggagatattaattgaaataagtaatacttcatagatatcctatacatgttatatatctatatctaaatcatctatatctatctattacatatttatcacctatttacctatctctatacacatatcattgtaggagtagaaatcacagaaaatgagatcatttgaaccaatggcctggtttgtgtcatttaaataatcttaaatttcaaccatataaactctcagatactcaaataatgcaaattctgcaggtatctggagtaatcgcttccaacattttttgtttttgagacagggtctcactctgtcacccaggctggagtgtagtggcacaatctcggctcactgtagactcaacctcctgggctcaagtgatcctcccacctcagcctcctgagtaactgagactacaggcacgtgcctccacacccagctaatttttgtatttttagtaaagacgggtttgtgctgtgttgcccaggctggtctcgaactcctggactcaagcgatccacctgcctcagcctcccagagtgctgggattttaggcatgagccgctggggctggcttctttcaacttttaactctgttgactgcatataactttttcatatttaagaaatgtgttggttgttgaagaagaccaagtctgaactcaaactgggttcttagaaagctttgaaaggaaaacagggacaaattaagtgtctgcctctgcccaaaggggaagtccctaaaagagaaaagtttaaagacatcaagaatagttctgatgcttgcctaaaagttaagtctagaagtagagtaataagtaaagtttcttggaaccttttcaatccagctagagagatacattatgaccactgataatggtgtgctttctacctctcagtttaccctttgtaaataactcaaatggtttgctttgaactggcatatttatttattttccctctgggaaaccacctctactcatattcccgaataaactgttttcctataatcagctatgtatgaaggctttagatatcaacagaactttccataatatctcttttaaggtgaaaggttcagaataaatctacctaagattaaatgctccttaggtggaaccactgagcctcatgctacctacatgcctatgacaaacaaatttttatttcatatgcatactctgctgaacaatgacttatatatccaaatacctactagaaatctactcctgaaaatccagcagacaattcaaccacaacattcaaagcaaaaataatggtttcttgcccagcccattcttccccatctcaattaatgtttgcaacacacccactgtgactcaagccagatacctaagagtcattctctatttctctccagcccttatacccaacagccaatctatcatcatttcttgtgagttctacctctgcagctattcttccagtgcaagcctccatcacctctcacctagaatgttgtatttgttatattttaggcctcctttctttctactctagctctgtttctttggtcaacacagcaaatgaatgataattaaaagaaaatgaaaggatcatatcacttccttatttaaaactctcttttagcttctgtctaaacatggaaggatcaaaatccctactaatgccctgcaaatcctgcatctccaatctcagtttctcacatcccatcaatttcctgttcactctggccacacagtctttcctcttgtttcaaatggaaaattgacatagcccaggcttaggagctttgcactcactgttgcctctgcctggaaaactctggcctctgagagtcacctgtgtggttccttgatatccaggtctcagctcaacttttacactactgtgagaacatccttaccaccttttcttaagtagctcagcaatgcccccaggcaggcactctctgcatccttaccaaccttctattttccaggggattttttactaagtaaaagtttcttgtttatttagttgtttggttactgtccttctactctaattataatgtaaattccctaaagtcaaagattttgcttctcttccgttgtactctacttgccttggcacatggcaggagcccaatgtgtttcataaggaaattaagattcctacctggtaaggttattctttcaagaaaaggagaatccaagtgacctttttccaaagtggttgaggtccttggtatcttgctgacttggcagaactgttctgagagcctcagaaattgaaccacgttatttaaattcaactctgaatgtaaagagtcaccaaggggccactaggatgaatcccagcatctctcatttcctcaggccccctcatccttctgtttgttaaatcaatgctggaggaagatgggtggcatcacattcaatgacaaggatgccctgtgataatttgcatcatctccaaagaggattaaaaggggctgggtgcggtggctcacacctgtaatcccagcactttgggaggccaaggtgggcagatcacttgaggtcaggagttcgagactagcctggccaacatggtgaaaccctgtctctaccaaaaacccaaaaattagccagtcgcggtggcacacacctgtaatcccagcttcttgggaggctgaggcaggagaatcacttgaacctgggaagcggaggttgtggggagctgaaatcgtgccactgcactccagcctgggcaacacagcgagactccatctcaaaaacaaaacaaaacaaaacaaaaaccaaagaggactgaaagggatttattaaatctcagcgccccaagccagtggttctcaaagtgtggtccctgggccaggagcatcaacacaactaaagaactttgttagagacacagattatcggggggctcagccctgacttggagtatcagaaactttaaacctgtttgaacaagctcttgctaaaatatgagaactaccatgctaagacaacagtgccaaccttgattgcaccttatgattacctgccaagcttttaaaatttatcaggcctgagcccctctgctacaagttcttagtcggtctgccgtgagtgagatctctgtattatttaatttctactaagtgatgctgatggagctccaaagtttagagtcattgccccagtgtgggagcagggtaacttcaggtttatccaggtactttgtagattttcatcctgaaaagaaatataatttggaattcaaacatggcttgcctctcggttttatagtaggagagaagggaaatgacttggcctaaaacacagcatatggttctaaatgctagtgttgtatagcctcatccaaagcatcaactcatagagaagtacattaaagcagtgtaatgttcaaaaccaagttccatagtaagcatctgctataatagaatgacttattccagaagggaagtttcatttcaggagagcttatcatgacatcaaatatgttttgagttaatgaaaatgcaggaagcaccaagttaatagggcaattttaaaccataaagcctaatttaactgcgctaagaatgacaatataatgctctgcacaaaaggaagtttcacaacctgattgatcaaatggagaattactaggatgctggatcgcatcttccttgaagaagctaagttgactaggagaggcagacttccttagaatgcagttatgtacttcttaattaaacaaagaatgattaaaaagagattttgctttataaggccacagaacagcttgtttgataaaattgttataagcctccagactttcatttctactttaatattgattccattttcagaaatagttaagtagaagttattcaggttcttctttatatatttgcttttttagttgttgttagacgtaagataaatttgaaatgtcaggaaggagaatgtttattttcacaataaaaagcttactctgtgtaatattgaaactatccattctgatataagataatgttttattttggctgcttaatttcaaattgaattatttaatagaacaattaaaagtcaatacaaatgaaacagctacttgtttttctcagtttatggatgttttataaagtgtaaaagcagctgtttcgttatacttttcttgaattgaatagccataagagctttcttaaaatcatatttgatccatagctctttcttttatagcttcttctatataatttacttctaagtaacatttcctttacatataaaaattgattattactgtcttgtgttaagaacttttcctgggtctccttaattcatcagaatgccaatattacgattagcaaaaccaattaggccatttatcgcagagaatattggaaatgtgctatatgcaaagcattgttttacaagtagttcaacattctaattttgaaattagactaagagcataatacatttagaaaatgtggatagttaagtttaaatttaaaataataaaaagtcaagaatattacaattttacttcctcagtcacactaggcacatttcctagactcaataggtgcacgtggctagtggctaccatagtggacagtgaagatacagaacatgactatcatcacagaaagttttgttgggcaggcagtgctgtataggctagttagtgaggaaatacatttttaaaaagcattgttccctggggcattacaggataaatttaagaattctgtttcataaggaaatattatgccacacatggagtctttcttaaaataactgaccctctagaagaggaggcctaagtgtacaacctgttcatttcctatcggagttggttgcctggaaatgttgtacatctcagtttcatagcaaggtcataaatgttttgtaggccgtatcctctgttctatctactatccccacagcacaaagaaataattatgtgcatagagtggacacccaatgaatctttactaaaagcaccaaagtaatatgaggcaaggagatactacacagatttcaacctttgaacttgaacagtagtttgtaactcctggcccagtctagtactagattgtagggtcctgatgaacaactgtaggccaggatctccctctgtttcaggtgccttgtggtaaaatcacatgaccactgaaccctcaaccactccctgaactagatgctaccaacaccaacacagaacccctttccccataattccttccttatccctggtccaggaccagccaacctgaacatagactgacaagcttctcatgattcaattatctaacttaagttaccatatgacttccttcaacaaaagttacccattttaaaatctctgtttctttctgtattataggagactcatatcccaaatacacacacacacacacacacatgcagacacacacacaaacacacacatttatatatatgcagaaaagcaatgataaaatctctcctgccaaattagcaatatagttttgtttcaaaatatttatgcataaatttcataaggtattctgacttttaatttgaaatttaattcaataaagattacattagtcagaaaaaactcatctttggccaggcgcagtggctcacgcctgtaatcccagcactttgggagaccgaggtgggcggatcacctgacgtcaggagttcgagaccagcctgaccaacatggagaaaccccgtctctactaaaaatacaaaaaaaaaaaaaaaaaaaattagccaggcgtggtggtgcatgcctgtaatcccagctactcgggaggctgaggcaggagaattgcttgaacctgggaggcggaggttgtggtgagccaagatggcaccgttgcactccagcctgggcaacaagagcgaaactccgtctcaaaaaaaaaaaaaaaaaaaaaaaaaaaaaaaaaactctccgtctcaaaaaaaaaaaaaaaaaaaaaaaaaaaaaaaaaaactcatcttttaatgttagtttataatttaaagacacaaaaacagcttcgtttctagattcaagcaaggcatgtatttccaaaatatctcttcatgattgccccaaatactggatctcctttcctgttggactgtatgtatctaaaatgtacagagattattgaaaaataagttaggatagggactattaacacaattttgttctgaaaatcttcccttaatacatcacatgggtttttgaggcagatgtttggagggcatgatttttagggcagaaccagcacaagttgcaagcaatgcctggacacctgttgagcccttctgtgccatctgcttaaagggaagtacacataaccttaaaatcgttgctgcttttggaggtcattttatcaggattgagactacatcccccacaacccacaggacttaaaaagagagagatttatctcagaagggcattgtctctaagtgtgatcttcatttttatgagctgagcttgaagtccctgacatttagaaatgatagtgtgttgatgtgaggttctttcgaataatccttctaagttttatcagctttgcaaaatgttactaagtgctagcatttagtttgtgaaatgttttaactattgagaaggtgatgttggtcagtccttaactaagatcgatcaaagtaagttcagtaggtgactgttttacaagtggcatggtggtggtgttcctcaaaggttttggagagatacaaaaggactctctagttgtggttttaagttatatactcagttttatatcctgttaaagtttttataccatattttaaaattgctgtttggaattacaggaaatgtttaattcacaaatcatttatagttacaggaaatataattctattattgatataatgaattgaatggtttttaatacatcgtagttttaaacacttaaatattcacgagtaatatttgggaactttaagaatagcatccaaaaggtctacgtgttcatgtgtatgtctgtgtttgatttggtgggggccattggccaaagtttgatcccactcatttgaacagcttgctcagtatgtgcatcattggggaaaaaaatcggcatggagcgttcggtagctagcctctagtagaattatcagaggaaaactgtgatggtgaaactgagaatttgaaaagccagattgatgttttccaagcttgatttttagatgagaaagtaaaagagtattttgatttaacatttgaaattataatattagtagcaataaaatataccagtgcttctcaaattatctgaggtggcagaccaggtttttaaaaatttcattttgctttaattttcaatctctcaaggaccaatactttggtaaaataccataaatatcaataactagaaacaacgatgttaccaaaaaaaagacatacaaaaatacaagccagggcttttaatattttttttcatttaacagatattatcaaattgctgtgaaatttactaaatgttcactctcagtttctatacttttattgtagaacaacaaaaggaatttgttaactggctgtgctctgtaggctttttaagtagaattgctctatgtcactgtgcattaaattttgtgtttggatgtatcctaagcaagctatgaggtctctgaggaaaaaattatatatatatatatatatatatatatatatatatgtgtgtgtgtatatatatatatatatatgtgtgtatatatatgtatacatatatgtatacatatatgtgtatatacgtgtacatatgtatacatatatgtatatatgtatacatatatatgtgtatatatgtgtacatatatacatatatgtgtacatatgtatgcatatatgtatacatgtgtacatatatacatacatgtgtacatatatatgtatgcatatatacatatgtgtacatatacatgtatgcatatatacatatatgtgtacatatatatgtatgcatgtatacatatatgtgtatatgtatacatgtatacatatatgtatatatgtgtatacatgtatgcatatatgtatatatgtgtatacatgcatacacatatgcatacatatatgtatatatgtatacatatacacacatgtatatatgtatacatatacacacatgtatatatgtatacatatacacacatgtatatatgtatacatatacacacatgtatatatgtatacatatacacacatgtatatatgtatacatgtatacacatatgtatatatgtatacatgtatacacatatgtatatatgtatacatgtatacacatatgtatatatgtgtatatgtgtatatgtgtatatatgtatacatctatgtatatatgtgtgtatatatgtatatatgtatacatatatgtatacatctatgtatacatatgtgtatatatgtatatatgtatatatgtatacatatatgtatatgtgtgtatatatgtatatatgtatacatatatgtatccatatatgtgtgtgtatatatacacgtgtgtatatatgtatatatgtgtatatatatacacgcgtgtatatatatacacacacacaatttatgtgcatgaattgtgtgtttttattttgattataacttttaaaaagtcatacaagtgtattctgcatcacttgactgaccaaaatgtacacttgcataacataagtgctcaagtttgtgtttatgtttacaatgaagtcaacaacaagtagcattactttaaatgtcagggtctgataaataaagaccagaggaagctaaagaaagaacatgatactttgaacaatcctctctattaaatgggaaaattgggctttagatctgagtgttttaatttctactttaatatgcttgattatagttttaagatgaatgcataccagaaatgaattgatttatataaatctttcattttaaagcagattttatcattttacaatgtgtgagaaaagaataaaatcagacccttgattgacactgttctttcaatcagtttatgaaacattttcctctgtgtctaccacttttatttgcataattaaaaattttaatgctaaatcagaaaccaaaaatggaatgtgcataaaatccccttggactatgagtttggagagttggcattttttctggcgtgatctgctataggcttactgttacttagggcccggagaggtgggtcagggaaaacattaaatgtattcagggtatgatccatattctatttttaagttttatgctgtttattttgagggaagagatactgatatagtttggctgtgtccccacccaaatcccaccttgaattgtaataatcctcacctgtcaagggtggggccaggtggagataactgaatcatgggggcagtttcctccattctgtttttgtggtagtgagtaagtctcttgaaatctgatgattttataaatgggagttcccctgcacaagttctcttgcttgctgccctgtaagacatacccttgctctttttctgccttccaccatgattgtgaggcctcctcagccatgtggaagtgtgagtccattaaacctctttcctttataaattacccagtcttgtgtatgtctttattagcagcatgagaacagactaatacagatacaaacatgtaaagtgcagaataaggtcctatatgtcaatgggccaacttgtgtgttttgtaattaaatatactagtttagagaaaaggaagctcaagctcaacatgaactggattcatcagtggtggtctcaccgaggaacatgaccaaacttcagtataaattgtgtttacatctcttcttaaaaaaataattaaatacatgttattattgtttgaaaagttatttaatactgagcatctacacattaatcatgatgaaaaaataatattaaacttttgtatgtcctgctagcttaggaagaatgacactgacaattatttcccttaaccattgtggtaagccaagtattagttcatagcaaatatttcatttgtagatttcagtttttttcactatttctacttttcatacaatatcattcttcaaatgataaaatagtacttagtgaaggatttgggagcatgttaaagttatttagcattaattgcagcattacactgggacacatgtacttctatttctgtaacatatcactcatcatttcactcagataaaggaaatattaaacattttatcagatggggaattcctggggtcacactgtagcagatgagttgggattggtataccttctccaagcttcctattagttacacacgcacacacacacacacatgcacgcacacacacacacactccagtttggaatctgtctagccaagaccacagtgcaagatgttaaaagcactccacttgctttgggcatatgccaggcctgaatgagtctcttaccattgggaaaacgatctatatttaaatttttctagatactatctattaaaattattctatattaccaaagaatggaaatattttccggaaagttcagagtagcaacatattccttaagcatgtttccacttcaaaagataaaaagtttagaagacatctccatgtcctcaaaaagaagtaagaaaacattataattattgattaaaagctgggagccctagaaagaaaccttggagatgaatgacaaggatacaaaaggatttgtcaaaatgagaaaagaagacaaggaaactcaagtacagctagcgatataaaagctgcattgaagtctattatagtcttatatgacagaaaaaggtgaagaaaattgtatataagtaaggaagaaatgtttatagatgaaaaattatatatatataaaatctatagattatatataatatatacaggaagagagagagagagggatggaggcagggagggagggagagaaatagagaatgagaatgtgatgaagggcagagaatagggatcagaaatacagctgattcagttgaaggaaccagaaaatgggagggggcaatatatttgaataaaataattacaaatatgtaataaggataaaaacataagtctttttctgttgctcttgctctatgtacatgtgagcacacgggcacacgtgcgtgcacgcgtgcacacacacacacttagaaagttgaaggctttgtagttaagtagggaatttgtagtatgtagggaatttcaaccttgattcagagtgacaggcaaagatttcaaatggaggtatatgtgtattcttcaatgggaggataaattgaaaacataagtaaggcataaaatgtatctaaaaaattttaaccttactaaattccaatgaaatccaattatgattttcttcctaaacttgacaaagttattcctaagtgcatctgaaaaatatagcaaagaatatgattataattttaaagtaatataggaggacttgccataccagataatattgtcatgggtcaatcatagtctttaaaacaatatagtactaacttcaggtgagcagacaagccaagggacataacagatggccctgaaattgactttatcatataaaaagactagtatttaattttttaaagtatcattaaccagtagggaaataaccatctaaagaatatatatctattagccatttacatatataaccaattaaatatataggtttgactatgtgtctccactcaaatttcatgaggagtcgtaatctccagtgttggaggtggggactggtgggaggtgattggatcgtgggggtggagttctcacaagatctggttgtttacaagtgtgtggcacctcctcctgcacttactcttcctcctgctctgaccatgtaagatgtgcctgcttcccctttgccttctgccatgatagaaagtttcctgaggcctccccagaagcagtcatgcatactgtatagccttcaggaccgtgagccaattaaacctctttactttataaattacccagtctccggtatttatagcagtgcaagaatggcctaatacaatatgtaactatttaaatatatacaaaatcattcaaatatgtatagaaccatttaaatacatatattaaattatatatatataatttttcaatttcacgtaatctagagagtttatattaaaattgaaacatgacaaatgagaaagctattggttaataaatctctagataaagcagaacttttcaagaatttttatttaaaaatgaaagggaaacactgggcatggtggctcacgcctgtaatcccagcactttgggaggctgagacgggcaaatcacctgaggtcaggagattgaaaccagcctggtgaacatggtaaaaccccgtctctcctaaaaaagtaaaaattagccgggcatggtggcatgcacctgtaatcccagctacttggaaagctgaggcagaagagcctcttgaacccgggaggtggaggttgcaatgagccaagattgcgccactgcactccagcctgggcgacagagcaagactctgtctctcaagacaaaaaaaaaaaaaaaaaaaaaaaaaaaatgaaagggaggatccttacaaaaggaaagatgattttgatgcattaaatagaaaacatttttaacaacagcaaaataaataagataaaaagattattggctaattaggtaaaataccttcaacaggtgtgatgcaatttgatttctgatacatgaattcttcaagtcagtttttataaagtagcaaagcgcatgattatgcaattaaataaataataagaacacataaaatagcaaagaaacatatgaaaacatactgaacatcatgagtaattggtaatcaaagaaatgctaaagtaataagatacaatctttcacctgataattttgtcaaaaatattaggtaaaatagtcaccctcatacactgctagtcagaataaactgtttttgcaggacagtttggtaatagctatagggaatcttaggtttaataatttgtaatcttgatctaacaactcaaattctgggagtacatccttaagaaaataattagacttttacaaagatttatataacaagaggtttatcactttgatatttatagtagcaaaaaaattaatttaccaaaatcataaacagtaaagtagttatctatgaccattcaatgaaaaactggcaacccttaaaaatatgcttaatggtaattttttttaagtaagtgaactaatcctgttttttggatttggattgtcttttaaataaggtcttacatataatcttaatctaacacatctaaccacattgtattaaagtaaatgtttccaataataccaatgttttaaaatttatagagttgcaataaggttcagtatgtttgttattaatttccatcaccgctccatgtgtgcttggaaaggttttgtattctgaaattgttgggtacataagatcaagtttcttcattgtgtttctcaaatcttatgtatggtacttattaattttaattttttgcctgttttatctatcagtttgtaagaagagtgttgaaaagctacaactaaggtggtttatttgtatatttctcttcatattctgtcaaatattaatttatacattttaacatatatattatgttcttaagtgaatgattacattttcttggaatatatcttcagtacacctttctggtaaagtgaaactcttacaattatgtggtgactctctatctccaatactactcagtctttaaagtctatttcatgttttattaatatggttaaaccagctttgtttgtattttctatatataaatatttttatatgccagcctgtatagttttaattgaggtgtgcctcttataaatccatttaactggatttgatatttgctttgttcctgtatgacagtctttgcttttcaactggaacttttagttaatttttaattgtaatgactagtgtctgtaatcatgcctaccatattctgctcctgcttttttttttttctttttttttggggggtggggggatacagtttctctcttgtcacccaggctggagtgcaatgttgaaatctcagctcactgcaacctctgcctcccgggttcaagcgattctccagccttgcctcctgagtaactgggattacaggcgctcgccaccatgccaagctaattttttgcatttttttttttttttagtggagacggggtttcaccatgttagccaggatggtctcgatctcctgacctcatgatccgccctcagcctcccaaagtgctgggattacaggcgtgagccaccgtgcccggccgagtttgaacgtttttatacttgatctctattcttttcatgatcctgcagaaaatttgcacatatgcttaacttacgaaatctacttttagctatatctttactcgccttcagaacaatgtaagtacgtaggagactttattcctgtttctctgtattttagtcatctttttttttctaattcacaaacgggacgttatcatcatttctttatgcagtcaatatttgtttaatgtaagccccatgaaggcaagaagtttttattgtggtggttgttcaatgttatactccaaacacataaaacagatcctacacatagttattatgcctagataattattaaataggttgattaaatatacccaagtcgttaacttttttttttttttttgctcatcataccttcctgcatccctctgtgttagttttccttctgcctaaaaagtaattgtttataatttccttcagtaagggtgtgttggtaccaaatactctctgtttatttgttgcctgaaatgttcatattttgctttcattcttgaataatactttgatggttatttagttctaaatttttttaagcagagtgtagtattattccacagatctttacattcattgctgcctgtaagaatttggttgttagttttattgttatgctcttgaaggtactctgtcttttctctcttattttaaaagttttctctttgtgtttaattacatatgatttcactatacatacatagcagcacatttccttttatgtattatttatttatttatttttattttattttatttcattttgagacagtgtctccctctgtcacccaggctggagtgcagtggggagatctcagctcactgcaccctccacctcccaggttcaagcaattctctgcctcagcctcccgagtagctgggattacaggtgtccaccaccacgcctggttaattttttgtatttttagtagagacggggtttcaccatgttggccaggctggtctcgaactcctgacctcgtgatccatcacctcggcctcccaaagtgctgggattacaggggtgagccaccgtacccagcccacatttccttttatttatcctttttcagattcattagtgttcatgaatctggaaatgtctttcactagttctggaaaattcttgcctattattgtttccaatattatgtcagcctcattctctttctcctcttctcatggaattccacttagaaataagatatattttcttattctatcctccatatctccaaccctagtctatattttccttctctttgatttgttcctgcattgtggaccatatctttagatcactgattgtttcttaggtgtttctaatcagctgttaaaatagccatttgttcttatattcaataattatatttttctttctaagacttatagagttttttatttccaagtctgcttaacaattttacatagtcttttgtttcttagtcacataataaaccccttcttttacttcttaaaaataaaaggtacttttaaaacatgcttactttataattaatttcgaatgatttaaatatcccaagactttgttagaatctgctgtctatattctctacttgttcccactcctgcttgtttgcttccttccttccctcctttctcctttctctctttctttgtagtatgctgcacagttaggaaatacagtctaacgtatagtgacaaaagaggggggtcagtgattctcctgttatatgaggtatggggtaagaggaacagagagaagtagaaagaagggtggatatattagcagagttctctagagggacagaactaataggatagatgtaaatatataaaggggagtttattaagtaatattaactcacacaatcacagggtcccacagtaggctatctgcaagctgaggaacaaggaagccagtagaacttggagttcaatgttcgagggcaggaagcatccagcacaggagaaggatgtgggctgggagactaagtcagtctagccttttcacgttttttttttttttctgcctgctttatatttgctggcagctgattagattgtgcccaccggtattaagagtgggtctgccttccctagcccactgactcaaatgttaatctcctttgacaacaccctcacagacacactcaggatcaatatcgcatccttcagtccaatcaagttgacactcagtattaaccatcacaatgggattaccaaagagcacaagaaaacttttggaggtgatgtgcatgtttctgatcttgattatgatgatggtttaacagctgtatacctatttgaaaacttaccaaattatacactttatgcagttaattgtatgttaattatacctcaataaacttgtttttcaaacattggacacatagataaccaaaatctttataattgttagtcttctacatggaaaattcatttataatttcactttcattttttcacttttctgcatgttggtaaaagcacaccctttaacacaggaatttcatttttcagaatctattctcaccaagtcaccagatgaacaatagatcatctacacagttataaatgacaatattgataagaaaaatgtgataagaagaaacgcttagaagcaacttaaatgttgtacagtaaaagtttgatagacagattgtgaaatatatatgctagaatataaaacagtcaacattatctggagaggactttatgatttaaaatgtttcagtcaacaaaatagcacaaaacttttagttgtttacactgtggtaataatttcataaagattcgaagagaatgaaataaggtaagccaaatgattaatgactgttactttggaaaagtagagttgtggataatttttatttccttttttatgcttttcttcatactccaaattctctaccatgaatatgcattacttttctcatcacatttttttgaaaatgactaaaaggaactctcccaaataattttccttttatctttcaacgaaatggcttttaaaagaatcctctcatagaggatttgaagcacgtcaagaaaattgttcagaacggctgagagtcttatggtgaatgtgacaaggttatagtccaagttttgacatgttcatcattaacgttctgctggtccctagcctgtctcagtggatggagatgaattcattagagatgagtaaataaaaaagtgattttctctctaaattaatataacgacacacttttatgatgaattttctaaatcatttcaggttataccttcctctctgtgagttcaattatctttgtcataaaaagcttcttttccatagacaagctttacccatttttcatagcctaatttaactgtaaagctgttaacatcctaatttaagctgatgataaatagtcttttaaccgatttgaaatttttgaaattaggtggtataatattcatagatataaccttaccaattgtgaggtgaaaaaaaattcaaagcataaatatggctttaaccttgaaacctgacaggcgtttgaataggaaagagatgagccatttcctgtatttaaatttctctagactccccgtgccctgtgtgccaccattttgattaatccttcttaaaacttatcttctattaaatgtgtgaaaaacatatgtttctcattgttaacatctcaatgttttactcaagaattggataatctgaggaagtttcattaataaaggaaaatatatatccgggaaatattatgtatgtatgtatgtatttcacacctttctctttgtaggttatcaaaatagtgtgaaaaattagaattaggcttagaacaacactatcttttactctaaagctctctagaaaaggtccctaaaattaatcaaaaatgggcactatgtcttctgttttaaataaataccttaataccttacaatacctcttttacaatgatgtcatcttcttactagccaaatgccaagattctgatgtaagagagtaaataacttgtgaaacaaagtaagagaatctaaaaaaaaatcagtttgcttggggctttatttgtatcattattttctagcattttaccaattcatttgtgtttcaatcatccatgatgcattttcttaatgctggctgctttcattttttattttttaatttttaaaataatttcaacttttattttagatttgggggtacatgtgcagatgtgttacatgggaatactgcatgatgctgaggtttggggtatgattgaacccatcacccaggtagtgagcatagtacccaatacgtagtttttcagactttaccccccttcccccgccctgcatctggtaatctgcagtgtctgttgctctcatatttatatctatatgtactcaatttttagctcccaattataagtgagatcatgcagtatttggttttctgttcctgtattaattttcttaggataatggcctccagctacatgcatgttgcttcaaagaatgattttgttcttatttatggctgtgtagtattccatggtgtgtatgcaccacattttctttatccaatccacccattgatgggaagctaggttgattccatgtctttaccattgttaatagtcctgtgatgaacatacaagtgcaggagtctttttggtagaatgatttattttcctttgggcatatacccagtaatgagatttctgggttgaatggtagttctgtcttaagttatttgacaaatcaccaaactgctttccacattacctgacctaatttactttcccacaaacagtatataagcattcccttgtctctgtagccttaccttttgttttttgactttttaataaagccaatctgactggtgtgaagtggtacctccttgtggttttgatttgcatttctctgatgactagtgttgtgatgcattttttcctgtttcttggctgcacatacgtcttcttttgagagtgtctgttcttatcttttgcccgtttttaatggggtaatatgttttgtgtctattcaattgtttaagttccttatagattctggatattaggcctttgtcagatgcatagtttgcagatattttttcccattctgtaggttgtctgagtactctgttgatagtttcttatgctgtgcaggagcttagtttgattagatcccacttgtcaatttttggttttgttgcaattgctttagaggacttagccaaaaattctttgccaaggccaacgttgaaaagggttatttcctaggttttcttctgggactctaatggtttgagaacttacatttaaatatttaatcctttttcagttaatttttctatatggtgaaaagtagggatccagtttcattcttctgtgtatggatggccagttattccaacaccatttattgaatagggaggcctttcctcattgtttaattttgtcgactttgttgaagatcagatggttgtagggtgtgtggctttatttctgggttatccattctgttccattggtctatgtgtctgttctcgtaccagtactgtgccatttttgttattgtagccttatagtttaaagttgggtaatgtgatacctccagctttgttctttttgcttagaaccgctttggctatttgggctcatttttggttctgtataaattttagaatagtttttttttcctaatcctgtgaaaaatgatgttgatagtttggcaggaataacgctgaatctataaattgctttgggcagtacaaccattttaacagtattgattcttccaatccatgatcatgaaatgtttttccatgtgtttgtgtgatttatgatgtatttcagcagtgttttgtagttgtccttgtagagatctttcatccccttggttaggtgtattcctacatattttatttttgtatgactattgtaaatgggattgcattcttgatatggctctcagcttgaatgctattggtatatagaagtgctattaatttttatatattgattttgtatcctgaaactttaatgaaatcatttatcagttctaaaaggtttttgatagagtctctagggttttctgggtatagaattgtattattggtgaagagagataatgtgacttcttgtttttctatttggatgcctcttatttctttctcttgcctgattgttctggctgagaattcagtattatgttgaataagggtggtgagagtgggcattcttgtcttgttcctgttcttaggatatatgcttccagcttttgcctgttaagtatggtgttggctgtgggtttgtcatagatggctcttatttttagttatgttccctagatgcctagtttgttgaggctttttataattttataaaatccctttgtataagggatgttgggtttcagcaaaagccttttctgtgtctattgaaatgatcatatagtttttgtttttaattttgtttatgtggcaaattgcattgattgatttgtgtatgttgaaccaagcttgcattccagaaataaagcctactaaatacctatatcaagaggttatacaaatctcaaattaatgatctaacatcacacctagagggactagaaaaacaaaaacagtctaaccccaaaggtagcagaagaaaagaaataattaaaatcatagcagaagtgaacaagatagggaatcaaaaattcatacaaaagatcaacaaaatgaaagatgattgtctgaacggataaacaagataaatagactactagttagatcaacaaagaaaaacagagagaagatccaagtaagcccaatcagatattacaaaggtgacattataacaaatcccacagaaatacaaaagatcctcagagactattatgaacacctctatgcacagaaactagaaaatctagaggaaatgcataaattcctggaaacacacaatctcccaagattgaaccaggaagaaatgaaaaccctaaacagagtaatattgagttctgaattgaagcagtaataaaaaacctaccaatgaaaaaaagccctgggccaaatggatttgcagccaaattctaccagaagtacaaagaagagctgctaccatttctactgaaactattccaaaaaaaaaaattgaggagtagggactctccctaactcattctatgaaaccagcataattctgacaccagaatctggtgaagacacaacaaaaaaagaagactataggccaatatctctgatgaacatagatgcaaaaatccaagaaaatacaagcaaactgaatccagcagcacatcaaaaagttaattctccatgaccactctttaaaaatgatatttaatgtgcctcattttccttcctccccccccactgaaatttgcttctatttcatcattcctgttgcatctaacactgagcaagtatcttaggaaacaatacaattttgtaaaagatgttctgcagtagcctctatgtaaatatcgtttatccctctgtcttattaccaagataatggatgtgctttttagctctctctgttatatatatcctctactttatgtgtgtgtatatatatatatatatatctcctctgctctctctcctttagctctaggtttcaatattcattcccaatatagcaggcaaacttttactttgagaaacttaaaactctaatcagacatttcaattcctacatgccatctcaagcctaatttgggaactgtgggagcataataacgcattgtctatttcttcctttctacttttgtacaatagcttttgacttggagggagtttacttctacttgctgcacaattatcccaacatccagctcaatttcaaaggtccatttagctgctttggtggtacactttgacagcctattggccttgtagattttaatgcattttgcattatttatctcagttttccaagtatagtttttctgttgaatttctactcgttaaccaattttctggaaatgtttcccaattgatctgcattgcacctgtagcttattttttttttggttttggcaaaactcagctgaaaggtgtatgaagtacaatgtgatttcttagcacattgatggtactaagttggctctaaatgtgctgatgcatatagtacacttctgcaatgatgtctctctgggaaaccccatttaacttgagttacaataagcaaagataacagcaaagctctcagtactctttgagacaaaggtctcatacaattcattaaaattaagatgattctggctgcaagttatagaaacccagattccgattgattaaaataagaagggatgaatggtctcacttgacaggaagttcagatatgggatgggcttcaaggaatgctcatttagcaatgtcatcaagggtccaggtgtttttctcttcctctgctctgtaattcttagtatcattctatgtgtggtagaaagatggcttacagcagtcccaggcatcatatctatatccaggagacaaaggtaacctattttttcttatgaatatctcatatgagcaaggagatgtccctgtagtccaagatgacttcttattacgctttataggtcaaagtagtgtcacacgctggttctagagtaaaccatgagcaatattcctcttaaaatgatcaggccctccataaaagtgggatgagttctgtttttactgggacatatggatatctggacttgggaggatatctgatcaaaattggagttctaatagtacaataaaagtaaagaaatgaatgttggttgggaaacaatgtccaggttgtgtcatcatcattgaacagtggaaaaaaatgcagagggcagtgagagcccctgtggcccactggctgtgaccagcatgggtttctaaagcactggtgaaggataaaagaagaggacaataagaatgcctatattttggcccgaggcgaaaataatgaatagaattccttagtgggcagatactgtagtttggcccactcaacacccctttcatccctcttctatagagattggaaaggaaagtttttgatttcacagcctctcttgcagcttggcttaatcaaaagcagaatgctggccaatgagatttaggaaaaatttatcaggctgcatttgctgaataaatgtcaaatttgtatttggaagcacgatatctttcttgaaataaggaagataagaagtcacttattaaggacgttggagtaggaagtaagctgtgctctcagtggcatcactgagatgccatttgagtcttggactatatactctcaaaggtctggtcatgtgagaagacgtaaactatagcagtagctgaaagcaatgctatcaaatatagagtgctcaagttagttacataagtttactcatataatattccaattaacttagccttttaattgtttcccaaaggccaaatcagaaaaacttctcaaacagtatatatcacaaatatcttaactagtgcgaacccagaatccacctaatcacactcccagtgccttagcagagacaaccgtggctaattcttcaaggcgtcatttatatggataaatgttacatccacaactcatatctgaaccaaggcaggtttcataaatcagaagtctagtttgagcccccacgtcagccttattataacattcaacgtaacaaaggacggtgtgttataccttatgtaaactgacctttaaattggcctgaaaatattcacatgcatgaatggggctgtattacagcaatgacattgaaaattatattaaagacactttatttagcagcaaatttaatataacatttgaactgctaaaagtcaagtaggaagtagagagtactttcttcatttatttgatgaaaaaaaagcacagactgctttaaaaatataacttttgactacatacaaccagatgaaaaaagacgttaactagagggaaatttgtttcatacccataaatagaaactaacttaaaatgtaccatggtgggggggaaattagttgagaattacaaaatcctcaactgctttaataccacagcttcattccatttgcctctcaactattcctgctggggcttctgctatagtttattaacaagtatcagtgtttccattaccttagaaaaacaaaaccaacaatcatttttcaaaagacattcaaattgtcagtatgtaattattgctaatattaagaattcagtatgttaccacatacaacgcacataccaactatctactcattgagataaacttatatttccgaaatgaaaaaaaagccattataattaagactcaagaaaacttttccagtataaatatactcttaattaaagttgagataaagatatatctgtgagatagtttaccaaaatatttatgttaaacatcaggctctactatatttaagagtgggtttccatcaaaatacctcataattatctagttgcctgcatgtacaacagaaatacaagaactgaactggatgagtacaaaagggctttcaaatgtgtccactaatacagttaaaagaatataagctgctacatgtataaatacaatattatataagtatattatataaacattattttcattttatcttctaacagctttataatctaagtgttatataagtattttatatttatatgatatatacttataaatatatatcaacacttatataaatttatatatacttatataaatatagtataagctactacatgtataatatactgcatgtataaatataatataaaccatatacatggtatacagtttattctcctaagtaacaccaaccattaactttgtagtatatcatatgaaagagatgatatggttaggattcaataatatacagaggtatttgtcactaatagatgtagtcaaaaatcaaagacaataatgctaacattttttatattactgtttttagcagtggaatattttctttaagccacaggttacaaggcagtccaatgtagaacaaagataaaaacagctgcgggttgaagcagagctgactattcagccatggggagcttctcagaaacattagaatcctttatagggtctcaaagagacttgggacctaagtgttttctcctatgtcctaataattatacctattttagcccccctctggggacattttaagtgaccaagaattgttaagaggaaaatgggaaggattctgagctccaaactacatttcatgctggccctcccatcctcctaggacatctgattatttgtataaaggagatgtattagaagtccttggaattttctaattagaagttccagctctgattacttggagtttgagtaatttttcaagtaagtattagagtcaaggcttggacccagatatgactataaaactcatacttttaactaatttttatgtagttttccactgatacactagtggcattctcagccaactaattaagttttctctgctgaatgttttgaattctttgtcttgggtaatctctccctttaaaatgtaaggttgaacctgtagagctccatattgtcacttaattatgacaacatagatgagaaaagtacaaagctttgatgtgtctttggtggagattatatgacatattgaagttttgtgagatggctcagaaagttcagtaatagctgacgttgaaaagaatcaactcttatttatgcaggtgaataataatgtgactaatctggtattgcccattagtaattgatcatttctctctgacttgggaactatcgcctgtaatcccagcattttgggaggccgaggcaggcggatcacgaggtcaggagattgagactaccctggctaacatggtgaaaccccgtctctactaaaaaatacaaaaaattagccgggtgtggtggtgggcacctgtagtcccagctactcgggaggctgaggcaggagaatggcgtgaccccaggaggtggagcttgcagtgagccaagatcacaccactgccctccagcctgggtgacagagcgagactctgtctcaaaaataaaaaataaaataaaaataaaataaaacaacaacaacaaaaaggaaacagattttgaagttacatccttactgaaaactttgttttattttcttcaggtcacttacaagaaaccacttactcataatgaatttcaattatggcatgacctatgtcattatcctgggatttaagggtctagatttaggctgtttttattcacatggctagaactgtatctatttagaaaattaatttaactttaatgtatcaagactattttatatagcattgatgattttctacttcaaaagggaaagctttaagatccaaagacattgatttccaaactgggacaggcataatcctgaaccttaatcattttattcttagtgcttcagctttctattgaattttagtgaaagataacatggctctggacaaactttcgtctcttggagagagcaagttgacacagatctgaagtattttgtacatttgttgaatatgccacccagtcttccacaatgtgggagtgcaacatttaagtatcaaaatgaagcgaagttatcttggtgaccttctgacttctagcttataaaccattcatatggaagccagaaaatacagtcaaagatttaattttccaattgatcttgtatttagcatcatttagaataacaatctggatacttaatctagttttttttttaaatttcaatcagtttgtttgaaatcatgtaaacaaacaaagcctatattgtgaagaaaatacatttaattattaccgcctctaaataaatctagtttaaaacacatgtggtgaatatttgcagaaaagtgcatttaacaagtatgtggcattgtaatattaaagaactaatggaactaacggtgaagatttactaggcataaattatagaagcagataatgaggttattaaaataatatgtatctgtaatttttatataaaagactttaaacatttttttgaacttcttttttgtgtgtttacagatatacactttttttttttgcatgttttggtctacataggcagcatttagatatgctgaaggtagtctagtaaagtcttctgcctgagtaggatattttattaatttaaattacagtataatgttttaaataagaatgtatgtttttgtaagtgagatgggccactcactcatggaatcgacatatatttgttcagtaccaacaggatgctgacatggtgccagacagtgagaaggcaaggattgggttttattcaacgtggcagcctctatagtgtttaaaacattgctttaaaagctgttggtattctgtaaatacttgttgaaataatgaaaaaagaaaggtcctcgactttggagaattaaatatgcaggtaataacaatgtgatactacagtagaaggatggttcctatatttatatagctcagaagaacttatagtggaaggaatggaaagtttccacagaggagaaagatgaggaatttgatatgataataggaaatggtgtggccaaaggcacagcttcagaaaagaataaagtagccatatgtgaagaataaagtgtaaatcaatttaattggacatagtctccaatgtaaaggaaataaacttgggaagattgtgcatgttcttgaatgtggactagggaagtttgatctttgtttgggaggcactggaggcttttgggcatatgcatgataagattaaaggtccttcctgaagattaatctagccgcagtgtgtaagatgggttgtcacaatgggagataaaaatggggaaatccactatgagatgaatttaattggtcacatggaaggtaataaataatagcctgagcagccagatagtgttcctgtatttgagactgacctcgtttttccaagatgcttcaaactgtgagatatttccagaagtctcaagtgtgaaataatcagtgttactctaaaataacattatgcaaagctacctcacttttctggaaatcaggcatccaaaagtgttaaaacactggaacacagatacaaatctgaacttcttgttgagaagactagactattcactttgcggaaactgaaagcatgtatatcttgtttttgtttcattgccagcaccagtgccttgaagagtgaaaactgaagttaggcaattcatgtataagactttctataaaataattagtttctaaagggtcaattcttagaagtacattttagctttctgaaagacatatttccagggtagaactaattcttaaataatgatgaatattgaggtgtcataatttcatatttatggaaacattgtctctccttgtgtataacttaacatgtaatttgagatttaaaaatgaaggaatttgatttcatttgctgttatttaagctccctatgtctgtttaaattttgctctgaagaacagctgctctaaagtacagccaatatttcttcctttgggatagctagttccactgaaaattttgatatcgtcaaaatgtgctgtatgtgtgtctatgtgtagccaatctccctttctcacatccccggatacccatgtccttatgcctgccactggttctcaaactttaaagtacataaatatcaccagaaacaattatttaaactatatgttcctagccctacagtccctggagattcagattccataggcatggggaagcctgagactgttttgataagctccactaggcaattctaatgcatgacttccagagatcataccttaagtggctgtaacttaagctctctctgccttacttgcatcagatgtcatgttcctgactttaagtagcagttattatttaatttaattaatgaataaagtcaaacaatgtggatgtctagaaaatctcctctactgaaagagcctgaaatagggtgtgttgccttactagagtctgatcggtagtagcgtcatcccacattgagagctgcagtttcatgctctcaatcctgagatgttttacagcagggtaaatgatctaatttatagtatgtgctgagatatttctaaagaaagcttgtgtccgagggtagaatgttttatgtgtttaattacacttgagttccaatccaattcgaagccatgtctacaaaggctggcgtttagtcagctaaacatttgaaagcttctttgttcctaagggggaaagcacaagactaatttttctaacaagtaattgcaggtgcaagttatgtttgcaatcttaaaaaaggaagtgtctcagtgaaggggaaattaaatgagagggttaaacgcatgacctagaaaggatgtttgaatcacttgtgtttttccatcttgtacaaaaatccatctttcctatgagatagggctaatttaccagttgtgttccttttaatatgaggaagttgggggctggagggagaaaaaggtaggaagaaattagccaaacacaatcaccagaacatgttttttttttttttaagccaggagggagaaggtgaagatctacacaataaaggagtaaataaaaacacttgtaggggaaaaaaaataatggagtgttttctcatccactaaaacagtaaaattccatctttaggtttttctttgttcagttctctttggaaggaactttctcagctgaaattttatttgctgtttttgtgtcatttttgtcatcagaaaatatttccaagttaagcaatcttacaaagaagtatctcaggactatcaacattagtgagccgggtaccctgaagtgaggtactctttcctcacttcatagtgtggccaccatagccattcttgcctttcttcagtttgctgtctatcggtgtccatcagaaataccttgttggcaaaaatgtcttccctgcccatcttatttggtctattaatgatttcataaacttcaatatgaatctttatgagacctcctactccaaactggaagctctaatcccttttgcctctcctcctttggcaaccagttcctctctttgatgtccctagtttcctttctctagatttcttccagttccatcatgctttccagatatatctccaccaaaaccacctccaaaaagctaaattcttattggctgccgcagctcaacagcggatgctctggtgaaataagcataacaacaatagttgctttgtatgtagcagggatcagcacagttttcctgtaaagaactggataataagtagtttaggctttgtggaccatgtggttttgatcacaactattcaatggtaccagacaatacttaagcaaatatatgtgtaacttattcaaataaaacttttctttgtagaccttagaatcatttcatataattttcacatgccataaactattatccttcttaagattttaaaaatcattttaaaatctaaaaataatttttgtctcacaagctgtacagaaacaaaacaggccagatttggactgctgaatgtagttcgccgactcgggttgagagttttttgttttcacggtgtccctacctatcatctcatctaattctcccccacagtcttgtgagaaagttaataccgctgccattttataaatgtggaagttgagacttggaaaatgtgactgtcttgcccaaagaaagagaactaataacctgtgtttctggaacctaatcctacattgtcatgcgtccaatcctgtgttcttacctccataacacacttcatgctagtgttatatctatgcctgactgacacagttcaaatctccaaaccaaccaaattccattgaggtggccatttctataaaagctgtcctttggaaaaaaaatttatccaaaacatcaggactcaagagtgtaacagaaggagggcttgttaaaccatcagctgctggacataaccccaagaatttctaattcagtggttttggggtgggggccaaaaatttgcttttcattttttaaagttagataaaattcacacaccataaagtttactatttaaagtgttcaattatttatagagttgtgcaagcatcatccattattatctaattccagaacatttgtatcgccacacaaggaaaccctgtacctatttgtggtcacttcctattctcccctccccacctccagcccctggcaaccactgattgactttttatgtctatagatttgactaccctgaacacttcatagaaaaggtatcgtacatgtggttttttgtgtctagcttccttcacttagcataaggttttcaagattattctcattttagtatgcatcagtacctcattcctttttatggatgactaatgttccattgtatggatatactacattttgtttattcattcattaattgatgaatatttgtgttatttcagtggtttggtttttgtgaataatgtctccatgaacatgttttcaattcctttggctatctacctaggagtgaagttgctgagtcatacggtatctctatgttcaactttttgaggaactgccaaactgttttccaaaaccagctgcattatcttacattcccatcaacactgtatgagttccaatttttccacattctcgtcaacacttgttattgtctgtctttttgactactgtcattctagtgggtatggaatagcaactcactgtggttttgattcgcatgtccttaatgactactgatgttgaacgtagttttgcgggttggttgagaatctgtatttgtaacaagctcccaggagatgctgatgctacttgttcctggaccacactttgagaaccactgatctaaaaattaccacttactcctagcaaatagaatatgctgtgtataattgtttttgtaatcatagtcattatggagctgtactttagacattgaatataaaggaagaacttattccacaagatttatcgagaacctgaaaagtgcaaggcactgttataggcatcaggaaataaattttttaacaacagatacaaagtgagagtttacattcaggtgcgtgaagatagacaatagatgataagtgagcacctaacctttcaagtggtgatacatgctatgaacaaaaatgagagagggtgtggctctagagaggggacagtggggaaaggtaaggtgaccagagaaggcctctctgatgaggtgttgtttgatcagggatttggaggcagtgagaaagcaagacctgcagatttaatgcacaagaaggtaaaagcacagtctttgggaccaggccaagctcaatacttagggctggccctccactcgtcctttgacctaaaacaaattacttaaccactctgtgtctcagattcctaatctattcaatgggaataatagtatttccctcataggattgttatgaagattaaatgaggtagtatatgtaaagcatttagagagatgtgtggcacatagtgttacataagacgcggatatatatgaggctaagaaagctaaaactttagtccctctcacttacatgggcctcttctgtggccttctattaaatattgtatacaaagtaccatattcttttctagaaagagagcctccaagttgtctaagctgtaggccctacatagcctagacctgtacctgatattaactgctatttattcatctctgggataaatgattccagacaaagggagcaggagtgtaaaggcccaaaggctgggagaacatcaggaagacattgtaactggacaaaagtcagggaggcacaaagggagaggataaggtgagaccaaaagggacagtacttgggggatgggaatcgtaggcatagagcaggtcttggtaaaatactttgtaattgtgaattagattaggagacactggagagttctgagaagagagtcatgaactgctttgcattttaataggatcattttggctgacctttagagactagatgattaagaaggcaaaattagaaggtggaaaactcatggagaagcagtaatctacagatgagataatggtaccaaggactaaggtagagatggtacgatattgatagtttatgtatatattttgataatggaacagacagaacttgttgatgaatcatatgtgggattgagagaactgttaaggatgattgaaagatttggtgtctgaggaactgacaagtgaggatcaggactggatgtacatgtgcagtggaaattaagagtttgatgttgaacatgttagttttgagatgcctattttatctgtaagattctattttatttctatgatatatagccctgatggacattttttggaatctctacagttagactattttatagttatatgcccatcataaaattctatgcagaatgtaccatatggacttttggtgctataacacagatgacttttatggaaaatcagacaaggtaggtcagagaatttctttatggccagctccaagacaggaaggtggggagagattagagtcctgccggggggaaaaaaagaggaggtgaaaagagggtacgagaaggtcagaaggagagattttttctgaagtctgcttctgaggcctgcagcaccccaacattataaccaaagatggtcttttatctttattgctctgaagcacttccaaagctgcttcaggaaccaagggcaaatggccaaatattttaacaaaaggtatgcttattgttttaaacacttaggaaatgacaagagttatgagccaggaaccatggacaaaaacctacacacacacacacacacacacacacacacacacacacacacacacacacacacacaatgttattacaccctccatggaactatgatggttctgtcctttttatgttacatgacatggaaggtttccatttaaactgtattatctaactagtagataatgctagcaatattagtaaaattattgtgttctctgactgtaaggacttgaggacatgtttcctcatcttcataaactactgcctgcccctatgcttgactatggtaggtgctaaagatgttacatgaatgaaagttacaataatctgtacaagaatgaggtctttcttttgggtattttatttttgtttagaagggatcttatactcattaggcactgactatccataacagcttaatactggacagtgtagtcaaaacacatgactacaagttccaagtccaccaatttttggctttattaatttgacaagtcactaattatctgagcattacttataaaatggaattagtggtattttttctattttacagtgttatacttaggattggataagataatatacagaaaaacatgatctacaaagtaccaaaaattatattaatattttgatctaatctagaaaaattttgattgatagtgtctactgcttaatctgagaataacataccttgctatagtttccaaacacttttcatagaggatgtaaaatggattttcaaaaattacatttcctcaatataaattacaatggtttgatcacttaacatcaactctcattaaaatatgattctctttgtaggctgaattagctctcttttgagattcatatgtagaaaataaccaagtataaaaaggcttgctgcaaatgtcctctgatatttgattttgagtttgacatttcaattcaattattctgaatttaaggtgtcttaaatcattgaatacattttgcggataatatgtccctgtacccttgcatatttttcataacctcttatacattagccaaaattagaaaaagaaataatcctcttccctgccttaagctaaactagaatagttggcacatttaaacaacaaatgatgagaaaaaaatgacattgataaaagtttcactgagtcatcatgaatctcattgggtgagcaattctattgagggagcatatatgaattttcatatactttaacactttaattgtgctaatattttaagtaatatttgttctttaaatatattttcttatttttctgtcatttaccaagtatagattcatcatttaccaattctgactcttttttttttttttttgagacaagagtttcattcttgttgcccaggctggagtgcaatggggcaatctcagctcactgcaacctccgcctcctgggttcaagcgattctcctgcctcagcctcccaagtagctgggattacaggcacccgccaccacgcctggctgatttttttgtatttgttagtacagacggggtttcaccatgttggccagccttgtctcgaactcctggcctcaagtgatccacccatctcggcctcccaaagtgctgggattataggtgtgagccaccgtgcccggcctctcagactctttaaaaaagatagctgaatgggactgaaccaaccagtgcagatccccaagggcaaaatttgggagtaccttgtgtccatgtctctagttatatggggatagagagacaaaattgtgtttaaaggagtttcaggcctcaaggctagaaaaattggcttatccaaataggttctcaaagcaacatgaaatgagatttaggagatgcgttttggaaatggccctaagagctaggaaagaatggagtaaagtataatggttccaaatttgaatttaaaaggaaaattagagacaatgtctctagagactagggactctgtcttgttcacagctgtattctctgtgaatagtgcttagaacataaatatttcttggctggcaaaacaccgtttaccaattgtgtttattacatgcttctgctaaggtattgtgtgagcaaaccagacacaatgaaagggctcaggaaagaaagaacaagatcctggtatcaaaaacaggtatataaagtgtggctcttaccctccagtaaaaggcaattaagtccccccatggaactcagtttcaacaaatcactactcatattgtgtgggagagaaggatctcagaggatgcttataaagtgacctgaagatgagacaggaatggaatcccaggcagaagcaaagcaaaagtatgtgcaaagtcttggagctgtataaaaggatggtttgtttggaaaatctctcgcagtttaatatgaggatcatgagaaatgacactggggaaatagacatgaatcagactataagggttttcgttgttgtgctaagaaatttgggcttggttaagactaagcttcaaatagttaattctaggatattgacatgaaactatagcccagatatgttaatcatgttacaggaaagtttagcttgttagcaaaagtataatactgacctaaaagagcatacttaagtcctgaaagtggagagccttgtctaaggaggagagaaacaaatatatatagtcagaagcagtgataaaacagaaacttttcccctaccaccccaacagtatttagttaaaatatattttatatcagcctctagggccattatgtcccaatatgcatcccctctagttttattatataagtttattaataacctcttatgtatttatgattgtagttaatatacaaagagaactaaatttatggtagttcagttttaggtattgcttatatgattttttccataatgctgtcaacccgtgggacacctgatgacattctttttcaagaaccaacatcacaactaagtttgtatgtgaccttaaagtagcagaaggagctggtcatgagatgaaaagaaatgctattctacttctattagattattctcaaggactgataaatactttggattctaggtatccttggtgcaaatgatttaatgaacatgtgccatgaagaaaaataagattatagagaatgaaattaaatccgtgctctacctgacttaaaagtgtgcatattatttctctcttccaaaatatctagcatccttatataaagaaagaagtccctacataatcattcctttcccaaccatcacattcaaattatcaaatataaactctgttttcagtttggagaaagaagatatagttgctggcaaaatttgggggtgtgagtcgggaattagaggcagaaaaggcaagggatgtaacagaaaagctttatgaatatatctttctgtgccaaaggaaatggaacacatcttgcatgaaacaaaatgtgacttgttaggcagcctaagatcttatcaaaggagtggaaaatatcacccactgctgactggctagtaaaagggaattgtgctcaaatgggtcaagactcacttctcaatgtccacaagctttttttcctccttatttcctctgtaaatgctgtttttttgtttttgtttttttttttttttggcatgcaaagggacacacacacactgaacacactgacacacacaatgttatgcagagagtttcctcccagatctattcatggtttaaagccccccacctccctttacctgtaataaatatctgttggctttgatgttcactgtcagggataaaacaaattcacaaatatttggtacacgctgctcctgtatgtgacattgaacaaaatgttgatcattaataaatggtgggggaaaaactcaaagactaataaatgtcattgtttctgatgaagtagaacacaagaaggtaaatacccacaactacccccctgctaaggtacaaatatcagtaaaaaatgtgtatatttgaagtatttggtctattacaattcttcagatataaaacaagcactataagcattatggtggtgttgattttaaaattccaacttcacaaattcttccagaagtaccttatgaataaaataatgtaatattcagatgacacatatatacacatatgcacacatgcacatgcatgtatgtagtaggtatcaatagatgatagatgggtagatagatattcttctctctaccttgctgcattcaagtggctgtcatataatataaatcgtatttagtatgtatttttttttaacttggggggttctggatattttgacccacattcatatttttaaccacggtgttgaaaattctctaagtgatcttactgttccacaccttattacattaatcccctataaggcactttcccaaggagtccctgaacacttctgggagaattataggcagcccatgctactctgagcacatttaaaacatagaaacttatttacatgggcctaaatctacctctagaacacctgggtttattctacctagggctcacttcagaaatggtatgtttttcaaaaatgacaaatcatgaagtctccagtatgatttatatttcaaatccatctcttgagaaaattctggttaatagtgactgactagagtgttaggaacaattccaaggtgttttcaatctcatcaggaaaaagagctgctgtgatccattagtgatgcctgctatgggcagggtgtaggactagccaagttttgagtctatttcttctttcccataaaactcccttaaacatgtgcaaataggatccatgtttcatctaaggaatgtattctacccaaatctgaactcttttcagctacctcacaacacatgggctggcattctctgtagcctttggcatgatgtagcttgtcctatgaatatccttgtagccatcgcctccaccataaagcacagagctaatctaatctatgtttgcagtaattccatagaaaaatctttatttcaggatcacaagtgaagcttgaatacttcttaaaagttcctctgagctcatatgtatgtgcaattaagtgtactgaaagcaaaacgttatcttgtcatttgactgctaagagagcttgccataaacatcaaaaacagcttaacaatgcattcttattttttattctgcttttaaagggcattgctaaaagtcaactccatggtctggttctaccttgaagattttgtatctttctatgtctctgtggacatagttaaggatataccgatgactctagtagtgagtgcaacagcacagttgacacacacacaaaaactgcttacatttttaaaatggaaatccagtcatagaaatatcacagcacaacctctcaacgctaccccttgccaagaggctgtgaaagaaaaaggattttttttttttttttttttttggaattttgggtgatgctcttttaagagctagtgggacaaagtggaatatgttaccacttttggttctacttgagaccaaattccatgtgccctcatataatgtacttccaggatagccctgcttcaataaatagaacatcaaatattatactttgaattacaaatacatcaatgtaaaatgatttcaattttgaatatcctccattcatgctacatgactggttaagcaaaactgtgctgacatcatgacagacaattccactcacattttagttttgaatttctggtatatttatgattctagcttttcattttatatgctgggttatcttgtatcaacaatgtatataaaactgttcatgtttcctattatgacagctgcaccaagtccatgtctcagagctgtatatcaaagtggcaaacataataacacaacacagatctgttttgacactaatatggatttcatgcttatttcacatccccttggccaaacattcaaaaacattgtagttcccagtaaataacattccagaaacaaaatccagatgctgtgtctattatttcaagcacacattatcagatacaagaatgcacaatgcttttctacaatttacttttcattttgtatcctgtttttagtgctaaagcacttcattccccaaattctaaatattactgaaggtgaaataagagcctttagagggttctcttactttaaaaaaaaactgacatagaaaattacatgtatttatcatgtacaacatgatgttttgaagtatatatacaatgtagcatggttaaatcttgttgaaccattcttacatccctgggatgaatcccacttgatcatggtgagtgatcttttaattgtgctgttgaatttggtttgctagtattttgttgttgacgatttttgcacctatgtttcttgaagataattgcgtgtagttttcttttaatgtgtgttttgtctggttttgatatcaggataatggtggcatcatagaatgaacttggaagtgttccatcctcttacattttttggtatagcttgagacaaattagtattaattattctctaaatgtttggtagaattcaacagtgaacccatcaagtcctgggcttttctctgacgggagacattttactactgattcaatttcctttcttattattggtcagtttaggttttctctttcttcataattcaatcttggttatctgggaatttatccagttcttctaggctatccaacgctttggtgtataattatttataatagtctcttataatacgttgtatttctgtggtatcaattgtaatgtctccttttatctttgattttatttgagtcttctttttttttttttttttttttagttagttagtctaggtaaagggttgttgattttgcttctcttatcaaaatagccagtcttcatttcatggatcttttgtattgtattctagtctttatttatttctgctctgatctttatcattcccttccttaattttgggttgagttttttctttcttttcttctggttccttgaggtccattgttaggttgttgttctttttcaatgtcagcatttattgctaaaaacttttataactgcttttgctgtagcccatagattttggtatgttgtgttttcatttttctttttttttttttttttttctgagacggagtctcactttgtcgccaggctggagtgcagtggcatgatcttggctcaccacaacctccatctcccgggttcaagccattctcctgccccagcctcccgagtagctgggattacaggtgtgcgccaccacacccagctaatttttgtatttttagtagagactaggtttcaccatgttggccagtatggtctcgatctcctgaccttgtcatccgcccgccttggcctcccaaagtgctgggattacaggcatgagccaccgtgcctggcccgtgtttccattttaatttgtctcaagacatttttaaatttttcttttaatgtcttcattgatccatttgttatttgggagcatatggtttgatttccatgtatttttcaggtttccaaagttcctcctgttatggatttctagttttctactattgtggtcataaacgatacttcattctaatacttttaaagcaaaaatataatgattttgtcagcacattgatagatttttttttctagctttctatgtgctgggcacctatttctgcactattgtttaagttttgcaatgaccctattaggtagattatattattactccccgtcaccagtgagaaaaattgaagctcatagaggttaaataatgtggccaagattcaaaatttgtaagagtatagtcagaatttgaacccaggaagtcaggttttagtgcctattgttatcaacatatcatgctgccctgtacataaaaattataatgaaggtgggccaggtgcggtggctcatgcctgtaatcccagcactttgggaggccgaggcaggcagatcacgaggtcaggagatggagaccatcctggctaacacggtgaaaccccatctctactaaaaatacaaaaacaaaattagccaggcgtggtggcgggcacctgtagtcccagctactcaggaggctgaggtggaagaatcgcgtgaacccgggatggggagcttgcattgagccgagttcgcgccactgcactccagcctcagcgatagagactgcatctcaaaaaaaaaaaaaaatatatatatatatatatatatatatatacacacacacacacacacacatatatagacggagagaaggtgaagagttgagtaaattactaaagtttcttaagcccctagtatgtatcaggaattatgacaggcaattaacatcaataatcttacttagtcttcacaacagctttatttgttagaaaccaacattaccccattttgtaaatacaactcataaggttaagcaaacaagcaataaaattaggaaagtaagaagacattagttacacccctggtaagggaaaaagctggatataaactcctatctacttgcatctgaactagactagactttctgtatttatatcatctctattctaaaacagaacctaaccttaataaagtggttgactaaattgacttacctattttctcacttccatgatatttatgtattgaaagtacaagaagctaaaggtctttggatgaaacagaacatagcactgtgtttacaacagctttaagccacattcaaaacactttagcgtcatctcgtgttatttatttatttatattatttttgcaaattgagtggcattgttagcactttgaaaggcagaaaatatagctgcatattatatcataagaatagacaattataaaaagagtgtaagatgaagtacctttacatgagctgtaattgcagctggtaattaaactgaagtgtttcattttctcagtcagctcatcagtgacaccagaaaataaacaatttgaaagtgaaatccttaggggccaacaatagtaattaattgcattttccagggaagaagcgttcctaaagtctgtttggggtgacctcttgagtaatatacacagtgatttacactgtgagcagaagtgtggggttcagaaccaaatctgatttaacttgaatattcatgaagtctccagtatgattcatacttccatttccattgtcaagtttattgtctcctaggttaacaatgaaagcaaatttatattctgaataattcacataacacaatgagatgatcagcatggaaaaactttaccaggccagtaacacataaagtgaggctgctattaatcccttccaacttggaatctcctcaagtatcaagagcattgttttagagatacttgggagctgaaaagaaaatatttatgtgtgtaaatttggatccatatctcataagcctattggattaaaatcataacattcaggcagtctagtttgccactgttcattttcacagagaagagctttgtttgagatttgtgcacatctttttagctattctgatcacagggaacaaactgccatgacttatactctaatttctcttcttgtttttacttatgatatgaacatggcccttggactcagataggcataggtatagaatccagccccacttcttactaacaccttgtgttagttagctcataccagataacaaagaaccttaaaacttgctttaaaacactaaccctttatttagattatcattctacaggaagacaatttggggtgggctcagccaggtggttcttctggtttaggccaggctcatttggtctcagctggggctcaattatacacctgcaggtgactgccagattgggtaggtaggctgatctatggaggcttcagctggcatggcttgcctctgcttcctgtatcttccattttccagcattgcagcctgagcttttccaaatgatggtgtggcagtgatcagtaagagaaggtaaatccaaatatgcaagtctctgctattgttccattggcaaaatggccaagcccagagacagactgaagggtactgtcaagaaataatagtgatactaaaacccatgaaaaaatcgggggccattattacaacaatcaactacatatatgtataagaaactatgagccagtttcttaatccctcaggcccagttgctgctcatctcatagagttgttgtggagattaaaattaactcatatatgtaaaccaatgggtcaatcacctggcacattggagacacataataaatgttggccctcttttctctgacagatatttatgcactcccatttattggttatacaaagcaaatattctaatatgagaacaacctgttaatgatatgtcatcccactgacctctatagttattcagttatccggctagtgaggttagtgtctccttccttaacaatttcatattaatctgctgaagctatgcattaacctggaggatcaacttctgcacagaagtatattcctaaaattacgtattatgcatgtatgtttgcataatatacttccataaaagctgaaacttggctgggcacagtggctcacacctgtaattctagcactttgggaggctcacgcctgtaattccagcactttgggagaggatcacttgaggccaggggttcaagaccaacctggccaacacagggagaatttgtctctacaaaaatattttttttaaaaattagccaaacatggcggtgctgcctgtagttccacctactcagggggctgaggcaggaggatcacttgagcccagaagttcaaggttgcagtgagttgtgatcacgccgcaccactgcactctaacctgggtggcagagtgagcctctgtctcagaaacaaaacaaacaaatgaaaacaaaacaaaaactaaacttttattgagccattgatttagctatttttaaaacttccttacaatgtacaatcagaggcaaatctgtgttaataaagcctatatgttgcactggggggtcgcaggctagaagaggtcataacggtttaaaatttccaaagtgtcgattatggccattgaagaggctgagtcatcttaaagtcggcttgacattacaatcaaataatcagaaaagcccgtaaattgaattctactttggcctgattgtcttaaaagctggctctgatattaacggacggatgttcacatctttaatttggatcagggccactgacacaatagagtagatgagcctccataattttcaagtgaacacatgcttttccccattgatctgtggataatagatcattctattggctcccctgcagcatttaaatacagtctgcctaattcaaaattggtcagtaaatgtaatactaaactgccttgacctgaagacgatagaaatgaaaacccattttaaaaaatcccaggaaatcactgtacttgtcatatctactgcatgaaataaaaaatatatttcaccaaaatacacttctacctctattattttatagattattaaaacagtgcagaacatacaaggattaatataatgtgcaaagagatcttatatatatggccagggtctttcatgactgacagaacctctctgatgtttgctgactttttagccaaaaagaaagagaacatttggttaacacaggctcagagatagatagaattataataatacctgacagccctttgatacttggtagttttatggtgcagggaagggaaagattttgaagacttcattgggatcaaatgttaataaggaacaaggtgaaacatgcctgtaaaaataatattgattatatcacaatattctctatcattccaatgaataatccaataaccaatgaattcctaatagcaacattaatagggtgattaccgttttgtgaacatttattaaagaagaagaattttaaaataaagctatccatgaatttgctgttatgtcttaaaatactacataaacaccacaaggtgtctgaggtgtgccctatattaattttatgtttgtttggtaactccagtcatggtctctatagccaaagtcattcttcaaatatacagttatttgaactactcaattgaagggaaaatctggggtgacagataacaatgctttacagagtacatgtatatttaatcatagaagctcaagtatataggaaaataaaatgttagttacaaaatgtttatttgataattacacatcatgacaaagaatattataggaagtaaattcaaaatttaaatatattcatacagccaagatatgatccatatttattatgttgtcatgttttgctttataatctatcgtctgtttatgtgctagtttgtttaagtaaaaatattatcttcattttaaaaaagctgagcatgtaaaaaggccaaaattcggggttttggctatacttgaatagactgcatttgattttctttttgcaagctatacccttgatgacagttaaactgaacgagcattcattgagcaactatttagtttatagtcactatactagaatatagtgatacaaagatgataaaccatgatccctgtcctcagaaaagatggacgtatacatagcaactgtaatacggtatgtaagaactatacaagcagtatgaattgggttactcagaacaatcgagtgagggattcttctggcgcaggaggaatggaagtggcttcacatagaaggagctgagaatgcagaatgatgtaacagggctttccaaggttacccccaggttcagtgattcactaagaggactaacaggactcagcagatagcatactatggctataatttattacagcaaaaggatacggaacaagatcaacaaagggagaaggtatgtgtgagatgactaccagaggaaaccaggcccacgcttttaagagtcctttcccaggggagtcacacagaatgcacttaatgccttcagcaggaagttgtgacaacatgtgtgaaatgttttctagtaaggaaattcattacagactcagtgcccagagattttactgggggttgttcatgtaaacgccctaaaccatactgtctgcacaaacagtttaggcatagtaaacccatttgttatcagaaaatgctgggaacctttctgatatctaagttttcagaagcataaatattatggcaatgtactcaaaagaactgggcctccattttaggattccagctgaatgctaaccttgcaagcagtcctttctaaggacagcagcctcaggcctgttagattaactcttttctgcacaggtgaatagatctgtccagatatagttggtggagaaatgaattcaggctgtggaaatttcaagaaagggctcggatgtgtggaaaaccgttcaaaacatttcattcagtgagatgtttaatcttaagtgtttctgggactatttggagtgtcaagttcacactcctgaggcctgacatgatttcaggttccctgaacaggccccatcttgtaaagaggattaaaatggcaattgtgttaattcgaaacatttggcctctgttgtgtacttcattcatgtgaagatgtgattctaatttagaatatccagatatttgttttagttcagtgttttgttgtcacagtatataaagtttctgaccataacacctttgaagttgtatagttcaaaggtccctgttacagtgcaacggagacttcagtttcctggaggagagtatgtactttcaaagacgacatttcagagcatagtacattcatacaagtgatcgacacaaaatgtcatttttgtcactagtacttgtggcattaactataagctgtggagttgtgcttttgttttccccccagccagattgacatgcttcagtgcctttcagatcctacacttgtacaacccaaaacagaactatccctgtatttcactaggagaaaaatgaaaactgttaagcttataaatatttcactacagattgctgtatattcgctgctcactgttgaattcagctgctatgaaatgctaataactctctactgagggcttgagaacaacctctatttcgataaatattatggcgtgtactgaattatgagttccgtacattcactgatagacaagatggaatgttagccttattaatgcaactggtgcaatgtactcaaaagaactgggcctccattttagagatttagctggtaaggtacatgaccactgtaacatgcatgggccttagtagtataaaatagatatgaaatattgtacaaataatatctctgctgtggtttggaaatctattggaaaatatatacatttgtcttatcttctgatttgttaattactcttaggacattatgagtgaattttagaactaaaaagtcagtataaaaacagatggttacattttgtgattattagcttcctgtgactgctataagaaattgccacagacttagaggcttaaaacaacacaatttttttatcttatagttgtggaagtcagtccaaaatcagttttacagggctaaaatcaaggcgtaggcagggcttggtcttttctggggactctagaaggtaatttgtttccttgtctttttcagcttctagaggctgcctgtattccttgacacatgactgtttactccatcttcaaagccagcagcatagcaattcaattctctctctttctcacttctctctctctcttcaattctctctctctctctctctctgtgtgtctctctctctcatctctacttccatcatcacatctccttccctgactcggaccattctgcctgcctccatcttataaagatccttatgactggacccacccagatattccaggcttgtctctccatttcaagatccttaatcacatctgcaaagtctcttttgttttgtcaggtaacatagttacaggttccagagattgagattaggacgtggacatgttttggggatcattattttgtctcctacaaccccaataactctattttgtgttataaatactgtgaattattcagcaccaatacatggtattcaatcagattttgaccatgtctgtctatccatccattcagtaaatatgtattgagaacctaatatatgtcaggcaatgttctagatgctgaggtgcagtaattaacaaaggagacaaagtctttgttctcatggaggttgcattctagaagggaacacatataaattaatattggatatgtcctgaatatttggtctataacaaaaaataaggcaggattagatggcatactgtgttagtatatgtatgatgaggggtgccattttatcactaagtatggtcaatgatgtcctctctgaagaagcaatgtgatatgttgaatagtggcccccaaaatataggtccaagtcttaacccccggtacctgtaaatgtgatcttatatggaaatacagtcgaccttcagtatccacaggttttgaatccatggatttagccaactgtggatcaaaaatattctaagaaaaaacaaaacaataaaaacatacaaataaaaacaatgcaatataacaactatttacatagtatttacattgtaataggtattataaataatctagagatgatttaaagtatacaggagaatgtgcataggttatgtgcaaactacataattttatatcggggacttgagcatccttggattttgatatccacagcgagtccaaaaccaatccttcttggatacaaggaacaactgtattgtaagatctttgcagatgtaattcagttaagaatcttgagatgagattattctggatttgggtggagctaaattgaattataagtgtccttataagagacagaacaggagaagccacagagacacacaaagaggaaagccatgtggtgcatttacatgccaacaaatgccaaggattgtgggcaaccaccagaagctaggagagagacatggaaagggttctttctctgagcctccagaagtaacgaatcctatagacagcttgatttcagagttctggcctccagaactgtgacagaatacatttctgttgttttaagccacctagtatgtgtaatttgttgcagcagcgcaaggatactaatacaggcaatgtttgagcaaatacctatttgaaataagaaaacaagccatacagatactgaaaggaaaagcagtataggcagaagacacaataagtgggagactctctgtggtattcaaataacaacaatgggagacagtgtgactagaacccagaaagccagggggaagagtgtttgaagatgattccagaactatagtgctaaccaggtcgggtagggagggttttgtgggccatggtaaggactttgaatttaattctgtttattatatataagctagaataattatgatttactgaaatgtagtgtttctgggcatgacagttttaactgccagaagcaaataatcgtgacacaactgaatattaacacaaaacatgaaggttgaattctggtgagctccattgtgttcccagtaacttaactatcacatttttaataatgttggtcctggcctgaataacaaaatatattggttcctccacccccaacacgcaactactgtattaggccattatcacattgctataaagaaatacctgagagtgggtagtgaaaagacgtttaattggcccacagttctgcaggctgtataggaagcatggtggcatctactcggcttctggggaggcctcaggaaacttacaatcatgcagaaaggcaaaaggtgagcaggcgcgtaacttggcagaaacagcagcaagagagcaaggggggaggtgccacacttttaaacaaccagatcttttgagaactcacttagtatcatgaggacagcaccaagggcatggtgctataccgttcatgagaaacccacccccatgaaccaatcacctcccaccagtccccacttccagcactggggattacatttcacgtgagatttgggcagggacgcacatccaaactaatcaactacttatttctttttgtgtctgcatatataaaatctgttaggtttggctttccgtgcaacactgtttcatgtgttattagtatcgctgttacactctgatactcccacaagataaccctacccatcaatgagaattgaggccagtactgcagaatgaggatcctacacaaaatacagaaaccttacttgttcaccaaaggtgtgaaccagtagtaaaatgaatggatttgtttcccgtccccttgctggtccctgctaactctgactcttaaaagccataacattttagccaaagaggacggaagaaatagactcaaaagttgcttattaaaacttgcaatatgtgtgccaataattgctagaactgtgttagaaataaggacattgtaatgagataggatgttatttttctaacatgatgtctctatgttaagagataaaggtcaagtcctaggaaatgaagggctactttttaatggcgttgaaaccacgtaatgggtaggattgtctctagaagatcagtaatgcactgatacataatcaatggaagtttcttaggagatactttatttcttttagcattggttcctctccctactatgtcaaatataaatatttcacattgtatagccattaatcaaagtaaaactaaccacagtctatatatatatatatacatatatatgtatatatgtatatatatgtatatacacacacacacacacacacgtatatatgtatatgtactctgtatgcatatatacacagtgaattttagcttatgtccctatgggcagggaagagaacaaaagatgcatataataattcatctctgctcattttcccatgctccttcattttgtgtatcatctcacatgcaaattaaaatgttctaaatgacaaaagaaaatctcagttgtgggaaattaagcataaaatgtggactgaatcttgattttgaaatcctaagggttactaaaaatagaacatttcacacccctttcaagggagcacctgctaaattcatttgagtcaaatgtagaaatctctgtaattcgagtagataaggataatctagaaataagaccacgagcagaggaatggtcaatgttttttgtagccaacagctttgaaatatgcttatagaaaacattgcttaaatcaggactattttaattcagaaggaatctacccatggcctactaaattatcatcagagaggtggtcaccacacattggtttagtgaccaagcttgacatcagaaggcctgaattctgcttctgcttttattattagtgagataactgatctcatgcaggtcatttaatttcactgtaattcaagttctttatatttacactgagttgtgtaaaaattttaaaaaacaaaatacagcatcattttaagctgcataaaaggtagaaaatatatcatttttaaatatcaccaatgttatcaaaatcatatatccagacaagggatctaagtaatttatctatatagatggcatagatagactacatacactacttatgttcctcattttgaatgtgaacagattagccatagcagtaaattccatcgctgaagaaagttaaatacctttaagaaaaatacaagcctgtccttccagttgtaattttctttcttaatgtgctttatctttgatttgacataatgaaggtttttatcctgtgcccagaaatacaaaaacatgagatctaaatatcttttttggttacttccccgtgctttttcattttgttttggtttaatatacaaattaaaatgttttagaaaatattgccaaatttgtacattttgaagttttattctggaaatatgatccattctgcttattcttttaaaatactacatattttcattaaaaaatgatctgatgtaataaaaaaaagtttttgcttgagaattgtatcagtagatacaattctcaaatagaagagttcaactctttacagatgatcagaagtatatttcctttaaaaaagtgaaacttaaaaatcacacatttttagatgatgacagtttcttttgtaggagagtgtgtacctttacaagatacaaagagaaagaacatttgttatcacaatcataaatgcaaattgtggactcagcctagaaacttaaaagatctgtgtagaatgatttttctccccttttatttccagtttaattgttttctgtcatagacttttattgaaacaaatacatgctactgattcttccctaatcttacgtggctaaagctaatctttcttactatttgcttagtagaaaaaaagcaaacagcaccacatattttttttcttttccaaaatatagcaaaaaaaaaaaaacatcctattatttcattccaaaagcagtagtccttttcagacttgtgcagagcagcttatcccacagggatttcaaatagtaactcattggatgcaggtgataaggactttctatgaaaggccaaagcaactaaatagttatggtttttgtttgtatttaatattattttgttgtggatgcgttagtcatattttttcaaagggaagcaatcaagtgtgatagaaattatgatggaatgcagactggactactgtcaagagagctgagctctggtctggactctgtcactgacttagtatgtgcctctagtttccatgtttttattttattttgagacagagtctcactctgtcacccaggttggagtgcagtggtgcgatctcggctcactgcaacctatgccttccgggtttcaagcaattttcctgccttagccccccgaatagctgggactacaggtgtgcaccaccatacctggcaaatttttgtgttttcagtagagatggggtttcaccacgttggccaggctagtctcgaactcctacccttaagtgatccacccacctcagactcccaaagtgcgggggttacaggcatgagccaccacaccctgtctccatgtttttaaaataagaacagcaagatttgctcttaccaacctcatgggaataacagcaagaaaaaaaaatgggtaagctaccaaaaaaatcttttatttttaagaagaaatgtagttttctatttttggtatattatcaaattctcccttatgttctgacttacattaaaccattacatgtaaacatgtaaataaatattgatagtctgtcttgaagcctgactctgatacctgaaacctgaaatacagtcctaattctatagactgtatagtctgaaatgtattataaggaagagactcttttaggtgctgggatacctggtgaccaagataacccagttcccctacaagtttgtattctatgaaatagacaggccctatacaatgaaacaagcaaatattttctcaggtattgattagtgctgtaaagaaaagtaaagccagctaactgaatagaaagtgtcagaggaggggggacactttcatgaagattggtaagagaagacctgtctgagatggtgacataagacctgaaacctgaatactgagaacaactgagctatcgaaagctttagagacaaacattccaggcagagggaacaacaggacataaggctcttgaagcctgaagaagcgtgacaagatggaggaacttgaggcttactggcctggacagaaatgaagggggaagagagctttggatcaggtcgaagaggctgccaggggctagatcagacaagatcttgcaaaccgtgaaaaggagtttttattttattctcaataaaaagagaagtcattggaaaaataagcagattgttaaaatgacctcaacatgacagaattgagttggggagggtgtcctcagagtattacccagagaacttggccccaaatcttttacagatttctcttcctctcctcaaactttcccactcttgagtggctaaaatcttaatctctttctctgtctctctcaacaagagtgaacccgatgcactgcttttccttttaacatcttctttggcatttaagggcacctgagtgtagtcccttgggaaagtagattttcttcttcttcaaataaggtcatcacattcttcaaagaagaaaattctggtgagtgaaattcttcctttctgcccaccatctacctacttacttaaaccttagcagtcatctgtcaaggggatcagtgtttatttgtgcatccagtagcactttcttgtcatagccccatgaccctgctccttcagattttctcaaggacctctggagatgtttccaggttaggcatagccatgtgtttcaaaatgcagtccaccagttccaggacccaggacagaaagaactgcctgtgccaaatcttgttgaggcttaattgggaccttaaggacccttcaggacctctaaggcctttccaaagagcaagaacatgtgattcccggatgaaaagcctcatggttcacggctgccacaattgaggtggtgcagaccaccctctcccctgctggagcccgtaaggctcggtgtgggtggcgactgtggaaagcagggcaggaatacattgccttccagaaggaattcaccttattgctgctcgtggggacagtgttagctggtatgctttggcttcaggcagctgtgcctcagttcacccttcagccagtttttatttttcagtcttgagcagcttcacagacagtaacaatgcagcctatattcttccactaaacgcagtctaagattattcaataatatttggctattagttgttcccacaataacttcatctcgaacttcgagccttccaaattcagtgttttgtttcatcctggatagaccttgatgagagttcttcctattctttatgtaaataataccaagaactttctccctttcctttgaggaggtaaagttaggaatttgacatctgaatcccagtatctgtccagattgccatgttcacctttaagtcagtaagaaaatatgccttcaaaactgcattttgattcgtttctaatggaaaaggtggggcagtggcataaacaaaaatcttgaagaccctcatatatacagtctcagtacttctaactttaaaatcatcttgacccatatttctgtatctctctggttgtatttttaaaaccaccaaggctcctgtctgatttatcatgcccctttatctcttaaatcctggagttatgtcagccatgatgaaaatatacaataagctcagctttttatccaagttgtggctggatacctttgggacacaattctgaaaaagtagtcccaaatatcgcccgattatatagtacttcccctcaaaaggctggtaatgcacccatgcaaacaagaacaaattgaataactcaatttccagaaggccactgaaataatgtagagccctgaaggagaatttctataggggatttcaactggtttatcatactgaaattattttcaagaatccttctagacatttattggtttctcaaaattgtcctgtttaaggcagtaaccaaaacatcttgccttttctgtcatgcctacccctttgagttcacttccttcgtttctgtgcagtgatgctctgtcttggcttatctgtacataggtcactctcagacatgcatagacctgggggagctgtaggtccttttctgttctgatggcttttcttgtgggttctatctccttttcccttccccactaccatgcccataattctatcaaagaaaaagaaaaataatagtaaaaacaagaagctgttctttgttgtggctcattggtaagcaaaagattccatttactttaacaaatatatatagattgcctactgaatattatggactgcagcaatcagaatagcaagttattcttaaaacatagtgatgctcttaaagtgttttagctttgaattgagctgtctgctttgattcaaagtcacacagagactgctcttggaaattttcccataggcccaggggccactcctcggatttacagcaatgaaaacgtaaatgaatctgctcacttaagggagaccaagctgtgcagaagtggtgaatgttaagccaacttgccagaaactgatttataaaccagaatgctgattcattaaatgaaatgggagatgaatctggtaagataaccggcatcaatcatttgaacagggtactccctcttaatgaataagctcattgaagaaactaaattgcagatcagaaggatttttggtacagggaattagaagagaaaaaaaaagtgttaaggggcattcccttaaactcagtttactcaatttgttcctccccattttggaagtctttcagtctacgaatctggcagcagacactggaatgatgtcactcttgggcagttcttgcctttcatctaactttgatctcttcttcattcataccaccaaactttttttgggacaacaaagccctaacattgttacacaaatttaggtcagagtttattttgtattcatgacagttagtctcctgtacctttaggagataaactacagaatccagtaaagagatttgggaagtaccttaaactcatcagcaactatctatataaaccatttttttatagtcagttttttcaacagatgaataaccatgtctgtttcagcttaatgcttattagcttcaattttcaagaggtgactattttcctcattcaatttagcagctacttactgagctcctcaagagcaagaaaagtctccagaggaaacaaaaatgagcaaggcaatcctttatgaagtttacagtcagatttgagcaataacaacaataataatgagcacaaataattatggcacagaattaagaaatcatgtaagagagtctgttccagaaaatgaggcaatcacacagctgactgtgagaatcctgtggcttttgacttggaccttctagggcacatggggttttaccaagagagataagaaactgtttcatgcagttgaagagaccttggtgagacacagcatttagagagaaaagccccagacacattcagagaaaataatgggatggaccctatttgaagactgcaaggagtacatgtaaaaactgatctgccaattctattatggctttaaaaaaaaaaaaaaaaaacacggccaggtgcagtggctcacacctataatcccaacacttgggaggctgaggtgggaggtcccttgagcctaggaattcatgaccagcctgtgcaacaaagtggaacccagtctcgaaaaaaagaaaaaaagaaaaaaaaattagccaggcatcatagatcacttgagctcaagaggaggaggctttagtaagccgtgattgcacaaacgcactccagcctgggcaaaagaacaagaccctgtctcataaaaaaacaaaatctaagacacaacaaaacaaaaaacaaaagccctgtctctccttagaaccacaacagatcaagttatctgatgctttttttttctttttttacttttatgggtaacacttgtatttgaaaaagaaaagaatggcaattaaaagttaattattaaggcaataagcataacatttattaaatcgatttagaagcaacttgattataaatcttttttcagtagaattcagtcatcaatcgctgttccatatataaccatctattcctgatggtgtaaaagaaaacatgcaaaattaatataagttctttaatttctgaattttggcaatccctttacgctttgggtgactgattatctgtcattttctattatatgatttcactcagaggagctattttttgtggtgttataattagaggaaaaccaataatcgataagaagatagtttgaactgagcaacaagattgttttgattcaatgtttttaactgattaaaagtgactaacgtattttgttttcatccgtgacatgtaaacaatagaagggaatctcgctgtatctaacttttttccccaaacccctctctcattctccttccaaattttcgaggtacgaaggatgactttctgacttcacataaattgcccctgaaacatttctgtagttagtgacagctgtcttctacttacttccaggagaaagactttattcacacaccgttaaggctctttttactggcttgagcagcttacaaaagagagaaaaatgtaacgttatcaaagactttcttgtggctttcactttatgctgtcttccaataatatatactggtacctaaacactgagcagcatggagaaggagtggcctgacctgggtgaatttaacttacggagacagggctttctaagatgacacaggaaaggtattgatgagataaaagccactgaaggaataaatcattcatatgatattttatttttattaatttctggttcagctaaaagtagagaaatatcagatgaatgctattccacctagtcgtcagaattgacaagccacccaaggtcaggattgggggctggtctggttctggaatcagatggctacatttgaatcccaacttccccttttcactaactgtgactttttgggcaagtgacttaattttatacccttaagttaattttttctcttattcaatggaaatattaataatactttcctggtttagagtaatgattgaattatatggtatatataagacatcagtacaaagcgaggcacagagtaaatcaagcaataaatggcaactattataaaaaatggggccaggcacaacggttcacccatataatcacattttgtgggggccaaggcgggaggatcacttaaggtcaggagttcaaaaccagcctgaccaaatagcacacacacacacacacacacacaaaattaacgggaggtattatttctctataacacctatttaattgttctgggcaggcatttgtatacctctttatgttctatctgtcttcgtaaattatagaacacccatggctgtcactgaaagacaacttaagcagacccttcaccatgcccagtgaagaaacagaaagagaggaatttgggggattagtatccaagccattgaatcattaagacagaattgattgataaaaggatttgtgtttattaccccagatagtgaatttctctcagtagaaagagtgtcttttcatatcagtgtaggaggaaattcattacccattaatttcttaatgagacaaatggtaggcatctactggaattcatctatggaaacatgtttgtgtatgtgcataaacacaagtacagaaactcacatgtacgctcatatgcgcatgcgtgcacacagaacgggagagaaatttgttgactaattcttttatctttaaatatatgccatttttactgagatcacactcactgagtgggaatttgagagttattttagggttatttttggtgtatataattatctcaaggctctagataaagatcctggagttttaagcccatctaccaacattctggtttgaataagttatttgaaccagcatattagagagaagataaagtcttaagatgtgaggttataagattcctttttttcacgagggcagctaatgctggaactgcacgagtggcagaggtagggtaggagttgacttttaaaagcaataataccccttagccccaattttgggttttttttttcaacatgtttcaatatccatatgttaaaatgttgaatatttctacatctaccatattcacctatgcctgcttgtgaatttgttgtggagggttaaagcaagcaggacaatgtctgtctcatgttaactgctcagaaagtggtagctactcttactgtctcagacagtacctgagtctctcagttatccaccatcagtgttattttcttattaccattagctctcaaatggtaattttcaatcttttctacatcaaaaaccccttggggaatttgatgaaagctatgtatcctctattaaagaaaagtgcgtatacctacatgcatataccatgcaccatttccatacatagtttaggagattcacctattccatgaattgagagttttggtacaccagtctaagagctccagcacgagttgagaaactgctctttcatcttttaaggatacattccaagtgacttatatttgattttagaaaatactggtgaacatactccaaactacttccttgaatcttttctcttgggtcttgaggtaaagcctggaatccttgatgctctggaaactcttcagacagactaagattacttaaatccgtcagtacctcctgggagctggtacaagatgcaattcagaatttaaaattattcagaatgtactaagatgagacagtttatatatgcatcatgtattacatagcatccaagagagttcagtggcagcatcacataacgaaacagattaatatttcttcatcaaaacatgtgaatattcatattaagtgtaataaggactgtagatagcctcacagtagtttcttttgctaccaaatgagtaacattaccataaaaacaactttcagttatcagagcttttagaaattcagaattgcaaataaggatttgtggatctgtagctgaattcatgtatccagggaatcactataaaactcacatccctttatatttctcgactatacctaaagggttataaattgtatactacaatcagccttagatatcttgtagtttgccaagatggatagtttataaatttatgaattacacacagactacatgcatataaagtaatatatatgcataagtgtatattgcattacatgtattagtctgtataattcttcttttagcagtattcagcaatgcatccaagtagctctacttaaactagtatatattgcttgcctagcccaataaggacatataaatcattaagaaaagatttgaaaattatagctggaaattagaaaactgtctgcaatggcatagtttcatagaaacagaaaatggattgagtaccatacttgaatctggagcccctctcagcttcacttgaaataattttgcctgaaaattgcataacacgagttcactgataagaaaagcaattaattttaataaaataagtacgtctaaatttaaactatcttttagatttcaaatagcacaagagaaaaacttccacagaagtttaaaacgtactgagaacattaaaggaactgccaaataataataaaacataataataaaacccctaaatttaaactatcttttagatttcaaatagtgcaagaggaaaaaacttccacagaagtttaaaacctactgaaaacattcaaggaactgccaaataataataaaacaaagtaaaccaaatttctatgtctatgtccatatttctaactatcatattgtcttcaagtcactgctaaaataaagtgctatcaatgtaaaaatgctgaagactgcttctcccttcctttcaaagaaaatctgacatttagatatgaagaatgacaccttcttatgcctccttcatctcccatctatctagaataaattgaataccttgcaagggaggcaaaactttatcttcacccttttagggtcttcagctggcctgagaactaaattgatataagacagattgagaggggaaaagcatacaaatttaatatgaattttatttgacacaggagcccttgtaagaaaatgaagaaccaaacaagtggtaaaacctaaatggttttacactagattggacaaagggaggcaattctggaaaagtgactgactaagttgtatgaagaggcaaagagtatgggagacaaagagttattttcacaaggtctgtttgtacagaatctctaggctttgactctccatctctggtgatgagaatgtttattttcttctggtataggaaagacatctttcacttgggagtttcatcgcttgctttcaggaagaaaagggggagatcagaatgttcttcttgtacttgctgttttccaagtgcctttagctcaacataatccttatgccaaagtggcatagttgagggtagcaaattgtgccacccttcaacctcctggtgttccaaattttgctttgtgccttgaaggaatctaacagaagtaccagaaacacccttctatgagaagaatttacagtctatttagaaaagatgacactagggtggtatggatcaatacagcacacaacacacaatacaccgtaaagtgttttgcacatcataaaaactcaatacatatccgttgcttgattatagaacgttcactttcacagtacctctgaccttttatttttcaatttagtctctctgcagttcctaggaccacatatactctggggagtgcaaaagagacttttacattaaaatatatggaagtgccactctgtaagcctgaaaaagcccaatgccagccattttttatggttcattgtggcataagaattgttctagaatatgttaccctaggtcagttactcttttattcatcttctaacctcaatcttggactttttgtattagagcaacagccacctcctacccgcaccatgaatttgttcctaaaatctgtgtatctcaagatcttcccagtgataattgtttaccctggagcttggatattacctggctggacatctggctaataggccttgtgtcagttttcttttccctccagacttgcacatccctgagagagagtgttttgtttttttttaaattttgttccctaggctctttatttgcctcattttagtcctagtcctgcatggcatcacacttgatcatcaaccctgagctgtctgaattcagccatccaaattccactgaaatgttctcactcctaagtgggtatttttcaccctaatcatattacctcctctgcagcattgggcactgtgagtcactctatccttaccaaagctctttcctctgttagcaatcatgaagcagctgccttgcttctctgtacatctgtacttctctaatcccacaattaccacttaccttttgaatctacccaaggcctggtcccctctcttcttttcattttaaattttctctgggcaatctcattctggaatggcttcaactgctaactacatgatgatagctttgtaaaccccatctctagttgaaacttctattctcaactgccatctcaacctggaggtatcacaaaggtcataggctcaactatttatcctcttcaggttttttcttttacagttggtaacaccatccagtcacctaaattaagactttggaatttacctctgatggctctccatagccaatctaccaccaagtattttctttcttttttccctaaagccttcttaaaactgtgtttttcctccccataccttctgcacttgtaatggagatcaccaaaagttacccaaagccctcctcagataacacctctgaatgtgatttttcccttttcacctgagaccagcataagaaccatctagaaactgatgctgtgatagcatgaattattttcatacacctttgtatgtaaataatttccacataaaaatttctatattacttttttatgaaatgtgttaaaaattactgaaataaaatacttctactttgaaccaatttatgaacaatatttctagaagagttatagatattctatacaaaatgagttcaattgtcgttggtttttaccataagacattattgataaaatcctaatgttggaatctaataaatacttacacagaaagggtccttaaaaagacattaaagtgccattgaatgtcttctagaagttacatttaaagataaaatacattgatatgcttttaacttatttgggcattgaataaaagacctttcttataaatgagcataagacgattagtacaagagtggtgaggactgaaaaacaattcaagataggaaatcctgaaattgatgttactttataaactctatttctaacaaagaaaattgaaaaactttgagtttttgaaatgtataattattctaatacattgagaactgtttatcaattatgaccaaggatacttcacaaaggctagtaagcatgtcattctatgtcaaatcaccctcccgataggtattgcttaagaacctgctaggaagagtgatgtgaaaaataatacaaggaacaatgcattgtttttattccaaattagcttataatttagtgtgtcaataaaccatataaataactataatactctagtagcatatgatgcggcttgtaaaagccagtcacagagttaactgatgtgactttttaagttagaattaaatttttttttattatacttgaagttctgggatacatgtgcagaacgtgcaggtttattacataggtatacacgtgctgtggtggtttgctgcacccatcaacctgtcatctaccttaggtatttctcctaatgctatccctcccctatccctccaccccctgacaggcccgtgtgtgatgttccccctctctgtgtccatgtgttctcattgttcagcttccacttacgagtgagaccatgaggtgtttgattttctgttcctgtgttagtttgctgagaatgatggtttccagcttcatccatgtccctgcaaaggacatgaactcatcggtttctatggctgcatagtattccctggtgtatatgtgccacattttctttatccagtctatcattgatgggcatttgggttggctccaagtctttgctattgtgaacagtgccacaataaacatgcatgtgcatgtgtcttgcacaaaatcactctgtcaccttagcacctctttctttttgtttgcctttggaaaattctgttgaaaaccctttctaaattcctgcccacaaaatattataaaaggaggagggagataaagaataggagtaagaggaggagaaagtaatgaactgtggttaaagattaaagctttttcagaaaagcacttatcaaaagtttctaaagagctcaggagttaatgctgtactttttaggcaataatggatgggaattgcttttggaaagcactcttttttcttgaagagtgcaaaaaatgtattcctttgagtgaatgaaaatcaatgttatggtcaaatatagaggaattgaggagaaaacaaggacaagaaatgctctaaagagaagactttgttgcctcttttcttcttcatcttaggaataggatatcaatatttgaatcatccatgggagcttttcaaaacccctattcctgagctctacccccagagaaatgcaatccaaatctctaaggataaaactcaggtgtcagtattttaataaacttcccaggcaattgtgatatgtagtcacagttgagaaccactgctacaacagatctaaaaggcagaagccaagtaatgctttaatgaagaatttgagaggaggaatatacatcaccctcagctactgtcacctaactagctgatcctggtaagactggtagaaatatagcatccaaaataagcaagggataaaagactacaaattgggttcagtgtatactgcttaggtgacgggtgcatcaaaatctcacaactcaccgctaaagaacttcctcatgtaaccaaaataccacctgttcccccaaaaacctatggaaataaaaaataaaataaaaataatgaaataataaactgcatttctcagaggtgcaaaatacccaaaccctaaatttaaaaaaaaaattagtgagaaaaaataaaatttccctagctgttaaatccgtgatgtgatatttcttcttttaatctgaatctaaaatgttcagtcttggtccaataataaacacactcactgaaacacacagtaaagaatctaagcagggtgagggccatggctcatgcctgtaatcccagcacattgggaggccaagatgggaggattgcttgagcccagaagttcgagaccagcttgagcaatgtagcaagaacctgtctctacaaaaaattaaaaaataaaaaaaaattaaccttgtgtggtagagcatgaagttgaggctgcagtgagccatgatcacaccaactgcagtccagcctgggcgacagagcaagaccctgtctcaaaaaaaaaaaaaaaataagaataatctcagcatttgagaagatgataatatggaaagtcaggtgtgaggtcagcatgtgggtgaataatttcaaaagctcttatttcttaatatcagtaaatatattcccctcttacagaattcatgcatggtattttggggtgtgtaaaggtacctctcacttattctcattctgaaagtctttcacttccttggtggatgaaaaggaaagctgcagttggttataaaaacgtgacggatgatttaggtggctgtattcagctgtaagcaataaatgctgagctcggcagaaagtactataggcaaaaacgtgtgatttactagctatccaaagcacatgagatttataatgcatgagaccctcaggcccatcacttctcttcagtaatgggaaacaatattgtgggaaaaaatgacacatttaatttcaactttgtgttgtaaaacaaaaacgcagcctaattttcattttattattattttttttcttttcgtaaagcatctttgcatcttattggaaatacaaatggcttcttaagaagtaggaacaatagagcatgttcaaaacaatatctatcggtagacatttattactggctgcatgtttgtacgtgtttggtgggatgaaaatgagaaacccggagtgctgtgacagactcattgtgttctgatagactctcccgaaaactgattctagaagcttagtgttctttaaggcagatgtttagccaggtgattgccgtggttacctatggataccggataccgaaaagagtcttggcatacttaaaaaaaaaaaaaaaaaaaaggctagagaaaaaaatagtagagacattttttacccactgaactgagggtgaaaaatgtagtcacaaaagaccatgaactcaaatcccaactctgttaatgatatataatgtgaatgccataaactttctgtatctcattatatcatcctgtgaaatactgacctattttgcaattgcaatgtgagagataaatcaaacctcttctaaggtactttgaaaatagattctgcatttcagaataaatattaaacaataataatgatgatggaatagctgacacaatgcaaattttaaatagagcagagtaactttctaattatgagctacattttattctttgtgagtgtaattagaaagcgaccatgttcctttaattagaaagttaattagactgtgacctcttttcctgtcttactgtcttggactacaggccaggagtaaattgcaaatcccctgacctacatgactatagccccccaaaatcagactgtttaaatagaaataacattataaggaataacattgggacttgcaagtcagatggggacttcataggctatagaagggttctctcatgagagaaaagtttatgtggataaataaaaaagggttctctcatgggagaaaagtttatgtggataaataaaaaagatacttttccagatcaagcctatagagtaagttccctaaattgtattcaggatgttggttcctttgtccagtgactctattactttagtatgcatgcaagagaattacctgaaggacttgtttctgggctccacacatacaacttttttttttttctttttttgagacagagtctcactctgtcgctcaggctagagtgcagtggcacaatctcagctcactgtaacctccgcctagcgtattcaagcgattcccctgcctcagcctcccaagtagctgggattacaggcgtgtgccaccatacccagctaatttttgtatttttagtagagacagggtttcaccatgttggtcaggatggtttcaaactcctgacctcgtgatctgcctgcctcggcctcccaaagtgctgggattacaggcgtgagccaccgtgcccagctgcacatacagcttctaattcagtaaatgtgggactcgagaatttacatttctaacaagtttccagatgatcttggtgacattggttgagagaccacactttgagaactactgacttagaatattaatagtgttaggccgaagtattgttttgtgatcaaataagtttggaactttcaatgttgaacaaagttaagcaagtttgttttttgtgtgatacctcaaaacctttgaatgttaatatgctttggaaatctccaagaaggatagactgcattgctcctgaagggggtggcccttacaaatgttttggctctctttatctcggagctacaaacagaggttttgctatttcacatagtgttcttagaatgggttgttagaatgctttgttttttagcattaacagaagaatgtcagaaatgagtttccattggtgtaatttgtggtttccccatgtgtgtactggccaaaatattgtagagacattccctactcttgtatgaagagggtatacaaatctagtaaggtttcaccctttaatgtgagaaatggtactgtacatttgattaccatttttggaagtttcttgattgcctggctcctgatagcctaattagctgaattatttctctgatcttatcatgtttacctcatatgaaattttcatgtaaaatgacatttggaccactttaaagaaatgtgtgacttcatagagtcgactgttttgagctagcttgttcgtaaatgtctaaagaaaaatttgctgtgaaatttgctcacattacaatctagaagcaaaattcctagagcgagaggttaaccctctgccacttctaaccagtggcaattatagatacttatcagaaaagagcataataagttgtgcaagatgagattgcctgaagtcagattaaaacactgcccctgctccccactccaatacttgtttgagtccttgttttcaaaggatttcatgcatccagtgttattcaaaaacacttgcgaaaatgctgtgtgattatttttaacttctcagaacaaaaaagaccgatgtcacaggaaaccaagcagcattagtaaactggtctgtgacatctctattgcactctgtgaaaattccatgaaaagcaaaatgggaatacaagaatcacagagaaacaaacaagtggagaagaggcaatgacttcatgtttatgttcttggtagcaatttcctagggaaataataacttcagagaaatagtcaatttgccttacctggtgtgatatacgttgtatattgtctaaaaaataagtgctctagaataggcaaaaacactttgcctaaaaagttgtgtacgtgaatgatactggaaaattcaatgatagcctttttgtctgttctcattttgtgtagttgagagcaagatgctcacaagtacatattaatattgagtgaaattaagaagtctcatccccagaataatgttgctcacaaaatagatgctcaataaatgcctgtggttgcattgggctcatttctgttcatgtgctgtttttttcttttcttttcttttttttttttttttttttgacagagtcttcctctgtcaaataggctggagtgcagtagtgcgatctccactcactgcaacctgcacctcccacattcaagcaattctcctgcctcagcctcttgagtggctgggattacaggtgcacgccaccacgcctggctaattttttttttttttttttgtatttttagtaaagaaggggtctcaccatgttggtcagactggtctcgaactcctgacctcaagtgatccacccgcctcggcctcccaaagtgctgggattacaggcgtgagccactgtgcccggccacatatgctgttttaatttcaacttattacatggcttagaatatatttttaaaaagatattttgatgacacaatgaccctgatctataggaatgccatttttagccagaattaatatagagcactctgctttgggattagctttgggttcagtttttggccatatcatttaccagctcagtcatgggaaggataccttggaacatttaataattttttggagtttcagcttgattctcccaaaatgtgactgattaaatcttacctaatacgtcattcattcattcaacaaacatttaatgaatgtccagatgtgacaggtgctgctccaggactgggggccaggagtaaattaatgcattagctgctctcatggagcccacatctggttgcacaagacaggaaagaccaccagaaagtacgtagtagaatatcttgggataatgagcaccatgatgagaaataaatcagagtaagggaacagggagaattataaagacgctcttttattaagaatcaggcacagcctttctgataaatggaggtttgcaaagacgaagtggtcttctgtgcacgggacaaaatgagataaagcatacacaaatagattgtgaaatatttgacgtggtgttaggtatgaagcaaaaaaaaatctatttcattgtgattaccattaccatattatcactgatgttgatgtattttcagaaacacctatctcgtgtgcatatttggtagacaaacctgaggaaagaattcctaactaataaaaagcctcataaatcaaatgccacttaacaaagggaccagtcttgttaacattgctgcaacagaactcgagctctcaccactgctttagtgagatcattaatatgatcattgcaatagtttgtgctcctaggattattgatagagaaaatgtgtatgataataactattaaaaatgatatcacccatcaccatcaattactgattcctctgtatgcatcatacaatgtgcatagtgctttatattttctattgctgttagttctcccaacaatcctataaggtagatattcttaagatgttgtcaaataacttgttcaggatcacccgggcaactttgtaatcagacctgggatggaagcctggagcagagtgaaaacaatgcccatggcctattgaccacattcataataaaatatatattggtaaaaaaaaaataaaattacaagactcttaaacttttatatgtttcagttaacattatgaaatagacaactaaacttttgccctgatttggaacccagacttctgtgtgctctttgttttttaatgaaaaatgtgttttaaatacttctgtggtctgaaagtatcccctagaattcctattttgaaaatccctagtgtgatggtattaagaaacggggccttttggaggtgattaagtcataaagatagaaccttcatgaatgggattatcaaccttaaaaaagagatcgaagagagtggcctaggcccttttttgccattccaccacttgaggacacagcattcaaggcaccatcttggcagagaccagtcccttaccagatactgaacctgctgataccttgatcttgcacttcccagccttcagaactttgagaaataaattctcgtttataaatttcccagcccctatagcaacacagactaagacaaataccaaataaacataaaataaactcttggagaacacatttgcacacccaaaacttcctgaagatagcaattcctagaattcgaagcactgagagagtaaacaatttactttaacttttgaaaccatgcagcctcccctcaattccatgttttatccctcatctgtcgatagtgcatggtgctgtaggtcatgatcaaacttccaaatagaatcattcatacaattctaagtcatcattaaggccaattcagaacgtggagattttataatttagttgctgtttgagaaactgaatacctaagacagcttatttgattattgaactttatttagtggaatgacctctggtggcacaaataatagaaactgctttcaaattatcattcagggtagcttgtagttggccatgaatagagagacaattaagtagcaaatttattacaaagcaaattccccagtgacctactgtttttcttttctagtgaggttcctcaacgcataatcctattacttttggcttgaatgagctagtcactgtcttccaagctgaactatgatgttacatggaagtttaattttcatcttatttaatttgaccttaagtgagctggatcatgaaaaggcaacataatctccaattctcgacgttaagcgtcttttaactactctacccagtaatcattcccaagagacattgtgaaattgtttaaaaattggtcacaaatgctaatgctaattttatgcccccagatattttggcatctctttcttcttattgtgccttttacactgtgaggcacccagcaggacattcctatggatggatggacttaaaataataaattccaaccaccattctctctggctaggccccctgctctaatgcttaacacaatgcgtggcacatggttagcactcatttggtgttagttgtctgaatcacgaactcaacgaattaatgaatatacaaatcagctaacaaacagacagcagaatgttgaccttctactttctctcatttgtttgaagtgcaattcaagaccggagaaccaagtggacaaaatactgcatatagatacagcagcaaatgcttaatgacttaaatatcctggaaatatttttatatcttactctgacttttcacaaacattaaaccaaaggaatgcttaactggcaattttaggttctcactgggcaaactcatgggataggcagtgtggagaggggcttgcatatgttttttgcatcatttcaataccccacatctgagagtgtacaatttgggttagatttccactcaaccggttggaatttcaggttttggactacgtcctctctatttcctctttatactttcatatttggaaagcatgatatgagtactgtcttagggagaggatagacaggaaagggaagctactgaaagccttcttttgaaataataatttcttaatctatgcactaacacacaagagtttatatctcctggaattttaaagtaataattgtagtgtgacaaaacaatgttaagtcataagatacatttcaacgttttaaaacacacacagaatacatcagtgcccattatgtgataactgagagattaatttgcaaccaataatatccttggtattttagcgttgtggattgtcaaaggcttgcttattgcaggttaagacattaaagggcccacattcccacttcttattaaagggagactttacgaaaggtaggcactgtctctacacttctgggaagaaagcctggtgatacgtaatgctccccctagcagaaaaatagtggtcaccagaagcatctctccataagataaggtgagacaaatagtgctgggccaaaccttgtgaactatgggcttcaacaaaagctaagagtctcatcatataactctcacctagactcagactatttcaagcaagaattaaggtaatgacatgaacttcttgccacagttatctctttattataaaatgtccttgactacaaggaggtgtaaataataactgccattccatggataatcagggtaagctctatacattgtctgccaattaccatgtactacttgaaaattgttaatttagttgaacttgaaaaaataaacaagtggccctctttggcatagtctagaagagactgcataggaaaaatgggaaattaaggtggaggatgatggatggggttctctgagtacagcagagggggcaagcagaagagttggagcatcatgaatggggtcacagtacattagtatggcttctttggcttgattgtggaaatgtgagagacaactattgtgagattcaaagacagtggtaacatatataagaagtgactgacaagatgacagccactcaggaaaactgcctcagaaggcagccagaaaggatcaattctggaaaatgactggcggaagctattaggcatattgaatgggtctgacttagtggttgatttgacaatgagagcaaaagatagatgttataaaacatcattcagagtcaatgaatctggctattgccaaagacagagaaatgaaagaataaaagggaaggtatggggaagaaaataagaaaaaaattaaatgattatctttagtttctgcattagttcttctgctttggaatctccctagctgcctgcagccaggggcaaagatagtttcacctagagggtcctgattgaggctgaggatacctaggctcaatcacagcagtggcacttcccattcagaggaaggcttaacattaattatgagacatgagatccaggtgctgaactgacaaatctattctctctcccaaggcttcccaaatcacagctccgataggcagttatcctagcttgtattagtcataattccctgtagccagagcttccacttttccttgcgttctgattttgatgctatcttatagattaccctcctaattacaactcactgcttacctggttctccaggaatcatagcatagttttttgagtactctgtctcacttgcctggtcaggacacactacctcactttctattctaaccatttctcaatgccgaggactcatatctcagactcaagacagttatattgttttatttttaaagtcactaagatatacccatatcttggtattccataagcaagaaggaagtgagatgagaaagtggttgcaaccacagtgttaaaaatatggactggaaacttgtctatttgcagatggtattagatttctattgctgctgtaataaattaccacaagtttagtggcctaaaacaacacaaagttctcgtcttacggttcagtaggttagaagtctgacatgggtcttactagaacaaactcaaggtgaggctgaactcaacagggctgaattcctttctgaagctctaggaagagtccatttccttgccttttctaaattttagaggctgcccacattcctcagtgtgtggccccctttttccatcttcaaaaccggcaacgtctaatctctctggcccttttttccatgctgtatctctgatcacagcgggacagattttctgctttaaaggaccaatgtgattagattggacccaccaggaaagtctcccatctcaaagtctataatgttaatcatgcctgcaaagtctcttttctcatggaaggtaacatatgtacaatttctgaggttcagatgtagacatccttgggggaccattattctgccttccacaaagatattttctaaaccattgagaacagatgagagtctcatatccactaacaagagccattttgatatgcaacacagcaacccaattgacaaggaagtcctcagagatagtgtagactgtgatactcttcatctttaattctataggttttacctgcgtagtgtctgacctgaaagtgacaaagtttcccacaccttgctagatattcccacacattcctatttagcccatctagacattagaagggaagctttcctatttatgattcctatttaattggagtgaatggatttctgtcatttcctgttgttccttccatagccttatgattgtgtggtaatttgaaatctagacctttttcttttcttttttttgagatggagtcttgctctgtcacccaggctggagtgcagtggcgctatctctgctcactgcaacctccgcctcccaggttcaagcgattctcctgcctcagcctcccaagtagctgggattagaggtgcccaccaccacgccgggctaattttcatatttttagtagagatgtggtttcgccatgttggccaggctgacttgaactcctgaccttgtgatccgcccgcctcagcctcccaaagtgctgtgattacaaatgtgagccactgtgcccggcccaatctagacctttttctaagttagttataaaattttacatttttccctccttgcaaatttgttcccatttgaagaaccatctgcaagaagaagaatacataccattcaccaaaccttctatccgttgggtctatcagagaattagtattggtggtgtcttctagtcctcttgcagattaacaggttatccacttgacctgattatccatgacatcaatttggtgtatcctaaacttcatcagagcagaatattcctcagaaggaatatcatgtcaggtagcttttcagcactaagcctataaatatcctgcctgtgtaggcacatgggagtcaatcctgagaaagcagctcattgaggcaaaaaggggagatttttagctgaatcagacaattactcaataagtctgctttgtggatgtttgtgtctcccccaaaattcatatgttgaaagctaattcctaatgcaataatattaagaggtgagacctttaggaggtgattaggctctaccctcatgactgggattgatgcatgtataaaagaggcccaagggagtttccaacaagtgctgggctatctgctgttagctagcacttaagatgtcttacctgtaaagtgtctttcactataattagtctttctgactaattgtcagattcagctaacaatctcttctttttgcctcaatgagctgctttctcccatttgcctacacagaacataattgtttcatacactagaattagatcagagtagattcaggctcttcattacaaaatgctcatctctgctggatgttaatatcaaaatcagaattctagttctatcacatattgactgatataagaataagtttagtttaaaataaaaggtgagagaaagaatggaaaagtaataatatggaacatgagcagcgtctcgacttgtttctgcttcctctctttttcttactaattaaaacagataacaacaaagccctttggtcacagcccacacaatcacaagtggttccctttgttgatgtgatgtcactggaggggaaatgagcagttgacaggctgtgcaaccaagaaggcaaaatgagctcaaccatttgaataaaacatagcaggtctcccactccatgtcattgactgacataacccaccagacagtaccctttaaataggctgtctctcttttatgtagcaaataaaaaaaaaaatgtaacatgtaaatatcaggtgattcttcttcagcatctgtggttgccagaaggaatttactgccttttcattgtgtggttcaacttggtcttcaggtggtgtgccccaaaatccacaattagtgggatccagtggtgctgtggatgtttgtgccccccccccaattatatgttgaaagctaatccctaatgcaataatattaaaaagtgagacctttaggagttgattaggctctgccctcatgaatgggattgatgcctgcgtaaaagaggcccaagggagtttgttagaccccccacttccgccctgtgatgacacagcaaaaagtgtaatccgtgaagcagagagctcacgccagacattgaatctgctgtcacattaatcttggacttcctagcctccagaactatgagatataaatttttgttctttataagccaccgactttgtggtattttttgttataacaacttaaatggaccaacacaagtgatgatgtttctagagtctgtgtatgtgcatgtgcctaagtattttgccaatttagcgttaatgagtacagcaatgccaacaatggatccattctttgcctctcctattaccgcaggtctccttttcacagatcagtatagataagggtagtagagataaatattacgaggttatctgttagtgcctgttcaatcaactcttgattttacagtagtcttcctgtgtaccatgacccagacatcttataaaagcaaaacacaaattgcagttttaaaatgctattgctctgcaccattattttcctcttcccactaatttgcttgcgattcaatgtgttttctagcatctctcatgtcttgggttcttggccctcatatttccctttggattgcttcattttggtggattttgggaattcccccttggctaataaaaccttggttattcctttctgttctgctgcctagatgactattccccattccaaactttaaccctgtggaaccccacccccacacaggccatctatagacctttgttcttcctaacattttcaacagggcaatgaagtgtttcataaatatttggggttttatggaaaaaaaatgctctaaggcagcttaaagctattcttcaaaataagaaaagtattctatattttaaacatgtatatagtcatcttctttactggggaattaatggagtactctaagctattgcccctcccactctcttctcttcagctacccaaagtgatgatgtggaacttccagattttctcctgcaagttcatgctttatttattccattatgaggtccacatcaaattatattaccattcctgggattctggagttcagatctttggaaaatcacagtgtcaacagaaattataagataaaggcacttatatatgaggaatgatcccttgccctgcatttacagattcagatcaaaaaccaatgcccacatattttatctctagcttttactaaacagtagagtccgtgacttcattcacagtaggtgattgatacatttcgacaaaagtattttgcaaagacgcttcctgcagcatcaacagtaaaagagatactgaggtaggtgctatatgtatcttctggatacaaatttccaccaaaaaaaatttcatcttagcacatatctttgacttatggtgttcaattttaaatataactggcagttttgataaaatgcattcctttccattgtttctgttacaaagaatgcaattttaaggttttctgtttttgtaaattggagcggtggatacaacagttaccacccccacacatacacttctctaacacatacatatatacacacagttttaacattcccaattctttaaaaaattatctttgatcaaattattgtttatatgatgtaaatgccttggacactactgcctgtcagtgatgcgagtcagttcttctattccttttattggctcctcagagatttctggaagtccatctataatagaatcattatttcataatgataacatattttaaaaactcatggtttcagaaacatgagcaaattgccttgtaaaagcctacattgagggagttgtgcagactttaaaacacctcagcttctcactgcacattggatatggttgagtattgcaaatacagccatatttatccatgctatctagcattagacagtccttatcatcaagtgatctgagggcctccttcatcagcttcccttggaatgcttgctatcaaagtactttcctgagcccgctacagatttaacaaaccagagtctctgtgcacccagagaagggagtttgctccagtgattttcgtgcacactaaggttggagaaccattgtccctcagagccattagaaattcagcttgcatcagtctagagttctacaagaggcaatcacaacaacatgctatctacgaaaatcctatatttccatccctgactcagaatctataaatttcagtttaatttccactaaatgtattatcccgggaaaaagggcaggaagtaattatggaaaaaccattgaaacgtaagcatggtgagcagatagtatgaatatgagtataatctgacacttttaatatctcagagaacagaggaacaatagggaaagcaggtactgaccagccccagttcacgtttgtttctgccctcttgggctgtgcaactgtgtgacttgggcaagttacatgaccttgatagtcaaaatgtgaatgacagtatgtgtatattagtgatgttgtgagaattaaatgactgatataatgtgtccaccaagatagtagacagatagtaggcccccgtgtattagttacctttcttgttttctaccactactacccaagagggaagcttctaaactctgaaggagatctgttgatagagtctaatgtgtcatccagctttgtctctgggtcatatagagatacagtttgtatgccaaaaaaaatgtagtcctctatacagttcagaaaattaccaccaatatgctttatcaaacagcagctacagtgtagtatatgccaacctcagagtgggtctcctcttaaaggttcccaagtatccagtcatgtaaatgaagactgcatctaaggagttagctgtacagagaagagtctctgagaaagcgaaatagggttatagtctcctctagtccttactttcgctttaaggaaggagaaaatagcaaagagtgaagaggcctggaaaattgcagtaaaacagagcaaataggataagagactaataaaataagtggagcacagagaaactaaattgaatgacaacacatgagaaatgtactcaagttttgactcctgatttgtgaaccagaatctgccaataacaactaccaaatagatcagcccaaatatctattagtaacccccaagaacagtgcgatgtagtagagtgacccagcaataaacaaggccccatctctgccttctagtgttttacagactaggaggaagcctccacaaatttggcacagttaatgggtagctaatcagaaaaaattaagcttatatcaatgtacttaagctgtgaagaaaaagcctcatacttcttgttaaaaataaatatagtttgattgctcaaagagatcccagtccacagattaccacagtaaataattgcacgcccatctcttttgcaaagcacaaagcaacctgctccacgcgcctcagatgcctttctgaatcaccacagagggagacttttaatcatttcaacaaccagagcaccagctttgttctcaaacaatgctggaaggtttctcacacctctactatccatagtattataatttttcatttttcataggcaggggttttgttttatttggttggtgttgtcatatcccagaaacgaaacaggcctgcaaaatcaatgccacacgtacaactatgtatatattctcccctgtaaatctccattagcttgattgggactccatagtggctggaggtattgcctgcatctgcctttcattcttagtttgggcaaaatgagtggtgaatgactcttatacctgccttttaaaattggggatctcagatgagccctggctctaccactaattgcatggaactacttggtaagcagcatcactgaggcatcagcatcccatcatatttatttctagggaagatgacaaattatggccaaattagcatcgatatgaacaagtttgtagaagggtcaaaatataaatacaatatacaaataactacagcagtaatgtttttaatcactacattttcaaaaatattctaccgaaaagggtgattaacaaattattattatgttaacctagaaaaagaacataatcagtatataatcactaagaagacattaggcacatttaaataagtaggtgtttgcatgttaatacacacgtactcttagctcaggaacatgatccattaaccgatagaacgagtaagatgttagctaattggtgagttcttgcagtgagaaatgtctaatgtgagtccctggtacctgtgattttcaaaattatttaaacaggaatcaaaactgttttaataatttttgaaagcattcccatgctttagaattttggtttaaggcttagaccaaaatcatcatggaaaaaatgtgtgtctagtgctgaatcactttgacttgtattagaatgtcagctccaagaagacagacatttttgtcaatttttaatcatcaatgtacccacagtgtttacaagagtatctggtacactgtagggttattagcaaatattcacaaaataaacaaataaataatacttacctgtttcattacagtttctctgccagaattgtaatcattggtcaagtttgatagtggacatgggcctctttcttgggaagtaataacaataggaagatatggtactgaatgctagcttatgggaggtgtgggttaagaggtctcagggatgccctgtcttataaagagctctgcacaaacttaagcttaaactaactggaaaattaggacagccatctctgtcatttctctagcgtcttctaccctctattgctttccagatgcaactcaggggactctccttcccattttcctggccctttgctttctttattgggaactagttaccttcaattctccccctttgggtttatatgcattttagattattatggttattcttcttgtaacctcatttgcgtggtagatgcaaaacagaatttgagacattgccatgaacaaaaatggagccaattatttgtatttacatacttttctgaagtctattcatcagattttctgattcttagtgaggacttacttaggattattcagatgtggtcaagacaaaagcaatgaaataatcatctgaggttttgtattatctacagatataattctttatatttgctaaataacaaaaggaaatatttttctcttgttctctctgaatgaagggcaattgtgctgtttttctgtcactgtctataattttacttctaagaaatggcatgaaggtatatcagttacataagagggcttttatttgtcctttttggtattttttagtgtttggtttaatgattaaaatatattgtatctcttagatagttaactatacacttaccatatgacccagcaaccttacttctgggcatttaccaaagagaaatgaaaatctatgctcacacaaaaacctgcacatgaatgtttatagcagccttattcatgattgccaaataacttaaaaaagcagcctacatagagttcattgggtgaatggataaaaaccaactgcgatacagacatacaatggaatagtacacagcagtaaacaccaaagcagactcttgatatgcacacaacatggatagatctcaaagacattaggatgagtgaaacgatctggtctgaaaaggttacacactgtataattccatttatatgacattcaggaaaagataaaactatagtaatagagaacagaacagtggttgcctgggattaggagtagggagagaatgccacttcaaaggaataataggattaagactttgggggtgatgaaactgttctgtaacctgattggggtgttggggtggtagttttatatatgtgtgtgtgtgtgtgtgtgtgtgtgtgtgtgtgtgtgtatatatatatatataatatttgtgtacatgtgtatctgcatgtatttgaacatatatacaactgtataccaagagaaaaaaaggtaatttcccagtatgaaaattttaaaagtaaaatttaaaatatatcaaaaatatcatattgttccttataaatctataagcatagagaaaaagctggaagggtactcaagaaacgttatcatctgtgtggagggacttcaaaataagaatctatttcttttgtctttggaaaaaaaagctatttccgttttaaaaatatcgtgaagtcttttgtttagaattggtaaaggtgcttttctaaaaacgctcattttcttgtagcttttggttaataaaaatactcaaattattactgattatttttatacagtattttttctggcagtattaacagtatttgtatatggtgagtgttatattacttctgccaagcttgaaaacagagatgacaagttccgtaagtgtaaaaaaataaatgaaattaatagtttcgtgcctaagagcctctctttgcatatgagattagtacactgttctcatgcttattttgtattataattcacttcttcagaaagctcactttattccattcagttgcaaagcttggatggttggtatgcctataataaatttagaaaattaagttattactgcagtgaagttttcaaaactccatccactcacaggtatttcagttataattttgataatggagaagatggaaagatagatactatcaatattttttcctttgctacatttattcccttatgccttaaaaacgagggcatgatatgatattccatatgctaacgtgtgtatatgtaaaagaaagagaaaaaggaacttgctctatactttaatttcagaatatggctacctttgcttatgttagaatgtcagcaacagaaaattaaatagcccatataattaatgcttgtcttttattccagagtaagtttctttctgtgttttgcacatagtgtaacacaagtttgttgctgttgcttttttcattgagaaatctttaaaatgatcatgaagtgtgcaagtcaaagtaaaaacaataaaacgaggtattcaagtagatactgagaggtaaatgaattatgttcgttttatggcaacatccaaatattttgtgtttccattttatgtcaaaagttaagctttagctggaataaaaaatttcctctcttggtaaaatcagttgacttagcagttttatgcaagaactgaagtattcaatcaacatttttttttccatcaaacttcccttttgacaggaaattctgtgtctgattctttttttctttaaactgcattcaaaagaataataaaagagcaccacatgtcctctttgctgaaggagtttttaaagagataccacaataattattttcttgcttggaagctacctttattaagaggccaattttatactggaatctactattaaaattatgtgactaatgtttcattatgaatcatgatcacaaacagagtcattatgtatgggagacctgagaaatgttcgccaaccacattcaaaaatagatatttgtgtgtgttccagttacattttatttgaaagatcaccttcctttttttcttccaaatattccctttccccctcccttgtggtcctcctcacatctgagctccttttcttttcacagatggtgatactctttgaggtcaggtacctatgacctggagtgtttcttgaagcacttccaatattcggttctactttttcaatactcatgacagcacgcagtctaaggcaaaacagaagtgagggttgattgatcataaatatagctgacaccaccaagctgtcagggagcaggacactgaattgatcaaattttaaaagtggaggatgtgtggagccaaaaggaggtcgccttattttggagtcatcagctgagggctaagaaaagaaaattctggaattctgctctgtcaggatatgggatgggcttttagaagaaaataaggaaactgatttcattgcaacatgacttttggcagttgttttaccttaccttttgctaaaatgtcatccccgcacccccctcatgaccctttactattctccttctctttatttttaattttgtaaattttaatttttgtggtgacatagtaggtatatatatttgaggggtacatgagatgttttgatacaggcatgcaatgtgaaataagcacatcatggagaatggggtatccatcccctcaaacatttatcctgtgagttacaaacaaacaactcgattacactcttaaaggtattttaagttattttttacctcagaaatctctggttcatattatcagagacttaataatatttattgatcagaatttaacatttgaataatttattcttttcttatatgtacagtagtgattgggtgggaagagggctgagttcaaatatttactctcccacaagctacttggcaacttaggtagttggaacctcatgatccaagctctgaaatctttggaaactacattgtaagagacaattggttctatagagggaaacccttgcaaaagttacatgtgctctactgatatatcaaatgtatgtgtgtatgtgtgtgtgtatagtagaactgatggtagattatttcaattatatagcattaatgacaggtggactcaatttattttctctaagcagctgaaaattctcaccaagaaacagccttcctgtattcaccacctttatttgaagttgagaaataaaatgttgccaagtatatccagggtcatcccatttttctaaacacaagttttctctgcactatgacactcacattactgctgctaacatgacgagcttcagatattatcaggaggcattttgtatagtagttaatagtataagttcgggtactagtcctggattcaaattttgggttggctactatccagcttataatcctggataaattatttaattgctctcagtttcaattcctcatcttccataaactggaataatactagtactgacatccagggttgtgaagagaataatctacatcaaatgtcaacagtcattttctgtaacagaccagacagcaaatattttaggttttacaggccatataatatagtgtctttcacaactactcaactgtgcctttatagtataaaggtggacctatacaatacataaacaagtgggcatggctgtgtttcaataaaactttatttacaaaaacaggcaggaagactgatttagcccactggccctagttggcaaacctctggtctatattaatgcttaacacagttctaaacattaattttaattaatgtaaattaaatgttattagttctgtggcatacatttcaacgtatgccattattcaagaatatgtcacaatcatacaggccatactgtatttctccagaaactaaaattactatatcctaaaggaaactaccatggtttgaagatttgtttgtgagaaattctgcagtagcatctggtgatctggtgagagggacataataatcagtaaatagtttgcagtaccttcttatcaactaaatagatgaacgatgctataaaaatgaaacaaaagtgacttaatgaaatcttcagtaacgtagggtcacacatttattcattcttcaaagtagttatcctttcactataatttccttcctagattttgctaaacatatacaactggtagaagcctaatgtgctgttcctgtaacattatattcctgttccttgacttcctgatataatgaagctgattatattccgtgtttgataatgttcatcctattaggattgggaaatccattgaccaccgagcacaaccttatgttcatgttcttatcattagcaccactccagctatggagctgtcagcattttcagcctaaatgctgctttcaggggcctgcaattcagtcataaaaattagctgcaggcagaaacttgatatatgaagtccagatccaagagagaattttattacatttttaacacagagagagaagtacattagaccattataaaaaaacatacaaattagtgtagtgaacttgctctgcatccttttctgttctgacgtaatttaagattgcattcatatctgcccccttcgttttccatgtatccatgaaggaatcttacggatttccagtgccaggtgactttacgacaagttcccttaaggttacatttaagattggaacagagcagcttgagtctctatttgtcaatgggaaaaagattttccagccttttatgaattcaaaattaattagaataaattttctgccataatgcagcaacacagggtatgacctgcatcaggcttcatgttttatgattgagttttaagaactggcttgtgtgcaaagacttttctttgacgtgagattgaattaaggaaacttaattaacattttctaattaaatactgcattgtgaactcaatcgcattgtactctgcaactatgatgagattgttctgtctttatttaaataaacaagatggctcacagggttgagagcttggttgataaccatccctttctttcctcagttgtcacctctgcttttcagaaatattattagccactcacctaactgcaggaatttggtagacacacatttctcaaaaatgctcaaggatactaaaaatgatacctgatctcatgattgacgagagtagtagtctacccatttaatacctaattccagttcattctattcattcgagacaaaccctatttttattccctttcaccttattttctccatggaatatgtgatgtataacatgtatcatgtaatacacaataggtagcgtataatatgtgatttccagtgaccaccatggtgttcaatttaatagttaatgtgccatcctcatcttacttgccccgagagctgcactggacaaagtacacaccatttctccatgatactcatcttcccatggctcccaggacaccacattctcttagtttccctcccaccattctggtcactccctctcactcttttttgctggttagtcctcttccccctagtctcctaatattgcagtgccccagggcttaatccttggtcatcttctctactctccctactctcattccactgatgagctcatcctatctatatgccagtgcctccttaatgtatatactctgccctgacatttctcaaatcttgcatacctaactgtctatccgtctctgctggaatagacactccaaactccatatgttcaaaatcgagttcctgatcttttcctgcggacctgcaccacccacagccttctctgtctcagggacggtaactccagttgtcagttgctgaggccagaatcttagaaataatccttgactttttattctctcactctttacatccaatctgtcaggaaattttcatgcctctcacttgaaatttatccagcatctaaccacttatcacttctccaactcttatcaacctggtataaggcacttaccacagtttgttgctccaaagctctctgttttacattgtcagcaacagtccttacaatgatctacaaggcccaatctgggtgaattcttcatccccccgtcttagcatgtctcctcctctctgactttcttatgccacaacagccccactggccttcttgctgttcttctgacatgccaagcacacttccttcttagacctttgtactcactgcctgcaatgaatgcctgcaataacacatcctcctggctaactccctcacctccaagttttttctcaaatgtcaccatttcagtgagtcctatttcgatttctatttaaaattgcaaacctattctactgccagcatttctgaggtctaccttttctcctttccccatatatcttatcacctttgaacagattatctaacttttgtctgtctgtctaccccttatcatttgcccaccacattaggatgcaagtcccatgggggcggaaagttttgctttgttctttcgtacatcccaagcactgagagtagtgcctggcacatagaagtaactcagtgaacatcagaactattaaaagcatatacaatcagacgggcatggtggctcatgcctgtaatcccagaactttaggaggctgaggcaggagaatctcttgaggccaggacttcaagaccagcatggacaacatagtgagaccctgtctctacaaaaaatgaaaaaataaaaaaatcagctgagtgtggtggcatgcacccgtagtccgagctactcgggaagctgaggcgggaggttcacttgagcccaggtgttcgaggatgcagggaactatgagttcaccactgcactccagcctaggtgacagagcaagaccctgtctcaaaaaaacgcatatgtaatcattgaagaaaattaaattataactatgaaaattcaagcagtcacaatatagtgcaaaactgaatggtttattaaagatgtttaatttgaaggagattttttacaagtaacatttgttttaaattattcttattaacattttaaaagattgattttgcatgatacaagaaggatggtggcttcctatattacagaagtaatattttagagaagtaatagttccagtcattgccacagagttctaaataaaatttgcacatggaaaattaagcatgtaaagcaattgcatcctcatgatttagctaagaaaatgtccaaaacagttaaggtcagtcgtagatttaactcagtgtttcaaaaccatttgattcattggtaccaaaagcaagcgttttacatttttctccaaatctttggatgttgttatttcttctttaagcaccataaatttttagctatgcatgcttactagaagtaagcaataagcaataacttattccttttcatctgtggcttatagaacctcttgctttgtgcatatgttttgcccctctatttcactccagaggttttgatcatatcaagtttcacttaataaagatgagtagagggcaaaaatcagtagtaactttggggaaaagtagaagttccccttaggcattgaattataatcaagtgaggaaaagctattattgatactcattcagaatttcatattagatcattgaaaatctttaggaataatgattgcggagtcaccgctaataacttaatgacaattgaatatgttaaaggctttgaaaaagataaaatagatgtagatgacaactcctgactcagatgactatagtaatttttcataattaccattcacagaatacaatttagatagaaataagagcaagagttaaatgcaatacggagtagctctaataggacctagacatcagggttaatttgaaaattatagttcctaaagtaattgtgttgcagaagcctatcatacaaaatataaaccatgaaataaaatttttatgaacttcttactaaagctgtttttatacccttgttttgatgatttacatttctaatttcacaactttagcccttagttgagccctaagcaaatttatgaaaacatatttcttattagagtacttgaaatcccctgtatgttactaatcccaaccaatgaataagaatttccattctgcaataaatatcattgctatcccataacctatgtttcacttgtacaagaaaatacttcttcagcacaaagaaggaatgattaattcttaaaatattaagaaaacagcctaataaagtctctcaaattccacttgtaaaagcagaaaaaatattagagtaaaatcgccacagattgtctcctcaaatcataggaacatgaaaattggaaactttcagcaaaatttatttttaacattgttcaactgttttgtatagaacatttaacgttaagaagcaattttgtggtttgaactatttgcatgataatttctggtgtggaagatgccttagagctgtgttgcttcaacttttcacatcagcacagtaacagtggggccaatttggtctctttatgtatatttcaacattaaagttatttttagacaaatctaccattggaagattattgttgcattggtggtggtgagtgagattcagctatgtcaaatctctccatttaaaaaaatgaggctgtcacatatttcaggacttctctgatgaggtgtcacagtattttgatttaacagactttgtataactatgtggatacaatagcaaaagtttattttcatttttttttttgtaaattgttttgagctaggtcagaatgatttctaagcatacacacgctaaaacaatgctaagacatagaaaacagcaaatttttcaggctattggtagatagtttaataagttcgtcctcttttgagaggtctagtcacctgtgtctagtgttggatggaaaggggcttggatccactggttagtcttccttattgtctcagagaaggagaaaagggctttatcgtgaagaaaaatgactgatggagctctatatacacaatagtataatttgaatttaataatcaactaatagtaccaaacaatttataacccccataaactcctaacacccgatcttcattttcactgtaataattctgtcgcaatacaaagtgttcatagttttttcttgtatttgtcaataagatggctcaattttggatgagaatttcaaccactgttgtttacagaagttaggattttttttttaccaccatgttgagctccttgaaaaaattaaaggtaaactttttgaggtgaggtagcctttgtgaataacattgcaactgaggaatttttttttttttttgagacagagtcttgctctgttgcccaggctggagtgcagtggcatgatctcggctcaccgcaacctctgcctcccgggttcaagcaattctcctgcctcagcttcctgagtagctaggattacaggtgcccgccaccacacttggctaatttttgtatttttagtagagatgtggtttcactttgttggttaggctggtctcaaactcctgacctcaggtgattctcccgcctcagcctcccaaagtgctggggttacagatgtaagccaccatgtctggccacaactgaagaatttgaggtcaaaatagtcctaatgaaggctatcattcttcagctctgcctttcatgaccctttcagtgtacatattcatctggttatattttcagtcaatttcttggctcacccaagaaaaaaatgcatatcttgttgaaaaattcctcgccaactattttccatcaaacagtttttcataggtcttcacagggagcgttattttaaatactgagactccaaggcaaatgaaacaaccaattcattatgctataataaaaccataagaaaaataacagaggtaatctgaatcgagtgactggttgttccacagtgtttttaaaagacgcttcttgttagtgttagtaaataaaggtgtctatgtttttcagcttagctacctctttttggctcaaatcagattctactatccagtttttaatcaaattttctcttatctataattaacccttcaaaactaaactttaaagttcaacttgtttcctttttatgactagctgaaaattttttaattgtaaaagaaaaatgcttataattttttctatatgcatatgattgattttaaaatgtcattgcaaaaacgatggcctcatggcatataggttcatgtttttttgtgtgccagacactaaaattgaggctcctttatattattaaattgaaactcatgtttgaaataaactaaatacagcctataaggtttagattcactgcagtttactgctgattggaatacttttggtatcgagtttaatatctgacacaaactttcatcatttgtgatattcccttctaatttatcttgcatatttccaccagtttgaaatttgcacttcaaacttcctatttttattcatgacccatttcaaaatatgatatattaattatcctttactgtaaatatatgtactcaaaggggtttggtaataccctctttgtaataagtatgaaaagaagtgtccaataatatggattgattaaataaatataatccatataatactctgtagctacgggaatgaaaaaaatagagttacttgtactgatagaattttgtgctttttagaagatatatgtgtatgtgcgtccatacatacatgtgtgtatactgtatatgtgcgtatttctatatattcatgtacatatgcatatgtttgtcatgtttgtctattattatacacacgtgttgtttatatatgtagtattagccaagaaacatacagaaaaaactgtttccatggttacctctgagctctggggagtgaaaccaaagcacagaatgtgggtaggagctctttactcttcatcatctatcctttttaactgtttcaattttttttttactatgaccatttgatttagtatgaaatttgttatatatatatacacatacatatgatatacattcatacatgttgtgtacatttatatcatatatatattacattatatatgtatctatatacaatgtagtagctatcttcaaagaagattttttataactaaagataagaatgttaaaagtgaaggaaaacctcaaggcccaaataactttgtttgtagtatttaaattctgctttttctttctattctctcactgtctattcccttcatcacttaaattcattcccactaaaaatgactcacggacatagtttggaactagttgccacatcacctcaaagttaagggcagcagcttctctatttacagctgggaaaacttgtaactaagagggaggccatagctttagttaaatcggcatccaaggaaacaaaataccagaaattaacaatggttgcaaaatggagtcctagcctaatccctctcctttctaattactccctaattgtttcttaaccatgtgccgccaggctgcagtggttggggtatggagagtgaagaactttttgaataaggcaattcttactctggaaggactaacgaagaacctgattgtaactaaaatgagggaacagttcctactatttccatcaaattcattctgcccaaggaaaaagatgatgatttgattttaattatgctaacagcatttcaatagcctccggagaaaatgcctgctttccaaaatgcagatcactaaattatactgtgcctcctagcaactcctactactgagaattcaaagcttatctcaactttactttgttttaaccatcctaagatttcagtccacagctttcccataggctctacctgccttttagtgtctagaacacactctcacggcatctgggtcttcaaacccacacagttcctgtgagctattcaagataggtcaggttccagctgaggtcaggcattgtgatcactcaagttaaccctcctctaaaccctacctctagtgtcctaaatttgctttttgtctcagcagataaaacccagaggttcccaaacctgctgtgcatctgagtcatgaggaaagtttgtgaaatagattcttggtttctcagctacactaatacacggcaaggcttgctatcctttcttccagttcactgcttctgggtcctgcatgctggagcaccaccagtgctgcctcacctctggcctcctcctgacaaaggggtctctacactctgcactctgtcatctgtaaccagccttcttaggcacaagctgccttctattttttaactcccagtttcgtttttatgaactattcaaatcaaataattaagaataacatcaatgatgccagcaccagtagaataaggcacacctttgctttaggtcagatttccttgttcctctgtttcctgatgaaggcctatgcttctggactttcccttgattcaagatgagtgttctgcttttccaaatggccatcagcagggactaatggtggtcactattagtcttcactgacaggctttttagtccaaacttggagacatggctattgagcccagagttctcctcacaggcactgaggcacaggattctatgagcctcctctaataggtttcattcacagggataatgacatggatggatatggttatattcatgtaggttttagcaagaaagatgctgtccactgagagctacctgaaagattatgatacacactcttggaaaagaataagaggagcagattaaaataaaaatctttgcttaacagtttgagttggatggcttgatgaattgcaacacctaggaaaagaaatcttcctaggttatcttacagttatgatttttttaagtataaaggagatgagaacaataccaatgtaattcatcttaaaagactttaacctgtactaaagatttgtgaaattcttcattaattatgattgactattaataccatctcaaagattttgctagacctagaaaggctttgttaaataattttccatgtaccccatactctcacagatttaaaacctaacactgggagatagtctatcaggcaaaattatgaacttatatattgatgtaggcatagttgctcataggttccaaaagttaatatatacatttccaaaagttaaatataacattgtggttttgattacatatcacgttttcctttcccgctcaaatgaagttttaacatgattgcctagatttggtttcaaatttacctgccttagaaactgtcactcaaatgtacaattactttttcaatgttaagaagaatatgttatgataagaggttcctaaagaaagcatttcatagttctctggcattgaattttttttatttgttaccttgtttacttgtgtgtgaacgagcataaagtgaaccctcagaggacaagaaaaaatatcaggtatttctttatggatttaatctctgaaaattttccatcatcactaatgatgtcccaggagtccttgaagctaaaataacaagatatacaatttacacatttttatttagatgcactcattgtttgcaaataactttgcaatctgataaagaggcaaaaagataaactataggtataataaacttgaataaatggatagaatttagaatgtatctgggggatatatcaagggtctgtttggcaacttgggaagatgattggagaaaaggacagaaatacttgaggaaatctttctgcatggactggatcaagtctaaattccaaaatactgtccagccatggaatggcaggttagatgacagcttagagcgaggattggaaatgggaaacaatgtgaggatggcaaaagagggtatgtctcaagatgagattcaccagagcagagcaaagcagtgaagagccttcacttcattggacagcacttgctctttctccctttacatagattaaccttgagtttagcaatgcttatggagactgctagagaatgaagggaaacaagacacaatctgttaagtaaagaagcctagaaacattgggtatgtggaaatataacatgatggtgctaacagtcattatggtgactctcatttgtagaagactagttctgtttcattaagagataggtttcagcttgtcacctagtagatcttatcttaatcatggctgtgtatgttgactcacataccatttttactagtatgcacatccaccgtttactgagctgttgctctgtgctaacttacagtgtgctaagagctttatatactgtattcatacagttaatccctataacgaacctaggagtgaaatttttcacacccagttttgcaaatgagaaaattaaaatatcagaataagtgacataactttcttaaggtcaaggagataataaaagataggcttctattttgacatagatttagctgtctcaggggcctaaattcgagccaccgcatttatgttttagaatagcgattgcaaattgttgactggagcaccaaaatcagcctggggacctgctttactgattctacatactatgttttcagacaatctgaatgtgcatttttatggaggggagtgttaactggagtcaccgtgcatcattgttttaaatcatcttgacgtttaagatttcagtttttcatttaaggttacaggttgaataatatttctccctactttatcaaaatatatatcatatatatgtataaaataaactagcacaacagttatttaaagacagttcaattgtttgtactgagatatacaaacagaaacatttgggagaaatattacaatattcgtaaagaagccagggacattggttttgcaatattgaggtgacaagtttccaaaaattaattctatactgatttcagatcctattttccatgaatagacacagccagagggattcccttctgtaatcctcatccgtatgcctctaccaaccaattaattgctcattactgcatcaacataagtgtgaatttgttgacagagagacatttaagaaagaggttgtaaatatgtcccaatggtcctacgtactctggaatgtgggggaaaccataatcacagttaattcaatgtcaaatttcttattcaaatatgtatttccagttacggtgataatttttcattcatgctcgattgtgatgatttttgcttttattttatgttattctccattacggaacttcattttgttttacacaaaatagttaatataatacttcgcagtaagggcattttgaaagaacagtggcttaaaaacaaaatttatctttgtgtttcctacgaggtggtaagccagttagtattcaacaagtgtttataaaattatttcattttcttaaaagcctataataaagatattaactggagaaagaacgttgaaaattcagatgagatgaccagtggttttaatacagaagagacagttttcatatttttagcacatagaaaaaattgtaaaatgtgtttgctaaattccatctgaacattatcgtaagaaaacctcacaaatattttaatttcttaagtaaaatagcttatttcatttatgccctttactactttattttcactagataaatcatcaacgttttacttactttttcaaaaatcccagtagaacaatcatgtttgttttgacaaactctagaaggtttttatttctattaatttaaatagacaaaaagaagacacttgaaagcagcacgaaatccccagcacctttttacgagattataacttgtgtataaaagtaattaacattttctagtatcatattttaaccagatcagagattcttaacccaggattcttggatctacaaattaattttaaatggccttaaaattgtacacacaaaaaatattttcatggggtggggaagggggacaagggctctaccattcatctgttcttttttttatttttgagacggagtcttgctctaccacccaggctggagtgcagtggcatgatctcagctcactgcaacctctgcctcccaggttcaagcaattctcctgtcagcctcctgagtagctaggactacaggcacccacaatgcccggctaatttttgtattttcagtagagacggggtttcaccatattggccaggctggtctcgaactcctgacctcaggtgatccacccacctcggcctcccaaagtgctgggattacaggagtgagccaccgcgcccggccccattcatctgttctttaagagcgtttgtaactaaaaaattttaagtcagatttggaggaagaaaattagaggttttggggaggataagtcttgttcactgaagagtccctttcacataatttaaataagagctattgtgtatgaagctgggcacagtggctcatgcctgtaatcccaacactttgggaggctgaggcgggtggatcactttaggtcaggagttcaagaccagcctggccaacatggtgaaacctcatctatactaaaaatacaaaaattagccggggtgtggtggcacatgcctgtaatcccagctacttgggaggctgaggcaggagaattgcttggaggtggaggttgcagtgagcaagatcgcaccactgcaccactgcactgcagcctgggctaccgagcgagactccgtctcaaagaaaaaaagctattgtatacgaattgggctgctattatttattctcagtatttaatagtgaagaaatgtcttttctaatcatgcttatttatccattcactttctgataagcatttattgagtgcttaatgaatgctagatattgtttaccaagataggaactcagaaggttgagcaatctggggagaaatatgactaatcaaattgctgacacattgagtgtgagatgcttgtgggatatccaaatggagatgtccatggagggcagaggtccaagccaaagacttagatttgaaggtcagtaaatatgggtggtaaagtcattaaagtgtttgatgtaggtaagcccattcttgcatgtatagtgtgagtagaggatgaatgagagaaacagccaacattccctaggtgcgtggagggagtaccttccagagaggctggaaagtggttgtaaaaaaagccagcagagaaagacttccaaaatgagggaagagtaagctataccaagaatgtagaaagatctagtaaaataaagacataaccattcaaactgggaatcaattttagtggaaggctatcagtggacgtcagactgcagttagtagatgggaaacgactttcagtgtgctgtatgtttaaggaaatgattgattgggagataaagtcagaaaggacctcattacttagcacctggtatgtgatattttataaataccaagttaatggctttaactgggaaataataaaatcattttcctcctaatcccagaagacaatccactgagagaatgggatacttaaccaggggagaagacagtgataactttggcataacgtgtatcattcagagttcaaccagagaagtagagcagtagggtattatatatgtatcctattaggtgtgtgcatgtgtggagtttgtgtgtatacacatacatatagatagatacacatatattttacagagaatcggtttacaccattatagatctggctaagcagtctccacaaagctgtctcttcatctaatatcagagcctgaagttcacaggcaggcagtcaggtgggaagatcacaagcaggcttgaattccactaggatagactgaaacctgtgttttttgttgttagttgttgttgcctctgaccacggcagtaagaatgagcacacatacctctggcccagaaatcagacactgaaggaagatccaggggggaagagagcaatcccaggtccaaatgatgctttatgtcaatgaggcaagtcagcataccagcagcagtatgcatgtgtgcacacacatatgcatgcacatacacacatactgcaaaatggcaactgccttcctaacatcctccaactagtgtgaaagaatttatcgtgtagcctaccctaactggacacatgcaagaaaatggaattctggtaaatgtagtttgacctagcaagttggcacattacagagccaatacaatgcgtactttcagagatggcaagccttagaggctactagagtaggggttctgggtaatcattgtgcttcatgaaggtcctgtcacttggtagataagtgaaggaagttatgtagaaatctgagggtgggaccatgaagatcagcttgtttatcctctcagttgttctaagggcattgctgccatccctgttaacaaggggattaggaaataactgattcaatttgcctctctactacttccaccattcttaataataaaaagaaatgaccagtttctatttatttttttttcaggcaatatttttataagatgaatgatcttgattattacagtgaaaataaaatgatctctcagaatgttctgaaaacagttgtacaagtggaagttacagtgttggcttaaagaagagaacataaatactattcacacttctttagctgtactaaaagagctatagaatgtagccttatttattgttatgtaaaccagtaaaacttatccagcaagtgacaggaccttcatcctgtaccaaatccctgtttttggagtaagatgccaatggaaatagtggagctagtttaaaatcaaacatcagttcaaccaaactgatttaacattttcatttgtgttggggaagctcacggtctttaaatatcgatgagaaaggtgtctcttctaatacttgcttatgtgctgttaatgctgtactcccaaagatgatcgctaatctataatctaatctatacaactacacttttcaaaggatgtttagagtcacagacctgaacctgacttagggaaaggtgtttctccaagagcttttctgtgactacagattgttggagaaaacaggtagtgaaggaagatggcgcatgatctgctgcgctaccatgaagtagaatatatggtgatattttaaggctatatgtttacttttgcctaaattataaaagcaatatttttatattataaaaatttaaatgttgggaaataaagactcatataaaaaagataacaaagaagtaactgagatatgtcacaagttctttaaagcttcatccgtggaatcttaagaggctctctcctacttcagatgagaaagtcaggaagcatatcgtttgactaaacagtgatataaaaaatactaattaagtgacatttcagaattgcagttttgaaatgatttgctgttctgctcacaagaatcgtagttatgtttactaactttattcattttgtcttaatatttgctatagctgccgtgggcatggccacggcaaatgtaagctatcagactgaccaggttgatcacatcaatgaggaatattttcattaatccaagatggtgtttgattcagaatgcgcatcgtatcagcaacacttgccatcgaccattaaatgtgaggaattccaacagttagttagcaccaaggagttaacgatatgaaacatcatccagaactgaacaaatggctttactccttcctgtatcttgggctgtgtggaagttgtcagggtttcctggaaaagagttagatatgcttatatagattaaatatactaaagggcattccccgtaacagtcaagtaagtgttgggtaaaaggcaagtttattcatgtaactacagatagaatacgaatagtgtgaatgattccgtaagtattttagggaaagtattcatctttatgcaatgaaatatataaagtggtcattttcctaaagacaagaagacagttattttaattgacttccacaacttcccacttagagagttgctagtattaaaaaataaataaaatatcactgccatgaagattaagagtgatagtcagaaaatggacttcagaaaatgatacactttctttaggtaggaaagcagtaaagctattctcaagtgataaccttttattagatgctggcaagtctgaaatgctccttgacaatctcttttattgaacgaatcttgaggactataaacctagatcagtgccttataatccttgcataaggctgttgtgattaaaaaccaagtgaaaaacttcccaatagctcacagaagagtaatcagtctgtcttagtatttattagggtgtgtgtgtgtgtgtgtgttttaatgggatactgcttaagtatacaggccaggagtaaaggtaacaccatgagggagggtaaaggcatggaaagtcagattgggaactccaaaaagaaagaaagaattttgagggttgtcagagcttctcaagagatcacacgtttagagacaattcaaatacttttaaacaataataacaaaaaaatctactgagcctttagtttcatgatcagaatgggggatcaaagtcagaataccaggattagtttcaagtgattttaaagacaccaatattagaatggactgagacaggagatacaggttgcaaagagaaataaataacaagtcttcctcaagaatgaaaagaactctgagagacgtagctttggtcatagactagaaatgagaataacagtgaataattttttttttttttttgagatggagtctcactctgtcgcccaggctggagtgcagtggcgcgatctcggctcactgcagcctccccctcctgggttcaaatgattctcccacctcagcctcccgagttgctgggattacaggcgcctgccaccacgcctggctaatttttgtatttttagtagagacagggtttctccatgttggccaggttggtctcgaactcctgacctcaagtgatccacccacctcaacctcccaaagcgctgggattacaggcgtgagccaccacacccggccaacagtgaattttttaaatactgaaaatatctatgaatgctaccaaattctgaaactcttcctgattaactcagcacagaaaattccctctcattttgagcttcagttgttcaaactgcttccatggcagttcaaactgctatgtctccctctatcaaatggggacaacaaagccaggcttcatggtatattttaggctcagaagctgtcagaagcattttactgagccagtatggagaagagacaagcagagcaaacttctgcctgaaaaacaagcagttaacactgagtacttctaatataatggcgactaacaaaaatccttctaggcagaaaaggagaaaacacaaaacagtgagttcactgttacatcttaaataataaacaacatgcattagccatcatgatttcctgcacttgccacgttataagcttataaagcttcctaaaaatatttcattagctttgaaaactaataaatctaatgattacaatttatatttttaaaaacataagaaaagcaggtttgtgcctaagaccttgagtgtcaagaaagtttagagaggataactcattaaagtgtacagcgaatcataaaattcaatttgaattgaaccttccattttggcccaacctatccatgtaaaaaccagcaaaacaaatcattctaagtcacaagctgctgtatgtgttttagaacagatactatttactatattacccctaaataaaccaaggtctaagtaaatggtttctagcttttctctagttaagctaagttctttcttaaaaggaaactcgttctaattcatatttttcttctcgaagagggagcttatatttttctgtttctgcactttgaacatgagtattgtgggaaagtattaggggattagcaggagataaacgtggtttttgtcttcaccactaagtggatcaaattagtgggtatatggccatgattttattctgccacactatgacctgtgagacaaggtggaaaaagtagattctagaggcactgatggatacaggctaagctgggtaacaaggataccccaaaatgtaatgtctttgatcaaattgaagtatattatttctctcgataaataaaccaatagctagcagccccagaccagtcaggtgattccattcaattaagtcattcagggactcaagtcccttatatgttgttgctccccatttttttcctcgtatttctggtggaagccagttcactgatacatctgctttccagtctgcaggaaagggaaaaataaactccagggcatgcagctttatcataaaggaaatgaccaggaaattgcacacatcacttcttcatacatctcgttgacccggtctcaggcacatggccacatgtagctgcaagagaagctaagaaatgtggtctacaactgggtagccacgtgcttacctaaaattctagggactatactactaaaaggaagaaaggactaatagacactgggacacatttagtggtctctgcctcaagaggtatcagccagggtttggagatgacgtattcagcacaaaaaagataaggcagtgtttggacagggttacatgtaagttgtgattctcttgaacagacccctagtggtcactgacatttgaataaactgctaggggtatttcactttcaccaccactaatattctttactttcctcctcctttcatttttctttccgtcttgctcctccttttcatattccaattttccccccatatttttcctttttgtttcaactgctcatgatactgaggtctaaagaatttactgagtaatgagcacagatgtatgctttctttatgcatttttaatggctgatttaaatatacttggaggctaaaaatgcaataatttgctttaaatgtgtaggactctggaaagatgagaaagcactgtaagagttaaataaatcaagaaaggatttggaatagtgactatgtaattaaaagagcagaaataaaggatgtgccttatcaagatgtaatcacaaatattggaggataaaaagacctctgtattaaaacctaaagatatctgcattacaaaaaatgttcactttgtggatgacttgaaaaactttcgaaatgagtacaattataagcagatctgatgtttttgtcagaaagcaaatcacgaggtacttcttccatccactcaactcaagggtaacaatggctgtactttctgcccttcatcatcaccaggagtttctgagtagccttttagagcaaatcaatttcctggcaggtgagtaatttctactgtatagtcatcattttcccgcatcatttatctaagacccatcttctcaacactcaggtgcaacatcacaccttcccaggggtgaggtcatcaagggcatctgggtgttaaatgtttgatgttaacaagagggacaccccctcttctggctggtgtccaccgattgttctagacaccatgaacttttgtttcatgcaggtagaaaacagccatcaagagctaaaatttgagcccttacaagaatctttttactacccagcacaatgtggtaataatattcccacttctcaggcccttttccttcaagtgaataagatttcctctctattctagaggagccatgctactgcctctcttcatttgattactgtgggaaatcccccagcagcttattccaagttcactgcgcagccctctgattcctgaaaggcataatttggcctaacttgatatatatactatatatcatcacttacagtaatgtttgtcccataatagtaatactactactaataataataataattgctaacagtgagtgagcactcaccatgggtactataaatttatattaacttaattaactccaagttatttgttgttacttaaattctcttataatctattgatcaaacaattgagttgctttgttcctaaaagctacaaaaatatatagtaatgtagtataaaatctattttcataaagaaatctgacactacagctgaattatggttagcaaatttaaaattcataccttgttttcctcttgtgattttgtctccttgaaatttgagcagatgttgttatatctttcagcaatcacatcctcaactatgagcttaatataacgtacccctttcattacttttcctttcttttagaattcttagataaatctctgatttccaaagaactatctgtgctttgatattggcaactattatctgctgtaggtcctagtacttatttaggtaaaagatcttaatgaagttccaacgaacttcatttgtctccgtgtgtgtgtgtgtgtgtgtgtgtgagagagagagagagagagagacaaagaaattcttctcttttttcatttctgaataaagctttctagaagagccattcagtgtaactaatgacaaaagataaatatgttttgtaaaccactttgcttttatcttaaatggggagtcttcggcaaaacatttatctttaccatgaccgtagagtaattttaatatacatgattaatggtgcaaatgaaattaaaatccccctactattcaacatcttagttaagaacaaaatgctcactgtttcctaattgcaaagagtaaaatgtctggatgttgatgctttttaattagaggagaattttctttttaattaaaaaaagagagcttttttatttttcagtaagttagagagtgtcctctagtggagagagactctgatctcatagttttagaaatggctatatgatacccagttagaactgtgctccacttagctgattggaatctactggttgaagggaaaaagtattgtttttcctctaagacccctcaaatcatggcctagttaaaaggctgcagtgtgacaagcattgttctcattttagataggaatgattttttatgatcaattttagcatgcttccttctgaacctgttgaggttgagctgactgtgcacctttctgccaaaaaggaggcagaagcatttagtgcaatttactgtggcttttacaggtatcaactggaggcagcaagaataccattgtcttcaggactgcagacctggctgactgatatatttgatgtgtgcagatccctaggccatagcttaaatttgtttcttttattatttgaaggaaaacaaagaaacaaaattgagagacaaattaaataaaggtctctcttctccttaacttgtcgaattctaatgctaatttcctgtatttctggttaaatgtgctaagcagtcttagctctatcacttgtgtatcagagatgagaggtggaggagttttttcgatatctaaatggaagagggtacggaagagctgtggtggttggctctctgaatcacatactagaattgccttatcagaaattgcttattacagcaaattagagactgaaagaaaagaacgatagttgctcttgataacaagctaaatagcttggacttaaataaagataaaaattttattgctgattctttttttaattttaattttttaagttctgggatacatgtgcagaatgtgcaggtttgttacataggtatacatgtgccatggtggtttgctgcacccatcaacccgtcatctaggttttaagccccgcatgcattaggtatttatcctaatgctctccctccctttgcccccaaccccgacaggccccagtgtgtgatgttcccctccctattccatgtgttctcatttttcagctcacacttatcagtgagaacatgcagtgtttggttttctgttcctgtgttagtttgctgaggatgatggcttccagcttcatccatgtccctgcaaaggacatgatctcattccttttttatggctgcatagtattccatggtgtatctgtgccacattttctttttccagtctatcattgatgggcatttgggttgcttccaagtctttgctattgtaaatagtgctgcaatacacatacgtgtgcatgcatctttatagtagaatgatttataatcctttgggtgtatacccagtaatgggattgctgggtcaagcggtatttctggttctagatccttgaggaatcgccacactgtcttccacaatggttgaactaatttacactcccaccaacagagtgaaagcattcctatttctccacagcctagccagcatctattgtttcctgactacttaataatcgccattctgaatggtgtgagatggtatctcattgtggttttgatttgcatttctctaatgatcagtgataatgagcttttttcatatgtttgttgactgcataaatgtcttcttttgagaagtgtctgttcatatcctttgcccactttttgatggggttttttttttcttgtaaatttgtttaagttccttgtagattctggatattagacctttgtcagatgggtagattgaactttctcccattctgtaggttgcctgttcactctaatactagtttcttttgttgtgcagaagctctttagtttaattagatcccatttgtcaattttggctttttttgcaattgctttggtgttttagtcatgaagtctttgcccatgcctatgtcctgaatggtattgcctaggttttcttttagggtttttatggttttaggtctaacatttaagtctttctttaatccgtcttgagttgatttttgtataaaggtgtaaggaaggggtccagattcagttttctgcatatggctagccagttttcctagcaccatttattgaacagggaatcctttccccattgcttgttgctgattcttatatttgaaaaaaagggggataaggagagtgttcataaaatccttcagtaatccaacaaatgtcagagccataatgaacaataaggcaaatatattcccttttatagataattttcagaaacatgtatagtcgtgactcccacacagatggaagaatgaatacatgttaaaaaattttttgctgatgtgatatgaggggaccaagcagatgttatgaccagttcaaaggaaatatcaaagcagcagatttacacagattaaagaaatgttgagatgaattgtaaatggagacaaaattgtttttttccccaggttataggggggataggagaggtgagtcaattaaatcactatcagacaggagagaatttgtacccctatcagtgtcctacattttacagagtcaaaatatagttcaaagacagtaaaaaagcctttgggaggccgaggcaggtggatcacgaggtcaggagatcgagaccatcctggctaacacggtgaaaccccatctctactaaaatacaaacaatcagccgggcgtcgtggcgggctcctgtagtcccagctactcgggaggctgagacaggagaatggcgtgaacccgggaggcggagcttgcagtgagcccagatcgcgccactgcactccagcctgggtgatagagcgagactctgtctcaaaaaaacaaacaaacaacaaaaaaaaaaacataaaaaagcaggaatccaataatctggaagggtgtgccatagaccaatgagtagttttccaatgaaagatatttctttctacataactttgtaaatatatatatatatatatatatatatatatatatatatatatatatatatatatatatatatttctgtagcctggttgggttgccagtgacccagttttatatcctactttcttgtctacaccagctacttctctacctacaactgccattattgtgaaccctctttctctttcctcttctccagcctccctgtccttgcttcctgcttacaggacctgccctaatatttttcaattttgttgcttttctgagccccagttccactttaaacaaattccaaggtaaaaacaaattgttctggacagttaactgtaatcacttgcatgaaaaaatcacctgagggtgcttgttaaaaattcaaatccctggaactctccagacttgacttgctgaatctaaatctggtggggggtggaggtaaattttttgacaataaatttggaactcactgacttaagtaaaataagaaaaaaatgtaacatctaagccatatgactctaagctaaatgacattgtagaatatatgggagtataaaataaaaactgatatgaaagttagtggaaatatgcaagaaaaagcaaagttaatggtagcattagtaattgctagtaataactttccctaaagttcctatcacaatctatctagcactaattattttcaagttgaatatctggaatgtcaatctattaattttttaatgtccattctagatgctatgctaagtgagttttaaaattatttttcctttttaattgaaagcatacccagacacacattaaataaacacaaaaaataaaaattcataatcattctgttttttctttgtatcactttccattctactgaattttactaattataaatttaaatcttttaatcttgcacttttttgttatttctagacttcaattttaagaaattatttttcctccacatatttataaaatatatactttctcctatatagtatatttatttcatagtaatatttaactctaataaatcccacatttatttttctatattatatgaaactaatttttgtttttagaaaataatgcaattctgataactcattgcctggagttaaatctggtaccatatctgagcactacaattgatttcaaagagttgtaccactgcctgcgggataaacatgatgttgtttttttataattgttttaaaatacattttgctctttgtttagaccaacaacgtaatgtccagatctatcatcattacacttctttaggatagttgttgacaatatctacctacttaaatttctaaataaatatagattttgttgagttctacatcttattggacttttattagcattagcattacatctaaaatgtaacttgggaatggatttgtttaattgtttattgctagtataaataggatctcttctattttctaattagtaactgtagaaatcatggatgataatgatttctaaatatcatagaccataactaactacagagtttcttcttaaggctggcaaaactatgataaaaatcagtgtctcttagagaataagattaaaaaaatttaaatcacattaactatagctaaactgtaagtacattaaatttattgctacaaatcatgtagtttaaaaaaaacccctcaaatttgccagatttacaaacttaccccactatggaaaactggctttcttctgaattgccttcatcaattatttattgctgcagggttgcaataggctgaggtagatgctcttatggagtatctaatatttcatattaggcagatagtgtttcatttttaaatttcaagccttgtgcctgtaatcacagctactcaggagaggggaagaccgcttgagcccaggagttcaagaccaggctgggtaacatagcaagaccccatttcaaaaatatatatatatatatatataagcaaacttttttaataattttagaatctatgctcttaagacccacattctctcttggttttattttgcatattctcttttgagtttcttaagggtatttttgtctggacctaaagttctatccaaatatattgaaaaaaatgggtagcccctcctttgagaattaccacatagactccatttgatctataggatagtgagtcttatttttacgtgattatattttgtttaaaataactcaaactatagagaattttatattttggaataccaatacaaaagaatgttatatcaaaaggacaaatttttaaattttgctagtaagtgattacaatatatgtcttagatttgaatatttaaaataactttttaaaaagtcaaaatatagggctttttaattggttaagtatgcaatcaggttatcttcaaacaatgtttttattgaaattggttcaatatatgaagcctttatttggcaattttcatctttatgcactttccaaatgttagctagttaatctgcttaacaatattccattaaacagttgtacacattttatgttcatacactcctataaactttaacaataataataataatgatgcttttatcagctttttaaaacatctcattgctttgttatatcctattgtattagtaaaacttctaaaacattatcatattaaaagaatgctggccaggtgcagtggctcatgcctgtaatcccagcactttgggaggccaaggtgggaggattacttaagcccagaagtttgagactagcctgggcaacatagggagaccctgtctctatttaaaaataaaataaaaaattagctaggcacaccaacctgggtgacaaagctagaccctgtctcaaaaaattagccaggcatggttacacatgcctatagttccagctacccaggaggatgaggtgagaggattgcttgagctcgggaggttgaagctgcagtgaaccgtgattgtttcactgcactccagcctgagcaacagagtgagaccctatctcaaaacaaacaaacaaacaaaaaactgaaaagaatgctagtaggcacatttctatataccaacaacatccaagctgagtgccaaatcaagaatgcaatcccattcacaatagccacaaaaaataaaataaaatgcctagaaatacagctagccaggagggtgaaatatctctacaataaaaattacaaaacactgctgaaagaaatcagtgatgacacaaacaaatggaaaaacattccacactcatagataaaaataatcaatattgttaaaatggccatactgcccaaaacagtttaaagtttcagtgctatgattaaaaagtcaaaacataacagatgctggcaaggttgtgaagaaaagggaacgcttatatactgctggtgggaatgtaaattagttcagccactgtggaaagcagtttgatttctcaaagaacttagagctaccattggacccagcatcccatttttgggtatatacccaaaggaatataaatttgtttttaccataaagacacatgcatgcgtacgttcattgcagcactattcacaatagcagacatggaatcaacctagatgcacatcaatggtagactagataaagaaaacatggtttatatacaccatggaatactatgcagccatcaaaaagaatgatatcatgtcctttgcagcaacatggatggagcgagagaccattattgtaaatgaagggaaagaaaaccaaataccacatgttctcacttataagtggaagctaaacattgagtacacaatacaggtatacttgagggtggagggtagagggtgagaggaggctgagaacggaaaaactacctaccagataccatgcttataacctgggtgatgaaataatctgtacaccaaacccctgtgacatataatttacctatataacaaacctgcacatgtacccctgaaagtaaaaatttaaaaaaaaaaataatgcttgtaggcatatttctattgaatttaaaggagatgatactgtgagtcccattgtatattcttgtttaacatatgtttacttttaaatatttggaatggaatattttcagtatttcttaataaagcaagcctacaataatttatttagttcctaaaacttgccaagtaaaaatatagtctgattttataatcatacattttataaatcattttataaattcattatagtgtttataacacaaaagtaggtaaataaaaagcattttagatatgatgttgacaattgcatgctacgatccaatgagaagcctttttatcttgatgttttcataattttgaacagtactggtgattagcaaaatagctatatttaataataaaattttggtttaatatgaatgttagggaccacaaagagatcctacttcactctcactaggatggctataatcaaagcgacagatgctaagaagtgttgacaagcctgtggagaaactggaaccctcatacattgctggcaggaatgtaaaatggcacagccactttgaaaaccaatttgttatttcttcaaatatttaaacataagattctcttatggcctagcaacatcactcctaggtatgtacccaagaaaaatgaaaacataatgtccacacaaaaacttagcagcagtattcacaatagccaaaaagtggaaacaacccaaatgttcatcagctgatgaatggataaacaaaatcaacatatgggatatattcacacaatgggatattactgatacatgctatataacatgaataaaccttgaaaacattaaactaagcaaaagaaaccagacataaaaggcaataatattgtatgactacatttataccagatgtccatagagacagaaagtagaagtagattcgtagttgctaggggctaaaatggggagtggctgccacttggtacagggttcctttttggggtgataaaagtgtcctaaaattgattgtggttctgattgtacaattctgtgcatatacagaaaaccatggaattgtacaaattcatgctatgtgaattgtatctcagtaaagctattaaaatatgcatactatgtatgtaaaaaataattttatagacagtagcatctggtaaatgtttaacacttggctctaaatgtagttctgccaagaatacagttcatatttttgtttacattagctaataaaacaatggaggtgcatatcagaactttactcactcatcagtgatgtaaatgagttctttgcggaatcatattttagtaggagaatattttcttgatgtttgtgctattcccaatatggcagctatagacacgacatacttttaatttaacctgcattattaacattttccctgtcacattttaagtacagtcagtcaacaaaacaataaatcatagcctgatttgtagcatttgccaatgtatggagtaaatactccccctatcgtctttttcaagctaccaacataatgtcattaaacatatagttgagaagagatgtgcagtagtacactattgtatagtatttccaccatacggatactatagctgtaaacaatctcaaaagatgagtgaatgaatggtaaaatgtagcaaaataatttggaagttttgagtatctattatttttgtttttaattttttttgtatttctataatttaattttcaatgactgtgcttaacagcctgctcacagaatttctgaaaatgtggtaactgacttttgcaagctggtgtggaataataccactgaaataatacctgaatgaggaggctctgtacttacttacaatgtgaagcctagtttacacgataaatttgggctgtggagacatgtagacatgtagcctttaattaatgaagctttaaaaaaagggaaacaaggtaaaatgaaagttcaaaggatattaagcaggttattcattaatttgagattatgtattgagttcttaatatattcaagatgctgtaatgggtcctggtaatacgaaggtaaataaagatataatttctgcctttggggaatgcatagtcaagttgctgggctagatatgtgagcaaagcagatactgaaaggactatattatgataaaacagaaatatgttccaaagtctatggagaaaggagaagagaaggaggaagaaaaattaaatgagtattttttgaaagcgcaggcctgcattttggaagaagtttcatttgaattggatttaatggatgaagcgtgtattaggtgaaaatgagaatttaaagcaaagaatataggcttaaataaaatcaagagactataaaatggaatatgaatgggtgactcccaaaattcagatgctaaaaacctgttgtgtaattggcatatcctagttcattggccaaaggtacaaacacagtcccatcatttattactttcataactactatttatcctttttaatccttatttgcccttatttggtggacatacatcacttattcctaagctccaccctgctccatgaatttctatcaagtcctggttcttattgagattcagaggaaaggataatagtccttcattcccactttcaaacacaaggtaatacagttgggttccaacgtcacagctctctgacacaggtgtgattaattactttttcccaataaatagtacctggtgaatccagcttttctccacaacactaaggcccctggttagagactcaggtgtgagcttgacctcacctggcctgctctcagaattgactccattggactcctagtgtctaggctgtgagcagagcaatgcataagaagtgaagtggtaactttgcttagccgcacaaatttgtacaattaagagaaaccactgaaaagcctcttcacagaacaaagcactgctcaaattgactttctgttctgcctatattgagaagcaactggcagttcccagatctctttctctgtgtgggtgacacagtgatacacacacacacatatatacacatatatgtatacatatataaacacacatatatatacatatatatagagagaaaaatatatatattttctgccttaacaggattcctacttaatgtctggtttaagaggttccctattatcacattgataaaaagcagagtgttctgtaattactgctaccacctatgctttatcactttaagaaattatgtggaaataatctgatctttgcagtgcttattccttatgtgatcccagagtattgtaacattctcaatccttgattctgtctgatccaatctcaggtttgaaaatacagtaagattgttctctttagaatagagatgtgattgcgtcagtctcctatttgaaatcttccctcaacttcccattgccctgaaatggaagtctcacattttccacatgccatacatagaacagcgctgctcctgctcttgcgtcatcagggtccattcgtctcctaatcttccctctacttgcccctcgtctacactttagcttcagccccttcaaaactattttattttccccaaagctcccaggctttttctcactcatgctctttcctctctgtccagagtgtttttctattcttctctccaccgtcttctattccttccttgaatttcactgtcttacccacagcaagcccatctcaagactggttagagttctcctaggtgtccccatagcactgtagatacactcagtactggagccccaggcagggtggggtagtcaaagaacaggtgagccaagatggctgagaaagcagattgcttcttacatgggtgcaggagccattttttaggtgtggcagcacaaggcctgcaggtaaaagaaaagaaatgaattataaaattatgaaaaataaaagtgaataaaaatgaatttcacagttgatgtcggaaagaaaggagggtgatgtgagacagtaattcaggttccaatgaggaggtcaatcggcctctctgctaaggaatgtcagattccttatttatgatttttaaggtcccatatttactaaaattgtaatggaaaattaggcaacacctggagatttctatttatgagttccaggcattaagtcccacctaaaaacttaaacttggtcttataaaagacagtataaattattaatatatacatttttaaaactgtaatacatcttgattccattggcatataatgttaatcatcatactaggtagtattttgagacttattattgaattcgtgactaccttggcactataacagatagtcctggtacaaaaaaaaacaaaaacaaaaacaaaaacagtgctcttataaaaatgtaaacacaaagaatatttgatttgaaactgttttgtaatgttggttgacacttgccgtagaaatctgcaattgatttccaatcaatggaattgacatttattcattttgtaatgtaaatattctctaaaggagagggaattttatactaaaatatttctgtacaaagattaataataaagaaacctccttggagcctcagtttgcctcttaaaagtttgtagatattttctggacttgccttatctggtcatcagtgatgactatcacataaaaaatccggctggacgtggtggctcacgcctgtaatcctagcactttgggaggccaaggcgggcagatcacgaggtcagtagttcaagaccggcctggccaacatggtgaaaccccgtctctactaaaaacacaaaaataaattagtcgggcgtggtggcacgtgcctgtaatcccagctactccagaggctgagcaggagaattgcttaaacccgggaggcagaggctgcagtgagccaagatcgcatccctgcatcttagcctgggcgacagaggaagactctgtctctgggtttaggggcgggggaggaatccaagtctgtgaggaatctcttggagaacatgcagacataagctaaaatagagaaggctatatcatgccatattagaaatattagaagagcaataattttcatgaattattcttaaacaacgaacataagagaatacgattttatcctataaaaatgttgtcattgtggaacttgtagaattaagttacagatactcatgccctagtttagaaagattacatgtaagtgcattctgcttttctctgtgtttatgctgtagaatctctcataagcaaaatttcaagaaatacgtactatcaactcatagcttagccctgaggcttccagtacttaagaaacctccttccttgctccttaggatcgcagagttctcagggccctctggtaatattctttttttttttttttttttgcatttaatttttatttttattatttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacgtatgagtgagaatatgtggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatagctgggtcaaatggtatttctagttctagatccctgaggaatcgccacactgacttccacaaaggaaacaacaggtgctggagaggatgtggagaaataggaacacttttacactgttggtgggactggtaatattcttaagtatctatggctaccacaaattgagagtttgcttacttcaaatgccagcaaaggtgttgctttttcattttcagcccctcacgtggtgcccatccctgagagttcctttgccccaatccagacttacaagaccccatcttatccctcaatttctggttccatttagcggtagcaagatcttaaaactagtatctactggaatatgtcagttctgtaatgctgactgaagcttgagtaaaccaggtgcttgtaaagtggcatgaaatatccagaaataaactttactttctacgggcattaaatttacttccaccttttagaaagagacttcaatttaccttattaaataactgaccaatctgtattcaccactaaaacattctaagtagcgtattgaaataagctaatctttacagtagtataactgattttatctgtgatgaaaatcccaaatatttattgtcacgatttttgttttttaatgtgtttttctacctatgtgttagcttctttaattcgaatgttattctctatgaattaaaaatattttaatagcattctcttaggatcttgcgtttatggttcctttttctttgcagccaaagattttctatctcccacattcgagactgagaaacaccttctatctgccctataaaatcttataatcagcaacgttatgtaccctttgatatcatgcttcgagaagggcatatcacctctgtggtatccttcgcaatcattcatgacctcaatctaatcatgagaaaacatcaggcaaaccgaacgggaaaaatgttctgtacaatagccgaccagtcctcttggaaattttacaagtaactcacattccattaaacaagccatgttgtcgaaagcacacattctatcaatttgacaaagattgaaaatccctgaaaaattattcttttagaaagatattttattaaatcaatgaaaagtgatcaaaatgttacctgtcagtttgcctaaaataagtgtgaacaaatagttttataacacttttccatcacttctctctgcaggtgactctgctaatctaacctgcagagctttctttgggtacagcggagatgtcagtcctttaatttactggatgaaaggagaaaaatttattgaagatctggatgaaaatcgagtttgggaaagtgacattaggtaattttttttccttttaacctgtatagtcaagattaacatttactccattagtgaatagaaagtaagctgaaaggatttttttttgttttactagtatcataataaaaatactacaatatttaatgataaagaagcaaaacactgttaacagacttactatggaattgcaaaacatgaatgccatttgcaaagaatttaagaaaaataacgaagattgttcattaagccacatactgagtgcggctgggggtggtggctctcgcctgtaatcccagcactttgggaggtcagattgggcggattgcttgaggccaagagtttgagactagcttggccaacatggagaaacgttgtctctactaaaaatacaaaaattagccaggcatggtggtgcgtgcctattgtccgggctactcgggaggctgaggcatgagaatcacttgaacctgggaggcagaggctgcagtgagccaagattctgccactgcactccagcctgaacaacagagtgagactctgtctccaaaaaaaaaaaaaaaaaaaaaatatatatatatatatatatatatatagtgagatcaaaataccataaaatatagaaaatgttagtgtactttttgtatatgagaccttttttttaaaaaaaaaaaaaaaaaatgttctttgggaggccgaggtgggcggatcacctgaggtcaagagtttgagaccagcctggccaacatggtgaaccccgtctctactgaaaatacaaaattagccgggcatggtggtgggcgcctgtagtcccagctactcgggaggctgaggcaggagaatcacctgaacctgggaggtggaggttgcagtgagccgagatcgcaccattgcactgcagcctgggcaacaagagcgaaactctgtctcaaaaaaaaaaaaaaaaaaaaattttcacaggaaacattaacaaggtacagggactcaagcaaacacaatctctgtcatttcctgctacgtatttttacatatttgagccaccaagtggaatataagcttttgatggtagtgataaggatacacaaaatgtgtttatcgcctttcttagtctgactttaaggtcgaaatatttgtatagtgggaatgataacatgaaaatatttgaaggcataatgcctaagccccttttttgttcaatgtgtttacttatttattcatttaagtatcaattataattcattcaatgctagctgtaattatgctttggcatagatacttatttttattcataatgtaaatatgcaagaacgttaataataataagtaagttacaaccacatcaaaatgatgattacttctaaacatactcccatctaaagattgcatcttctgggtatatacaaacattttaatcatggtcccccattctaaatgtcaagacttttaaaactttatcaaaggtaaaaaagaaaatgattttcaatagaaaaataacacattttctattgggaccttctttctggcaacaaatacataagaatattgtactctagaatgccccagtgggattccagaaggctagatggacaattgtctaatatgtactaaaacatttttctgctgattttcgtatttaaaacttcactcttatcttttacccatggtctatgaaatgctaaaataaatgaaggacaattaacctcctaacttttaccccctctggctttgtgtgtgttcagggaagtttctagaaaggtagtttaattctgcatttaaaaatgttgaacagagatgacaacgaggttagtgagcatttaccattaattttaatgtcagagttaaatacttcaccagaacttttagtctacaggtttatagtttcacgttccttcaaaaacaggcaatttgttagtatcattaacaaaagtcagactgaacatttcaactgaaatgtcaaaatagctcagaaattttcttttcttttttaaaaaattaacctgacatgtaattaggccttcagcctgagacattagaatttttatctcaacttacataatatttcttcttaaagggaaagcaatttgtaaactttttcttcaaggtctttctcacctctttattatgacagtgtgattgtcctgctaagggagataattaactgcaacttcattagcatctacaaagacaagcttcctcattacaagtgaagaagaaaagggcataacttaattaacacagcatcaattcatagccaaattagaagcacagattttgtaggtagttttacatcagattcggattcatctacatttctttcttgtttgtgtatgtgtctgtttgtgtggatttttgttttgttgctttacattttagaattcttaaggagcatcttggggaacaggaagtttccatctcattaattgtggactctgtggaagaaggtgacttgggaaattactcctgttatgttgaaaatggaaatggacgtcgacacgccagcgttctccttcataaacgaggtgagtgtaaccttctaagcttcggtggtcaactgaatgtatgatgggagaaaaaatcattgggaaccaagaaacaaatttagttttgtttttctccacaaagttctcctaaataaaataatcatatttgcattagagccaccgaggcaaacagcacagtagatgggtgagtaactcagtctctaaaatcaaatttgaaatccttgcttttctttaataccaactgtgtaactttgggcaaaacatttaacttccctaagctttagttatctgataaatagaatggggaaaataatagtatcaacccttcagtatgttgtcagaataaaataagacaaaaaaatgtgaagggcttgacagagcctatacaaggaaagtcgttaaatgctatttattattattagaaatagatattaggggccgggtgcagtggctcacacctgtaatcccagcactgtgggaggccaaggcaggtggatcacttgaggtcaggagttcaagaccagcctggccaacattgtgaaaccctgtctctactaaaaatacaaaaattagctggcggtagtggtgcaagtctgtaatcccagctatttgagaggctgaggcaggagaatcacttgagcctgggaggtggaggttgcggttaggcgagattgcgccattgcactccagcctgggtgacagagtgagaccctgtctcaaaaaaaaaaaaaaaaaaaaaaaagaaaagaaaagaaagaaaagagaaaaaaaaaaaacaactaaatggttttaagtcaaagattgtatttcttactggaagattgctcctttagtgtaagaactgtctggtgaattccccactgcagtattttttgacatattgtttctgccttggataactttcatttgtacaatagtctccaatgatgaataataatgcatttttaagtaagataagctgtggttaagtgcaatgtctgttgtgctaactctgcctctacagcaccccatcaccttttgcatagggttaagtgcatttaaatgtatattgaattgtttgaaataagtgacaactgtaaaatgtgagccattcctgttagtaaaattgtttgtgtatattacaagagaaaaataatttttctacattatgctaagttaaaactttctactctttggaacaagcacacttgatgttctcttactcagcaaatttacaacgattttaatttcaaagcccgtgtttaatcctagactctttgaggtttgaaaagaaagagaacattgaaggctgttcccccttctttattgggcaatagattccctttgaataatattactgaatgctgttaaaatagacacctctgttgtcaaggtgactatggtactaaaatagtctaccttttagggatgtgagtcaaggagaaaggtatgcagcagctaacaatatgattgtatctttctatagtttagtatatagccaatcaaggaagagattttagtagaaatatcatacatatacaaggacagaagtagcttctcatagttaaaagcaacttaagtgttgtgtaattgaacttcttatcctgccataacatcttctgaagtgatctatcagcttatactggatcacattcccttctcaaggaagtccattttatctttggaaaaatccgttagaaagcatttcactttcactgtctatccattggccctagttctgtacttttaatcactcttccccaagacagcccttcaagtgtttgatgacagtcaccatgagtctctgaacctttacttcactagattcagcctctttagcttcttttactcattcttcatttgtattagcgaaatacttttaccattctggtcactctcttgaatctgctttaattaaagagtttgaattagtcctcaaaaatggagttaggggagagaagatatagggcacataaaaatgtgttgacttgaacaacatattttggggggggacaagggaggggtgacagttaagtaggaatcaaaggagaaggggaggaaaatgaattatatctaaggataaagctattaaagctctgtttttacagagaggcacacagccaagaaggggtcaaaaaacctccaggctaagttgcccaaagctatgaaaccttccatttctagaaaaataaatgaagaatgaagaaaattatttgaaattttttccagtaatatttgatttcctaaacatgaaaaaaatgtggtcaatgttagagtattcttcagtacttaagtcttttagtatgtttttcaaatatgcgtttataccaacggcattttattcttgataaataaaagcattaacaagccaaaaaaaggtccttccaagacatgtactccaaaagtccctcttaaagtgaatgtatgccttccttttaagggagctgcagcaaatgagtcatcaattcacaaagacaccaatggatgcaatttcctgctcttgagggactcatgattatatggaatgatctatcccacccatcttggggggataaaaaggactttcgttcacatatgacatgacctgaactttaccagccctgcaaggttcaggagaacagcacacagcatatatgaaattataggtttgggtctttgatcattgagtctctaaaaagtcaaatgtctgtcatgctaacaattatgtaattatcaggtgagttgctatattactcagaatactaaggcttagataaggaactggaagctttcactattaattgtatttttctgccacttactcataaattccttaacttataagccttcacagtcttcccttttaaaacctccctagagagacatgttcaaacatttgttgaatactgatcttgtataccacaagctgtcattgcttctgacaggtaaaccttccaggacattcctttgccaaaattatctaagcaatttttccttcactgttaccttttgttcattatcattgacataataaaatgatttcagagccctccaatgggtggtatggattctttgaaacattgcttccttgtatcaaatgtgtcttccttaatgccaaggggatactataataaataattcagctacatttgagctaggctatgttctgggtcagccttttatctgcgtaaaagaatcataattccatgaaagcctgcagaaaatctaccaagaaatttgaccatagaaaaatcttgctcgagaatatccaaagttgccaattcctgcagccagaaaaggtattaggttcatcagaatctcatcagacatgcaatatagatatatttcacttactatacagagcactagaatatgcagcaagagaaagacagagaatgaaacggcaaggcccatgggccatattggtttatgactgccctgctccttactcttcactcctgccagaagcttctattcaatcctctttgccagactctggcctggcaagcttgagcattagatcctggcttcaaaaataataatcaaagtaaagcgctgacaaattagatattgggttacttcttgttcttgttattgctcatacttgattgaattccacatctgagtctttgaatcttttacccagatacacttgctactgcctgtccaacacacactgaacactgaccttcagttctcctccaaagctctgatctgtcctattctctccattttttacattttccatttctctgacacaaacaatagtccaggtagatacctagaagtattgtgctctgacctcaggcctagacactcttgtacccatcaagctgtctcagattccttcttcactctctgtgccttctgtctatactctcattttgaatgacctcacagtgtagacatgtttattatcttaatggttaagagcatggacttaggagtagggctggctgtgttcaaaacccaactctgttcttactagctgtgctatctggggcaaattacttaatcactttgagcctcaaatttctcttctataaaatgggaataataataagacctctcacatagagcagctgtgaggattcaatgaactcgtatgtgtaaatacttatcacagtgtctgacacatacttagcacccaaaaaatgttaagctattacaagatttccttgctctaactatgtgatactctggctaatgaaggatgcagcaattgtgtgttccattaaaaattccctgaattctaattcatctttcattaaaatcatcagctttagctccagcaattttgttctgtcaattctgaatttgactttataatagatatactgtggtttgaatgtactgtcctaaaggataattttgtttatttattcatgcatttaatgatgactaagaacctactatgtgcctggcatttgtgctggccaaagttacaggcatgaaaattaaaattaaatgaacaggaaataaggactaatataatttggaatgccatccactactttttaaattacagtgatattaaacattcctaatgtatgattgtgcttcctagtgaatgtttcactttgaaactgtcacattggggatgttcattagcaatcttactctgaagggttatgtttccttatatggattacaaaaatatggcaattcattaatcaaaatttagtttgggaactggcaaagtatctatctgagagactcagcactagttaataatgataaacatctaggttttctttatttcccatctaacccattttacttcttgtgtgcactctctttatcccttcaaagaatgtaatcgatagaaattagacctgctcaataaactccctagacctaaaagtatctttagtaatgtaattaagtgcacatcatttaggatgcattgttttaaagccagatgaatttaaacccagtggactcctttaacccttcttgtaacgaatcatccttgtaatatgtgccccatccttgttagtatttgcctagtgaatttatttactgagagttacagtaaggtcataaaacggtgcaaacttcttttggggctggccatttgacgtctttgaccattgatttcagaatatgttaaagccaaacttcgttcagaaatcaaaacctcctacctctctttatggcagcatttccctagaaagacaatgacccattaaaagctgagctaatgtcaatgaaatggatacttttactgagtcttagcttatgcagtgccaaaatattaaggaattttagtaatgttgctgcagcatctccaaataaaagtcaacaagtttaacaaattctctccttggataagatttgacattttatagtcaaaattttcttctgtcccgtaactgtttttttttttttttttttttttttttttttttgctggggggggcttctctgctcatttgtataagacgtctaatagcacaaattatccaatactaatgattttgtacctctgcacttcttttattatttatgtttatttttacagacaaggcctcattctgttgcccaggctagagtgcagtggtgtaatcatggctcaccgcaacctcgaattcctgggttcaagcaatcctctggcctcagcctcccttgtggctaggactacaggtgcatgccactacacctggctatttaaaaaaaaaaaattgtagagacagggtctccctatgtttcccaggctggtcttgaactcctcggcttaagcgatcctcctgtctcagtctcccaaagtggtgggattacaggcatgagccactgtgcccaactccctgtgtgcttcttgatacggatattccaacaaggctattgattgccaccaaagttgcagacatgactattaaccacttgagctatttccttagacttagaatatattatttaaatgagattaatcccaagttagttatttttttgcctcaaccgtgaaatgttttgaaggcttttttttttttttgagacggagtctcgctctatcgcacaggctggagtgcagtggtgtgatctcagctcactgcaacctccacctcctgagttcaagcaattctgttgaaggccttttgatcctagtttttgctaatcagttttaatatggaagtatgtcatgtaacattgtttggcctcttagccattttggtcacacagttttcttctctatgaatgagaataaccaagtagcatcattgttagaaaagaaaaggaccattgtctgctgatgattaacttttttctcaattaataaatgacaagagggtgatcctggacaaaaccaatgtcgagggccaagaataataaactctttagtctttaatcatgcctgttgatcattcatgtgggccaaagctcttaaatatttaattatacatggttatagtcactggaagtccttttttgctttattgagttttacacttgttttcttaactaaatgttcaattcttgatacagatctttaactagtatttctctcttacatgcttcaaagtaccaaacccacttagtaaatgtgatgaatgggctgattaagtgtattctgagtgatctaaactttgtctatagcaggatttctcaatcttgtcactactgacattttgggcttgataattctttgtcgttgtgggggctgtcctgtgcattgtagaccgtttagcagtactcctagcctctgcccactacatgtcaatacaaccttcctcagttatgaaaatcagaaatgtctccagacattgccagatgtccccaggggtcaaaattgctcctggtgacaagcactgctctacagtatagatataaaaaactcagtcttcctggaaatgatttcaacacttaagctgctcaatgtagggaaattcaaaatagaaggacaagtattttaatcttgaaaaccttccaagattataccaaatgtgactagaaggtcaacagaatggctgttcttacaccataggaattgacaaaagttaggtttcttctatttccatgcttagagagtcagctaaaagcccctagaccagtgcttcacaaactttacagtatgcacaaatcacctgggaactttgttaaaaagcaattcattagcctggggtaggactcaagattccaatttcaatcgagttccttattggtgttgccactattggtctgtggaccgcagctggcataccaaagcccttgcctagacaatagatctttctaattagcttggtagcctctaataggtaaagagaaactagttatcttgagctcactgtctccatgagaaaggaaccaaagctgagtagagccagtcagtaggactgtttttaattaattgcctcattctttttacatggtcaacacctttgaacctatttgaacagtggttcattgccctcacactctactcttaatgaggttacttgtttcacctattcaatgaattgtgctatataacatacttgctactcagagagatgtctgacagggcattttcttcaagtattcaaataattaacctcttaaatgaagagggccctcactgttggacccatttcctatttatctcattttttaaaaaggaaataaacttaggaatgtctcaacgacatatatatggatatacacatatgttttagcctatgcaaataggttgaatctcagcctatgcaaataacatatggaggaacacgatgtatggtgaacacgaaatactgctgattttctgttttgaacacttacttgtattcagctaactctcaattaagtgtggtaagaaaggatggaaatggtatggaaattgaactgccacatattattggtcaatgatatgcttcaaaagcaggagggagggagggagggagggagagaagggaagagaagggaagggagggaaggaaggagaggaaagaaggaaagaccatagaccatagcaacacagactggttaaaaccatctctccgagttcaaaagtttaattcattttaaaaggcatctgtctagcatctaacagaggctataaaacacaagtatttttacagctgaagcaactaaactagtgtgtgtatagtcaacagtacacaatgtatttgaatactgccaatttttatgtgaccactgagctgccagtggcagcagtctactcaagtgagggcagaaggaatccactggaactcatatcgatgtattagaaaatgataaacaggcagtgtagaaaaaataattaagtttaaaacatttgcaggaagcccacagaaattatctagcacacagcaaaattccacttgtgtaatcagagattccaaacaagatagtatattcctagccaccacctaccaacaaccaacccctcactcctccttctcagaaccaccttcatattttcattatttctgggtcaaaacaacctgttgattgacaatacttcataatcccactacaaatctcacttcactgcaggctgcttaaaagagataattcatataatgctgttgtttgaaaaagcgacaaatcattctaattcaacaaatatgtattgagtgccagctatgggcaaagcactgggttaggcatccttactagtggactgactgaccgctgccagaaggatatctaccaccatcctggagcattaaaacagcatttttgggaagagggagatagctgtgcatttttatggctgcaaattcctgcatttggtagagaaatggcacaactgggtcataaaatgcaaggtataacttttaataagtagttcctgtacgttgaacttttgacaaccaggtcagtaaagtgagaaattagacatgacgcatacaaaaatgctaactactatctcgggtcatatagtagggagaaaacgtgttgatttccagtaaattaccatggtaacttgtatagattttagtgttgagaattacatttgccatctgtgggaaatatattatctttttgtatctaattttagggcatgtgttctatttttagcatgtgttctatgaaaaataataaattgggaggccaatttggataaattaaaagtggatattaaaatgctataaaaatagaatttatttttaattcaaaaagaaaatccagtagtacatttaggaaagcacacaaaggtcatttttaaaaccacctcaaaattgttaccattaagcgaaatttgatatgaatgagaattgactaaaaagtgagaaattctgaactgtgataaaaaaaaatggacagttacctgagagtattttgcttttgactctttagctttgtgtgacctagagccaatctctttgtgtcattgttcttcagttttatcatttgtaaactaattgcccctagccgcactgtgggaatcttgaaagagcatatatgatactgggtgactaataatatacattagaccatttgtcagattttacagattctctgagtttttacacattgtgcctcaattttgccaattttgaaagtgagatatggtggttgctcttcctagggattttcttatgccttaagtgtttgaaaagttgactcagatctttagatggcaagtttctgtaactgcaaagtagaaattacaattccttacgacatgcaactgcagttcaaagtaccgacttacaatggttgccaaattcatgcaaactaaagtggaagaggccattttcaaagcctgaaagtattaaatataaattacctgacttaaatcagcttagaattataattctactctgtatgtgatgtaaaatgaatttgacttaaaaatttatttataccacctcacaatttcaaggtaatgactcacaactgcttgggtccatttctaattctccccaaacaaatatgtctgtaacatttaaataccttaatgttgaaagcaacttaaagaaatacattaaagataccgcaataaaattctatttagttaggcttcttcggtagactgctaccactggcaattcagcagtcacataaaagttggcagtattaaaatacattttcttctgtgggctgttcacatactagtttagtttcttcatctgaaaaacaatgcaattagtcaaaatgaaatttgaaatttttacctcctctaaaatcagatgattgactccacgttttatgtgaatattcataaactgttgccaaaactgattattatttatgaagagaaaagctccacagtggtgtttaaaaaattcctgttagacttgcattgctgaaccaggcatctttaaatgatagttgcataaacagataggcaaataaataaataattaggctaaagtggttaccaagagaactcttagcagaacatagcttgcaaaccacactggacaaattccattccaaactgtccagaataaaaggcaaaatataagctattttgtagtactagtatttaaagccatagatcaattacctatgttaaggctacatgaaaacctaatacattagaaagagatgcattaaataatttagtgaagtattaacagtggttacctcgaggtggcatgattccatgtgatctttaatttcttatcatccttatgcatttttcaaattctttactaaaagcatgttttatagagtcagaagaaaagtgagaaaataaatctattttggtatagctactgaatatttttgaaaatgcttataggaaacctatcattactctctgctataaaatcaagttatttacacatttttcaagtatattgaaatctatttgcttgaatatgtactcttgctcccactttgtctattttataaaaaaacattttaggggacaccttacttctacattattttctcaagccactgctagttttcatatgctgaaaatcaatacatacagtgggatgataaggtaatgctctattctttgtgaagcagagctatgttatgctattttggtaaaagataattcattattgaggacaagcccttcatgtataccagtacagaggccactaaactatgtgagccacagacttcttctcaagtttgtcatggtttaaggaaccatttactgctccctttggatgaggcaagtaatggtagggtctcctattggtagctcccaaaacatgctcattttttcatagattgttaatggggaggggggattttttttttaaaggttaacagagtcttgaaagcatctctttacaaaatgagaaagaaaggcaaatttaccactattttcctcagcatgtttatgaattcagaagtgttcataaacattcaacatagagaataaatatatttttctgttattcccactgggggaaatgaaccaacatatgatttttgctttaatgctttgtaactctggaatcaccaagattttgcatgaaacttgtctcaagagataaactattaccaacaaattttgccacacacattttcttctaatgctttcagtaagtcagaaatccattaaacccctaaagaaacaatattaaaataataacataaaattctgaagtttattaatgtatcccatttgtatattgcaatacaatcagtttatatgtgtgtacaatattttctaaatgtagttccatcaattaaatatactataaatcatcatactatatttgtttagaagagttcaatatttctgtagaaaacatggcttcttctattggttatctaggcagtccagatgttctgggttctttggccaatccaaagcattcccaatggaagaccaaattgttctaactatgacaatataccctcttgaggaaaattgctttcaggataaacatcacatcccttaacaaggagtaaaatggcaatgccaccttcactctgacagttttctctcaagagatgttttgtaacattccatctgtgcctgtctgtttgtatgacatgttaagaaggaaattcctagtagagggaaagcaatacttttctaaggtattttcttttaggcatcagtgaagtttgacaccttgatatacaatagccctgtcttctaagctggtcacctgaggccctttttgtttgttattataacagtatcttccttctttgtctgtcttctccccatcatacttaatcttatgagatctgagataaaggaagccccatctgaatactttgtacctgtatgtgtgtgcaaacacacataatggtctgtgtacatctcacattatagtctttagatagaaatatttcaaacactgcctttataatctaaaggggaaaggttttctgcaataaagctctgtctgtgttagtaacttcacagtatacattttgaaaatatatggcaatttttcccaagggagaatcattgtcctattgtactgacctaactttgcgaaacctggtttaatgggttccatgaatccgcaaacaaatatttattgaaaaggtacatgctatttgctttgaaaataaaaaaagataacatattctagctgagaaatcaaagcatgagtttgcctaccttcacctatcacatcacacattcattttcccagtgctccagaccaaactacttgccaaaatcctttgcagctacctttgcattgtgtcattctgtgtctgacccctgtctctaaaatactcctacagaaacacacacacatacaaataccccaactgaatttctcatctggcttataattgtgatacttataatgtagcatttcttatataaaaggggtctagcacagtgacacttaagtgctcaataaatatcagctcttattattattatttattattatctgcttacatgtctgactctgaaactagacatgagcacctttaacgcaaaaacatatttcatccatcactttcactttatcactagaactcaaaagcactgtacctggtacagagaaggcacttataaaacaaatagaaaatgtatgtattagtaagaaaatttgaatagcagtatcaaagatgtgaagcagtacatgattgatttccaaatgtcaagtgaatacaaacattcttagttctgtaagtctatacaagactgtattgtcattagctttgtgaatgaaaaaaagaacagaaaccaaacaccacatgttctcactcataagtgggagtagaacaatgagaacacagggacacagggaggggaacatcacacaccggggcctgtctcagggtgggggcctaggggagggatagcattaggagaaatacctcatgtagatgacaggttgatgggtgcagcaaaccaccatgccacgtgtatacctatgtaacaaacctgcgcgttctgcacatgtaccccagaacttataataaaagaaaatggaacaataatttttaaatctatactatgaagttgatcatttttctatatattaaaagtttattcctaacttaatggactgaatattaatgctataattataccttatcagttgcttgaaccttaggatacattgactagatacacagacatattcttggaattttagaatagaaacacataaaacctagctttttattcaaaattgggtttgttcttaatcatctaatcagtcattcattttcactgaatatctttaatgtgtcagatagttagcaaggtatttgggataagtagtgaaagatatagacaaaatagacaaaaaaaaaaaaaaaagagagagaagacaaaaaacttgtcctgatggaatttaaatcccagtggaagacaaataataaacaataatacatttattgataagcaaatgaaatattatgttatatagtgatgaatactataaaaaataaagacaagtagatgcaaaatgcagccacaggtttgtgacttggaacgagtggtcagtgtatccaattgagaaggtgccgtatgagcagagacttgaagaagcaaagagagaggcatgtagaaatctaggggaaatactctctagtcagagggaagccagagcaaaggtcctaagataaagtcattgcttacaatgtaaaacaataaacaaaactaactctgatataattcaatatggtaaatgaaaaaaaaaaggaacaggaaatacatgttctaaagaggaaaaaaatcacgtttagttggaaaagttatattggaagtgcaagatcctaacctttccttgaaggactggttgggttttggtaaatgaagaacttctggtttggaacaaaaaactcatgtcaaatttaatttacattagaaggatgattatggctaaaggttagttagctgcttcaattaaaggaataaagaaacttaaatgcccacataaggggtttagactttgttccatgggcaatgtaaatcagctaagagatcctgcagaaaattccagggtgaagacatgatctgggaagatgaaattgaaggctttgtgcagattcgtgtacaatagctgtaaataacagaattttaatacaaaggtaatcaacctgaagtacactctaattacaataacacttgcaattattatcttacaatttgaccttttattttttaactttctattttggaatacaaaaactgcagatattatagaaaattacaagaacagtgcaataaattttcatatatcttctccacctagatttaccaattaatagatttgccacatttaccttatctctcttcctacatataggtaggtaaaaagagctgcactacatatacacacacacacacaacatatcattgctaaaccccatgagagcacattgcagacactgaaactaaattcttcaatgtgaatcccctaaaaacaagaattttttatgtaaccaggatacatttatcaaattcaggaaaattcaaaattacaaaatgccattgcctatgatatagtctatattcaaatttcaaaaattgtcccagtacataccctttacaccatatttaccatctaggataatgcactgcatttaactgccaattctctttagtctcctttaatctggtatggttcctcagcttttcttcgtctttgataacactgacatttcgaagagtagaagctagatggttttattttttatagttgtccctcagtttggattggctggacatttccttattttttttggatgtttatgtgtttctggctataatactacttaaatgatattgtgccctcttattgcagtacaccgggggtgggggggatgatatcaagttgtcccgttattggtgatgttaaatttggtcacttccttaaaatgatgtccatttttccccagtgaggaggtactatgagacggtgtgaatatcctgcctcaccaatctttcaaccaataattttaacgtctattgataatttttgcctgaatcaattattattatgatggctgaaaaatggtcatttctaactatatcgttcatttcatatttaccggttgacattctgctcttagggagagctttcccttcttgttggtttatttgtaactaatatgaacacatggatttgtgctttattcagttactgccattattcattttaactcatcttttaaaacataccacctatgaatacttcttaattcacagagagaaaaaccagcttaacacccttcttgcctagttgaaagagaaaaaaagcacattccaagggtaggctctagcatgctgtgaagagaatgttacactttttcttctagcctttcattttatttttcactttgaatagttcattaacacataacaatgaagttccaaggacctgtgggaccttagtctaactgggctctaatgatgggtcctagccaacaaccatatttgcattttgattggcagtaagtagaagttaatttggtgcttcgtctaaaaacctctttccaaatggcaaaatatactactttggaggtaatcttttgcccaaatgtttggtcatacagattaagccgctccattcagggatcatttttatttttattattataattttgggggtttataccctgacttcccaaaaaggacttttgcaagatcaaaactgttattcttacatactggtttgtactttcccaaaacattttcttcctttatgtgaatagcagcttgatttgttaatgtgtttcccccaccccccgcaaaaataactgcttttaaattacactgatgtattgtagaactgagttgagtatctttgtaggctgagcataattatcctcctgccaggaacaaataagttatactgctccagagaaataaatatgcatatgaatttatgtggatggataaattcttataaactttagctctttataacacaatgagagaaaaagaaatgtacctggtgaggctaatgaataaactgggatcattataatgtctgtcatgcattttccccacaaacttgcattttactgcatataaatgagggaagaacacttcaaaagactttttataatgaacgaaccaactttaggataaactacacaaaagtaagccatctaaaatcttcagttataccttctggcaaaattctatatatataggaacacacacacacacacacacacacacacacacacacacacagatcaaatagagatactgactaaaaactgcaagtcaagagttcaaaaatacatatgaacttttacttactttgttaaaagctttaccttttcgaagatttctagcagaaaatgtttgcaaacaataacaccaggtacaggccaagaaaagaacatagtttcccatagtatactaggtaattgcagcaagatcagtggaaaccaaatgcatttattatttgcaatgtaattcaatatactaagagatggcacgcactttattttaattagctgtttcttttaaggggttgcttgctcccactgtcttgataagaaaaaattgtagtcattgctcaaaatgcttgtagcaaatctagttttaaattgaaacaatttattccaaagcagtctactactgcagcaataatcaatgtgttttcccttagcctgtactggagctttcctaggactattgttaattgcctgtaactaaatgatcgctggggcccttaaatgcaactctttggcacttgttcatttgttgtttttaaccaaatgccagttttccctaggttttgcctagcaattttgctttacaattttcaatattcagtctcagtcccttaaagggggcagagtctatcattttaacaaaatacacaaaggctaaacagattttaaaaggtctgcatttctccttctgtcctcagatgttgaattgtgctgaaatgatatctttttattttttaaatgctgccactccaggcaacttgaactagagctgaaaagtagatcccatttcaaagggaaaatgacatttgctggggcaacaccatttacattgtaatgtaaagataaaatacagcagtgggcccaaatgatttctcttaactgtgacagaatttaatccttagtaattttgtataacccaaaggataagcaataataggtagcgcatgtattaatgaatctgtctggcttggagcaaaagaatacagaggctaaatctaatgcacaattttctttgaaagggttttcatatgctatataaaccagtgtgacttaaatagaaaaaaaatttaacttgcatacatgtataatgtgtaggcttgtatattacactcctgcatagaaatattgtaataactgaggggcaggcactgtgcaccatggggaaagacacatttccattttgttcctgacctctttataaggacattataagaacactatgcttctgcaatgtaatactacagaagtctctgggggaaagtctgtgatgctctcaggatctcaggataaattagctccttgtaaattctgtttctttagacttgtttttggtattcctattattagtaaatgactatctatggcccagaagaattattcttgcttattgctcattctctaagcatatataacttttcatatgtttgtaccctaaaggagtttttcatgtgacacaagactgtttctgtaactgctaagctacatcaaccctgctctctttttcttattatattttaaacaacactattgattggctatgtagagtattctaagtaatgtatatcatttcttaaatggctcgtgacatgtagcaatgggagtaactcctatctgggtaattactttgctaaaaataagaaggacttattttcatacaatttttctctaatttacctgtattcaatttctcaaaattaaaaaagtatgtagagaccagtattataaataccatctggagaaaatgagagttctgtttattagattgatcagattatatttcaggcaaatattttttattatttccaaagctcctcgactatctatgggcacttaaggcatgccacatgcccagcccctgtgtagtgcctccagatataaagaatgtgcttgggggcaccgtaaaagaatcattccctgcctgggcccttatctacagcagagcagctttcctgactcccagctttcttcccacacttctccccacataggcctttggttagaacttacgtttttcttaaaaaaagaaaaatcaaaatgttaaagaattgaaatatgattcacataatataaagcgtgtagctctaagtgtttggctaaatgagttccgacaaatataaacacttgtgtatccacaccataaacctatttcctttaccccagaaagtttcctcttgctccattccaacaagtttcccttcactcatcatcaatgaatctattttctgatttatgtcactatggatcatgttggtctgttcttgagtgtaatttaaatagaatcatacagtaggtattatttcttgtctggcttcctttttctaacataattttgtgagagtcatgcatgttttgcgtatcagtagtttactacttttattgctgagtatattctatcatatgaacatacaatagtttgttcatcatttcctgttaatggacatttaagttgtctctatttgtggctgctgtgaataaataagactattctgagcattctcatacaactcttcttgcagatatctgcttatatttctcttggacaaatacctaggagtggaactgctattgatatggtagatttttatttaattttattagaaattaccccaaagtttacaatgtggtaatatcactgggtactctcactagcaatgtttgggagtggaagctaagtgttcttgattctttttccatttctttttttgtacaagaaatttttgagtggtaaattcctagtgtttaatatactaaattagaaaatcttaaaagaagccatagtcaaaatgcttatttctcacattatatccaatgtattttaaatcatatcttcctgatgtataaatcaccctgtgggcataagttagaattttacacaggcttctgtgtatggtggagtttattatcttgagtgaacaagacccaatgtatccccacaggattagccgctcaccctttctgttcatataatagggggaaaacattatactgaagagctttttgtattttgttcctggtatttttgtagtactgtcttgtgtggttccccacaatgttaatcagataagctgctggaggtatttttcagtgttttacacttcatattaatttacttagactctaaaagagttgatctcactttattttttcttagatgcatacagttcaatcgttttaaataagattttcttcaatttcccatttaattttaataattacagaaaaacacacttgattaaacagcagttaatgtgttgtttattaaactgtagaattagaaatcaagggctaggtaataggaaatatgaatgaggatttttttttttttttttttgagacggagtctcgttctgtcgcccaggctggagtgtagtggcgcgatctcagctcactgcaacctccacctcctgggttcaagcgattctcctgtctcagcctcccaagtagctgggattacaggtgcctgccaccatccccagctaatttttgtatttttagtagagacagggtttcgccacgttggccaggctggtctcaaactcctgacctcaggtgatctgcccgccttggcctcccaaagtgctgggattacatgtgtgagccaccgtgcccagtctgaggactttttttcctgtaattattacaggaaaagtgacatcacctgcacacacacacatacacaatgttcttgtaagaaaatgatggccgtgcttttcagattatttgtcactcatattacaccagtcccatcatgatttcaccccatttgtgagaactcaggactgatctgataacctgagggtacttgttaccagcaaaaccgtggatcattttaaagttctcagtctaagcttacattgactgtgttatgaaattagataacttactggtggattctgaattacagaatcaagaataacattattttacagctttaatttcagaaatgtttatatttaattgtagttaaggaaactagtacttttcaaggtagttgtcaactgcagggaacaatggctacccatcagtaacaacatttgggctgtgatgattaccgacaacgcttaaagtgagtttcaaaaatctatgcatgatggcttactatttaaataccaatatccttatttttgttacaatgtccatggttctaaagaaggaaaaaataacaaaaaattttatctccaagttttcctgataagttttgatctaaggtagatattcagtagaaaaaggagaatttgtatacagtgagtgtcaagaaaattccttttttggatagaacgtagtaacatgcctggtaaaaggggaagcaaaaatcttaaaaagtaaacggttgaatgaaaataaaacaccaccaacatattcatatactgtcccatccactaggaggcctacttcttacacccaaaaagcattcagcctccaagattatggtagaccaccttggtatcactgtattcaggaagatacagcagaggagctattgctcctggcaggagtcagcagacagcattcattagatagtcttcccaacattctatgcaacaatccacagtgctctcctgaaactgtgttgtttgacctctcacctttctttggcccccaacccacaggtgacagctcaagtgagagggatcaagattctcattgggagaggccaaaagtcatcctggcttaaaagcttcatatccacaggaatcagtatttattttatcaaccccataagcatagcttccgggatctccacaagtgatacatttatataagagagttatggtactctgttaaacccaatattatagtttccaatcagatatttacaattctcttaatccaaatgcaagctaccaaccaaggttcatttttaccacaagcaatgttgcttagcaacatggttgtcacataccaccttatctagttaccaaggaaacagagctagaaagttatcaaaaggtcaaattctcatgcaaaaaggaaaggggttgtgtcaacccgttaacccacatctgatctcatccaggaaaatgtgaaatcaaactgagtttaatttatgattttggatgtgaataccatataattccccattgtggttttttctttctagagctaatgtacacagtggaacttgctggaggccttggtgctatactcttgctgcttgtatgtttggtgaccatctacaagtgttacaagatagaaatcatgctcttctacaggaatcattttggagctgaagagctcgatggaggtaggatgttacctcttttattgttctttctgaatgttctaatttctttcttgtctttgttttattaaggggaaaaaaattacgtgcataatcaatggcagcagctcgtatattctttcagtgctcagtttgtaaatttctcttttgtaaggaaatgtgtgatgctttatagccaatactgtaggtattttcctctgaaagttgtaaagcaacacctatccattttagaattgtattccaaacacttacaaattacaaacactgattgcaatgccatcagagtgttccttttctctcaccttgtaatcaggactgaaaggccagttttacttttttttaggtaaggagtgtctcttttaattgtgttttctagcccagtagtttgaagcgaatctcaatttgctcctgtttagactgatccgttataataaactgtactgagtattttaaattcatccagcagtcttttcaatcttgtttatttagctatatttagatagcctaatttttattccaagtgtggaccaacagaaaaatgcacaagcacattaatttcatagtaatgcatctcatatttttactgtacgtagacaaataaatattgttttgtggaaatcataattagtatttgcttctggtcaccaatgaatatgtgtacaatctaagaggaaaatggagtccttaaaattcagctccctaaactgcacattagacttatgtttttaaaaaataacaaaaaggaaaataaactaagataaaccagcaagatgggaagcatatgcaaactgacaatgaatagtacagatgacaaagctttcttcatcattttttttttttttagtgaggtggagtttcactcttgttgcccaagctggagtgcaatggcgcgatctcagctcactgcaacctccgcctcccgggttcaagcgatcctcctgcttcaacctcccgagtagctgggattacaggcgcccgtcatcacacccagctaattttttgtatttttaatagagacagggtttcaccatgttggtcaggctggtcttgaacccctgacctcaggtgatccccccatctcggcctcccaaagtgctgggattacaggcacgagctactgcacccggtctcatcatatttatatactgtttttttttcagtgattttcagttttgcagtaaatggtaccaaggaaaatgaggcaattgcctatgttgccacgtttccagggtcctctggaataataaatccacaagcaaaactagttttgcaggtttgtaaagagaagtggtttattcagaatgcctaacactcctcttggtttacccttctctccttcccattagggtgaagcctgagctgcagcaaaaccctttctttttcttaagtttttaattgctgatttgcctatttgtttctaactttcttgcctattgatgcaaattattattattactattgctgctgttttaaagaaatataaggactttgccattgtcggaactactgttgaatgagcaccaagcatagtgctaggcattcttagagtcattcttgctaaccctcacaaacatcctgaggtcaatattgtaatctccattttactgataaggcaactgagactttcagaggttaaataacttactcaagaagataacacaaatactgtaagtgtccaagatgggatttgaaaataagtctattcccaaagcctttatcttatcggatactctctattatttgtattttttttaaatttagtatgttcagtatcatctaaagatctactgttgtttgcacaattagcacagtacatggtatttgaaaaagcacattacctaaacaagtctccccttttctattaaccctgttttgaatatgtttattttgtgttctgaatgagatgaatcattttaccaaactatcaatttctagggcagtaatctgtcattttctgaatgtagaaaattctggaatataatgaaaatgaattaatcatacgcagtggaactttcagtgattcgaagtttcgtttagtgggtcctgctaattgtaaacacttcagtgactgacttgggtagccttaccatatttcattgctgttctgaagctgctgggttctcagttttttaaaaaatgttttaagtaagaaaacaaagcagacagacactaacaaacagtattctaacagatgagaaggttctcttggaaagcaatttagttaataaatcctttagcgattcttagaactctgtctctgaggccatcttaagcacaatcgagggtctaactattagggcttttcttgaaatgccactgaaaatgaattagacccaaagaaaaccaagataacaaacttaactgtcatctggaatatgttaatgtacaagttattcccctaaaaagcggggggcagggggaagcaaagactgtcaaggcagtgattgttcaaatggttttatgggaagaaattattactagaaccgcaatcacatgttcagcctccctatattaaagcagacccgttcctgctgaaatggtggtcagggccccactcttaactcgtatctcccgctgcatcacacctaacctctagaacttccagacactgttttatcagaaccatacagcagtactaataattatatagcaagtttaaaatctatatcttaacaaaagttagaagtgtataattgcaactttctttaattctctagtgctctaaaaccattcagcttggctctcaagttcccatttctactgagaaaaaactcataaccttgcttctccaagattactccgtcacttctggtttggaattcagcttcttgtgggttaacactcagttgaaaattggaatattccatttcccttcttctcttttactcttgtttaaacctgtttccagggaactcatatgtagctttctggtaaaggaaaaagtcacctggtgcatatgccatcccttcctcacttgagatactaccacctggtctttggacatgttgagcactgacttctgaaggcgtagatccttgtcatggcctccagtcacaagtttcacacacttgcccagatgtttctcccttgggaatttcagacattcttacctgtgtttctagtcccataaactcggctacacgcatacccaccttcccattaaaaaaaaaaaagtaatcatcttcttcatcctttgcctctttcatatacggtttccacattgagtgcaggatttctctatgaagtttacagtttcccaagattttccctgggaaacttgacacaaatcctcgcccttctcagattctgcctcaaaccatatgaagttctgttatcctcttctcctctctgtggccctgagggcccccttctcagaaacccatgcaggctgtaaaccttagtcacagccccttagagcctcctatacatgcttttatggtcaaagaatggtctactcttccaatagtgaaaaacttctctgacatcatcaaatccccatgcttcctagctctgcaagctttttcctcttccaaagaagagatggctattcaacaaaacccaaggctttgtaaattcttgtcttttaaaaaatgtaatttagagtcaaacctgagtattgccttctttattcatggctatcatatttaccttccctgaaggggtaatttataaaatacttttgaaagtaagataaggcaaaaagtgtgaaaaataaccagggaaaaatgtttaataatatcctactatagcaatatgataataatagattcaatggccatttattgaataacaagtgatgtgttgactactttatcaataatcagagaatcacacaattagaaagacagaatttaagctccggtctaaatggctctaaattccaagatatacagccattttatcagacttgcagatggagtttctggcatcagggacacattcactcagttcctttggagtcattacaaaaggcattacctggctatatcagttctttatcagaaggattatgattgatatagaaggattctaatattttttaaagatagaacatattgatgcttttctctctcagttcgttcacatcactccttgttcccctctatataaccttacattttattatctcccctgcattcagtccttagcatttccaattccacaacactccccgcccatactcattctttgtcatcctccattttacacctcagttcctggtatcaccttctatctcattggccacactttcccctcatatgccatttctaattagtcatcaatatcagtcaattgcacctctcaaaaatagatattttccttacccttaattgcaactgctttgtccaagcctcctacaccaccctcttgttttcattctctacttctctatcttatccttcacattctaacagaattatctaagtacaaatttactgttccattttttaaaatgcctccattttgcctgctagaacagtctagacttagctcagaaagcaattgccatcaaagggtgacccaccttacttttgtagcattgccacccccatgggatctcaacatgcagagttctagttagaataagatgttagtctttgtaataacacagctattgagaatgaacctaagacaatgtaatcttgcataattctctgaggtttttggggaaaatgaagtaaccacaatggttaaggggaggagaagatacgctatccccctaccactttgattccacaataaaaggaaagaaagtttggataaattctgccagaaaaatatttattagcagacagccttatcactcaacttataaatcagaagaagttccaattctgttgtatatgtgtgtgtttgtgtgcatgtatgaatctgcatgtgtgcatgcttttcagaaaccttgcaagaaattttctcccaaggcaaatgtggcaatactccagtggtaggattgaactcaccttctgttgacatccaagaataattttcatcaagaccattttggaattaagcctagaagatcttctccaagggggcagaccactggccctgctagatttttgtaagggtgggaatgtgtttctaaattgtgttaagtaattcatatgtcttgattaacactgattttaccatggaaataccatttccaagacccattgtacacagtaaaaagccactatctttagcaatgaaacttgatttctaatatccattgtgttaattgatgaagcatctacttttgatcagaaatatagtttaagtgcttgtagtgaccgcctctggagtgttgcctcattttagttaaatgcttgctgaccatcctaataagggcaagctactgtctttagagtagaacttatactaacaaagtaccaccaccatttatgctggaaagattttaaaaaacaatacagacatcacaacagtgttagactcctttgctcctccatgtctctgaatggagtgtcccttcaagttttgtttaaagttataatcctactttatatatttttttcagagtgtaaaatggtttttgttgttgttttcagctttttttccttctctgactatgaagtatgtggggcatgcttactcataatgacgccagggcaagcttataagaacactgtaatcactaacacgaatcctattttaaagatgaagaaagagatctcctagtcctacgttgggagttattacaggcattgaacaaaattagttagagcaattttttataatctccacctccatctcagaaaatgtgaacatctgttccatttcaggcatattaagcacattggcatctatgaaatcttaggccatagaatttctttttctttctctttcaatgacaaggtcactcactattcatagtttcaggaattattgtcctcatgtccatcagtgaaacatagtacctctgcaaatcatttaaaaaccttatagggattttttttggtgtttttttttttttttggtgggggggtgggtggtggtggtagttagaccatttacatacacaggaataatctttagaagctagaacaagtttttggatcccagaaggagagatgtagagttgttctgggtatatgacttgcctcaaatcattaactgttaaatggtaggaaccgaggcttcttatcccaaatcttgtgctccctttgctattctgctactttttaatccccttaagacttctgaatctatgttgcctgctgccctcttagggatacaagagaaggaaataaatatctatagaatgactcctttggaccaggcattttgctatatgatggggtctcatttaattttagacatcttcaggaaggtgctattttatagatcaggaaatatagtcccaaatgagttatataaaaagttatggcaatcaagatttgagctaagcttctgggtgtttttttcactactttataccacagatattttaactagtatcaaatttaagtgtttgagaacttatagattcaaataatccagaaaagtaccaaatggcacaacatgtgaattagaacagtactgtaaatacttcaaactgtacaagtcaagcaaatttattttacaacaattgccagaggttgtcatagcagaattgaaaagcaaaatttattaagacaatgacattcaataatcataaaatcaaaccattaaggttttatatatctaatgtttattcattcaaagatatatgatctctgaagataattttatttgaaaaatcatatcttgaaaacttgagaaagcatatgatggcaaatctgagacataagaagaaatgtgacttactttttgaaaactataatttattcaaattttatcaatgcaaatttttaattatcacagttttctgtgatgatatgccacacttaaacatacaaaatcaacttttaggattaaaaaaagatgaactatacaatttatctttgaaccctcctccagtttcattttaggaatccatttactgaatgacagcctctgccactagtcaatttcacttatgtgattcatatatacttgagaacaaaaaaaaaaagaaaaaaaaaaaaggaatggccagctgccaaaaacatttgacaactattcagtaagtgtttagaggttaaaaactcccccaaaccggatgtcatacttaaaacatttctactgtcagtaaatcttttttctagccaaatccaatacagccactaccttcaacttgaaaagtgagtcttcaacctacattttcttaaaagctgtgttattctaaaataatcccgcagattccttgcttcctcagtcattttaaagaacattgagggtattatcctctcatatgttaaagagaaaggtgcatttatctataacctttccaaaccctcttttcattcctgaacataatgccattttttccttcttcatcaagagttcttaatattttaaattcatattttttatttgttaacgccacagagtccaaacttccttctttcctctcaaaaatgtttttataaaacatcaaagcttttagttaattcaatttaagaagaaatatctgctggacttgttgattgacttcaagtaaccaaacaactagttgaatgattggatcttgttttttgtttgtttggtggagcatatctgccggggtcttttgaaagtcataagaaagagtaacttaatgactacattgcagattataaagaattactacaaagagtgtgtataccagctgtttttcatctctgctgtgaacagaattatagttgatgcttaaattgcagaggattttgagaataaagctcagaataagaaatagactcttgtaccaacctataactacttttaagctgtttataaatgaaagttgaatttaaattatcctagccctatcctttaaaaatattagcataattttgtttttcatggttataaagatgtcagcttttcaaagtttcaccagtcacatgaagttcatacacattaaactatgtcaatttatgttctttcttatatcaaaacaatctaagatgtactatccaagatgcatatacagttggtaattgaaaaagggaagacaccttagaatccatatgattttgagtcaaaaaacattgctgaatttagtatggcatctggcactctgcttccggtctgacaacttttcaaatcatgggtttgcttctgatggtaaataaatgcctaacccattactgcactgatgcagactctggagaaagagagaaattagatatcactcaagtgtcccattggtttgaggatggtgctgcagatgcttgaaagaggctttctaccagtataatctacttggaaacaactccattataactgggagatactaacttaagtactataaatacatccagatgacataaggagatagaaaactaactgatgtcatagcaccaattcctaaatttcatttaagattaatatggttatttcatatattagtctaggcaaaaatttatcccctttttgataaaaacatgaattcttagctattttattgggagtatatctcctctaagtattaggacgatctatcatggagccgagggggcaaggtttagtttttatgatgttgtggtcaaatacctggcagataactgcagttgtttggtgtcattgagacctctgcatgcctatatcctgttctagaacagagtttattgaagtgtggtccctcaatcagcagcagcatctcttgagagtttgctataaatataaattctaggaacctactcttcacctactgaatgagaaactctagaggtggggctcagccctccaaatgatggtcattcatgctcaagtctgaaaaccactttcctagaggcatttacacagatcctaaggccttttttttttttttctttttttttgagacagagtctcgctctgtcacccaggctggagtgcagtggtgcagtctcggctcactgcaagctccgcctcccgggttcacgccattctcctgcctcagcctcccgagtagctgggactacaggcgcccgcaaccacgcctggctaaatttttttgtatttttagtagagacgaggtttcaccgtgttagccaggatggtctcgatctcctgaccttgtgatctgcctgcctcggcctcccaaagtcctgggattacaggcgtgagccaccacacctggccaaccctaatgtcttttcatgaatcacagtaagaagctacagttcaagagtattccaaaggagccttgctaaactctgaaccacagctcctagtaattccttgagaagtcagagcagcatggagtctacatctccaaagcagtctctcctgagaaatgatccgagtcttgagaaaaatctcaaaattagctatcgggtgtgagtcatgtgataccaaaatgaaaggccattcgttcatttcatcaactgataaacttgagcatctactaagccccagtcacatacctgagctaaggatctcatagtctaagagagaagataagatataagcaaaatcatataatacatgggaaaaatcatcacttccaactgagggaaatcaggctaaccttcaaggaaaacaagctaaaaatgcagctgctgattatttagacaataagtagccacagatattttttaagccaccataacacatgatcagtggtaaggtctgggaaggtaaatttggtgactctcttctccagaaggagaaggaaatggaaagggaagaccactcaaatataattataacagctgagatatgagtagggcctaacctagaatggaaatagaatccaatagatttgtaccaatgaatggcgatgagattattagtaaagataagggataggtggaacgcgcatctgaagttttgacattaaagaaatgagatttttatgttactaaaattaaaatgaaataaaagatgaagaacacagcttgagatgggaagcttgttacgttgtgagcatgtgaagtgtgaggtgcatgatgaagatgcaaattaaagtgttcaggttacaggtaggagtgggggactgtcataattcaggagaaatagaacaggatcatgcatccaaattgaggaggcatctacacagaagtgatgttatggaagttgatgttatggaaggaaaggatatttttaagggaaagtgggctgaaagaaaaatgaagtggaccgcagaaaacatcttgcagaaagacggtatttatgggttggaagagaggtttccatgaaagaagcaggggaatcagagacataatgttatataagcaaaggcgatatttatctgaaatttaccagtatgggtggaccagttgtttacatctcgtctgatttctgaatgctccgttcttactggtgttcatatgttgatatggctttaaaataatcttaagcctagagaagatatgaggcaatgaatgaggatctaattattacacaaccccagttgaggggagtttcaacactttgcactactttgtggcaaactggaaaagaacagattaccagaaagaaaatagcatatgcccaaaataatactacaatccacaatctggcctgaggagtccttccattattagcctgtgactcctgaactacccttagtaatacatttatctcttaggaatgtactatttatttgtctgcatctcctgctaggctagaaactaatgaccaatattgtaaagaaagtttaatatctcataggtaatgcatgtgaatagttaatgaatattttaattaattattaaccgatattatgtactgactttattgtgtgctttcatgatttcttactcaactaaagtgtttacatcaatgagtggtacaattatagattgtactggcctatgggcatatagcttttctatagcaaatataataattatttttggagaaaactagattttgttttttaaaatgtacaactatatgctggctaaagaataaaggaaatgccaaaatatgacacatttggtatgattgtttttcttaaacttttttgccctaaaagctgctgtttaaaaaactcttctatagctgaagtttttattccaagtatcctatagtgaagttgttagtgccttatatacctgtgttaactttacatgtagcaaacacttttctgagtttgccctgaaaagttataatcatagaatgatttctagatggctcaaaattatcagactactagaattaacacacatgtatatatctcaggaagtgaattttagtgtccttgaagtcaaaaggattgtcccaaagccacccagaacaatggtgaagaatgtccctctatcgttgatgtttcatagcccaaatattttaagttctatgcttaatgcagagttcattttattctgaaatttatgagtgtttcaatttaacttgatctaatcatcaagtaatacactgcctatcatcagggaagtgcaatagagagctaaagacattgatattggtagactcagcatatcaacagtatttaaaatttaagtgaactatgaatcttgatatcttagtcgaaaaaggaaattgaccaaagaaagactatccggaagataaatgatttcttattcttagaaacaacaagtgagaaatctgagatggtatattagaaaaattaagataaagataacaaatgattgatagtagtcctcaaatatttaaaattttctcatgtaaaaagggggaagagtaaggagagaaatgagattttagaactaagtttcttttacttacattctacttcttgattcttatgaacaaactgattagcatgatgaaaaataacttggcaatattttatgtgtaagatgagtggagaccagaaaaataatgtctttctataatcattcattttaataatattctccatcccaatatgcaagaactgactcctagtaaaaaattaattctcacaagtttggttttattttctccccaacagaaaatcaacacagcacacataatctaaaaaatcattcattcacaattaagtcagttgccgttttctctctcttttttcaactgggtaaaatggccaagggtagaatcagttgaacgtaagagcatactgatatccaaacatatggcttttacaagcagtcaagattctctgtgatctgtgcatcaaaaatggtgaaattctgctgggtgcggtggctcacgcctgtaatcccagcactttgggaggctgaggagggtggatcgcctgaggtcaggagctcaagaccagcctggccaacatggtgaaaccccatctctactaaaaatacaaaaattagctgggtgtggtgacgtgcacctataatcccagctactcgggaggttgaggcaggagaatggcttgagcctgggaggtggaggttgcagtgagccaagatcacgccactgcactccagcctggacaactgagcaagactgtgtcccaaaaaaaaaaaaaaaaaaaaaaaaaaaaggaagtctgcatttcattactcttttcattgatttttctcctacttttttcacaacaacaaatcaaaattcaaccctttgtacctccaaactagttttagaatcattgaactcaatgaaacttaatgaaggcttcatttttcggtctttcagaaatgggacatttggagacgtttatgaaaaaaagtgcatgttttcatgtcctattgttatctttgtagagtagtgacttcgacttttctttggaattttttgacagacaataaagattatgatgcatacttatcatacaccaaagtggatcctgaccagtggaatcaagagactggggaagaagaacgttttgcccttgaaatcctacctgatatgcttgaaaagcattatggatataagttgtttataccagatagagatttaatcccaactggaagtaagttaatgttttcatttgagagtgtgcatattcatgtgagtgtctgtgtagtcatcactttttcatggaattttaatgtttggttctttacttcaaaatttgtatctgttagtttccctagaaagaaacgtctttgtgtgttcacatgaaatttaatttttgctagctcagagaaaagatactccattactgtataaagcatctcattttgtgagccttgacattgaaagaaaccaaatgagagatttgtaccgggaaaaaaaaatattgctgacattaggagaagcaagtcccaaactctattcagtgaactagtttcatttaatttctgaaagagaatctactaggactttctggaccaaattttccattcactcattttgatgcactcttttatcttttgtagcatacattgaagatgtggcaagatgtgtagatcaaagcaagcggctgattattgtcatgaccccaaattacgtagttagaaggggctggagcatctttgagctggaaaccagacttcgaaatatgcttgtgactggagaaattaaagtgattctaattgaatgcagtgaactgagaggaattatgaactaccaggaggtggaggccctgaagcacaccatcaagctcctgacggtcattaaatggcatggaccaaaatgcaacaagttgaactccaagttctggaaacgtttacagtatgaaatgccttttaagaggatagaacccattacacatgagcaggctttagatgtcagtgagcaagggccttttggggagctgcagactgtctcggccatttccatggccgcggccacctccacagctctagccactgcccatccagatctccgttctacctttcacaacacgtaccattcacaaatgcgtcagaaacactactaccgaagctatgagtacgacgtacctcctaccggcaccctgcctcttacctccataggcaatcagcatacctactgtaacatccctatgacactcatcaacgggcagcggccacagacaaaatcgagcagggagcagaatccagatgaggcccacacaaacagtgccatcctgccgctgttgccaagggagaccagtatatccagtgtgatatggtgacagaaaagcaagggacatcccgtccctgggaggttgagtggaatctgcagtccagtgcctggaactaaatcctcgactgctgctgttaaaaaacatgcattagaatctctagaacacgaggaaaaacagggtcttgtacatatgttttttggaatttctttgtagcatcagtgtcctcctgttttaccatgtcttttaccattacattttttgactttgttttatatgtcgttggaatttgtaaatttacattttttttaaagaagagactgatgtgtagatagaaaaccctttttttgcttcattagtttagttttagaatgggtttttattttatttccttttttaaaattttactttgcttttaacatttccttggggtgcttggacaaatctatccgatgggacaaggagcaccggattctttctcgggttctgcctagcatcaactgggccacgtcggccttcagagaacagtgcaacaaatgccagcattgccattcgggggaaaaaaaaaaaaaaaaaaaaaagatgagaagaacacttgttcataggagggccccaccagtcagagccctgaatctcttccttgtcccacctcattccccacctctacctttctaatggcggcatgatgtgtaaactctgtgcaggggtgggggcgggtctaactgtcttaacattcaagtcactgctcttcagaatacactctagacccaaaggtgtgctaatcacttcacagtgaccactacagagtactaagaagagaagatcaagggcatgaaattggggaagagtgttatttccgttttttaaatgagttgatgtacccttatatatatatacatatatatataaatataaatatatataaaaacaacaaaacaaaacaaaaaaagaaaa

SEQ ID NO: 5550 - DNA, 1369324 bp, human; identical to SEQ ID NO: 5549

SEQ ID NO: 5551 - DNA, 1369324 bp, human; identical to SEQ ID NO: 5549

SEQ ID NO: 5552 - DNA, 1166476 bp, human
tgaaagctccgattccacacttgattctcttatacgctacttttactcagagtttgaaggttgtgaccaaaagaggctccggtaagcagtattcctctattttttatgtgtttttatagcttaaagtgatagtgctacatctacacatgtgccattagtggaaaagttgagaatgatcagttatcaatattgtggagatattgtagatattatgagtaaataggtggagcacactcatagggaattaggaaagtgagagtggattcaaaagaatgtggcttattttatcgattactatgaattggcatggattcaatagcaaagccttgtatttagatttcattttgtggtaggattttaagtattcttatataaacagtgttatttaattttttgcatggaaatattattgtatctttgatgttaacttttattgttaccattttgatgtcagctatacttagggaagattcttttcagggttgtactccagctgatttgatgaattgcttggaagtatataaagaaaatactagtgttattgaagaaaatgtcatgaggaagcactaatattttaataggaaatatagaggtaaagtaggatggtaatgaaaggaactactaaatagattaatgttggcatttatgaaaaactttacatgttatcaggcatcttggtttgtagtggactgttgatagttcaattgtatgggacaattgaataaataccattatcaatgtgaagttgtatcttgtctagtaagtcactaataatataaagccttgccatgctcacactatgtggagtcacataatttttgaagttatagcttttaggtatgaaggaagatgaagggtattgtgttttgttgctagaattagaatgtattgtctgttagttctagagagcctgtgggaaaaagaagatgagataatgtacaagaggttgcagtgttgtgatataagcaattgcatggacaaaagcatctttggagttcagaaaggaaagggaatgaaagggctgagatggggctgtgaagcaaacatcttaaccatgaggttaaaaggcttcaaactcactttgatgatataacgaaaaagcccacatgcaggggaaatagggagcagctctgctctcgtgagcccctcctggggataaagtctgaagggaaactggggagggcattgtgcatggacaaaggtttggtgcatggttgaaagttaaaaaaaaatactgagactgttggttctagcatatttggttattatacagctgttgtatctgccattgatgtggttataggcaacgtgaaaaaaatactgttgttatgtctacacattatttcatctcttcttctcagtggatcttctgaatgagataaaaccctagggcaggattatgatgttgtggtttatgtaattcaaatgggttaatgggaaataacatatatcttgatttctttaattgtactatgctcaagtacaattgagcataaccaagagagttagagtaggtagaaagaggggtaaatagtgatgaaagctgataatttttacaacactgatgttttctggaatagaaatttacattaaaatcacttaagataggtttttgagatagtagctatatataagagaaacactcatttgtgtaagtattataacaaaatgacaatagttcatccaaaatagaaatattgattaattctttaaaactttatttttctggttattaccactaattatataaaatctgtttttttttcagttctttctgtgtatgtcagatctatgatttatttattcaaatagaaatgttactcctttttaatcataaagtaatggtgataggtccattctatataacctctaatttgggggcaagaaattttatcaaactgggacttactttgtgtgtttgagaagcatgagagcagagctagaaacatggggcagttggaaaatgcaaatttaatataaatgcaaatattaaaatgtctcaaaaatctatattaagtgattttaatgtaaattcctattctagaaaacgtcattgttgtaaaaattttctgctctaaagacctgagaaaactcaagaatctgtctcaaattcagttttattttaattttgtaattatttgagaagaatggtaataagatgctgtgctaagctaagcagaagttctgagacctttctctcttcagtttatgaatgcagttgtcacgtaattatataataccttctaaaccaaatgtgttttctatattataatgtaaaaatgacaaggcaggtactgggattttgcagcatgcctgatttgtttacttttctatatgatgtgaattaacataccttccttcccctagtgtctatattaagatccagatggatggaggcttgtttgtttgtttgatttttggatattaagtgtgcactttgggaaggaataatattattctatccacatactttcatagcttggactgatttcagctgatgtctgttcctgtggcacctttgtttgaaggaagcagatatgtagcttactgaatagtgtcattactcatctccatacatcaagtagaagaggagtgtagttggcatcttttccttgaaagattaatagctcaatcttcatacccagcccaacctataaaaccagcagcaccatggccaggggataaaaatcaatttttgatgtttgattttacgtattaaccaagaggacttcttatctttcttcttttgtcttatcatttaattctcttttgattctttattttattcatctttttgaaaggtcagtaaacatgactcaaaacccaatgcttttcatgtgtcttttactagaatattatttttagttcactgtgaccactagaaaaccagaactagatattttaataattaggaacatatacaatattatattacacagagaaatattgatttttaatggcatgttaattttgtagagtgtttactttagattaacacatatggtcattccataaaagtagatattgttttctcattaacagaactaatttgaaagcaataggaggtcttattacacaagctggaaatgcattatttttatcacattggcttacagtcccatcgctgttaatttaaggaacagattaaatataataaggcaggccgggcgcgttggctcacgcctgtaatcccagcactttgggaggccgaggcgggcagatcacgaggtcaggagatcgagaccatcctggctaacacagtgaaaccccgtctctactaaaaatacaaaaaaattagccgggcgtggtggcgggtgcttgtagtcccagctacttgggaggctgaggcaggagaatggcgtgaacccgggaggtggagctcgcagtgagtcgagatcacgccactgcactccagcctgggcgacagagcaagactccatctcaaaaaaaaaaaaaaaaaaaaaaaaaaaaaatatatatatatatatatatatatatatatatataaaaaataaggcaattatatcattataacattcttgattgaaatattaaaatgcaactttataacattttgttttaaatatcacttcagatatgtacaatatgtatgacaactaaggactatatctggtctctcaggtaaagtcctaaagttgtgcctacatttagaatgaagacttttaatatctatggaagcacatattcagcattcgttacacaatagattttatcctgggacaatttcatacctattttttttagtttttataagtagcacttgatgaaagaggctaagatgaccaatattaccaatccccgtcaagcatgtgaaatattatagcaattcagtaagtaaacatctcggttgctgtcatttttagaattctgaaaaaaaatcccccacatgtaaagcaaacgcttgcttggagaatctttgtatctcaaccagttgaggaaatttagctttacattcttgtttgttggtccctttcttcattccttcctcccttctttccctttttgttctttccttccttccttcctttcttcctcccttccttcttctctgctagtatatttatctgcaaataaaaataatttattttcatattcccactgtgtcttggtaggacttttcaaactataaaaatattattattactttgtctgcatggttgaagtatttgaaatattctatctttacaaggccattcaaagaggttagcatagtctttgttaataatagctattcttaaatatatacattttaaaatggtgtataagaaaatctgcagtaagatttgggagcagggaaatagtataaatagttgaaggactgttatggacaaagtatgactatagcactttgcggggactaaagtgtgagttgtaatttgcctgaaaagtttgggatactgaagaaaaatgaagctagaggggtctggatgtagaaattaggtaagagaaggggttccatgatgtttttctctcaaaaacatcctcagaatataagatggtgagtgcaaggaccatgattaatgtatgcttataatctctacagtgccaaatatgctgtttcagagtcagggttcaaggaaatgtcttaatgacttaatgacttaatgactgcatgaatggttgagtgagtggttttaataatcagagttacatcagtgaggatgctacaggaccaaaacgatattagaaagataaaggtaaaattaaatagaggcatttaagaaaaatgatttttttttcttaaagagcaatcagtataatgtataatgtgagactactgaagcaaaagatataacccggaataagcaatatctaggacataataagggtttagatgaagacaatgaacctttacaaatggggagtgttttcatgggcttgaaatgcagttcaaaatctgttaaagggtaaggaaaatgattcttcgagtatttttctattggaattctactacgtttagtgccgctttaaagaagtactaatgtcattgtgcagaattttgaatttaatggtattgttccataatggccattatgaaaaggctgtagctcatgattactaatacaggataaataagcaagtgacttcagtataggaaaaaagtattcacagttattagaccatatggagaagagtaagtggctgcattaccaaaaagcacgttattttaggaggaatttcatctatataaaagctccctaaagcatccagctattagagagtaaaagggttaccaaaaggagttgatcttctcttcattctagaacctgacaggggacacctgtttgtgtaaatgatttagatgcaattcttctagacagcaagaggaaggcaagcctcaaaaggttttcctaaacttgtgactctaggcccaaataatttataaaaggtaagagtagtcaaataaccaaagacacagtttcagttctaatttttgtgttgttatgtatggatattcatttaagtaaaagaaattatactactgtgtaaagaaagcgagatttaactgaataggaatgagaaagtctagtgggggtacttccatctcatgtcaatgtgatttatgtgcagctgctctcttgagcattcctgtaagtcaatgagcttaatttcacatgattaagagacaacctagtcccccagcatctgccttttattatgttaccatgtgtttattctcagtttgtcaaatatgtcaaaaaagataaggtgtttctccttattttcctttggggtagcttataagaccaaacttctgggactttgtttctttaccttttgaagttaaaaaaaatgcactttaattttttctcaggaaaaaaaattctcctatttattgtaatttttacaaattttgaaattagatctagagtaattttaatattcctttgaaattatgtccttaaataaaataataagtctaataaaaatggaacttgcacctaacaaacaaaataaaattagccaatgtctttgtttagttatatctatgttctgttatacctatattctgttatacctatgaatttccccacaaacttacccattcagttttagttgtcagtataattttatatagagttggcacagatgaataccaattgtggaaaatgatgcctgcttcatggtgagttaaggataaaaggcagtatgaatgaatcttccaagttgactaagacttcaatgaggaggagaatattccaagttaataagtatagtattccaagttaatccaacttattaacttggaattcaaactaattaacttggaatattattattattagttgtattagtattccaacttattaacttgtattccaacttattacttattattgcttataataagtaataatattcaaagtatcataagtatataagtgtggtactgtattatgagggtacaaaataatatattgttctatgtatttgatgggagaggtgaggaatagagggaagcagtatagaagctggcaaatggtaggcaatataagtttgttagagaaatgatgttcgtattattccattttcatgctgctgataaagacatacctgagactgggcaatttataaaataaagaggtttaattgggctttccatatggctggggaagcctcacaatcatggcggaaggcaaggagaagcaagtcatgtcttacatggatggcagcaggcaaaaagagagcttgtgcagggaaattcccgttttcaaaaccatcagatcttgtaggactcattcactctcatgagaacagtgcaggaaaggtctgcccccataatttaatcacctcccactgggttcctcccatgacaggtgggaattgtgggagttacagtttaaggtgagagttgggtggggacacaaccaaaccatatcattccaccccggcccctcccagatttcatgtcctcacatttcaaaaccagtcatgccatcacaacagtcccccaaagtcttcactcatttcagcattaactcagaagtccacagtccaatgtctcatttgagacaagtcaagtcccttcggcctatgagcctgtaaaatcaaaaacaagttagttacttcctagatacaatgggggtacaagcattgggtaaatacaggcattccaaatgggagaaattggccaaaacaaagggactacaggccccatgcaagtccaaaatctagcagggcagtcaaatcttaaagcttcaaaatgatctcttttgactccatgtcttgctcatctgggtcatgctgatggaagaggtgggttcccatggtcttgacagctctacccccgtggctttgcagggtacagcctccctcccagctgctttcacgggctagtgttgagtgtctgtggcttttccaggcacacaatgcaagctgtcggtgggtctaccattctggagtcttgaggatggtggcccccttcttacagctccactaggcagtgccccagtagggactctgtgcgggggctctggccccacatttctcttctgcattgccctagcaatgattctccatgagagccccacccttacaccaaacttctgcctgggcatccaggcatttccatacattttctgaaatctaggtggaggtcaccaaacttcaattcttgacttccgtgcactgccaggctcaacaccatgtggaagccaccaaggcttggggcttgtaccctctgaagcaacagcctgagctctgtgttggtccctttcagccacagctggagcagctgggacatagggcaccaggtccctagactgcacacagcaggaggaccctgggcccagcccatgaaatcacattttcctcctaaacctctgggcctatgatggtgggggactgctatgaaaacctctgacataccctggagacattttccccactgtctcggggattaacattcggttcctcattacttatgcaaatttctgcagccagcttgaatttctcctcaaaaaatgggattttcttttctatcacattgtcaggctgcaaattttccaaacttttatgctctgcttccctcataaaactgaatgcctttaacagcacccaagtcacctcttgaacactttgctgcttagaaatttcttccgctagataccctaaatcatctctctcaagttcaaagttctacaaatctctagggcaggggcaaaatgctgccagtctctttgctaaaacataacaagagtcacctttgctccagttcccaacaagttcctcatctccatctcagaacgcctcagcccggaccttattgttcatatcactgtcagcatttttgtcaaagtcattcagcaagtctctaggaagttctaaactttcccaccttttcctgtcttcttctgaatcctccaaactgttccaacctctgcctgttacccagttccaaagtcgcttctgcattttccggtatcttttcagcaatgccctactcctggtaccaatttactgtgttagcctgttttcatgctgctgataaggacatacctgagaccaagaagaaaaaaaggtttaattggacttacagttccacatggctggggaagcctcacaatcgtggtggaaggcaaggagtatgtcacatcttacatggatggcagcaggcaaaaagagagcttgtgtagggaaattcccatttttaaaaccatcagatctcatgtgactcattcactgtcagaagaacagtgcaggaaagacccacccccataattccatcacgtcccaccagattcctcccatgacaggtgggaattgtgggagttacaattcaagatgagatttgggtggggacacagccaaaccatatcaatgtttattgtagagatagcatacaggcattcactgctaggaccagaggattaacccctgatccactggtggtcaactataggcttgcacgtgatccataaggtggcttggaaattagggacactggtgtatcagtatcttactgatgttttaacaaattgctacaaatatagtgacttaaagcaacacaaatttattatcttacagttcttgaggttctttatcatcacatctcctctgactctgacccttctacctctctctttcccttataagggtcttcattattatattgggcatcctcagataacccaggacaatcatttcatcttaaaatcatgaatttaatcaaattggaaacgtaccttttgccatgtaatatgacatagtcatatgcttcagggatgaggcagtagacatctttctagagaacattatttagcttactgcaactggcaattagccaattcaaacaaactgtctattgaatgcgttgaagactagagcaagaattgtcagccaggagccagatgggaatggaagagaaaagaacagggaagttgaaaacttttgctgaagggcctgtgcaatccatggtgcatgataaaaggtgcagagggtttgtagcaaaagaagaaaagggaaagaaaacagggcagagggaaaggaaggatgagagatgcggaaggagaaagaggaaactgatactagtgatgctttggatcttaagaacattttaagattaatctgcactccacacatatactttcaaaaatacccccttttctttgtggtaggctaaaggcgtctgtgttcctttcaacaaagtaatacctgacctgaaaatgatttccagacgtaaagtaatagcagtgagaatagtgaagacagaagagagagcaattttaaagttagactcaattgaaatagatgatcaattagatgtgagaggttataaagaaagaggtaaagaaaaacattctgtaatgagaggattgggataccatccatcatattaaaggtccccaaagcacagaaacttgaaatgactacttattgaaggaaaatagtaaggtctttgtgactaagatgaagccccaaatgtagattgaggatagaatatgagggattttgaatatcttgcaaggaattttagattttatcttgagaacaaaatattttggctgagatatttaataactttgcaaatccctttagtagaaaattcagtctgggtggttgggcctctgatttgatagatctgttcattgtggtgtcttctctacaccataaagatgaaacttcttgctttgtgtatgatggtgttacacacatttgtgagtccatcagtaaagctgcctttgcagagaagggaagacacacaatcaaactatgtaggatcatacatgaaaatggcatggtcaaacctggtgtttgacatgtaacactccctgtagaaaagactagggtgggattccagaatgaccagtaagggactcgataaaaatcgtatttacatatactgagggcctgaaaagcaatcaaaggcactgaaaataaatttctgaagaatatataggatctagtgagtgtttggagatgaattgtgaaataattcgaggagaggttatattgatggtgtcgccaattacagagagaagatgaatggcaatttttgcggggagagtggatggaatgaagtcaattcggaacatacaagctgtggtagtcactggaagtattgagctaatggatttattggtctggaattgtactagtttcctgtggcttctgtaacaaattgtcacaaactgggtgacctaaaacaataaaatttattgtctcacagttctggaggccagaagcccgaaatcaaagtataagcagggctacacttcttctgaaggctctgtgacagaaaacttccttgcctcttccaccttctggtggcttcagttttccttgggttgtagctgctaccatcttcacatggccttcccctctgtgtctttaatctccttctgcttttctcttataaggacacctgtcattggatttaggatccactgggaaaatccagcatgatctcattttgagatctgtaaccttaattacatccacaaagattctttatccaaataaattcatatgcacaggtcttggcggacatatcttttgggggaccactgttcacactgcaaatgtcaaagcaagaggtatggattttgaaattgtcctcatattgagagcaacatgatggaatgagattatccagggaaaacatgcagagagagaagaggaaaagaaaagggaaagggtgaggatcaaggattctgtggaacactagccctgaagaggctggcagagaaagagcagccagtcagggaaagagactaagggaaagctaagggaggaagaaagagaccttacttgttttggttcctgcaaaccaagagtggagaaagtttcaaaatgaaagaatgatcatgttacattctttggaaagttgtgtcagataactgaaaatacgtcattaaatgaagattcaggaaaatgtaggggtggagagacaacggagtctgaaagaagttgatgtcaggttttaaaaagtatatattgtacaaaatcagtatattaaagggcctttgcatattaaagggattttatttatttatttatttatttatttatttatttatttatttatttattttgagacagagtcttgccctgtcgcccaggctggagtgcaatggtgtgacctcggctcactgcaacctccacctccagagttcaaatgattctcctacctcagcctcctgagtagctgagattacaggcacccgccaccatgcccagctaatttttgtattcttagtagagacagggtttcaccatgttggccagggtggtctcgaactcctgacctcgtaatccgcccctgcttggcctcccaaagtgctgggattacaggcgtgagccaccacacctggccagggattttactttttaaagtttgtttaactgtttagaaattatgctttttctatttaggtaaaacgagtataaaacttgtggtcatccatgctaatgaaaagaattgtacattagtacagatataatagtatagataaaattttttccaatcaaaaacttctttttttttccaatcaaaaacttcttttagcaagaattaaaacatgttttgccatagataaacctcctgaaggaagggtgatactgatttaattttcgttttttcatttcataaatacagatatggaagatagcttacaagtgtattataattttccacggttaatcttcatgttaagtatcgtaagttccaggaaaggtctacagacagctaatatttacactccaactttcattcacagtgatgatcacaaaaattacatctttttagttagtatctcagaagtggcttacattaatctgatgagtattatattaggttggtgcaaaagtaattgcaatttttgccattactttcaatggcaaaaaccgcaattagttttgcacctaccttataatacccacagcagtggaaattaaaacacttgggtttcaatgcagctgctaacgagccttgttgattgggaacatgtccctaactgaagctgtcatatctttggtttcctttttcataaagttttgcactacaacattgtccatacaaataatagttcatctttttgttcctttcacaaatatttattgagcactttcaatgcatactaagtatatacctgacacttttttctgtaacttattttacatgtttgcaaattgatcacacgtttaaaaaggcagagtttgtgaccagagtacctgaggcccattgttagctacatttaactttgtgctatacagtttgagtcagcactacagagtggaggatgttattagcttaaaacaaaggttctgttaagagaaaaaaaaattagtttttatttctttttaaatagcacacagtatatcattagaaagccaaattaaaaataagatacttctccttgcatgtggtgatgtgattaagtaaaatttggtttgtcagtttcaaataccaaaccatgttttagtctatttttgcttatttaaggcaaatttctttttgtagagttatggtctcttaagacatctatgcaagacaccttgcatgggaaatgttgccttaaggcgatgacagtgaataactttgccaagttttaaaatctctgagggttatatataaatatttcttcaaaaaatgtcagtgagcctcttgtgagtattctcaacactattcaattgtcatttatgttttactaactgtactaaaatatttccaaattagttttgctaccttgagctcaataaagtactgccattggcatcttactttaagttcttaatgcatattccacttattttgtattccaaatattatgttgtaaatagtaaagaaaaattattcttatcaatgatgaagaaagattttcatactctggtgcattaatatttttctgaaatatattgtcatatcagaaaaaatgcaactatctgaaaagaggattcttccaattttttctataaatatgttctataaagcaattgtactctccaatgccatcttgtggctttttaggattgatgaaaatgcggtaataaacacagaacacagggagaaataaacatgggaagaaaacttctgatgaattattgctcagtgattattttacttgatcttaatactgttcaaacatttatttgccctgatttattgccttaggttttataaagagtatatatatatttctcctatattttgctacatttttataatagaaatgttcattgagatcttgtaaggagataaaaatatcgtatttttatgatcttagcatcatgtccatttgtagccctatattaccagaattcaaattattttgacaagtgcattgatattatagacttattaaaaatcctcttttaatacattgctgtcattaaggtcttgtcattttaataattcaggtgtcgaaaggagaaaaagtcattaaagattttagttgctcactattataaataagagctgctgagaagaatatggaagtgaagatcttgtgtggatagatgtgtgcttcacgacttaggttttcctgctggtctattggacaggccttggaataggagatgggagggcctaggtagaatcaagctaaatggaaagcactagtcatcaggcaaagttaccttgaaaaagcagttacttttatctgcatgtcccaaagaatgaagaccaagagaaattattggtcggcaatgttttgtttttttaaagtgaaaaattttcaaagggtcttaacagttataaatgcgttttcaaacgaaaggcatataatacaccccccacacacgaaaatattagcatgctaccaatgttttcaaactttgataagaatatttttcctgttatgagcactcatctaaaatatgtacaactgtacttgattacgtgtgtttcttttaggattttatgcatggaacctacttcttcttaaaggacaaagtaacaggttgtgtacaccaatgttaacaagcatttattgaattcctagtatataccaagtgcttgataacattgattcacatcagctatgcctgggcataaaaaaggttaaaatgtttagatatttgtttgtagaaacttgccttttgtattctttatttaaaaaacaaacttgtggaaaattttattaatagaaaccaaggcaatatgatttatctttattaatttgatcattcttagttttctatacctatgaatcatatcctgaaaattgtttatataatttcctcataactttgctgatttttttaagaaacatatggagtgcttatttttgtaactgcatgcctttttactttataaaatccatgtatctgtcatgtctttggaactggtggtgctataggcattgtcctttcatattcactagtcagttctaatttattctttgtatttagcaaatgttttcagacaaaacatactgtaaacaagcaactggactgaattctctgggggattaaaaaagatgaacaatctaccacctctgctattaaataccttgcaaaaaataagtgatatgagatatcatacatgtatagtatattactttcctattgtagctgtaacagatcaccacaaatttagtgtcttaaaacaacacaaatttattatcttatggtgatgaaggtcagaagttctaaaatccaggtatcagcagggatgcattcctttaggaggctccagggaagaatctgttttcttgctgttcccagcttctagaaaccacctgtattacttgtcttgttgctccttcctgaactcaaaatcatcagcatagcatcttccagtctctgtaacctttacttctactgtcacatctccttctctgactctgactttcctgcctccctcctgtaaatatccttgtgattacattgggcccaccactttaatccagaatgatctctccatctcatgatccttaacttaatcataccttctaggttccttttgccacttaacagtcacaggttctaggaattaagatatggacatctttggagagtcattattctgtcaatcacagtggtatattagagtagcttttacataaaatagtttgatatggatggaatacatctatatcagggcacagtacagaataagtgatgagggagtgtcaggagaaaaggtggaaaaagatagatgggagccatatcacaaggactttgtatgacatgacaagaaatgctaatattatgctctaggaagtcaggaaccattgaagaaattgcagcagagcttagtaggaataacctgaccagatagattggaaagagctctaagacaagagagtgggaaatgaggccagtagtccaggtaagaaagtcatgaactgagccagtaacagcaggaataaaagaaagagagatggatttgattgctagtaaaaactggaagtaataaaaactagcaggtgattgtacagtgaagagagggaggtggaaggtaattccagctgcttttattaagttaaaaattctgttgagaactagtagctaatgttatatttctagtctatatttttcctggtcaaatacatttttgggttttcaaaatgatgtatcttttgcagtgtggattccgactgacaaattgtacatctgaaataaaaatctgcgtttgggtccactgtagggttctttcaaatgtcttctacccttgtgcctataatgaagtattgtatcaatgggtcttgccttgataatctcagtgaagaacttcaagttaacacagggagaagctttttatttttttaagatgtcaagtttcttttagtatgtagtgctaaattgtggtatacctacatgcatacacacatatgcacatgtatccactcaaatatacacacagttaactattaattcacaaaacacacttgtattgcagctttcctatatgccagttgctgaggattcaaaaacaataagaatatatgatcgctgcattttaaaaatatctgttttatttacctaactaaatagtataagctcgttgagtataaaaacatctttatccgtttttatatgtatacatatatgtatgtatatatatatatatcttttgtaatcgctatgcttaaaagagtcattgcataatcagtactcagtacatctttgtatttcatttctggatttaagaacactgaaaaatctcatcacagcactctctattttcctgtggcaatgtacatgcatgtcataactcttctctgataccagaaactccttgaggaatgatctctatataggttaagttcattaatgaggctttacacatagcattatttgaccaattgttatataagcaaatgaataattttaacttacatgaaatgaatagtttcattagagtttacatttctctgaaaaggaggaattaaagctttatttttagttggcagggtgacctgaccattcatggttattgtgtataatcccctgctgaaattgtaatagctgaagctgaaagcactgagactatactggaaagtgaatcttgagatggcactccttctttagctccaaagggcaaattttcagttactttgttataataggaattgtgcagcttttgcctccttcttatctttgagagattttgccatgtctgtacatatgaaggtcattccatgaaggaagagcagatacacaaaaggactcctgcatggaagcgtggctggaaggagtaaggcattagccaaagcagctgctcaatgtctccatgtctctcagaacggatcataacaaaccctaggaatgctggtgaatagaagtggcctacaacattgagggtgtttaattttaattcagaacataaattagttcaatttggcaacttgcgcattcattctgccactctaactgacatgctgctccgtgatgaacagtgatgacttactgtttgtttcaaaggcatgttttcgctttctttgggagacgtgcttggtttgttttgttcaatttttaatgatacatgattttattttaaatttctttggaaactgctttgtatcctagggtttccggcttcctgtgaattgaggagaggttattaccttctaagttttcaattaggaaaacaaagcaagtttggaagctccgttgggaccttgtaaaccctctcaaagcatgttctgaaagagacaatttttgtgcaactagctctaattgtctgagatgagactatctacagaagctaattggagagtgtctcattctgcagcatgtatggagtcagcagaatagtaattttgctttcttgggttgtttttcctttttgttgttgttattttgttttgtccacacttcctttcagtacctagcattttaagataaatctttctcaatttaaaattacttatctctaatggtaaggctcaggatttccatatagacccttcccaaactctgtgtaataatgttcctaaatcctcaaccattctttagacctaatatggaattagtaagcctttgatggacttgtattcccttttgctttacctggatgtgatattaaattctgtttcaattttaatgtttgtgttctgaattacagctggtaggtacagaatagtatttatcacattttctttcttatgatcaccacctgagtgattacgttgttgacatattctgaattagacaagaacatatgctcaactaaattgatgccttacatagaaacttgcatataatgaatttcatttgtgcagttattttaatttttgattacactttttggttttagttttatgttttctcatgcttctctaaagctgttccatcatgacttaaaaactaagacttctctgaaacttggaaatttattatgcagatctcataattatcctaactagaaaccaggttcaatataattaaggaaaaatatttaaactttatagatgtacgccatttgttctcctattcatcctacatttgatttttagtttatagtctttaataagtggggaaaacagaattacattgacactttttggatttaattggaaggttttcagaaaagctcttttgcatcagactatctcttctacaaatgttctagtgatgactgatgactctagaagaaaactccatcaaatggaaggtagaagaggagtcccaagtaggaggcagctgagaatgcagagtaggagaagcttctgaggcagtgtatcaagtaatatgtaaggacagagtagagacttgtgtcttcctccttcttctttctgtgtccaaggctacactttgccattatatgattttgacatcaaataaaaccagttttcctcgcagtagattgaggcaggtattatgaagaaaaggatggacaatgccagtggattaatggcttaactcagacacgtttctgttgtgaagaaaccttgagacaaagtttaagactgggaaaaataacattaaaatcagatgttttgagttaagaaaaaacatatagatgctgtttgagatcattttaaatggaaacacttagtttatgccaccatgtggttataccacaccatctgtaaattagtgttcaatgacacattattaaaacttatacattcaaactcatggttaattttaatctagatgcctacatctctgcgaattgcaagcatgtaaaactgaactcaacttgcattaatacatgaagagttaatgagaaactgttttcctgtgtatatgaatataaatgcatgttttactatttcatatagataatttatacattctttacatgctttatgggattatgtagttacatatttatatgttataatacttgaattggaatgggtattaaacaagacgtaggcttttaatatgaaaatattaatatgctttaatataaataagttaaatattttttggaaaacaaattaggtattcattgccagcttataaatatgaagccttttaaatttatacctcactttagccaaaagaggttacgttactctttgcaattattatttttaggagaaggagggtatttttctactattgttgcttttttctcagcatttttgagtcaatgggtgaaatgcttttactcagtgctgtttttgcaccaagtacattgttattttacccattgtaaattattctctcaatggtttaacaggctaaacccttaaataagaggtgtctttttttaaagaaaatatttggaaacgtgcaaatgaaaagagtaaatctatttttggtcgggttgtccaaactcttcttaggatcttatagctagtatttgcttttttaatggctgtttgaggtgtgtttaatttaacaagaatatgccagggatttactaaattatataagacagttctttttttcaaaaagtagatctagtaattttatttttcatttaatactcattcaacatataatattttgagttgtctactatgtgatacctactattctaggaacttaggataaaatgatacatgcatttctcatgaagagtacagcctagtgggcttaaataaacaagataatttcataataattcatgctatgaataaaataaaacaagttagcatgatagtgattggcaaaggtagttacttcagatagggaggtctctttgcaaagatatcatttgagttgagacttgactctgaaaaaagagcccattaagtgagaacatgggaaaagctcattccaagcaggatagtgagtaccaaagatatgcagcagtagcaaacaagacacatttaagaaatagaaagatggtcattatggatgacaggtagtgacgaagaatcatgcagtgagtcaaattgtaaagttttcaaagggtgcagagcaatgattggaggagtaaaatggaaggaaatgttggagaattagccgtggccccttaggtcatggtttagagtatgcattttattctcagtgtaatgcaaagccattggaatctagcaaatggaagactgagtatatgatttacattttttccaaagaatctttttttttggctgtggagtaagaagctatttaaatcatcctagcaacagatgacagttaccagatcttgggtattaagtggaagatggagagataaagactggttcgggtacagtttggaagtaaaaccaaacaggacttgatggcatactggatataggggatgaggaatatgtaagggatatataccatataaagaagcacagatgacttctaagttttatgagtaactgtattgatggtgggactatttcctgagatggggaaaattagaggagggagaggttcctgttttcgaaatgtagaattaagttcgagattcctattcagtcttcgagtggctttgtcaaggagtctgcaggcagctcagtggacaggttaataatggatatttaagtggaaggagccattggcatgtaaattgtattgaaaaccatttgcctggatgagatcactcaagctaagtctaagtagatataaaaagtagaggttgcaggacagaaccctaggatacttcaacatttccgtagttagtaaagaagtgagataccagaaaagtgagagagaaaatatgagtgtgatttcatgggagctcagaatgattcaataatacgtaattaaatgtattgcatagagctgagaagtgaaataagatgaagatagaagattgctcattggatttggacacaggtataactatcaataatgtaaagcaatcaatgaatatcacagaaaagcatagaatggtgggtaggcagaagtcaagggagcaagcccagaagtcttatttgcaatatgggcatgacactgcagcaaatttaaaatcttctattgaatgtaaaatgcatatgaattttttttgtatgccactagatagctaaaggtgaacatgtaggccaaatggaaaagcaaaaagaacagaagcatagagatcaaactattttagggaacaaaaactagttaacatcaaattgattgaaatttgcttcacaaccccatatttctcatgcccactgtcctatgagatctattatgctgttatgtaatgaagagctgtgttaattattcctgccacctgcatctaatgaaattagatgtgaaatttctgataggtacagatggccacttgaaaaaaacaatccagtttttcttttttttctatcagctggtcaaatctcataagttagaaatgttcagactataaaattaaccccagcattcttcatttgtatagatactaagtataaatgacaacttcctcaagcccaaataacttgtttggatttagagtttaaatactatccaattaagtgtatcatgctgacacattgtcatttaatactccctttggtagagggttaagcttgttgaattatttcaacttaaataatctgataaccctctcccagtttagttcagttaattttatacaaataaaattaaatctcaaaatgcatataaagtaagagcataatacagtatgtaatggggcataataaagttgccaatattataatgaagcgcatagaaaaagtgtgacctattgtaattagtaatgtgcacctctgacaaattgtaaagcatgaattttcctggtaaggaaaaagagaatgtgtggtaatggtagctaaaatcctattcgttttgcatagattgctatcaatattctgaagctgagggttgttgaagttggaatttagatggttgaatgaagatgtgctctggaaattaggagtacagatagacccacatggtcagataaaggaaggctgacagaataaagaagcaagacatgggttggttacttgagttgtggagatgaatgtgaaataaattgaataagatacaatgattagaaattgatacattaagcctggagatgaatacaatgattacgaatatgttcagacccacatatgtaccaaatgcaatggatgtcagacatctcactgtgaaagcaggtgttgagatgtgcaagacttaaggtaaccacaagctgagagaggagcagaaacatattaagaattctctaaataacagtattaaacaaaataatgttgaagcccagaacgtcagagattttctttataactccctcatatgaggtgaaataacctacttaaggttgttcaactggttgtgtggcctactaggttagaccatcagagacagtgtggtcctccttggatgagttgtttaggagaattatacatgatataaagaaaggtcacagccatgtgttagaaaccgacctttgtgcattactccttctgcaggattccaggggaagaaaaatcaattgctgactaaatagcatatttgaattacagagatcagcaacagtataaatattgcaggaaaatttatatataaagaaacttctatgtgcctttattagttttgtccacacaaaatgaaacaatgtgtgtatatatatatttttttcaggcaagcacccaattgaatttcagaaatcagaaaacaaataatttaacctttctttttaattcaattatattgatttgccaaagaatcactctctgataaataattttaaagtgtcaactctctgaatattgtaaaatatgtaattttgggtaaatttaactacatattcttggatccttaccattttcttctcttgaatataaaagatttagaatatgtcttgatgattttttgcttgttgtaattaaaatgtcaaacttaaagttgttaaaatgtacatctctctgatactagtaattcttttctcttttaaaaaacatacttatccagtatttaatttcatatgtctagatttgcttaggcaaaaggtagaagtgcctgctcttcagtttgcacataagctaatatagtttaatatatataaatgaatgtgtataatagaagtatattcataagttagaacgtgacatattacctaacataaaacaaataaaacagataactcagtagtttgaaagggaagcttaagggtaatactatacatatagtgtcataacactatcatgaaaatctctgttaaacgctgtctcctcaggcacattctgttaactcttcctaccacacttgtcacattacccagtttcattttcttgacatcacccagggccctctgaaagaattttctgtattaacatacttgtttaatgttccactgtccatataagaatgtaaactcagtcatagaagatttttttttcttgttcacttctatatcccgagcatctcagaacaatacctggcatatgaaagatgtttgataaataccaatgaaattaatgtttgaatgaatgatagcatttctgtttcgttgtatttttcattaaaaaattcaagtttctctcaactgatttcagatattccttcttttctaacatatgcatgcagcactatgaatttccctctaggtgctgctttcactgatccccaaaactttgattattgtcatttgttcaaaagattttaacattttttggaaatgtcttttttgagtgtggattatttagaaatgtgttatttaattgcaaatacttggagattttccaggtatctttctgttgttgatttccaatttaattccattgtggtctgagataatacattgaatgatttctatccttttaaatttgttaggttatgctttattgcccagaatgtggtctatcttcatcagtgttccatgtgagcttgagacaaatatgtattctgccattgttagatggagtattctataatgtcaatgagttaaaaatgattgataatgtgactcaggtcatatatgtccttaatgattttctgccattttaatctactcattactgatgtaggagatgtttaagtcttcagctataatagtggatttgcctgttttcagttctatcagttttggcccgtggagcttgatgtgctgttcttaggtgtaggcatgtttaggattgtaatgtcttcttgggaaattggcccctttattaagtaatatacctctttattactgataactttgcacatttggaagtctgaaatgtcttaatacattaatgatcttaaataaactaaaactccagcttgcctttcgagcactgcacagtacagtagtttctgatctttctgttttgcctctcttagtgtggaatctctgccctgcaaatgagctgagtcccgagtgaatcaggacccacgtattctgtcctatgaaggctgagtgcaagaggagattacctcaacttcttggttgcactcacagtgattttgcttcttgaaattggaattagaaagaaagagaaatgctagcaaattgctcctcctaatgagttacggtaatctttgattgggaaataaagctagagagtgccccatcttcttagccatatccattagtaattgagcttttgcctagttgagctgtgtggaaggttgtaggaggaaaggagcagataatggttcaaatgccacagactcccactattctaactgaattttagtatgttttcttgaataaatgtttcgttcacttactatattcctttggggcaattttcaggtttgtgtgtgtgtgtgtgtgtgtgtgtgtgtgtgtgtgtgtatgtgtatgtgtgtgtgtgtagtttttaaaaaactgatttcacaagttttgcttgtttcactagggaatggtccatagagctcatcatgctgtcatctcaaaagtggatctttccaactttcctttgattagtgttagtatggtatatctttcttaatcattttgtgtgtaacatataggaatattcatgtttaaggtgggtttcttgtacacagcacatccttgtgtcttgattgtcttaatccattctgaccatctctattttttaattggtatatttagactaggcccatttattgtgattattgaaatagttgggttaatatgtacatgtttgcaactgttttctatgcatttgttctttgtatatttttatttcccctctttttctggcttttctggctttgattgagcatttatatgatccattttatcttctctcttagcatatcaattatacttctattttaaaaaatcttggtggttgccctagtatttgaaatatacattattagctaatctaagtttatcttcaaataacagtatactgctatatgcatgctgctggtactttataatacagtgatctcaaatttttcttgtattacctatgacactgatattattcacataatttaccctcatactatatttacctaatacattgttactattattaaaattagcagttatataatataagaataataaaaacaaaatactttaccttcatttatttcctcccttgatgctcttcctttatgtagagccagatttataacctatattattttacctctgcctgaaaaaacatttcacatttcttgcagggcagatctgctatgatgaaatccctcaagttttgtttgccagagaaatgctttatttcttcttcacttctgaagtataatttcagtgaataatgaattctagattgatgttttttctttttttattgttacatgatagatgtatacattttaggggcacatgtgatgatttgaatacattcatagaatcaaatcaggataattgggatatccatcaccttaaatatttatcctttctttacagtaggaacattagcattattcttctctagatattttgaaatgtataatagattaatgttaactgtagtcaccctactaatttatcaaacaccaggccttatttcttctatttatctgtgtatttgtacccattaatcaacctcgcttcatcccctcttaccccaccctgcttggcctctgacaaccattaatctaccctctatcttcatgagattcaattttagctcccacatatgagtgaaaacatgtgatatttgtcttcctatgcttgtcttattttacttcatttgatgacttccatttccatccatgttgttgcaagtgacaagatttcattcttttttatggcagaatattaatctattgtgtatgtatgtgtgtttatgtatatatatatatatatatatatatatatatatatatatatatataatttttttcttaaccattcatccattcatggaacttagattgaatccatattttggctattgtgaatagtgctacaataaacataggagtgcagatatgtctttgatatattgattttatttctttggggtgtatgcccagtagtggaatgctggattatatgatagttctatatttagttttttgaggaaactccatgctgttttccgtagtggctgtactaatttacattctcacaaacagtatatgaggttttcgcttccttcgtatcctcgccagcatctgttagtccctgtcttctggacaaaagctattctaactggtttgagatgatatctcattgtggtgtttttaaagtaattttaacctttattttagattcagggggcacgtttgaaggtttgttatatgggtatattgtatgatgctaaggtgtggggtacaaatgatcccatcacccagttactgagcatagtacccaacagttagtttttaacacttgccctccttcctccctccttcctcgagtagtccccagtgtcttttgttgccatctttatgttcatgagtatccagtgtttagctcccacttaaaaatgagagcatgcagtttttggttttctgttcctgtgttattttgcttaagataatggccgccagctgcctctacattgctgaaaaggacatgattttattcttttttaatggctgcatattatgccatggtatgtaacattttctttatccaatccaccattgatgggcacctaggttgtttccatgtcattgctataatgaatagtgctgcaatgaacatacaagtgcaaatgtccttttggtagaacaacttattttccttggggtatatacccagtaatggaattgctgggttgaatggcagttctgcttgaagttctttgagatatatccacaagctgctttccacagtggctgaactaatttacatttccaccaacagtatataagcattcccttttctctgcagtcttgccaccatccattgttttttgactttctaataatagccattctgactggtgtgagatggatgtatctcactgatgcctgttcagttctcaataaatctcagctattgtattgttaacagtaacaataatgtaattatgaatcccagtgtaaattatttgatatataaacctaagataaagacatttattcaattatacatatatgaaatttgacctgatagctcttcatgaaacttataacctcttatctggaattattgtgatggtaaagggatcaccattttaaaatatatactcagtgatattttctagaaatatattataagcaacaattgtataaggaagacacaggaaaaaaaatcaagtttttcttatgaccaatgtcttcccactctaccatttctaagacctcagatactggatttcatgtactgtaacctatgagtcagtaaccatcaactcccaatatcatttcatttgtagtaggtccaccatgtatcaggcagacctttcacagtgatagatagtatacagaagctaccatgctgagatagcaacagtttgccataatctcatgaaacaccactaataggagactgctggcagagtcaatataatgcataatgtgcttagagacatttctgaaccaattgtaccagtcatacatctagcacagaatagataagtaaatggaaatattgactttgacacaggagacatgttttaaacaagaatacccaagctggataagatttgaggtcaattttggtaacttttaaaaatatccctgtctaagtattgtgacttttgtcccaagtgcacattactagtcactttatcttaggatacaggcaggtagctaagtaattaattcttaccaggcaggttctgctaagcctcctctggaagatgacctttttaaaatgttgacctcacatatagctgaatgatggatgtgtcacttactggcaagctcttttctgttttgatggggagtgtttaagatcattggacttgtagtccacctggtaaatggtgacaggattgtgagtctggatatgattgagcagtttagtaatatatataattttcatgactgtctgaaatctctagacaccttttcacttttgatcatgatttcaactgctgccgcctgaattacaaatcaaatgttagaacaatacatcatgatgctagaggcatagcttaggcatgccagcaagccaaatattgagttttgtgaggggggttgtgaaagacaactttttacctatttggaactaacttgaaagcatagctttagatttacaaaaatttaaggacacggggattgctattttgttaaggcttgtttagggacattgaaccttaaaagtctcaattttgaagaagtagtgattaatatcatttgggacaaacaaagattttagagatgaaatggtaggtgaccttgaatttgtaatttgtttgcagtgtatcccaattaagagcgtggaaaatctctggttaatatcaaatgtaagtactctacattgtaaaactggcagtaaagatgggaacatctctgtaaaatagttttatcaaatgagtggcttagtgtaagaatttgatttaatttatatatatacattatattttatatggaaatacaacaacataaatacatcaaatgtgctttcatcttagactctgaaaattggttaatgcctgaaaatttctgaagtcctggttgaggtttgctgtttctcaggtgacttagggctaaggatttataacttgattctaataaattctgtatgtaaaataggttaactttatttaaaaggtctcatgaaatttttaagtgattataggacttacacttaagttcctgagctaaatttcttctgtcttataatctgactgatgtcttcagtatgacctctagcttctgaacgtccattattttttctcccgtacactctagtttctctagtactatcttgagaaattacagaacaggtatttgtgaaatattggaagcatgtacatagttcctgtgttattcatattggggatcagtaaaagtattttaaagctagatgtcatagttttattcctctgtctcctcgatatttactccaaaaatgcaggaactctacaagaaccatggaagcatgctactatgtttgtgtttatatgtgagttacaagtcagtccctccaaacacccactccccaggaaatatacctggacatgttcatcatcttaaaactactctgatattatactataaaaataatgaattattcccttaaagaagtatagatgtgtctgagaaaataaaaacccatgaatcttcggatcctttaagaattatttttttggaatcttgatatgtcaagtgattcaaaatgtttgttatatatgtgcatgtttgtgtgttgcagacaagataattatatggagcaagctaattaatttattttttcttattaacaatttcttcatttactgaagggtgttttaaggtaaatatctttattacaactaaaaatgtactgaagaatatgtcgtaatattagcaagatttgcctaagcctgtataaccaaattggctaaaacaaatatatacactcttaagataaactaaagtgaagtttaagccatacacatattgttatgaagtctaaatttttgtaataagaaataggaattcatcactggcaagagatttttagttgtaaatgcttataaacattttgcaggtatttaaaatcccatttagttatataaatcattctgtggaaaataataaaattgtgtaagatcagaattgttccagaaacctaggatgcaggttactttttaaggataactccagaggcaaaattaaatatactcattatcaggttttatatactcattaatatatgtatatgtaacattaagaattgcatagttttttccatttataccaagggaaacaaattggagcttttaaataaagtctttgatttattatattttctccccacagataaagaacttttgttctatttttacctttgtgattactgcataaacatagtgatatatatatatatatatatatatatatatatatatatatatatatacatgtactgtatctacaaatgaaagaacatttaatggaattaagatactttatcagagaacagtctatgtttactctataaaatactacctactcaaattatccttttatattctcaatataaaaatgatgaaaacaaaatctacaaaatgtatgaagataaccatttgggggttttgtttttagtttgttcaaatggatactttactccactgtggaaccagtgggttttgtccctgatgtaacagtgatatttatataattaaatgactatttttgaaaatgaccctcaagataatctatacctgcttcttccttataagtgaggaaactgatgtctgtgacgatgaagtgactgacttaacggtatgcatctaattggttgcagagcctggattaccacttttgatgtttctcacttacctgagcatcagtgacatatatcatttggtgcaatgctggtttacaccactcactgcttcatctacctgccttgttattcaaataggaacaacacattatatcatgggattaatacaaatagtaaatgtacatattagtcaggaaatcagaaatcatttcaggttttttaagtcggaagagtttcaacttaagaaattagagaactacataaccaatggaaaaactgaaaacagagaggtcagggaagctagcatttgagttcacgaaatcagaatgttggatgatcaggaagccattgctggctatatgtgcaccaaagtgggtggttcacaggaggagctcactcaggagctgccacggactcctcatctgtcatctgattttgctacagctgcccttggaaactaatggcccatttttctctcaacccccaaggaaagtacaaatgcttcgagttggctgaaacagttctggaatatacaaggaaaggagttacagaaaatgtagttacaggtttccccttgtgatagagagtacaaaggggccgtaatgatgctgagttgacaataggcaacatataaaccagcatgaaataataacaccggacgctgtcaagcacagagaggtgtttggtaaaaaatattaaaagaaatataactaaagccaatgcctgcatttttaaaagaacaaatttaggacaaattgaaacattttaacttgatttgaaattatctaaccaggaatggttaggcatttacttgaatttagatttaattaatacatgcacatgtatacatataaaagttggagaagtttcatgatagttcttcttgtttgtggggtgtttgtctgaacattatctatatttactttgttcctagatttttttaatggagaatatccattcagtataacattcaaaggttcttgggattaggatgtggacaaaattgagggtccattactcagcctacagcagaaattgtagttccagtaacagtatgtaaaattacaaaaatcttttaagtttcccaaagacatttctcagtgtactagaacactttctaagcagtattgtcagtgtacacagaaatgcagatatgtatggtaaagcagtacattgtgatgtgggttatttggacttgagtcattttgcctagacaaaaagaaacttttttcctttgcaagtaatattaccaaaatatttcctagcctcatttgatctctaagcttcaccacacccctggctttcttcagccctagtgtaaggtgagtaatgggttgtgcatgtaaagataatgcgtaccacggtgtaagggccagaaattgggtgaagtttactgatggaaggggttatttcttacacattgcttcagttagcatccttttggtcagaagaaacaaaatctaaatcaaattggcctaaattatgacagagatgaatatgtttattatttaaccaatatacacagacacagggtcggctttaagcgtggttcatagtttgagttagaggttttgatagcattaggtctccagcttgattcctctgtgattatgttggctctgttccctgctttcccctcccaccatccacttagtttgttttggggtgatatacgattgacttggaagatactaaactgtacacaggaagggttccctcaaagagctcctcatcatgtacattccagaactctcctaaaaaggattcatctgcagtctcatagtaccttgtctgcagtttttccttaacctcctttaaatcaaattttatattagttctctgtgtacacattgataatgacttgttaaaccagggtttagaaagcagttgcctgtggaacacatgtggcccacagcgtgtttttgtgcagcccacaagctaagaaaagtttttccagtttttaaaaggggtgtagaaacaaaaggaaaggaataagtgactcagacctcatgtggcctgaaaatcctaaaatatttgctatctgaccttttatagcaaaaggttgccaacccctgtgttagactatcagatacaaggaactgtcttattcctgacacattgctgttgtgcctaatgcagttgtttccacatagtgctgtcatccttaaattgttcttcccatctaccctccttggtcaagcttttctgtttcattcggggaggacatgttgccatgggatatcttattaattcaggaggggaagacttgtgggagatggctggtggacatagatgagataaaaattctcaccaatgataaagtatctgggaactaaaaggaccttgaacaatgccctgtccaactgcatcttgctacagaagaagaaataaggacaagggatggaaggggtgtacccaaggccataggtcataatcagctgctaaggcatcatcaggaccctgcatcttggtccagtaccacttccaccaacccctgttattttttgtgacacaacatcttttccttataaccaactcagatatataccaagctgctgtatccatgcgaggaccatccgagactgttcttttaacccaagagtttcccagaattccatagttactgctgaaaagagtgagagtgatcaagaactttcttaaaaggattttctctttcattgtgtttcattttcttcaacccatctcataatacctcttgagatttctatagtcctttaatgctatgtccttgttccttcccggtagttatatttcaatggccctagcttcaagatgtctttggctgctttctaggagatctcgttgatattatctcatttatttattgaataaaggtggtgacaaaaatgtaccagatcttgacggtaacttatgtgattgttcattcaaagattgctaatggcctgttaaagcccttagatttattaatttcctcatatctcattctccttgattgccctctcattccaactattaactggctttgtaactatagctattatggtacttcagtctccaacttgccttccgatttttctgatagctccttcccccttcttagttctaattttttcttccaccacctaagtatgataactcttagtatatttatttcctattactgctgtaagcattatggctaagtgacttaaaacaacagaaatttattgtcctagatttctagaggtcagaagtccaaaatggggtatatgggttaaaattaaggtgtcagcacaactgtgtacttttggaagctctagggaaaaattaatttccttgtcttttctagcttctaagagaggcctgctttttttgccttgtggctccttcctccctcactccaagctctgtttctgtaatcacatctcctttttctgactttgaccttcttgcctccctgatcacattgggaacactggaagaatccagaataatcttcccatctcaagttccttaacttaatcacatcagccatgtcctttttgccatgtaaggtaacatgttcacatattctaaggattaagatgtgtacactttgggggccactattctgcctagtctacttagattgccaccattggatctcagttgcattttatttttcaatcttactggtaccctctgcctgtttaaaaatgtaaattgttttacaaaagtatgccttgattcataaaggttatttatttgcatttcaaacttgttttctgtaaaattattccaatcgattcttactttaatttacctacacctcaatttaagctcctattaccacttgaattgattccattcaaataatatcatttgaccccctgatttcatcatctggaccatctgggtactccaaaagagtaacctaaattacttttcaaagtttttccctttactttatgtattctcaacatactttattctctcccattgctatgctttttctttggtgtctgaaattccttctttgaaaactctagtcagaatttcttatcattattcaaggtctgtatctcaatggtgacttcttcaaattaataattatttataccacaaatcctatgtgtctcaaccccttttaaattctgcccttccccctattgaattttgttattgtatctggcagtagtcatttttctttgctttgtgttttatgtaactgtgtagtgttctgtcctatcctcctaccacaccacccagggaagagaaaacacatcctgcccagattcatatctcctaagtcctgctccgatgttttgtacatcaaagtataaataatagcattactgtgatgttatttaaaattacactgtatgtggctgtgctgatttaagatatgtgttgaagaattcacctgccagccaactatacctaaatgactgtctcctgaatttatttcattaggagactttttctgattttaagaaacaccttctggcatagcttctgagttatttttgaaaaccctattatagttatgttggatagatcaagtaatccagggtatgttatgcaacataccctttctgtatttgtgtattcattagttgcattcatattgactgagaaacactgtgccaatgttatgaagggtatgcagatgtgtatgccaaggtggctgtcttctaaaagcttccaggaggatatgttccactgtgacttttccaactacacaacagcagaattctagcatttagcatgtttgtgaaactcctagaggcaattaacacattatgtgacagaacctagctccttaatggtattaaaaatgcttttttgaggccaatgagaacttgatatacagcaggataattctttagaagtatcttttatttgacatttattagaaatgaagttgtcatgaaaaggcatggatgtttatatgctgctataagatagtcatctcagcaggcattttgatcagtcattacctttgacagagaatggcacaatagcatgagagcctgcagagctttctttaaagatggttcatataataggggcatcgtgatacttggagtattaatccaatattgagggaaattccgtgcccctaatgcttgaatatctatgcagattttggaatatgtcattttcagtagctttgacagatatgtaaataaccatttccccaaacttcataattgcccatgtcattaatttttctttttactgttgcagaacattttcctctttacactcaagaggataaattattattgtggttccatttcattggaaagcatacacctgcatatttgagaatctttaacatttgaatgtataatatataatataattaagtaaatcttcaggtattgaaaatgtacttttgaataatcacgttggcctcctgataataagcagtgaatagtaattgattagattagtatgctatttttttgaatatagtagcagtgactcaataaggtttaattgcattcctgtaaacatatggatggttcaagaattacttctttgtaaataatataaattggtaagactctgaagtgaatgacacagatttgatatagtaagacatttgaatttcagcttctctgagcactgatactatttcatcattgaaatacaaaattatggaaatgctgaggaagaatgaatgcttatttataggcacaaatcaccaatattaagctgttatcaaaatctttacctaaatttgttggttgcaaagttctgtaataggcttaaaaatgtgcagtgttcagaaagtaaattcttatttgatttgccagatgcaaataatgtatttgttacgttcattcaattattaaagaaaatttatatcattcttcctatcttgtagggttgatatatattacttggaaatgtgagacaaacgaaatgagtgtaaaccctaagaatatccattggtggactaaaatgtaaattttaatttctgtattctcatgtagcttaactagcatttagcatgtttgtgaaactcctagaggcagtttccacattatgtgacagaacctacctccttaatggtattaaaaatgcttttatgaggccaatgatgtacaatgtacaataatgtacaatgtttatatacattgacttgctaatttattaagtatccacattttagcctcttagacctactctgaagttgacttaactttcaagatgaacagtcatttttgacaccctgccatccccttgcaacagagaaaggtatcctgatttttgtgattctctggcacctaatagatgcctcagtgatatagtgttcttatgggaaggttatattgtattttaaaacatgaaaataccagaacagagtcaggatcatgaagccaactctttaggggggtacattagctggttctaaaaccttttacctgtagaatccctattcttgctcccagatgctatattgttattgcagacatggatgttttagctccgttagcactggagacaagcttccctacaccatagtagtaatatagggagagagaaccagtacatcttgtgtgaaagtttctttgcatattcaagtagtttcagaggcagcccaattataagaattaggtctataatcttaaatatgctgtaaagatcattaattatctgtgtaaatattggagaggatcagcatggataattaaattgaatttatttgaacataggcagttttcacattggctgttgaagttgctatttgtgcaaaatatataatttactataattaggacactttctgagaagttttttttgatgtgccatattttcatgctcagcagaaatacatataaagcataaatattttcttcagctacatatttttatttaaataatctccattattttaaattcctaaacatttatattatttaaaaacctgaactaatctcattcttaactaggtttgtaggctgggagtgtcagagctatgtataggaaaatttgctgtctttttactcattagtctaatcaagactagaatagactacgttgagtgtttactcatattacagatgggactaaaaatagaagatttccaaattacacatttaatatgaaacaggaagtgattttgatgtagactatgtaaaagttttcttctgactttattaggttattttttaattcataaaaagaacccccaattgtcttgatcttttttctaaaatttgaacaattaaattttacctttacctacagtggctgtgaagaggatctatattacgtggtagttatttgtacatttaattaatttctcctgtcagtaggactgaaaagttttattcatttatttgtacttacagcaaagataaagttagagaagtaattaaaatgtgggttgttttgctttcccacaaatattgaatgtcattgacatttttgtatctcttctgttagcttaattaagagttgaattattttaagcaacagttgtatgttttagtcattctaaaagtttaatctacctgtgaaaatccacttttcacctgcggtattatgtcaaattgttttctctaataacacttttataagtacagtttatctctccttagcagtataattttgcaaatgtcttgaaagtttctgatttgtatgtgtctccactagtttactcttcttttttttgacctgggactagatcttagaatggtctgtacatttagtaatactcatcattttgctacttttagagctacatcctggtttcattgtcgtaaattgaaagataaatttagaattcatcttgccaatgagttcagacaagaagaacatcaaagtcaacatttaatgtgaggaaattgaatataaactagtacttttcatgaaatcgttatatgtgaacatcagtctatatgaagtcccatctcagtgaaatatctaacaaagtatggcctgttaatagtttcactatcatttcaagtaattttaaaatataacacgtttctagcattataaaataatttagaatataaaaggctcctttccatgtgcttattgccatttgtatattttctttggataaatttcttttcaaattctttccccatattttaatttggttgacttgagagttttttttagttgtccctagactatttgttgaaaagattattatttcccacattgaattgtcttgttagccatatcaaaaatcagttgactgggatttctattacctcaaacattaatcgtttacttgtgttgggaacattccaaatcttctcttctagctattttgaaatataaatatgtacaactattatttatcaataaaaaatcaattgactataaatgtgagggtttattttaggaccaccgatgtctgttcttttgttcataccacacactcttgattactgttgctttccagtaagttttgaaattgggaaatatgagtcctccagttttgttcgggttttcaagattgtttttgctattcttggtcgctggtaattccagatgaattttaggcacatcttgtcagttttggccaaagcgatgctgagatgttgaaaaggattgccttttgatagggattgctttgtcaatcaatatgaagggtatttccactgtaatagtgttaaatcctttgatccatgaaagtggatttatttaggtctttaatttctgttaacaatgttttgcagttttcagtatacaacttttgcacttcttttttaaaatttatccataagtgatttattatttttgatattattgtaaattaatttgttttcttaatttcattttcagattgctcattgtaagtgtatggaaatcaaattattctatattaattttgaatgctgtatccttgctgaacttggtttttagctctaataggtttttcatgtatatgtatagattccttagtattttctgtatataaaatgatgtcatctgttaatgcctatagtttttcttcttttccattatagttgcctcttatttctttttcttatctaatttccttggctaacgtctctggtacagtgttgaatggaaatggtgagtgtggaaactcttgtcttcttcctgatcttaggatccagccctttaccatttagtatgatgttagttatggttttatcatagatgccctttatcaagttgaggaagttcccttctgattccaatttattgaatgctttatcatgaaagggtgctggaatttttttttttttttttttgagatggagtcttgctctgttgcccaggctggagtgcagtggcacaatctcggctcacttcaacctctgcctcccaggttcaagcgattctcctacctcagcctccggagtagctgggattacaggcacccgccaccatgcccagctaatttttgtatttttagtagagacagggtttcaccatgttggccgggctggtctcgagctcctgacctcatgatcctcccacctcggcctcccaaagtgttgggattacaggcgtgagccaccgtgcccggcctggaattttttcagattttttttttcatcttttgagatggtcatgtggttttggtttcttattcttttaatatggtgtatgacattgattgaattttagatattaaataagccttgcactcttgggaaatattcctgttggtcataatatatgctttttatatactgctggattctatttcctattattttcttgaggaatttgcatttatatttattagggatattggtcagtagtttttacttcttgaattgtctctgtctggttttggtatcagagtagtactggcctcatggaatgaggtaggaagtttatcatcatctttgatgttttggaagaatctttgaaaggttgatgttaattcttttttaaatgcttggtagaatagaccagtgaggtgtgggaggtttaaattttatttgtgtcaagttttaagttactgatgcaatgcctttacttgttacaggtctatttacattttttgtttttgttcttcagactgaataagttgaattaatctattttcatgtttgcagattctttcttcttccagctcaaattggccatggtgtatctctggagaattttttgctttagttgttatactttacaactccagaatttaaatttgcttcctttatttaatttttatctctttattaatattctctggttgatgagatacaattattaagctgtcctttatttctttaactatggttttctttagttatgtgcatattcttgcaatcgctgatttcaagtctgtctagtaggttcagtacttgggctccctctgcaacagttattattgatggcctttttcttgtgtatgggctatacttttctattttgtgtgtatgtgtctcaaattttttttgttcaacatgggacactttagatcatataacatggctactttggaaatcaagtctgtcctcctccctgaagctccagggtttgtgtagttgtttatttgtttagcaactttccttaactaattttgcagagtctgtattcttttttaaggcacagccactgaaatatcttcttggctaattcattgctcaggtaatgattgagaatttttaaaaatgccttgaaccagtaattctcccaacctttgcccagggtttctctctctctctctctctctctctctctctctctgtgtgtgtgtgtgtgtgtgtgtgtgtgtgtgtgtgtgtgtgtgtgtgtgtctgtatgtgtaagcacattttcaatattctggcaatttacaactctgccttagccttttcttccaacttgtgtagaggtgggagattaaggtgatctcacgtcttttctgggcatgactatagctctgaacttactcacagcctactagatccccagaaatatttcagagctttgcaaggcctcctatgaccatctcattttatagatttttcttttacattttttgtctatcttcttgtttgtcccatgtggcttcaccacctaaggcagctgcaaggctaaataattgagactgatagtttttgccatattagggatagaactttcctcattgagcaaattctgagtcaggtgaaataaagagaaattcttgaatggggtttttcagccagctaccagagagataaaatagtagtagttctctggggatggagctttgtgacgagctccaaaccagtttgtcctctttattggctcctaggctattgtttttttcaaggctaatacagacttggggaaagagggatggaaatagggaaagttaaaatataacagtgtttgttatttttactaaaagtcagccatttttcttgaataaatgctgttcagattgttgctagattttgtttaattttcagagttctgaaaaagttgattttgataattttctggatttttttatttcatggaaacaagaatttcagagtttcatactccactattccagaagtacttctcattttaatatttttgttttctttatgatataatattttgacaatttttgattactttgtacttaactttttaaaaaagctattaatggtttcagttttttaaataattacaatagtgcttcatatgcttgaagtacttattcttttttattattattttatattgatataataattgtacgcatttattgggtatagtatgatattttgatacatgtgtacaaggtgtaatgatcgtcagcgtaattagcaaattcatcaccacaaacatttatttctttatgttaggagcattcaaaatctttcttctagccatttgaaaatatacagtaaattgttaattctagtcaccctgcagtgctatagaacactggaacttattcctcctatatcaccgtatttttgtatctattaacaaacctctccatatcctccctccctcctacccttcccaacctttggtaatcactattctcctctctacttctatgagatcaatgtctttatttactcgaagtactcttaaaagtttaggacttaagtatttgaagaaattcacttgctttttgtttttattctactcaatactttttaatataaagatttacagtcccccaaattctcttttcagaatcttaatataattattcatttcgtcctgaaaactgtttctttccaaaattaaacatttgttgtcatttaataaaaataaaccagaagtagaagagctggaaaatccctccaagttcatctgaactggagaaaaatcaagtctaaattactaaatattttgaaaagtacagagttttattacagtaaactttgacaagttgcctttatttggaaaagaaataacctatttttctatattctattttagagaattaaaatacatttaaagccttatattgggttggtcaaggttttttttttttaaaaccttagtagtttatttttgtattcaaagtatcttccagcatgtctgttaaatttcttatttttttcaattttttttttttttttttagattcagggggtacatttgcaggtttgttgcctggctatattgtgtgatgctgagatttgggatacaaatgatcatgtcatccaggtactgagcatagtacccaacagttagtttttcaaccctccctacccccttagtaggctctagtgtttattgttaccatctttatgttcatgagtacccaatgtttaacttccacttataagcgagaacatgtggtacttggttttctgttcctgcattaattgacttaggatgatggcctctagctgcatccatgttgctgcaaaggacatgatttcgttattgtataaaaaaccatacagctgcatagtattccatggtgtataggtgccacatattccttatccagtccaccattgatggggcacccaggctgattccatgtctttgctattgtgaatagtgctgtgaagaacatgagggtgcatgtgtctttttggtagaatgaattgttttcttttgggtatatactcagtaatgagattgctgggtcaagtggtagttctgttttaagatctttaagaaatctacaaacagctttccacagtggctgagctaatttacattcccaccaacagtgtgtaagtgttcatttttctttgcaaccttgccaacatgtgttctttcttgacattttaataatagccattctgactggtgtgagatggtatctcattgtggttttgacttgtgttcctctggtgattagtgatgatagcacatccctttagatcaataccaattcaatataattcaaatatctatatttactgaatgttatgatgtaattgagtttcttcacaatctccacaatcctttagaaaatttctaagctttaactaccttctatagatttcatgtacaacatgtaacataataagggatagcagatgaatggacataaaaagcaattgggccttttccccgatatttcatgtgcaactaatgaaggagaaatagactttgatttaaaatctactggtgacttttatgtaatgtagtgggcttgagaaactttcagtatttatgggttcaaatatcattttataattttaataatgcatttatgtaaacattaagttaatgttttctgaaaagtacagcatgtatttaatgcaataaccactttcaaattatttattgaggtgaagttttcttgtaatgaaatgtagatcttgagtgagtaattcgttaagttttaataaatgtatgcatatgtgtaactcacatcctgattaaaagattacatttctatcactccacatctttacttcatgctccttccagccatttcctaggtacacaccaaaggtaaactacattctgatttctattaccatcaattaattttaactgctctagaacttcatataaatggaattataccgtaggcaatttttgtgtgtatcttcatttattaaatttaatgtttaaaaaattcatccctcttgttaggtatgttggtttttcatttttatttctttattgagttttttcacataaatacacagtaattttttattcattcttttggaatggagatttttttggatatggcttcaaatttgggactattatgaagaacattcaggctatgatttttcaaaaggggcatgaagtttaaacaaaaagccttcttataattctgtagaaagtgggtaatgtgtgagtgtgtatattatgcattaatatgcttacaaaaatgatatatatacacacatgctaaatgtctaataataatagtaattataatgacaagtaacatttgtttatgttcgctttgagctgggctcttgcataagtactgtacatgtttcattccatttactcctcacaacaatttgtaaagtaggtaaattaccatattatctctgacaagtagactgtgcattttggaggataagtgatttgcctaagatcatgcgcctagggagcggccaactggggatttgaaatctagttcttacactgtcaggcattgtactatgcctgctacttcctaatagttaacattatttgagctccactgtgtgccaaatatctgcatgacacacacaaacacacacaccgataatacagtgtagaaagataatctatgtaaagattagcaagggtgcagtggaagaataccccacatagaggtcatttcctcttcagaggattaaggcaaaggccaccaaagtgacttattagaggcagaagccagtcagaagaggtataatgtttgacctacaaagggcttaaaacttatattctgtttgttgccaacatttaaaaattaggatatcacgttaatatctggatttctggcatcctcctacacatcatgatatctgaaaaccttgcccattgccatggtctgaagctgaccctcaactacttcccttgggcctgcagccagccttgatggcttatgctttctgaagagaggaatatgagtttatgaatattaaataattttttgaggagtggctttaagctttaccttaaagaatttcaatagagatttccaggctgtgtgagggaatagtacaatgcaaggaaagaatggcacttgctgggtgagctgaaggaataggaattaggtgggaactatctcgattgcccaaaatccagcacagtggggggaactaatcagaacataagatctgaccttaatatcttaggaaattctatgttttgaaagcttttatagaggaatgacaaaatcagagctttaattttctaacaggccaaatgcagcctaaacattgcttattccagaaactgtcatttaagtgtggttatttgaattgaacatataggctgaaatgcaataaaccgccatttttgtaggttaaaaggaataaagtatcaagtacatgcagtttggcattacaagtttgcctagtagcactttaaatgagtcactaatttaatatattatttcttttataaagttcatttatactttctgaaccaagacagtggagctggtacaaatatacactgtaatgcctccctatttgttgtttcctttaaatctttaaaatgtgtttttatatttgttttttgagatgctgaatttccataatatttattagaatattatatgtattgagatgatatttccctatgttagggagaaaccatttgtgttatataaacaaacaataaagttgtctaaaaatagaagatccttttggaaatgttgatgcctaaaagacaaaattatgtggatgaacatacgtaagcttcagtgagcttttcttgtactaggcatttagctgtcttgcaactgttaatcagcacaggccttaaaacagctgctatcagattaattagagggaatccaggaaataattcaactgaatgtagcattcatgtaagtgtgttgaaggcaattaagagtaactatagtcattactgagacttccaggaagtatgccaaagggcttgaaagttataaaatgccttttgcttcccaattttatatatatatatatatatatatatatgacagagagagagagagagagagacagacagacagagagagagagtccatatataaacacacactaatagcaattaaaaataaataaaattgaaaagcttgaattacagggtgttaactcacttctctctttgaaattaaggggccaagggaaaacaagaccatttgtctaaattcatttagaaagaaaaggatttatttaaagatgctgtggcagataaaattacgtttcatttttgtaatcctagttttcatagccaatgaaaggcttaaaataaaggaagttgatatttcaccaaggtcacacgatctacgagaaggaaacttaagaaagtttcctaatgcgggatttaaatccttaaaaacttgctgtggtcatcatcggcatcatcatcgtcatcatcatcaccaccaccaccaccaccactgctgccattaattattattattatcatgacacaaaggttgattacctggcatctcatctcatttctactgttcttaggtttcttgcctgtcttactgaatgacagtatgttactcaaaactcagcatggcaaaaaatctgggttttttaaaaccaattttgcctgtggttggcaccttgaaaaaaaacgagagaccaagaaagagggagccgaggatgggagtggaagataaagatttaaaagaataagtattgatattcttttctctttatttttaagtgacaaaacttatatatatttatggcattaaatatcatgttttgatatgcgtatacattgtggaatggttaaatcacactaatataggcattacctcacatacttaatatcattgttttgctatttaataggtctaaaagctgaagtcagagaactcatttatttatgagaattttggtgtgcaactgcattttgctatgtgttacagtcttttaacctacttccaaatctcttcttaaggatgagctagaaggagagactggctgacactcctcatttttgaagccttggcttttataaaaggggccttcagtgtagcaaaaggcctacttataattctgtaaaaagatgttcatgtttttcaggaacgtttgtctctatttagaaaaaataaaatgtagtttgggaatagcggaaatgattgattagagtgttacacatgagacaaaaagatagatgggcaataccgttcctgtgttttcatgccctgttcctcataagcaacagggcaagagatgataattcccaggagaagcaggagaggcttctggatcatgaggtgctattctcttacagaggtgctaccacagttactaggtactcattccacttcttttttttttttttttttttttttttgagacttattttgattaccaggcctctggtttaccaagtgtcaagcccaccacggtcccatcttttccttatctccctcttcaatattcctgtctaccaccacccttccctcacccacatagcaataccacataccatcatttttctccaagccccatctcttaccccttgcaaactctgccattgttttcatcccagttcaaatttcctccacacaataaaatgttctccccatactgtgacttccttgaccttacgttttcctaggtgttattatcttcaccaaatcactaagtgtagattatgtatctttgagtgttcatggattcatgtggttagctctactttagcacgagaaacaaatgccctggaatcactctaggaagaacgttagttgctatgtggaaataaggagaaagaaatattttagggatggaaactgtatcacagaacttcagtttttgaaaaactggaaggagtcttagaatccatcccgtctaaacccctcatttgagagttctagaatctgagagccagagggcttgcacatctggtaagtaatggagtatattcttttgacagtaagtactaaaaattaggtcttgtaattccctggccagtatactttccacaacactacacagaatctaagctttggcttatattatttgaacaacttgaacaaaaatgaggtaccagattttgacagctggaaataaccggaagtaaaaggggttagtattccccaaacaagaaatagacgaaacaaagatgcagaaaagagaaatgagtgtggtcctgttagggaagaacatatgggtcagtacaccatatagtaccaaggctgggtaaaaggagtcttggtgaaggcaataaaaggaaatgtttttctgctaaagaaattaaaagtaatattaaaacaaactcgggtttttgtcttccttttttttgttatcaccatgacctggcaattgcaaacaataccagtgataaactattcctccttgaaaaaaatactttataatctaaattctaaatagtatctgctgttataatcagtatttaataatatatgtataagcattaaattaacccatatttattatatgcttgaataaacattgaattctacttggaagtttactaggggaattcctaattgtaatggtgtctctgacacatgcacactgaaatacgcacattaattttgagagtaaatttataaaaatttcaaatgattggagcttgcttcagaaggacttcatgtctccagctcctatggcactacataatcctgcatttaaacagaagctttgaaataaaccatgtgaacacattgattataaaggtgaggaaaaagaacttgagttagaactcaaattagaacttcgttctattgtgttattctgtgcgaacacttggaatttttatatgtgcttaaagtttaaaacgatgaaacagtgcaaatgagttataatgtttttggtaaatgcaaatttcaggttataaattttccagaattttagtaatatctctaacattgaaatttgaccttcttgatgctagaacctataccaaactgtggtggacagaatttactgtatcctaagcaaaatatgcttagaagtaaaattaatattacctatgttttttcttatatttataattttataaatctgttgataattaaaattaatgaaatgtatttcatgatttagatggactttaaaatatgactataaagcatcatttgtttagtgaaacaaaatataagtaattggacactattttgaaatgatattttaaaataataattacttttaattatatgtgataccaaatttttaaataaaatgtctattgaacagctagtgttcaaggcattgagcaaatgcatgttgacagtgagagctacaagccacatctaaacatcaaggattaatccatcatgatgatgaaaaatagatagcaactattatcagtacatatttttaaaaaatttatgactatttaaatgggaaataatttgtttaagtttttacattgcatatttcaacaacttgtcttgataaaggaaactcaggatgtaagcctgacacccaaagagagttggagggaattcattcattaggaaaatataaggaagaaatcatgacatcagttacctctgttaataaaaaaaatcagaaaagaacaagtaagtaaagtggcattttagaatatatagtagagtttaaaactgttaaatatttgagcataagtattttgctttgagagagaagaaaaaaatactacaccaagtaagaagtgctagttgcgtctcttagagtgtaccaaaacgatattggacattggagcctcgttatttgtcacctgaagatgactcatgggaatagaattctaaagcaatggaaacaggcactttatataggagtaaatatcacaaaacacatttttaaactcattattttgaaatatatacttaaagaatttgcaaaaatactagagttcacccatcttcctctgatagtggcatttcgtataaccgtagtacatgaacaaaatcagaaaattgacattggcacaatactgttaccttaatatagaccttattcagatttcaccagcaagcacattttttaacactaaaactttaaaaggatttaaaatatatatcctgtttttaaatcttattttttgtgagtccatagtaggtgcatatatttatgggttatgtgaaatattttgatataggcatgcaatgcataataattacatcagggtaaatggggtatctatcacctcaagcatttatcctttgtattacaaacaatgtaattatactattttagttatttaaacatgtacaattaatttaattgatttaattttacatttaaatattttttgtggataaaagtatttaaactaaatttaacttaataataagtatatatttctatactcattttctgaatatgagttataagatggttggactttatctctttattctatgtcttaaaagacttaagcttccgtgtctaagttgtacttcccaatggagtcagaatcactgagactagaacccctggaagctagaatgagacagatacagtagtaactggagctgtggggaaaccttaggttatatcctccaaatcatcttaacagcaacaagtatggaacctaatttccaatggaaatatgttttatatgtggtcttgtaaaatagtcctgtttatgaacaattctatttcagtacgacaatagacatactgaatattaaaccttaaattccagcagagaatttcagaggaaaatatttttttcaatataatatgaaaaatagtgtcaatgtttgtcaaaatgtgactctttgaatattctaatatactaagcttgaaggaaaactataaatctttttgaaatgtcttttccattttttattttagcaaagtatgcaatacttaatattccagtagtctaccagtagacaaatttacacttattatgttcaccacaaagtcttttatgactaggagattcagaacttcttataaatcttataccataatgcataacttagaataatttacataagaaaaattcaactcaaagactaaacagataccaagaataacatattacatatctaaaattagaaagcacacagacacattttagagataatagcaaaagctttttagtgcacaaataaagttagtagaagaaaaacaaggtaaaatgatacatatttttaacattacagaacattactaagaatacattgcctaaaattgatttataaacagagaaaagtcttatgctcacaacccctctattttaatataaatttaaaaagagagaaattgcaatgaaattgataatcatcatataagccatgatttgcacctttggtacacatcataattgcttggggagtgattttggaatacaccagaataaaacctggtaagtggtagtttgagataaatcaaataaaacacatttttttttctataacaaacaaaaggccaagtctggaatcattggtttctgtatggtgtattttatccaggactggcttatagattatttaagagttaaaattatgattacatggtcacatatatttgactttagacacttttaaatttagctatatattttaagtagagattcttatgaatatggaaataaaataatgtacaatggtatgataatctgatttatctaaattctgagttctagacatgccagtgagctacactggtagtaggactcaaaagtgcattatgtagggaaaaacatgatgaattgatttcttaaatctttctcagctagtggtcccttagtggcttaccctggtttgtcacctctcccatgatatttatcaatacttatgaacattttagaacctttctagccataatttggaacctaaaatgtttacctatgcatgtacttcaaggataaatatgttatgattatgttatttgaaggacctggctagagtggagcctacagctgaagtaaccagagttgggagggtatgttacgatataaatttcaaaaaaaaaatagttttaaaatatggctatgtaaaaataacttctattacttgtattttatgaacgattcaacctgtataaaaaatatagttctgtggaaaaagtttgatattagagagttctgttctttaatctctgccacattttcgctaaacatcttttctttgacctcggccaaattccttaactgttgaatctcctggggtgcctgtgagaattcaaaatgcacctcaaaacagcctaatacatggcagacattcagcaaatgttccattctcctatcccctaattatcacacaagacaattacttttaatctgtacatattgaggagctttgcatgttgtggacactttgtcaatattcgttgaaggaatgaaattgtggattaaatttgctgtattataaaactgatatcttttacttaataaaagcttggcagtatgaattgatagaaaatgagtaagtctatttatttggtggtaatgaagattactgggataagtttccaaagcaagttataaaatattgttccattaaacttttaaaatgggatttgttttcctgctttttgcctcatacagaataagtatggctctgtttcaagattctggtgtgttcatgatgacctctcaagatcaattctgaatcacagggagaaaacgttgaaatgataaagacatggatactagaaatgcaagcaagttatagaccattttatttacccatttttttttttagctcaagcaatttcgtgtcttatatttatggataaagttgaaataaaatttccctttttttctgttaaatattaagagtctggggattagttatgcagcatctatttatttatttctgtcttataaaaattatcttaaagggcttggcttaatttctataccataaagaaaaaatgtgtaagataatccctcgctatcgggatcattttcttatataattaatgagctgaacgtaaaagataggtgaatctacaaatttatttattttctgtcttataaaaattgtcttaaagggcttggcttaatttctataccataaagaaaaaatgtgtaagataatccctagctagtcgggatcattttctcatataattaatgagctgaacgtaaaagataggtgaatctacaaagaaaatgccccaggtaccatccattaaagcatgttgctgctatatgtgcaagatgtccagggtatggcttccataattataaacaatttactatgtctcaattattatttcaattgttaattcccttgtctctggattgatgctttagtgcatcatttattgtggatattttggataaaatgaatctttggattttgtaaaaacaatatttcaaatttgtatgcatctttgaagtctaaatagcatgttatacaaattgaaaattgactgtaagagttgctacagattcaaattttatgtagtttattttttatatcttgatttgtgaagaaacaaaaaccttaactttgcttggtggcaagaacaaggggattagaacatgaacacacaggatattcagagcagtgcgtttgtaaggcatgccttatttgagtttcaggtgcttgctcattaagatgaaatttttgtcaggcagtgtgtattgggagtttgctacttgaaaatcaatagtctgcattctctgccttattgtttcaatagcctcttaactgatctccctgctttcgctattgagctccctgctgcctagctctttgagctcatctcctaacacttcccctctctccagccttagtaaatgcccccacccacatccatttgtgatatcttttcattttctcccaccaagaggtggagtttaagctccccctttttgaatggcatatgaccttggaaattcatatggtcggaaattcaaatttcccaccaaattcccaccaaagttcccaaaaaaggtgggaacggaacgtaaacccccaccaaatttgaatttgaaattcaaatttggtgggggtttacgttcccaccttttgaatgccatgtgaccttggtaatttgccttgacaaatacaatgtggtaagattgacatcatgccatttctaggtttagaccttaggagaccttgaatgcttccatttattctcttggaaccctgctatcaacagatgatgaaagacttaacgttttactcaccccattcgacaggtggccaatcatcagacatgagcgaggccattgtagaacaagaaatcccctaatcttggctaggtttcctcataggtctgggttagctgttgtgggtactcatgtcttactttaaaatatggttatttaatacctctgtattgttattcctctaagaagatgtaataagtcctctggaagatatgacattaatggacttcgctgaagttttctgtgactctttatgtctcttgacataaaagacaagaatctctttaatagaaacaaagtatttgtctctatatttttatggttgaaaatgtgacttaaactagctacaatgaggaaagaacatgttacttgattgagatatggtgtttcctttagaaaagagaaatgcagttcttattgatattgtcttactggcattgtgtacagtttgatagcattcagtattgagtcttttgtgtcacagttcttgaaaaagctttgattcttgttttaagattacctatatcttgagtgattttgaaagcaagtgccaagaaaagatgttctattgatgtatacatgacaggtgaaatatcacaccttttcagaaggcttctctggtgaatttaattccaaagacaaccagagtggaggtggaagtaaaagatacgatttgtcatgttattataagtgcattacaaaagtaaagaatcatagcccatgcaggaggaatgatgtagggtcttgtttattagacatttttccccagggtttacatagcttagggattatgcaaacaaaaacaaaatatatatagtccaagataaacaagccatattgaaattgatatgtatgtatggtattaaatattgttagatttttctgaaattctcattttttatatattcaacacacattactttaattgtacgtattaaaaaaatttatcaaaataatcaatgatataaaatctctccttatatgatttaaaataatctagctatgtcagattaaaggaaactattctgtacctctatatctggtcaactcaggatttaaccaatagggcccagggtatttttagtctaaataatatacatttatgtttaaatcattgatttgaatctaatggcagcttgttgaaacatcaactgagtgcttgactttcacagacaagtaacacatttttgactgtagcatttcatctgaacaatacaaggtcaatcctcatataaagtataaataaatcaggggattctattgtatacttataacacatattcatatattagaattttatgaagttaaaaagattttattttcttaaagattatttttagagcagtttcaggttcccaacaaagttgagaagaaggtacagggatttattttacaccctctacccctacatatgcatagcctctctcattatcaacatcccccaccaaagtggtgcctttgttacaatggatgagcttattgtgttgacacatcattatcacctaaagtccatagttttcactagaattcactcttggtgttatacattctatgctttgggacaaatgcatccaccattatagtatcatatgtattttccctgacctaaaaatcctctttagttctcctattcatctttccatctgcctagcccctagcaaatactgatattttcctgtctccacagttgtgccttttccagaatgtcatatagttggaatcactcagtatgtaaccttttcacattggcttctgtaacttagtgatatgcatttaagtttcctccatgactttttatgacttgatagctgatttatttttagcactcaataatattctattgtcgggatgtacccaggtttatttatgtgttcacctactgaaagacatattggttgcatctgagtttttgcaattatgaataaaggtgctataaatattcacgggcgggtttttatgtcaaaatacagttccaactcctttgggtaaattccgaggagtgtgactactgagtcatatggtaagagcatgttcagttttgtaagaaactgccaaactgtcttttagtgtggctgtactattttgcattccaaactacagtgaataaaagttcctgttgctccgtattcttgccagcattttgttgtcagtgttctgaattttggctattctaataggtgtgtagtgatatctcattgttgttgaagatttcatttttagtcacaaaaatcatatagcattggaaggaatgttagatagcatctggttaaaatcaccacttaatgtataaacttactctgcaatatttcgttttaagcaatcatctcatccagaatccttttaagaccatctatggaatgcttcttgtcatgagatgcagaaaagctgtatgctaccaaacattagaaggccccagggctcagtccttggacatctttgctttgtgcacttactgccttggagatctcttccagtatcatggctttaaataccatttttatgctggcaattcccaaattttcatcaccaacctggacctctcccctgaactccagacacatgtatcaatctgcttagttgacatctttattttttgtctaaatgggtatgtcacacttagcgaccccaaacaaattccttactttttctcccacacctgacccttcacattcttcctcagtagtaactttatcctttcagatgatcatgccataaccttcattccttttagctcttctttttcatgcactccagtctatcagcaaattctttcaactcttccttgaaaagaagagttgaatggactcaaaatttgactaattctcaccacacctgctgcatcttagcccagtgccccttgtctctcacctgttttatttcaatagtcttgttactgttttctctgctttctcccttgctccctttaactgttttattctgaatatggcagccagcgtgattccttcacttaccaattgtatgatattcttctctattcagcctctacttataatggtcttttatctctctcagaataaaatcccaagtccccacagttgctcacaaggttctcatgcataaacatctggctccccaatgcctcttagtatatccattagtgttttccccttgtttgctcgactccagggcacaaggctcctctgttacatcagacacaccccctcccacgtcagtgccttgcacttgctgttccttttgcctgggatgctttccacacagctatctcatgagtcattcccgctcccctgcctgtcacagtcagctccttcaggtcttttctcaaacacctctgcttagtgagtccttctctagccacctgattaaacttgcaacctacttcttaactcttttcaccaatgactttttatatatatttaaataatttcttattgtctgtctcccttcacttcagatgtcagctccatgaggagagagttttgtctgttttgttcactattatatcctgcatgcctacaaaaggccctgctttatatacaccatagaatactatgcagccataaaaagaacgagttcacgtcctttgcagggacttggatgaagctggaaaccatcattctcagcaaactaacacataaacagaaaaccaaacactgcatgttctcactcataaatgggagttgaacaatgagaacacatggacacagggaggggaacatcacacactgggacctgtcggggatggggggaaaggggagggagagcattaggacaaatacctaatgcatgcagggcttaaaacctagatgacaggttggtagatgcagcaagccaccatggcacatgtatacctatgtaacaaacctgcacgttctgcacatgtatcccagaacttaaagtaaaataaataaataaataaaatgaaataaaaattaagtcccctgcttagtaagtattgattgacagaatgaattattttttatacattctaaatattagggaattctgtacttgtagggttttttttttctcaactgtgtattttaaaggagagaaagcaatcaacaactcctttgtttttaatttgggttttctatatttaacagatttatcattttattttttccctcagtgaacttgtttattaaaaagaaatctgtcactagccaaaagctgtctaccttttagctactcggcaatattggtgcataatcatgggttcttgggatgcttccaactttggtttgacctttacagattagctctgaattagggaccactgctgggtgagaagtaaggtgtaggaagaagacagatattccaacacaatctggaataattagaaggacgaagacaacaaggaaaggagactattttcagtgcttcaggcctcatttttataactgctgacacaagcctgctattaaaatagtcacatttcctcaaatattggactttcagatgcaaacggcgcagtcaaatagttctgttaacatgacctaattttcagagctaggtgttatatgtgctttcattctgagtctgtaaacctttagacctctgattctttcagccctaagctgatagtattattgtctaaaacctagcaattttctctgtaaactttatcattttgcattttataaaatcctttatacttacctatgtagagcttggagtttactatcctagggagaaggagtacaaggcaattaaaaaaaaaaaaagccccgtattcaaagcagaatgtttcaaaaagactctacttctgaaaaggggaaaaaatcaccattgttctgttggctgaatgtgttggaagtatctcaaagaagtacaattgaattaattatattttcatctctgtgtacccattcaagtctgagaacatgcacttcactgtagttttacctccttctggattacacgagaagctgcaagattatcaagatgtcagacattcctattgggataacatgacatctttactaaggacttctgtgggtctgatgttcttcttcctagaaaatcatatgaaagatactttaaaagtgccatgtacccacttgagcttattttttaattctgatttttaaaaatattttactacttaaagtgacatttaaaaagcatattaaacaacgatataagactctgacttcacaaattagtttttctaagaacatctaattagacaacttggattgtgtcttaccagggtgcatagatgtaaccaacctaagccagcccttttgacaatctgcagtatcaaagcaaaatggaactctcgtcttatacttacattagtacataggtggtctttcttgctcatctttatcccctttttaaaaaccatagcatagtgagtaacacatcttatatactgcgtattagacacatttctgtttatctttgtccctgtcttatgaatcttcattttgattatctgagcagtgttgctgatttgctctactggctttattcaactaatgccagtactcccttattggactaaggtcttaaaactaccgtgtgcttatgtgtactaaaggtagttactgtctgcaagtgaggaatacatttgatggaactgattaattagggtgattttctgtttttgtggtcaattgaaatcttttgttaattttagctttgctaattttagctgaattttctacagtaatttttatttatccataagtatttgatttctgcaaattggaagtaaaatcactcatgtttgtttacctagttggagctcagatttttattaaaatattgttaaaattttattaaaatatgcctataaaagcatagtgactggctgaatgcattgtgatgctcacgaaaatgccctctcacatctcctaccgcaagaaacacaactgagtactgggctcgagatgctgctttctggatccatcacagctttggtgctgaggccccactcttcttaggagctgcttctagtcagtgacagagtgcagcagcaggggtactaaaacgggcccattgctgagggatgtgggaactccactgatggcaatgtgagctcaagaatccccatgaactttacactgcactacagtgtaaagcttgttttccttcctccctctcttccccctattcttcaaagaggttagacccacatcgaggtgagatcggtctcttggcctcctctggcttcctcctgttttctttcataggtgttcctctctgaccctgcctctgataactcttgggtttgtctaatcttatctttgtgtctgcttttccaggaggagaacctggattaccacatgcaaaaaagatgcttttgtccaaataatttcatgtttgggccccttattcgtatttggccacaagttttaaaaacctgatctgtagtcctaaacttatatacccctatggttttttttttttttttggaagctgttaaataagtctgaatattctcttcatttatgttgttgaacctagcattcacttcttttcaatttgaactccgccaaccagtatggaaaagtatagtctcttctgtgtctgccagtcaaaggtagtttgtttaccccatttagcaaatcatgacaacttgatgactctttactaggtccactacaatgttgatatgtcggaaaacactttcacaggctactagatcctattatgcaattttgtaacagaggctcaggctggagttaaggactcacacttgccttggaagacgtgacaccctgctatttagaatgagtggtgctttgttttgttgtgcctgttatccaggatcaagacaatgagacatttaccatccccctgcatatcattttggcatgtatccttgtgaagggttgtaggaggcagcagttattaactccttaactgcacacatattttgcaaaaatagaaattttgcttgtggatagcctcccagagttgttatggtgactcatcaacaatcatttctaacacctggatatcaatacaaattatttgggaactttggcggttaagtattacctaaatcttggtgaaaattccttccttattaaagtattatcggcatactaacagcttgctccatacatccacaattaatatttcaattttattaaaaacatctgagaatgctgattttataatgtcaactttaaatctggagaatctctgagcatgaaatggtacagtagttaccatcgaaggagcagctgaaggtcagcctctgaggtgcattaattcttccaacattaactcttgtaaaaatgtcactttattgttattaagtagaggttcttaaaaggcccattaactctggtggctacaaagtggcacatcaattataaatttgttttatgtaaacggaacccccaaatgacaccatcaacatattgctttgtacttaggatcaaaataatcaaagccactatttgaaaatgtatttgcttgatttctcagacagaatctggggatagctgagcaatcatatctcatgcattgaagacaaattgcctcagtgaaatttctattatagtttaagaaaattatcttcctgaatttgacacactgaggtggctgggaatgtagttatccagcaacacctgcttaaaatgccaataggaggtatgtggtaactttgttccactcagttgctacacatgacctttggaattgccacagctaccttacagcagagaacagggacgcacacagggattttcagagaagcactaaggaaaatttgaaatgaagctaaattcaagaagtaaatgatacttagaccttttgcaaagaaaacccagagattttaaaatagacaatagcatgacaatttataaaaatgaagctatttaaacagtatgatgtatagtattcacaatagcttaaaatattttattcccaggagcaacctaatccataactttttttttttttgctaaatgttagatgttgatatttgcaatgcattgccttaaattggaagattataacaaatttgtgtattttatggtgtactgtctatgtattgtctcacagcagctttgattcacttccatattaaccttgataatttgcttctttcaacattcaggatgaaaactacttaatataattaagttggcaaagcctgcattttggcattttatcccactctacattttcttggtactgctttttctaccctcttaatttttacacatggaaataactcatgtgcctcattgtaagtcagtgtgttatttgccaagagatattctgcatgaggtctctaataagatattgaaagaatgaaaggcattttcttattggacttgcagtcatcagaatccacagaaggggtaaattacggccaaagctttacagggtaatggttaagcatgcagaattggtgcctgaatgctcgccttcagatatttgctgtatgatttggggcaagttccttaatctctttgtgctttcctttttttttttacttctaaaaagtgatgtataaatagcatttagcacaatccatctagtacactgagaactctttattattatgggcttctcaatatcctgatatagatagacataaatgcaaaccaatcacagaacagtgcttggcacataggaagtgctcaataaataacagctaccattaaaaatagaggcatgggattgatctggattttctaaatccttgaagttctaatagttttgtacagcatggggtggaaatgagcagagcagtttacaaaagagaaaacaaaattatgaatgcagactgtctacagcaacttcaatgcaattgcataaaataaattataaatataaatgcctgcagtttccacggggaaagctcaggttagtgaagggggcctaaaatgtaggtatcattggtgtcgaaataaatatacctttgaaaacgaccttttccaaccccattgaagttatctacctctcttatgaattaagtgtagaaacattgtgaggagcagggccaaggttaataagcaaagatttcggaccaagtttttatacctttttatcctgtttccccattgcaatcccctcagtgcatgtgtgtgcgcgcgcacacacacacacacacactctcactcatgcttctaacaaaaatatgttgttacagtacagattctcagtaaacatttcttaaataaaggcagccataatgtatgtttgttagcctatattagtgtgaggaaataaagtagggctactttataaccaaaatgaggaaaataaacagtaaaagaaaaataacgccaaaacaaatatgatttatttatttatccaggaatcacttatcaactacctacagatatatagatcattaagatagggtagctgcctttgggaagtttatagcttaaaaagaattataagatgtataaaagtttcaaagtgtggttaaggactgtcatagaaactctgtaagatgagagtgtttaattttactgactgtggttatgaggaaagttttaaagagaaggtacaatttgataatatcatcatagtgaggttttcattgagtaggcaatggaagggcacaaacagaagatatagaagtgtgaaacatggaggaacactcagagaactccaaatattttgaaataagtaaatcattgggctttcccagaggtatcacaagagatatggtcagaccagagtcagattatataccttaccaaggaatactgattttctagattgagtagtgtgaaaccagagacataaaggcaattcaattggatgtatactttagtaagatcacactaggaatatagtgaagaggaccagaggaggaaagacaaattaagaaaacaccagcatgtcaggtgagagaaaatgagtagtagcaatagggatggggaatgaggaatgcataaaaagaggaagaataaacaggatttgatcatcaattggacttcaggatgaaggagagaaaggaatctaagatacccctaggttttttggtttagagaatatagatgtgaaatttaggaagatgtgaaatttaggaagatgtgaagtttaggaagatgtgaaatataggtttgattatgctgtatttaaggaacctgtgggatgtctaggcatagatatcagagttggagggtgggatcagggaatgtggctagaaagatatatttcagcaaataattagtaggtaaaatcactggaatgcatgtgatgacacaccagtaatgtgtggagtgggaagagaccaaacgcaaaatcctaggaatccaatttaaagagcaggaacaattggggcaggggaaggggagagaaagagaattgttaggaaagtaagacaaaactcaggataagagagctgtgttgtggaaatcaaagatagagttgtgctatggagagattaaataaaatgaggtcatcagtgaccttggcaagaccagttcctgggaacagaatgcacacaaatctgatgattgttcttgaaaagggacagacatgagtaactggagtcagcaagagtaaatggttgtattaagcaaatgaatgaagttgtctcagatcctcttatcttgtagtgttgtgcctagcatatttgacatgcacagcatcttttttgtttgtttatttgtttgtttttgagacagggtctcactctgtcacccaggttggagtgcagtggcgcgatctcagctcactgcaacttccgcctcccaagttcaagtaattctcgtgctttatcctcccaagtagctgggattacaggtgtgcaccaccatgcctggctgatttttgtatttttactagagatggggttttgccatgttggctaggctggtctcgaactcctgacctcaggtgatctactgccttagcctcccaaagtgccaagattacaggcatgagccactgtgcccagcccagtgtatcatttttaattacttccgtcctgtctgcaacattagttttggaaataagtactaataatggctagaaaagaaaaaaaagatcatataatcattccaagaaaataaattaatgaataaattaaatattacagtacaccaaagaagggggaagtaatggaataataccttttatttttcctttaaatttatttttaatttttgtgggtacatagattaatatatttatggggtacatgagatgttgaaataataccttttagtttcattaatatgttttctgaataaagacaaaaaacttatatgcacttattgatctgttgcagtcatttctagttgtttctagtttcagtttctttacagttcattataatgcatttacttctagtgcaccatagttttctagtttagagccttaacgcctacaaagttgccaatgactttgtctggagagccctttttattaagtttcattttgaaaagtttctttcacatcagcaagcagatatacaaataggaaaaatcttaattataaggtaagattggaagagatttttaaaaatcctactctacagtaaattctggaaattgcaatatagtccatatctttgtttctttgggataaattctaggggctttcaaatgtctctatgtcaaagaatatttaatacaaaatctccaagtggtcatataaattgttagcagtgaagaaactcaagttctgtttcttggtcttcataatcatggtgagattattgtttattttaaatctacctttaaaagtgaaattatgtaatacctgtgctttggagatagcagctgcatccaaagagaccttcaatgactttgagacattaggaactcctgttgaaatgaacctatgtaggcaaatctgtgtttgtctgggttagaatatgtgactgagagttctcccgataaacttccaggtagaattcaatgtttactcaaggataagtcataaaaatgagttaatttgaagcttatgcaaatgttgttaaaactcaacaggaaccacagcaaattgcttaaaacttggaacaaaggagttttttttccaagagtactattttgacacagatacaccgtgttttattgtgctctactttattgtactttgcagatattgtatttttaacaaattgaaggtttgtgtcaatcctgttgtacagtacgtctatcaatgccattttttcaacgcatttgctcactttgtgtctccgtgtcacattggtaactctcacaatatttcatactttttcattgtgattatgtctgtcatggtgatctgtgatcagtaatctttgatgttattatgaaattgttttggggcaccacaaaccatgcccacataggaacttaataaatgtgtgtgttctgaccactctatcgactagccactcccctatctttctccctcttcttgggcctccctactccccaagacacaaaaatactgaaattaagtcaattaataatcccacaatgtcttccatgtgttcaagtgaaagaaatagtaacaggtctctcactttaaatcaaaagctagaaatgattaagtttagtgaagaaagcatggtgaaagctgagataaggtgaaatctaggcctcttttgccaaacagccaagttatgaatgcaaaagaaaagtgcttagaagaaattaaaaatgctactcagtgaacacacaaatgttaagaaagcaaaacagccttattgatgaaatggagaaagcttgtgtaatctggatagaaaatcaaaccggctacaacattcccttacgccaaagcctaatccagagcaagatcctaagtctgcaattctaagaagtgaggaagctgcagaagaaaagtataaaggtagcagatgttggttcatgaggtttaaggaaaaaaagctgtctttataacataaaagtgtgaggtgaagcagcaagagctgttgtagaagctgcagcaagttgtctggatctaggtaaaattattgatgttggtgactacactaaacaatagatttttggtgtatacaaagcagccctctattggaagaatatgccgtctagaacttttcatagctagagaggagaaattagtgcctggcttcaaagcttcaaaggacaggctgcctttcttgtcaggtgctaatacagctgatgattttaagttgaagcaaatggtcatttaccattctgaaaatcctagggcctttaataattatgctaaatctattctgcttgtgctctatacatgcaagaacagagcctggatgacagcacatgtgtttatagcatgggttgctgagtattctgcatccattgttgagacctattgctcagaaaaatatatttctttcaaaatattactgcttattgacaatgtacctggtcactcaagagctgccatggagatgtacaaggagaataatgttttcatgcttactaacacaatatccattctgcagcccatggataaaggtgtgatttttcaagtattatcatttaagaaatacatttcataaggctatagctgctatagatctgctatagctgtgatagatctaagcaaagtaatttgaaaatcttctagaaagaatttaccattctagatgccattaagaacatctgtgattcatgggaggaggtcaaaatatccacattatcaggagtttggaagaagttgattccaactcttgcagatgattttgaattcttaagacttcagtggattaagtaactgtagatgtgttgaaaatagccaaagatctacagtgaggattggagcctgaagatatgactgaattgttataatatcatgataacattttaacaaataaggagtcacctcttatggatgagcaatgaaagtggtttcttaagatgaaatctactcctggtgaggacgccatgaacattgttgaaatgacaacaaaagattcagactattacatagacttagttgattaagcagtgacagagttgtagaggattgactccaaattttaaagaagttctatgggtaaaatcttatcaaacagcattgcatgctacaaataatcctttataaaaggaagagtcagtgcagcagacttcattgttgtcttattttaagaaattgccagtcacctcaaccttcagtaaccaccaccatagttagtcagcagccaccaacattgaggcaagaccctccaccagcaaaaagattaagatttgtggaaggctcagatgatcattaacatttttagcaaaaatgtacttttaaaattaagttatgtacattgttttcagacacaatgctattgcaagctttatagactacaatatagaatacacataacttttatatgcaccgaggaaccaaaaaaatttgcgcaactcgcgttattgaggcatttgttttattgcagtggtctggaactgaatctgcaatatctccaaggtatgcttgtattatttagaactgccagcacatggtgataacggaaagcaattgactttaagtgaattttattattactttaaaaaattatctgcagaagatacatttgtttgttgtctgctccctatgcctggtctttggaaaaagcctctttttaagcaattaacatcctttttcaaagttaaactttttctttgataaaatttaaatgataaatatgttaaggatcacctatttcttaaaatattgaatgatttcaaacatatatgtcatctttactaagattacttacccatgttttccaattctgctagaaaaccagtggatcattctttgaagggtagacagtgtaccttataggttagatattatttcttatgcaacttatagtacacagaaatctatttttaaacgtacagtaaaagttaaacatacatgcagttataatatgcaatgatggtctcctacaaaaaagatcttagctattgattgattgattgattgagacggagtctcactttgtctccaggctggagtgcagtggcgcaatcttggctcactgcagcctccgcctcctgggttcaagcgattcttctgcctcaagcttcccgaggagttgggactacaggtgcgtgccactacgcacagctaatttttatatttttagtagagactgggtttcaccatgttggcgaggatagtctggatctcttgacctcgtgatctgcctgcctcggcctcctaaagtgctgggattacaggagtgagccaccgcgcctgggcaagatcttagctatttaaaatacgtatttcaaaatctctccttacctagtatctatctttgtttacttaagacgttgtaatataaatttgaactaggttatggtatttatgtttttaaatcatttaatttttccattgagtaccactctatggaaaaattattattattgatatacaataatatataattgtgtaataattatataatattgatatacaataataatatttattactattattgtatatcaattatttattgatatgcaatggtggtctcttacaaaaaagatcttagccatttaaaagatatatttcaaaatctctacttagtattcatctttgtttacttaagattattgttataatataaatttgaaataagttatggcatttatgtttttaaatcatttagtttttccattgaaggtaccactcacttcatattagtaagatttctgtgtgtttcttttgaagaattattcagaagcagacttcattgttgtcttattttaagaaattgctgatactagctagatatttacataaattgctttgactaaactataattaccttgtcactgttttctagtcaattgtaatgcagaaaaaaataattcaaactattaatatcatggtgaaaagcatgggctctcataggacattatcaagctaaaattccatatgtgctactaatcatgttaattaatttctatgcctaattctcttcatctgttaaatggggctaataatactacatagctcattactttgttttgagggttaagagtaaaaacacacagaaagttcttataataatatctagcatattgtaagcactcaacatgtataagttattttaggagataatatataataattatgtatttatttcattttcttttctttttttttttttgatggagtttttgctcttgtttccaggctggagtacagtggtgcaatctgggctcactgcaacctccacctcctgggttcaagcaattctcctgcctcagactcccgagtagctgggattacaggcacacaccaccacacccggctaattttttgtatttgtagtagagacggggtttcaccatgttggccaggctggtctcgaactcctgacctcaggtgatccgcccccccgcttagcctcccaaagtgctgggattacatgcatgagccaccgcactgcgcctggcctatttccttttctttgcttatgttgcaaagtgagaaatgcctcatatttaaccaagttgtccctaggactttaccaatctaagaatttttttttctgagaaaggcattctgaaagtcaaatctagatatactttaaatcaatatcactttaaacatttacgttagccatgttttttacagtgtaaaagactatcatataaattctgttaactatgttttattgttccctgttgtaaatttttatttatttaataaatctgtttataagaatttttttctcaataatactactgaaaaaatagatttcatccaagcacagtgttaactagataagaaaccaacccaccctattttaatagcagcattaatacttttccttaagaaaacaagacagccacttatagtataagtaagctaagaatgtcaaaagggcgctcaatatgtctttcttcaacataaaaagtgatgacaatcgatcagtctgactttcacaagaggctccctaggagagaacagcatactgataatagtaagggcaggaagcctatttagttgttttatattctgtagctctctgactgtcccagtagttacaaggcagcatgtttgacacatagctaaaattcaagatgaacgcaacacacaaaaagagggcaaaacatgatgggaccaataaggagagatcatttcttattataaaggcattaacttttttcaagatgagtgacttggagttttgagctgaagggttggctagaagaacacttcggtttacaaagagaaatgcaccctgtaatgaactgcagtggactctaaaatgaaattgctggaggctacataagaaatagaaaaaacctagaagcacaatgaaaaacatcccgatttacagcatccctaaaggcagctgagggttgaccccattactttcattgagcaatttgttccatctctcctcacacataccctcactaggacttctaaaatagaaagatgcacaacatcccttagccctttccactgtctcaaaaaggtccccaaactttgtttactaaagttttagaactttatgttttactgtgtttagtatttatttaattttctattttttttttccccttgacctagatcatagaataatatacttagaggacatttttctaaatgcaagttgctagaaatgacttggcaaagattagtacaattcacagtgtcctgcagcaatagaattaacgaggagtttttttaaagagagactgatttaattttttgatgattttgaaatataaatgctaagaagaaaatttgaaggaataattttagataatttatatctaaagtgttacaagcattttatgaaacactagctatcagattagtcaacagctttggttttaccgtcaacagatattctttaaaacattcatacaatttattgtgtgcttatgtatatctttatgcaatctttatgtgaacactcataggggactattgtataatgctatcattgttagcaacatttgtgctttgtttctgaagtcttttactgtactagtaatttttttctttgcagaaactaaagttttctattagaaaaactttagttggatcctgatttataagcagatataacaaacatcatgagagtcctagagaatatcatgtaatcttcagttgttcaatctgatgattaaattgggcagagaaaagagttccagttatgtgaaaagtatttaccgtgttaatgaatctgtgccaaaacgttcatagaggctcaacttcaggccactccctgtgttaattgctggggtaagatgtgtaacgtagacacttgcctctggatgggtcaggctccagtgggaccaggtgcattgcaggaggaatgcattactttgcccaagcgcttattaggactttgaaaagaaatgctttcattatattatttgatgttttgtacatttcagtgtcctggctagctttgaagatttcagagtaaaaagccacaatttggagattgatatttaatatttagaaacaactatgcttctgtttctctctctgatactactaaaagcaataaaccaaatatttattaaataattagttcatgggaaattatgccatttttttttttttagttggagtctcactctgttgcccagtctggagtgcagtgggaatgatcttggctcacggcaacatccgcctccccggttcaagtgattctctcacacagcttcccaagtaactgggattacaggcacatgctaccacacccagctaatttttgtatttttagtagagatggggtttcaccatgttggccaggctgtctcgaactcacgacctcaggtgatccacccttcttggcctcccaaagtgctgggattgcaggtgtgagccactgcgcctggtctcaaaccttgtattattagattaaattggggacctgcaaactttttatacaaagagccagatagaaaatatgtttggctttgcaggccgcatagtatctcttgcaactactcagatctacctttgtagcatgaaagcagtaatagacaatatgtttaaaaaaaaaaaatgagtgtggttgtgttccaataaaccttgatttacagaaacagatgcttggaatgatttggcctacgggccttttttttttttttttcttgtcaatccttgaattaagtaaagaaagtgacaggtttcctgctagaaaagggtttgttatgaggattatgtgatttaatatatgtgagatacgtagagccatgtctgcatgtagtgaatgctgtaaatgtgttatttattataataactgttagagaaatgtagaaacacatctaaaccatttataaggattacatcttgaatatatatttctttaaaacctggatcagtgactactactatacctagatttcaatttatcaaccaaccaaatacactgtgaaggattttgtggatgaaaaccttcagatgattgagtgtttcgattgcatattgcatatataagggttttctctaatagtagatatgaatagattcaataatatatgcttttttcatttgccattcatatattctttaaacttctaaccatttccccaaacttggctcattaaactgatatacattggtttactgtttatactcctgccttattttttgcatattataaatataatacaggtgtttctcagcaagaaagacaattgaataccaatgttctgaaatattcttgtttctgtcaaagacatgttcatcacaactctaccacatacactatacacatatatactattttttattttaccagatttttagaaatatccaaaacctaaaatattccagttgggggacaattatgttctactgggataagagaaagacagaaaaatgtggctttagaagcctagaaaagcagtgatttagttaagcatattcaaattttagtaatgcacagtcctgactgacacttaggactttttaatgtatctttttatttgtaggtaagattaaatagaaaataccatatttaaatctgtgaattcaaaacgatattttttgagtgcctataccatgtccaggttaagtttttctactctaatggagctaacattttataaaataacatttataaagtaagataacaaatgagtttttaaaacttggatataatttttactagagaaatactctcataaaaaccagagagactaagggaaagagttatgaaaaatagagtgaataactattttagatagggtggtattgaaagactgtttagagaaggaggcatttgaacagagagagttctaaatgaagtgagagagcaagtcatgtgaagatctagtagtagagtgtttggacagtgggaactacagtgtgaaaggccctgagatgagaaaaaagctgggatatttttagaaaagaaggaggctagtgttgggcatgaaggaaagtgatctgaaataaagtcagtgatcatttagggcctcgtgggctgtttttagatcagtgtagctctctgaggcagacatgagatggctgtgggtagggcagtgctgtgaacatcattaaagttttcccaagacccttctggtccatccagtggtagtagatataccagtagggaagctattatagcatttccctgggaaatgatggttgttagactaaagtggcagcagtgacaagggtgggaagaggtgattcaggatacatgccaaggtagagctaataggaattgctgttgagttgaatgtagagtgttggaaaaagagctgagtcaaggatgttttctatttgcgtcaggtagattctggtgtcatttactaagatgggaaggtttatgttgacagggagttgttaagaatcacaagttcaggccagatgcagtggctcatgcctgtaatcccagcactttgggaggtcaaggcgggcagatcacctgaggtcagaagttcgagaccagcctgaccaatatgatgaaacctcgtctctactaaaaatacaaaaattagccgggctgtggtggcatgtgcctataatcccagctactcaggaggctgaggtgggagaatcacttgaacctgggaggcagaggtcacagtgagccgagatcatgccacggtactccagcctgggtgacagaaggagaccctgtctcaaaaaaaaaaaaaaaattaagagttcagttttaactgtgttaggtttgtgaggctttctctatattcaaatggagctgttgagtaggcaattaaacattggaatctagagttcatggaagagatctgaattgcagatatacatttgagaggactcggtatgtaaatggtatttaaaaccatgagtctgtataaatatcatcaagatagtgagtgtagacagagaagtccaaatactaaatcttgaggtatttaaattttagttgtttggcagaagagatgaaccttcacagaagaccaagacgtgcaaagcaagttacaaggaaagctaggaaagtgtcacagccctcaagccaagtgaaatatgcctcaagatgaaatgtgtgatcaattggcaaaagctgtatagaaattgagtaagatgagaactgtcaaaattgctcattggatttggcaagatgcaagagaatgttggccttgaaaagaagagtttcaacagagaaattaaaaactgcagttaatgaaaaaaataggtgaggaagtggaaacaaagagtataaacaaatatttgactgagtttgctataaaaggagcagagaaatgctcttgtagctgactaaagacacgggacttaggaaggttattttttaaatggatgacattataatacgtttgtttgctaataggaatgttccaaagaaagagggagaaatttatgatgctgcagagaaaaggaaatattcaaatagtaaattctgccataaaaaggaatgaattaatggcatttgcagcaacctggatggaactggagactattattctaagcaaagtaattcagaatggaaaaccacacattgtatgttctcactcataagtgggagctaagctgtgaggatgcaaaggcataagaatgatacagtggaccttggggactctggaggaaatggtgggaaggaggtaaaggacaaaaggctacaaattgggttcagtgtatactgctcgggtaatgagtgcatcagaatctcacaaatcaccactaaagaagttactctgtaaccaaatgccacttgttccccccaaaaactatggaaataataaataaataaataaatagcaaattatttgagtaggcatgaagaaatggaatccattgcactagtggagggcttggactcagataatgacaataatggccatcattttttatgagtcatttacatatattaactcatttaattctaaaaataaccctgtaagctgtattttattaccacctctattttacatggacagaaaaataaacacagcaggttaagctagtaattggtagaggtggtttccaaactcaagttatctcattccagagtaccactctagagagttatatgttatacagtagatgtacatattataactgggaaaaaaggcagactacacagataaagttagggaattttttacatgtcttcataacaagatgatatagtatagtttttattctatttttcactaaagttaagtgcaagattatcatctgagaataagaaggagggatgggccactgagggatggacaatatgagagttgaagaagggatgggcaatgtagggaaagagcaaaaggtatgaaatatttgtcaagtacaggagtaaaatggccatggaaaatgacctgcaaaatctgccagtgccaaggtctcttgaagatttttgtcattattttaaagtgagatgcatcatcatgtgaggcagagagctaatttctatccatctttgcttcaaggtgtcaccagtgaaatatcgatggtgggactgacaggtaatctagaggaatagagcatgcctttcgttttcatatctgtcatccttttatctggcatggaggtgtgatggctagaactttgctagtcataattgaccatggagataagtaccacactctaggggtggtaggatattgagccaggcggcagaagtttgttctctgatgacttcattgaagtgccacagcagtcctggacttttcgcctgcagacatctctaatgggagtcagaaataaatgtgtatcttgtctaagcctgtttaggagtctcttcttcttatagtcagacttaatcctaacttattccagaatttgttttcagaagcgggttgctaaagggacaaaacctaaaaatatgactttggttaaatggaggcaaacaggtggttagcagcaagactcagatgttgcagtttctctcaacataggccactgttctgatggacacatggcatatagggagaattattttaaatatactttgggttttttttcaggtgagtaaaatggagagagaaaaggagattccacaatttcctttagtaacaaatttcactgtctagcaaactttactttcagggattgctttcaggtatgtcacttaatatttgtaccacttcatctaatttccattttcttatatactaaactcaagagacacatttagttaaaatttttaataaaatcttacacttgtcagatatttcaaatattttactttactcctgtctattataggaaatccaaaactgacttatatttaccttcttaaaccttgatatgttctcacaatctttttatttttcaaagatttatatcagtttatgacagtataactacaaaaaaaagtatagtcaccaaagtaaacaatgacatactccttgtcaaatcttagggcctatttccacgctcttggcccttatttcttatcttgcctttttcccctaaactgagagccaacatcatcatgggcgtatcaagtagagacagatcaatttgtgttggaatccagttagtcatttactagttagttatgtacctttagctagtcagaatttctttctaatcctcagttttcatccacaaaatgaactgtgttaaagactgaataaactaattttgtttactcacatttagtttatactttttttttaaaaccttcctttctttggttcaatttacaccatgcaccacctacattagtacctattgatatttgcgagggttttatgtctttgccccttctccatttctataaccatttctcaagccttcaacatggtactccttgccagcaatcattctttgctacctgtgttcctacccattctctagtttcttccagaggttccttgtccctcagcaggtctgccttcttactgcctcctgcataccgcccacttgcaccattttctatatattttctcttgcatcaattttccattgcatataataatctctagttcacaaacctgtatttgtaactctattttaaagacaatatttagtcttacttcatcccagaaatcattgactaacttcaccacaattgagacatcacttacatgaagttcctctttgtatgtgtataatttatcctcttataccattaaatttcttgtattgatcgttgattttattttaggcttgtcttaattatccatttaggatgtaaaatcttccttgtcttcatgatccgctgatggtataaaacttcctttgtttaaagaaagataaaactatctctgctgttccctgtcccatgctttgcagtgctatcactatgaggagaatttattaatttatgcatgctgcatttaatatgtaaaagcctttaaatacatgaagattggtactacaatgtcctcgatctttgctttcttaaactcaaatagtcttagttactttaaaacattttgcctagtgttatttttgtgtgtgtgtttcctctaaattcaagtgtttatattcttctttagttgagatccagaatcggcctcactgccatcatataatcaaattcatgcagagtggattggggagtttaattcctagcatctcctcttacctttgcttccatttaaaaatttaattatttctaaaattcaactaaaggccctcatttattataatttatatcattgttgaattattaattggttatttatttgctatacattatagtcaagcctgtagctgaataaagtataccttgatacattggaatacttatataaactgcataggcactaaggggctaaaagaaagtaaagtgggatatgataataaatgaaaacttattggagtagaaaatgaaaaaaatttaggttatattttatttcttttaattaagatggaattcatataacataaaattgaccactttaaagtgaacgccaatggcatttagtgtagattttattttactttatttttaacagctttattgaggtataatttacataccatacaattcaccctcttaaagtttaaaatttaatagcttttcatatatttacaacattgtgcagccatcgtcacagccaattttagaatattttatttaacccccaaaaaaccccatacctattagcagtcattccttattttcctgtatccactatacctaggcaaccattaacctactttttgtctctatagatttgcctattctggacatttcatatgaatgaaatcatatatggccttttgtatctggtttcttccatttagcataatgttttcaagattcatccgtggtatagcatgtatcactactttgttcctttttattgctgaataatattccatattgtgggtataccatgttttattatccatattatgccatattatggatatacattcatcagttgatgttcatttctgttgcttccatcttttggttattatgagtagtgctgctataaacatttgtatgcaagttttacttttaatacctgttgtcagttcttctgggtatatacctagaagtgtagttgttggattatgtttaatatgtaaacatattctatgtttaacattttgaggatctgccaaacagatcctttcctgatttctaaaatggaatatttatttttttaactgtaggctttacattccttatatatctgaccactagtttattgtaccataacaggtatttcctgatttcttttgtgctttgctttcatcaccaaataacaacttccttgaacttttaaaattacatcatttatagaatagaaatatgaaaagagttttgtgattcttagacatgaacacttccataattaaagatattcttacccctatggtaacacatggaatgaaaaggaaaatttgattcctaacattctattaattttattttctttatatatctcttccatgatgctgccaaaataattgggctcaatttaaatgcccttgtctgcttgccagtgggatgcatctgagaattcaactgtgctacattttgtttgaccacctatgtgttctactaacccctctattaactaaatgcctttttgatatagtcagtgttacttaattccaagggaaatctggggaaaatattgtaatttactgtgtacagtggagataaccacagtatgtaatatccattattgtatgggaattgtactcaagttagtccaatatggagtgatggttttaaaccttttagttaggaattaagtaaacaaatatttgtgaagcacccacccactaaatcatacaagtcactgaattaaggagagaaagtgaaaatattaatttgtggcttaattattaatagcatattaaaaatgtaaaggtttattatggttttagtcggagtttatccttcattacatatacaagtatgaaaggaaagaattatagcactaagccggtaagagaaaagcagcttgattctcttcagagtgaatagaaggaacataaccgtaaaaggaatataaacaataattccgagtgggagagaaataaattatttttaaaataattcaaggacatggcttaatgcaatgagataacatagacctgctaacctcattccagttaacaaagcacatttggttatattgtatcttttacagtttcatagtttgctgttttatagtaggaacaggataagctttaactgccttgttttcctttattcttccttttttgaccctgttaaatttaggaaagcacacacttggctcataagtgcttgttcagataaaacagtgtgcttccaaatgtagcagcaacccaccttcatcagaatctcctaagagggatgtgattgcaaaaatatcatttttcttagccctacatcatggctcttagatcagaacctctaagagttctgagctgagttatgatatagggctaagggagggcccaggaatgtacattttatcagtaaccccaggtgattagggtagggtccaggaatgtacgttttatcagcatttccaggtgattctcacatatgctaaagtttgagaaccactatactgtactgtattccctgctgtagtgactatgattgagcagaatggttaaaagcatggactttggtgtcaggcttatttgaatttaagttctgattctgttacttcattgtgatcaaaacttggataagcctcttaaattctttcagcctccactgtattcagctataaagtttaagataaaaggtgattataatctctatttacctaaagaataaagacttattaacataattctgccttatcattcttactattattagagatagggtcttgctctgtcacccaggctggagtgtagtggcatgaccatggctcactgcagcctcgacctcttggactcaagcaatcctcctgcctcagcctcctgattagctgggactacaggggggaaaccaccaccatgcctggctatttaaaaacaattttttttttttgtaatgacagaatgtccctatgttgcccagaatggtctcaaacccctggggtcaagcatcctcccaccttggcttcccaaagtgctgggattacaggcatgatccactgcacccagctgctgcccaattattaatagaatcttcctttattcttaaaactatcccactttagaggataaattatgtgatctagcatagctatgtaatcatttactgtgatgattatatgacatcacttatttgatttgatacagttggcacataatacatattttttaaatgttcttataattaatgctatttttaaaaatcaggccaactctgggcccactgcctaggagttagcccttctccataaggagcagtaaaagcaaacaaacaaacaaatttgattttttttttattttaacagagtactcaggattatctactgctttaattgcttttaaaaattgatttccatggaaaagaggtcactgattattgattgttggctagttttgtcctccatgggtacaggtctttaagtcattttgtcctcattgtttttactagcttggccatgccagttggcattgtcttgtgctaaaaggcattttgtagtagagactttggggaaaagacattcaagagaaggataataaaagtctgtacagtggaactatagtattacacaaatattattgtctataagccctattacctacaaaagataaatatgacattttccttctcttattagcttcatgatgaaacaccttgctattctgccttcagtttgcttttcacttccaagtaagtatattctagccatgggagagaggtatttaggtgtttttcttgtagttagatgggaatcctagactctctactcagactgctctgagcctaagttttttttttcactttttttttttttttttttttgagatggagtctcgctcttgtcgtccaggcaggagcacagtggcacgatctcggctcactgcaacgtccgcctcccgggttcaagcgattctcgttactcagcctcccaagtagctggaattacaggcactcgcgaccatgcctagctgatatttgtatttttattagagatggggtttcaccacgttggccagactggtcttgaactccttacctcaggtgatccgacctccttggcgtcccaaagtgctgggattacaggcgcgagccaccgagcccggcctctgagcctaagtttatcagtaatctcctaagtggtgccataaggatatgagttaatgtacatagagttcgtagcagcacatctttgttctcaattattgttttctttctttcttttttttttttttttttttttttttgagacggagtctcgctctgtcgcccaggctggagtgcagtggctcaatctcggctcactgcaagttccgcctccggggttcacgccattctcctgcctcagcctcccaagtagctgggactacaggagcccgccaccacagccggctaattttttgtatttttagtagagacggggtttcactgtgttagccaggatggtctggatctcctgacctcgtgatccgcccgccttggcctcccaaagtgctgggattacaagcatgagccaccgcacctggcctattgttttctaataccattattaagaagaatattggtggtcttaaaattgagcgagcagcagattttagggtaatatgggacttatttggctcattggcttctttcagccaccttgttcagattttttgcttctccagtaaaaaaaaaaaaaaaaaaattgttcttctttgtgagatggatgggggaaaaagaagtcatatagtttaaggagaataaggaaatcccaatatctgaacatttgagggagaagaactcaataatcaagggccaagtgacatagcagatatattgtgttttgcagtgtctgactgtcaacacgtaacaataagtggttgagattttcatactcaaggccttattcattgctttttagaaagtgtttttgttccacttccaatgaaggcataattctcaatgaaatatggaaagtgttgtagtcaacatgaaaatacatatattcaaaatagcatagcattaagcctgaagtatccaccatcatttttattcacatactactggtatttaaaatatagaaaataaatagaaatatagaaatataaacttctacagctattgccttcataaattacaaccttcatggctatcatatgtcccaaatatatgtttcagatatgtgcaaatgatgataaagaaacattcaatcatcagttatctaggagacaatgatacacactaggttatcttgagttaattatttcatgccaaacttaagtgactatgtgagaaccatatgtttggtgtgtaattcacactttcaataatgtttgtatcaactgaaatatttttcaatgaaccagcatccttataatgaacatggtgttattataaggaagctggcagtacaagtggtactttgtgttttctcatttcatgctttcatttagatttaagatgttcttggtttcatttccaagttggcatgagttagcagtaaataggaatctgctggcttgtgttacatttgcttttctgatacctctaaagaaagaatgggaagaattcagaacagtaatcagttttaattgaggttatccagatagaagtctttgttctatctaaatatcaagccaaatttcttggtatataatcagaaggaaccatgttgatttctctacttattgatgggtgtatgctttgattaaggagtcacagggaaagaagatggtaatattctcatagattaatgattgtggattttcagcagttaagaattgtattcaacctagaaaacaacttctaagaatcattaatagtgcaattcatagaagtagggttgattaaaattatgaataatttataaaatgtaatatatggatagaaagagcacattggctttatttaactcatgattaggcatacatgattattccattttcttcctttagcattgacttttagattatggaaggagaatgcctctagagagttaaagaataggcacagcacaaaagtaaaaatgaatgctccaaaagtagatatatgttgtgcttctgatgactttgcattttgtaatggatttccatcaaactgccttgctgtatcagtcagaatagtctaggttacattgtagtaatgaacagccccgaatatgaatgggctaaaactgaaaaaacaaaagatgtgtttgcatttagctcttgctatatgtctatttcaggatggagttgctggctgatatggtttggatatttgtctgctccacatctcatgttcaaatgtgatctccaatattggagatggggcttggtgggatgggaggtctttggattatgggggtggatttcttatgaatagcttggtggcttggtggcatcctcatggtaatgagtaaattctcattctattattttcttgagaaactcatatttaaaacaagagaaatgtaggtatctctaaagactgtagtaacccaattttattgatgatcagaggccaaaaaagccttgtaaccttacatgttgcttaatcctgatcatgtaacagaatcgtttggcaagagtttgaaatgcgtgaattcttggctcctattttcaatgttcctaatttaggaggtttagggtgagacccaagcatctatatttattcccttaagaactggttgttaaaaagagcctggcacctctctctttcttcttctcttgccatgtaatgtctgctcccctttgccatctaccatgaatggaagctccctgaagccctggtcagaagaagatgctggcttcatgcttcttgtacagcctacagagccaggagccaaataaatctgtgttctttgtaaattaacccagcctctggtattcctttatagggccacaaaatggactaagacgggacatgggctgtgttgcatgctatcccagactcaggcctgaggaagactccaagtggaatgctcctggtcactgtggcaggaggaaggggagtgctagaaaatcttgcaatttaattaaatgctgtcgtccagaagtgatgtacagcatttctgtccacaactctttggccagaattattctcatgaccctgccaagggcaaggtggcaaagaagtaccattctttcatgtggctgggagggaaaaaagaaccagatttagaagagcattagatatctctgtcacatctgaggaacaaattagccatcagagcaaaggtccaggcatcccatctcggcaaacaaagcatgattaaccctagagctgctgattctgagctcaccctaacttgattccctccactggccccaagctggcagctgtagctttgcaaacatgataatgcttctcttgttagaactgaatttagaattggcagcaacagaaacctgcaagctgcagttcatttgtgtatccatgcttaatttaattcttattgaatgaaatgcaccctcattttattcttgctggaaaaaaaaaaaactaacaacataaaagccagtccaactattaaatcaagattttctacaagatttgtgttaattattctctctgtcctttcacaagaataaaactgattttatttatcagttttgattcatttttgatacttgaaggaatgaggagtacagaccagctatggactatgtttattttcctgagaaactcatatttaaggcaagagaaatgtaggtagctctaaagactgtagtaatccaattttattatcagaggccaaaaaggctttgtagccttacatgttgcttaatcctgaccatgtaacaaaatcacttggcaaaagtttgaaatacgtaaattcttggcctctactttcaatgtttctaatttaggaggtttagggtgaggcccaagcatctatatttatatttaaatctcaccaggtgattccgatgggcagccagaagtgagaactgtcctggaatgttatgtaaaagaaagttattatttttgaacttgttttctaaatcaaataactatccaaacctaattttccaactttaagaataaggccatctatttagcagtacagaatccatgcttacaatgtttctggttcacttcttatgtgaaaacactgaagttgttaaataattcatagattattttgcaatcctgccagtctttatgtgtttcatgttcttgtttataagtcagtgagtagggaatacatccattttgagaatgccactctgttgtagttaatagatacagatcccattatcatagttattctaatatatgattcaccaaaataatggacaaaatgatgtaactaacaattgatttgcctgctctaatacctttctttaaaacactgtaataaaacaggaaatggttttttttaaatcatatattttgagtcaggagactagagttaaaatgaatcctagagatggaggatagtaaacgccaattgtgaagccagtaattacaggaatccatgtagtaataaacttattgtttctgtcttcaaagtacctttacttcatcctgtttaaagcttctgttgcaagcatgtcattttgaaagtaaattagactaaacatcattctgatgtccatagttcaataaagtagataaaatgcatattctatgaaagactgtcaaataaatattatgcttattcatctctctgtttgctttaaaatatactttaatttatgtaaatgagcatttaatagaaataaatagtaatgaagccacataatgcagatattgtcaagcttaaacaatccagacataggtaaggagaggcactattcaaaaggattattttaagagctgggagagggactattgcagtagaaagaatgctctagctatgagatctgtattttcaaagtcagataaaaatcttttctttgcctggccctcacctgagcactgcatatgcttactttatctcaaccctaggtggtatgaattactatccatttttagctgtcaaaattgagacacagagaagccaaatatgtcactgatattttggtttatgggggtagtgagcaaagttaggaagaactaggtgtagggaaatggtattgaaagggtggcatgacggcatgatcatacagttgattagggaatgctttttcctaacgtaagtcaatggtccagaaggcctcttaaggagaggttgtatgccgactcaggcggtgtgcatgtgtcacagttcagagacctgaaggaaagagagaagctttagttaaatttggtgaagccaaactggtaggtattttatccagattagtcagaggtataaacagttcatctaatcatttatggggtaaagactgggaatttggagggtctgtgtctggccttgtctaagtaaacaagaggggcatctgtgagtcttatctaagtcatacaggaaagacagtaagcctccagaagtaaaagggtgggaagacatctttaaccatcattgtttttcaggatcagagggctctgggaaagttcatggttcatataaagcaatagggtctagctaagtctcatccaataataggtatcatttagtgattgcctggccctcagttgagcactgcacatgatcactttatctcaaccctatgtggtatgaattattatccagttttaggtgttgaaattgagacttggaaaggccaaatatgtcactgaaatttagtggttaatctagaattcaaacttgaatgtccatagtaaaaaaatcaaactcatagtcatttatactatgacatcaaactgaagtagaaggtgcaatagtttgtttttataatttataacaaagtcattaacatttttaattattaaaagctaatgaatttttatggttcttttatttttctcttgcattttcatagatgagttccattcagacagtttgacaattaaccatgaaatctaaaaatcagaaatgattagtgccttgagttatacaatgagaccccatattgcttaacagttagaatctattgaattaaaaattaagagaaatataaaatattcttcaaagctactgagttatgcttaggatactggtctttgtaaaggaagaggaatgcaaaatgagtcatgttttattcaaggatttaaagtccagtgggaaagctatgacaatacctaatatataaataattataataataaaccacattgtcaaaagagaggtataaataagaaaggaaggtaaataaagattaatttacatttggtcaggagtatttttaagaaattgaaaaatcatacataaaaactaaaaatattggtagttttattaatgtggaatagatgattgctaagttagcttaactagatttagtaattctgtgaatgcatgatatatgtcaaatatagtacagtctttcagagaaaaaagtcatctttcaaaatgtgaaaatgctttcctattattcccaagtttcagtcattttagtgagaagtattagtaggttgtggaatacatatttcaagaaaaatgcactcaacttttaatattactcttggatttaacattgaggcagagaaaaatgctctatacagtttcaaacagatatgtattttgtgttctgaaatatagagattgaatgagagacaggaatgaacaggaccctaaggctgaaatctttacaaaagcataactgtggaggaattcacctcccaagtgaacttctctgattctcttgcttttaaacattatggcaggctctgttctttttctttggaccttgctgcgagatcctgctgagaagttctctctgcagtctgctaacagacatgtacagtgaaaattaaaattattcaattcatatatgaatgagcatattatatccagaacctacagattgtatttttgtcaatgtatggttttaaactgtttgaatttaaaaagcaatggaaattaaaatgtgactaggactttaagctaaattgttttaaaggagagtaatctgtgaaattaggacatctagagttgaaccatagagtttagaattgcaagaggacttaaaggtcatggaatccaacctcccacacagtgcaggaattcccttgtaagaaattcttagtaactagtcagctaagctctgtttgaatatccttagtgttgggaatctcactacaggggcagacatgccacttttgaatagctctaattgttaagaattttctgaactcagaaataactacctagcaaaagaggagtacttaatttgcatcagtgctttgaaaatttaaaaccaaagaaatggaaaatatcaaataatttctaaattgaataccagctccaaggggcagaattagtctcaatcattgtttggtaacttttaatactgtttccctcatgactcataatttcataaatttttgctattttgtttactaatataggggaaaatatgtgtttcagtggaagagcatgcattgtcacatatagcacaggcttgtggattattagattctagtctatcattgcctttcagctattttataactataaattttgtcttatttcacaaaatttccaatgacttctctcccaatcatgggtaagctagctttgcctccatttgcaattcagttcccttactcccagaaatgtgtgctttttaattttcctttgaactggttataacatctatctggttttcttattgaatgaataaaaataatatttttaatacatgctcattttcatttttatatctgtattagtcattattttaccttttctgaaaattatcttttaatatttgtggaggtattcccaccaagatgcccaatgatttgcttactagagccagatatactttctcatcagagaagggcacctattgagcagtttaaacctaggcttctacctaggatttctgactaaataattttgttgactgtctttcttatttttattttccactctactaattttgtgttttgcttttggtttgttttcagccagtaagttatttctgattgctggcaggaaatgttgggaatttggttttatggtctgaccatttggtgaagttattgcacatcactggcaagagtagttggaaatttggcctcaacgtcttatcatttgatgagttctgtaaatgcagtaatggtttaaagagttattttctctgtcgggtgtaagacgacagagaatcttgtttggtagggttttctatttgtcttatttgtctagtttgagctcaagtcagtgaagaatttcatgcccaccagaaagtagatatctagactaatgagtttttatttctgtgttcgtgttgaaattttagaattaaagataaccattttaaagatgctcgatgagctaagagagaaaacagataattaagcaaaatcaggaaaatgaacaaaatgaaaatatcactgaagacatacaaactataaaaaaagaacaaaaattttggacttgaagaatataatagctgaattgaaaaaaatcaccggaagggtttaccagcagacttgattgactaagtggaagaaagaatcaatgaacttcaagacatgttatttaaaattatcaggtcagaggggcaaaaagtaaaaagaatgaacatatatgaagagagactacgggacttatgggacatcaggtgggccaatatgtgtattatggatgtgccaaaaggagaagagagagatggacggacagagagctcaattaagaaaaaatggctaaaacatcccaaaatggaggaaagaaatacaaatataaattcaagaaattcaatgaactctatgtaggagaaaccccaaaagatccacacagagacacactataattacattttagaaagtcaggtacaaagagagaatcttaaaaattaaaaaaatatatatatatatcttgaaataagtcatactatatctttaaaaaatcaagagaaaaatgacttatcctgtacaaggtagctttgacaagttatcagtgaatttcttagcagaaaccttgcagaccggaagggagtgggatgatatattcaacatactgaacaaaaaagaacagccaaactagaatactatatctggcaaaattgtccttccaaaatgaaagagaggccgggcatggtggctcacgcctgtaatcccagctttgggaggctgaggtgggcggatcacttgaggtcaggagtttgagaccagcctggccaacatggtgaaaccctatctctactaaaaatacaaaaattagctgggtgtggtggtgcacacctgtaatcccagctactcaggaggctgaggcaggagaattgcttgaacctgaaaggtggaggttgcggtgagccaaaatcatgccattgcactccagcgtgggtcacaagagtgaaactccagctgagcccccgccactgcaaaaaaaaggagaaattaagattttcccaggtaaataaaagctgcaggaattcatcaccagtagacctgccctacatgaaatgctaaagagtatcctgtaagttgaaatgaaaggatgctagacaacaacatgaaaccatataaaaatattaaaatttttgataaaagtgaatatatagacgaatatagaatcctgcagtattgtaatgttaatatgtaaatcacttttaattctggtatataatttaaaatacaaaaccattttaaaaacctataaatccataataatagaaacataatataaaaagatgtcatttgcaacatcagtagcatacagtgtgtgtatgggagagatgtaaaggggtagagatcttttatgtgattgaagttatcagtttaaaatagactcctataactttatttaatccccataataaccacaaataaaatacctatagaaaataatcctatgaactggttacaacatgtgccagtttcctcactgaataagaagaaataaaatcttcggcatgtattcatatcttttaataaaagcctatgcaaacctctctttttttgtataaatgaagtagtattggataaatagatatttataataaaaatactggcttttgtcaatcttgttaaagttgaatattgataatatagtgtgatctaatatagctctgtccaatagaaatttttgtgatgttgaaactttatctattgtccaatagggtaatgactagctatgtggagctataaagcatttgaaatatggccattgctactgaaaaatataattcatttaatttaacttaaatttaaatagtcacttgtgatcacatattgtacagatctatggagtgagacttgtaagtattgccagtggcaaggaagtaacaagcctaaccatgaagagtttttgctatgtttctgtagtagaaactttcaaaccaacttacattctttttgcctgcttatatatgagttaagtaaataaaaatgaaggtttttagaaaagatcctttaaaaataatgactttgtgtattttagcatataaaaatttattttaaaatcttataccaacacttttaatcatataaaataaaatgtaacagacatctttcattatttgtaactaatatgtgtatttaattcagtttaaactgatagcattccttggaaaccaaatgcttttcaaatgataattcttagaatttttacatatcttagaagtgtttcttttgttctttgtttttttgtttgtttgtttataaaataaagacatgttacacttttgtgctagtgatctaaatgatgcaagacatgtaatcttgggagaaactagatttggaattttggtgttaaactaataatatgaacatatagcattgggagatatacctaatgctagatgacgagttagtgggtgcagcgcacaagcatggcacatgtatacatatgtaactaacctgcacaatgtgcacatgtaccctaaaacttaaagtataatttaaaaaataaataaataatatgaacatataggtaattaaatgacagtcagaaattgtcatctagaagtagatgtattggtcatctcagaaaataaccatacacaaaatacagaaatacataaaaatgcctgggatcaactaaaatttttataaagttatttttgattatcctacaaatagggatttgatgaatactaaggtatagaactttggaaactttatacttgggaaggtgttgaattatggcttctgggaaattataccaaaatagcctgctgttgaagtgaagctaagtttattgcttattgtgataatgaggattattagccttgacagaatctcattctagagaaggaaggacatagactgtctgtcatcttcctctctttcacaaacagtgccaggaataatatcacagaatcccagagtatctatattcgaaaatatatttgaaattattttggcaaatctccttttataaacaagcttttgaattctgagattgattactaaactaacatgcattgtttcatctaggtttgtatgactgatcagataacataccttattattttatcattcagacttgaacttaaaggcagagaaaggacaaaaaataaaatatttatagattatttggcaaagtataagtatctcacatctgtaaaattttaataaaattctgcaaagtttttgtgtcatgcttgcctaatgtgatttatctgtcaattggtatatagattccattaaaattcatttttaaaaaggtggaattatgactgtcataaatgtaaaataaaatggttaaaaattttatttagctcaacagttaatgaggaaaccaataagatgttacaactggtaaaaagagaattttaaaaaatacaaaacacacagatacagccaattaggaactgtgaaatgaatgtacaaatagatgcaaaaaaaatgcttcgtatccacaagacagtaatcagttgcatctacaggaggcacaattcatttacatatctatggacaataatcattataattattataatcagttttctacaatttacagagatgtaaaataactcaaagacgatgaaaggcggatatgactcagaagggtgctctagagagcacatccaattaactttttgcctatttcaaggactttcgcagtgtttttcttataaccccaatgaaaatgagaaatggtttccactttaccctactctccatcacgtcatattagtgttgcctatttgactcattagtgttatttgcctgactcctgcagccattttaatataaaaatttgaaattcctactctcaagttgaacatagaagatagtcaatattctaaatttaaaaggttaaaaacttaacgtatttgtttttaattttaacatatgtttaataaaataagaaacttgaacaccgtagtatttatggtctgcataatctgttggatttacctaattcatggattttaatacacatgttgtctttaggttacccctgagggcaattgtttttggcatacctagcataaagcaggtattccctgtaagattttttcccatttcatgtaaaaaggttaaatgctggtttggtggatcctgcttcaacattatgaagatagcatttgaactacatgtctttcgggaaattatatatggatatatctacagatgtagatataatagatacaaaccagtaagaaaggaaatctaactttttagtgatttcctttttacttttaaaaaattgctattgaattttttcagttaaatagtaacaaaaataactaacaacataggctccatacaaaatttaatttgccactttataactttttcaattcctttatactgtataaaccacagattttttgtttctagcctatagtttctgcctaaaatacaggaaatgatacttacaataccaaaatgaaaccattaaaagttttggatgctggattaagtgatataccacttaaataatgatccaactttgtctaaattcttcaagaactagaatatatataattttattatattatctcctttttacattgtttttttttcctttggatctgatttttcaaaactttagtctaataatgtatcactctgtaaagtaacattccttgtaagatttttaaagtagaaaatcttttcacatgaagatatatatgtactatatacatatatgtatatatttctaaaccctgtgttctttgtgtaattgatggaggattggtctgtagagaacaaccaaagttgcaaatcatggagaaaatctctctgaagtgcaagtaagataaagaataaaataattggagcattgttgttttaaaaaaaaaagcttctcttggaaaatgtccttaagtatacgtggttagaaaaataatgaatcctagctttaaatttgtgtgatttaacttagtttacgaatgtttatgtttttcattaatggaaaaacgtttaccaatgaagaataacatgaattgatttataataattagcatgtttaatttcaaggatactgcctcaaaacactgaattaagttttaaattattatgcatttgaccacagagagtctataccaagctattatgatgtagttatgtttgttttaatacttcagtctccacataaatggcataagataacctcatattcataatactctaagtacgtgcatgaaaaaatcaaaactgttatttgaataacaaagctcatgggacaaggaaatgatgccaaactatcttttaggaaattacagagtaaaataagttatttactttaggtacagtatttaacttgtacctagtacattgatttaacattcacatctctgataaagagttacctactagtgtcagaaatcccatatatctccaaggttttactatggctcgaatgcctcctccacacattcaggtgttaccaatgtggttgtattgagaggtggagcctttaaacaatgattaggccatgaaggctcctcctgtgtgaatgagattaaggcccttattaaagaggttacactcagtgttcagcgatcttgctcttcctccttccgccatgtgagaactcagccttccttccctccagaagacagagtaagaaggccctcacctgacatcaaaatgccagcgccttgatgttggacttcctagcctccagaactgtaagaaataagtttttgttctttataagttaaaaatatataaatacataagttatttatcatgcaatatttaaggaatacctaagcacatgcgtgctcaccatctagcttaagtaataaaacattgccaaagcagcgaaatcccctcctctttgtctgttcccttccttccctgatcatctctcctgtcttccagatatacttaccattctgaatatagtgacaatcatcctatgcatttgttatttctttttttaaatatagctgtctatccccaagcaatatatagtattgttttacagtttttaactctgcataaatagtgtgataaaatatgtgttctgaaacacacttttgttttgctcattgtacttgtgaaattcatttgatatgtgtagctctggttcattctttatcagtgacataatatttcactgtttggtctacattatcaaatggtggcctactcagaaaagaatgtggttaaaaaaaacccctaagttggacaatattctgattattatgattaatttcagatttattaaactaaagtttattttgaatcaactagcaatgaaaaaataaatattcatatttaatatgaccataaatcagcttttctattgcctttgcatcaataattaaaaaataagtaaataatgcactgattcaatagtcaggtgctatttatcccaattctacctaatttagaggtaatatattaggtaggaaacctaagagtatcagtactgattagtgatttgaggcagaaaacttgcaaattaggctgggaattgctagtaaggttctggattcaatcatgatgaagtgacttggttttatgtgcctaaggaccctgtctaatgagttgtatcgtcttaataggccacgtactggtaaaaaaaaaaaaacaaaaacataaaagcaagcaaatgttaatgatatctcaaaagagctcattaattaggcagtcggcacctcaacacagaaaaaatttctggccatgtggccctcaccccactttagccttagcaggtagaaaaactaaatgcttgaggagtatttgttactaattacctctgattggtatgccatgtctggtctcgttttgatatagagggcaaaaaacatgaaagccaatgaacattaaattgccaaagtgagtgtaacacagcaagaacatttaccatttccaccatgtttcatcataaatgggagaaataatactggagttgtggaggcaggggttttggagatatcacagatttgagtcatggacagctatgtagtgctatccattatcttaaaaaaaaaagtccttttaaaacagtattagtcatgtctacaggatattttctcagttttgcataaaatgcttcctgacattttcatgctaatataacattaaatatttctgttgtataacaatctcactagaacttggttttccttttttttaagacgtgaattttaagtggtggtcattatgatatcattgaaaggaaaccagaactaacaataattaccaaatacagcccttttattacctgtttcccaaagaatctccattttatgtaccatttgacaaatgcaacctattgtgtaagtagcaaaaactctgcaggcagagtgcatttttaatactttattacattaagactcaggtttaaaaaagtaagttatttctgttagctttagtatttttcacttcatagaaaaagcttttgtctgaattgtcctattttggggttcctggatttagtaagatgatataaaatactatactattttaagatattattaatactccactactaagaatataatattaggatttaattattttttcttgcctatacatattagactatatatttgactttgcatttgcataaagagcatattattacaatccctaacatttcttagatcgtaaggcaaacctatattcaaatgagaatatatattgaagattccatatctataagcctgagataaatgtatgatttggtgagagggagaagagaatttataataatgataaaagctattaacactaaaatattttaggatttttagcacagtgtcattatctacatgaagaaattgttatacttgcaagtgaaatagttccacgtgaattcgaatggctgggctagaaattaggaagttggtactatttggaatgaagcacttatcatttttctttttctgaagacatattttttcactcatctcttctctccaacatctttcaacttattaagcaggtcgcctaaaggagaaaccatctccagaaaaattgcaataacttctttagggctttcgtatttggcttcagtttctcctaccttccgtaatagattcaccctctttgttcacctttctaaaggaggcattgtaaggaagctttcttacagcgaatttacaatatctggtgacgtctgactcctttttttttcttaggctagacactttctcactgaaagaagccttttgtcggcatctattatgctactttcccaccgttataaatcctctatattttcttaaataggacagatgatattaggtatccagttccaatgccatagcacttgaatttaaatgtagacagtgttttattctcctaatctctgtaaactctgatagttgctttaacagaacgtgccttttttgtttgctttgttcagtggttgagctttaatagtaagtgaggagggaacatagataaaagaatgtctttaaaggccatgaaatcttccctcagtttggaacaaacaccttagcttcaatgtctctgccacttagcatatttaatttctttggacaacattgtccacagtgttgaaatgaatctgacttgaaaagctcaggcatttttaggatatatattggcattaataaatagtgtgttttgacttcagagctgtgaattacccctagttccctgataaaatatttgtaattggattttttttggtcagtattaaagtgtgtttgagtttcaagagagacatgaggagtttttaatatagaacaatttattttacttaatatcttacatttatttttggaaagtgattcattgtatttaaatttctcaaatattcaaagcaccaaggaaaattatagacaatagtttctattattatttgcttatttttctattggaaaaacttttgtttttttctcactatacaaataagttttttcaattagcttaataactttgaacaacacatttatttgacactacatttaactgttgtcaaaaatgttattggatcatggttgaataattaataaaccattgggtactttctacagaaccattttagttattttataataaagtccctcataggagatattagttgaggtgaaaattgttcctatcagtataagcccaagaactcttgtctgacaattaagcaacaaataattattgtgccctcatagaaaccactggtagctctttcatgaatgaatgacaatatttcactttgtagttaataatgtatgaagacagatgaaggtgtttgtgacagataatactccttcgtgaaatacagaatcactgctctgcaaatagtattcattaagggtgtggtatttgtctggattaagtagtttttggtggcatgtatgtataaccaattcaaaaatgcttaatgaaaatttatcactatgatagttataaggttgttttatagaatacaaagtttgcaaatgcagacaggattcataaaggagagaaagtagaataggcatgctatcaggaactcaggcagaactctcaatgtagtctctgagtttacttggtctcttgatttaattaattaattcagtcagtcaattggtcatgtgtctatttactcaacaggtgtttattaaggaccgtgtgtctaatccagtcactggaactatgtataatacagacttgacttaaaaataatatataattcacaaaccatgctactgacccatttaaattgtataatttgatgatttctaataataaccatagagttgcataagcatcactacaaacacttttagaacattttctttactccattaacagtcaatccctatccccctttcccctgctactagcaaccactagtcttctttctgttgctatggatctgcctgttttggatatttcatatgaaatgaatcatgtaatatgtggtatttcatgactggcctacttcacttagcacactataatccaaagtacttcttcctttttttgcagaataatataccgttgtatggatgcagcacattttatttatcctttcatcagctggtagacatttaggttgtttccacctcttggttattatgaataatactgctatgaacgttcacttgcaagtttttgtgtggagatattggtggtttgtgtttaaagtattgaggaaccagatttaccaaaacagctgcatcatttttcactccagctaatagtatctgagggtgccagttcctccacatccttaccaatacttgttattggtctttttcattatggccatcctagtaagtatgaaataaaatatcattatagttttaatttattatctctctaatgactaatgatacagaacatattttcatatacctattggatattcatatatcttctgtggagatataaatctttatagcgtttggtaatttttaaattgggttttctgtgctattattgaattataagagttctttatatattctagatgcaagttttcactcgcgtccgagtgaagagaccaccaaacaggctttgtgtgagcaataaagctttttaatcacctgggtgcaggcaggccgagtcctaaaagagagtcagcgaagggagttggggtggggctgttttataagatttgggtaggtaaaggaaaattacagtcaaaggggggttgttctctggcgggcaggagtgggggtcagaaggtgctcagtgggggagctttttgagccaggatgagccaggagagggaatttcacaaggtaatgtcatcagttaaggcaaggaccggccattttcacttcttttgtggtggaatgtcctcaggtaaggcaggaacaggccatttaaattttacttcttttgtgattcttcagttacttcaggccatccggatgtatatgtgtaggtcacaggggatatgatggcttagcttgggctcagaggcctgacattcctgtcttcttatattaataagaaaaataaaacaaaacagtgttgaagtgttggggcggcgaaaattttcgtggtggtgtggagagataatgggtgatgtttctcagggctgcttcgaggtggattaggggcggcgtgggaacctagagtgggagggattaagctgaaggaagattttgtggtaaggggtgatattgtggggttgttagaagaaacatttgttgtgtagaattattggtgacggcctggatacggttttgtatgaattgaaaaactaaatggaataagagaaggagaaaaacaggtattaaaggcctaagaattgggaggacctaggacgtttaattagagaatgcctaaggaggttcagcatagccttgccagcaaagattatttactttaagagttaagagtggcggtttggggatagcaccaggaagtatcagctgtgatgtcttggagaagcagtgtaaacaagagcagggcatttatgagtagttgagactggtgaataggagtatgactagacagaagatagcagggatgacaagttttttggggtgcagtctaagttggtctggtgtctggaatgagactggggccgaataaaaaggagcgtctatacaggagcttaaatgggctgtaccttgtagcattctgaggacaggcctgaattctgagaagggcaagtggtaaaagtattgtccagtcctttttaagttggtggctgagcttggtgagttgtgtttttaaaagaccattagttcactgaatactaagagcctgagaaactgcttgggtgatttgactaataaaggccggtccattataggactgtatagaggtgggaaggccaaacccacgaattatgtctgccagaaaggaagaaatgaccgtggtggccttcttagaccctgtgggaaaggcctctaactatccagtgaaagtgtctacctagaccaagaggtattttagtttcctgactcggggcatgttgagtaaagccaatttgccagtcctgggcgggggcaaatccctgagcttgatgtgtagggaagggaggaggcctgaataatccctgagaagtagtagaatagcagatggaacactgagaagttacttccttgaggatagatttccatgatggaaaggaaatgagaggttctaagagacgggctagcggcttgtaacctacacagaagaggttatgaaatgatgacagaacagaatgggcctatgaggctggaaggagatattttccttggtctaagaaccatttgccttgtgtgggaagagattgataggtggaagtttcagcgggggagtaggtgggagtgaccgatgtgaaggagaaaaactggccatgagggacagaagttggaaggctagctgcttgtctagccaccttatcagcataagcgttgcctagagcaatgggatctgacgccttttgttgccccttgcagtgaatgactccggcttcctttggaagtaaagcggctttgagaagcgtttttttattaaagaggtattaatgatagaggacccttgtgtagtgaggaaacctcttgcatggtggtgcaggatatggaaggcatatttagagtcagtataaatattgatgtgtagtacctttgcaagagtgcgggcttgacttaaggcaatgagttcagcttgttgagaggtagtggaggagggcagagctgtagcctcaatgatagatgtggaaggtactgtggcacagcctgcctttgctggtgagtggcgattaggcctggtggaactgccatcaataaaccaagtgtgttcagggtgaggaacaggaaagaaggaaatatggggaaatggggtgaatgtcaggtgtatcagagagatacagtcatgggggtcaggtgtggtatcccgaataatgtgggaggccagattgaagtctgggccaggaacaatggtaattgtgggagactcaacaaagagtgaatatagctgaaggagccggggagcagaaagtatatgcgtcaggtgggaggaagaagatagattttaggagttatgagaactgtagagagtgagttgagcatagtttgtgatttttagggcctctaaaagtattaaagcagtggcagccgctgcacgcagacatgagggctaggctaaaacagtaaggtcaagttgtttggacagaaaggctacagggtgcggtcctggctcttgtgtaagaattctgaccgcactaaccatgcctaggaaagaaaggagttgttttgtagaagggattggggtttgggagattagccggacacgatcagcagggagagcacatgtgtttttatgagaattatgccgagataggtaacagatgaggatgaaatttgggcttgactgaagtaatgggggctgtctgtgaagctttgcggcagtacagcccaggtgatttgctgagcctgatgggtgtcagggtcagtccaagtgcaagtgaagagaggctgggatgaagggtgcaaaggaatagtaaagaaagcacgtttgagatctagaacagaataatgggttgtggagggaggtattgaggataggagagtatatgggttcggcaccacggggtgggtaggcaaaacaatttggttgataaggcgcagatcttgaactaacctgtaaggcttgtctggttttaggacaggtaaaatgggggaattgtaaggggagttataggctttaaaaggccatgctgtagcaggtgagtgataacaggctttaatcttttcaaagcgtgctgtgggatgggatattggcattgaggggggtaagggtgattaggttttaatgagatggtaaggggtgcatgatcggtctccaaggagggagtagaggcatcttatacttgtgggttaaggtggggggatacgagagggggatgcaaaggaggctttgaactggggaaaagggcagcaatgaggcgtggctgtagtccaggaacagtcagggaagcagataataagggaactgggcaggtggggataactaaaaaagagtgtttaaaagaatgttttctaagttggcaccagagttggggagttttaagaggtttagaagcctggctgtcaatacctaccacagttatggagttaagggaaacaggcccttgaaaagaaggtaatgtggagtgggtagcctctgtattgattaagaaggggacggacttaccctccactgtgggagttacccagagcgtctgtgatggtcctgtaggcttccgaggcaatcaggcaatgtcagtcttcagctgctaagccgagaagatctgggaaggagtcagtcagagagcctcgggccagagttccacgggctctgggagtggctcccaggtgagttgaacagtctgattttcagtggggtcccacacagatggcacgcggcttaggaggaatcccgggctgtgggcattacttggcctggtggccagatttccggcacttgtagcaagctcctgggggaggaggttctggaggaacccctggcagctgcggttcgggcatttggagttcttctgtgctggagatgtggctggggtttgtctcacagtggaggcaaggaattgcaactcagaaatacattgctacttggctgcctctactctattattgtacaccttgaaggtgaggttaattaagtcctgttgtggggtttgagggctggaatttaatttttggagttttatttaatgtcaggagcggattgggtaataaaatgtatattgagaataagacggccttttgaccctttagggtctagggctctaaagtgtctcagggttgctgccgaatgagccatgaactaggctgggtttttcatatttgatgaaagaacctaaacgctaactgatttgggagaggtcggataaagaaaaaggagcattagccttgactatgcctttagcttcagccacctttttaagaggaaattgctgggcaggtggtggagggctagtctcggaacaaaactgtaagctggaccgggtgtcaggaggggaggtgataaaaggattatagggttggggagtagaggctgaggaagaattgggacctggctcggcctggcgaggagcagcctggggaggaggggagaggtcagatgggtctgtagaaaaggaagattagaaagactcagcaatgcttggggttgagactgagagaacaagcgggagggaaagaaggaagatttgggacgagttgcattgggaacaaagagtagggagggaacaatgtgtgaaagaatgcctggacgtcaggcacctcagaccgtttgcccattttacgacaagaattatctagatcttgtaggatggaaaaatcaaaagtgccattttctggctatttggaaccactgtcgagtttgtattggggtcaagcggcattgtagaagaaaataaggcgtttaggttttaagtcaggtgtgagttgaagaggttttaagttcttgagaacacaggctaagggagaagagggaggaatggagggtggaaggttgcccatagtgaaggaggcaagcccagaaaaaagagagtagagacacggagagaaggggttgggggggttcttgccctccagaaaagcagagaaggggtagagacacggagagaaggggtcgggggggttcttgccccctagaaaagctgtacttgccgctaagggtgaaggaccaaggcaggcgtccctgcgtggccagagacctctgaaacgtgggtgaataatcaggcaggcgtccctgcgtgattaaacaccaagggaagactgtcttcccgagcccgtgaccagcacgggagttttgggtccacggataaaacgcgtctcctgtctctaccagaaaaggaaaggaactgaaattaagagaagggagagattgaagtgtggcgccaagattgaaaggagaaagaggttgagggatagtgagagaggttggagaagagaataaaaagaggccacttaccggacttaaaattggtgagatgttccttgggctggtgggtctgaggaccagaggtcgtaggtggatctttctcatggagcaaaaagtaggaggacaggggattgatctcccaagggagttcccccctccccgatctgagtcacggcaccaaatttcactcgcgtctgtgtgaagagaccaccaaacaggttttgtgtgagcaataaagctttttaatcacctgggtgcaggtgggccgagtctgaaaagaaagtcagggaagggagttggggtggggctgttttataagatttgggtaggtaaaggaaaattacagtcaaaggggagttgttctctggcgggcaggagtgggggtcagaaggtgctcagtgggggagctttttgagccaggatgagccaggagagggaatttcacaaggtaatgtcatcagttaaggcaaggaccggccattttcacttcttttgtggtggaatgtcattagttaaggcaggaacaggccatttacatttcacttcttttgtgattcttcagttacttcaggccatctggatgtatatgtgtaggtcacaggggatatgatggcttagcttgggctcagaggcctgacacaaatcccttatacatatgatttgaaagtattttttctcattccttgggttccctttttactatctggacagtgtcctttgaaacacaagatttttaaattttgataacctctaatatatctattttttgtcttttttgttttaagtgaataactagtaagtctgcctaacttaagatcacaaaaatttctcctgtattttcttcaaagagttttatagatttagctcttacattgaggtctgtgatttattttgaggtaatgtttgtgtgtggtgtgaggatggagtccaatttcattcttcaaacttctttttttcccccttttttttagagcaaggttttgctatgttgcccaggctgatctcaaactcctgggctcaagcagtcctaccgcctctgcctccctatgtgcctggcgaatttcattattttacatgtggatattcagtttttctagcttgatacctatttttataatctaatagaaaggactggtgctcctcaaacttaaatgttagtaagaatcacctgaggttcttgttaaaatgcagattttgttatggtagtgggacctgagagtctactttcttacaaacttcctaggtgatgctgctgattctggtactgggactttttttttgtttatttttgagactgtcgcccaggctagagtgcagtgttgtgatcatggctcactacagacttgacctcctgggctcaagagatcctaccacttcagcctccagagtagctgggactataggcatgctccaccatgcctggtgtattagtccattttcacactgctataaagaactggctgagactgggtaatttataaaggaaagaggtttaatgactcacagttcagcctgtctggggaggcctcaggaaagttacaattatggtggaaggcaaaggggaagcaggtaccttcttcccaaggtggcaggaaggagagtgaacacaggaggaactaccaaacacttacaagaccattagatctcatgagaactcactacaagagaacagcatgggggaagcagcccccatgatccaattacctctacccggtctctcctttcacatgtggggattataattcaagatgatatttggctggggacataaaacctaaccatatcaccaggctaatttttgtattttttgtagagacagggtttcaccatgttgcctgggctggttttgaactcccgggctcaaatgagctgccttccttggcctcccaaagtgctgggattgcaagcatgaaccgtgcctggccattcctgggacattttgaatagcaaggaaatagacaagtactaaacaaagaattataagtgcattctaactgtgcatctgttttattttcacctgtctgacaactggctttctttgctgcttcccgtatgtgggagactataacctctatactgcttccaagatcacatcccattaggtcaagccataaacttaggagttgcaaaatggcattgctaagcctgagtttttaattcccagcagagatgagccaattggctaccttagacctatcagctcttaggtgttcagttcttagttctatcagctgtggctaggggtctggcttgtagagggctcagtgggtcagtggcagctcagagagaagagagttgtgggctggccagaaactgaatgcttttctacagatgtacaattgaccttctgtgtcatttcacagaagtgtgggcatctttgactttaaattgaaaattgttaaaggcatggtaattagcaggagtcaggaattctccaaatgactgttactgaccaattctgggcagaggagggggaaaaagaattttccttgattaccagctaaactgtgtttcatatttagcaacatgaatgatttgtgtgacttcactaaggactccgattggaacacaggcagtcctagtgcagactattgagtgggcagtcatgggtaaggtactgagcctttgtggaagctttctcatttatagactgaggaataatagctgttctgcaaagacatttttaatcattttgtttctggaacaatgtgtaggtgctgaatctgttagttttcctctctttccccgccttcctacttccagaaaagattttctgtgatttacatataaatgatcaagtataatagggccattaaattacggataaaacaagagccctctaatggaaagagaacatagtttttctacaaaaatcaaggctaagatggttactctaactgaataaaaatttaactatgagctttctggcacacatcataaaaacagaatagatgaaactgtttttaatatataaaaatcttaaaataccagttaggagagagaaaatgtttttttctaacattaaaatcatgtttacatagaataactaataagaaaaatggaatgacataattgacaatgttttaaaagtatcaaatgataaaacctttttctagtatgctccttgaattctagcctctgcacactgtctagtttctcatttttaggtatttgttacattagcatcccacttccaggtatttttatttggaagtatttttatttggaagactgggatttttattttagaagcatttaaacaaccagctttaccttatctattgaatgtctctgttctagctccccctttctttgtcccttataaagggaaaccagtagtctgttagtgaagagtgggaaaatcactaacttactgtaaggatattaactcttatatatcacataaaacatatactaggtccattacatagtacaaagaataagttgctacagtgccaataagcatgcaaataaatttgataattaacagctggtaggatttatgcatttattcactcatcatctattgagcatctattgaatattggaattatagcgagtaacaaaacaatggaccatagattatatcagaaatcttcatggttgcatgcaaatgaaagaaaaaaatagaatgaggatttatgtgcttagggcaaacactaacatagagccatttcttaggcacacatcaactaattttatactatataattacagtgcttaggtgaaaacaaataatacaatgatggttttaataaaattaaatttaactccctcttgtttcactgttactgtttttcaattaggaagcatcatgccatttgaaatttgggtaatacatatattattttcaatatttagatagcatgtatgttaaaaatattttaacttttccattttgcttttcacttcatgttatcaccctatttggacatttaatttttcttgcttgtattgttgcctgtgctgtacaatctctttattgctgcttttcttcaatccttcctgcatattgccattagactcttttcctaaagaatagtctttgttgtgagagtctcttgcccaccatctgaaatgctgatggctgaaattcaaggctttctaagagatggcagaaactaacttttttgcctcttattttgtatcactacattcatgaaagtttgaggtataataattcacacaaattcatcacataaaactttaatttgttttcatttgcggtattctccatgagtaggatagcgatttccatcctcactcgctcaaatattactcagcctttcttgtatagctcaaaggtcacttttgtgaagctttccaagttgacttcagctttcaggaatttccttcatctaactctttaagtaatttgggttagtttatatataacccagaaataatggctatgtgactcccactctatagagtaacattttttaaatctgcatctaatgatcttaaataataaggtgtactttttgctagattataccatgacatgcacacatttctccagaaatcgtcagtaagaccttcccaaagttctatattcatgtcagccacaaaattatctctctggcttcctcccattcatgtttgttcattgcctagattaagccacttcaccttccttatcctttttttttttctttaattactacagtttggttctgttgcccaggctggagtacagtggcatgacctcagctcactgcaacctccacctccctggctcaagccatcttcctacctcagcctcccaagtagctgggaccacaggtgcatgccaccatgccttcctcctccattttatcacatcatgacactctgtcttcttgctggaagttgtcattggaacttctgctgtttcctacttcctagggaacccagaattttcataccttactctcaacccatcagttcccctgagagttcaagaaacttccaggtaatagcagttcttctctcactctaaccgatttttgttgtgagacatccttgtggagactttctggtaaataaaactttctactactgtcttttctatatcattttcaacaagtactttctacacctggtaatagtgcatgttttatctactcttcaaaactaagggaaaaaatgaggacaggaagtacttttttattactcatggcttaactcagaggtccccaaacgtcgggccacagaccagtaccagtatatggcctgttaggaactgggacacacagcagagttgtgcagtgggtgagtgagcattactgcctgagctctgcctcctatcagatcagcagtggcattagattctcataggagcaggaaccctattgtgaattgtgcatgccagggagtgagggatttaggttgtgtgcttcttatgagaatctaatgcctgatgatctgaggtgaaacagtttcatcctgaaaccctccccaccgtctgcgggaaaattggcttccatgaaactgatcccttgtgccaaaaagattgagggccactggcttaacctttagcaagttctcttctttgggtgaaatacaagtaggaaatgaagcttcagtcacatattttctttccttttttttgtttgtttgtttttttgagatggagtcttgttctgtcacccaggctggagtgtagtggcgctatctcggctcactgcaacctctgactcctgggttcaagtgattctcctgcctcatcctcccaagtagctgaggttacaggcacgtgccaccatgccctgcgaatttttgtatttttagtagagatggggttttgccatgttggccaggctggtctcgaactactactgacctcaagtaatcctcctgccttggcctcccaaagtagtaggataagcttcagtcatgtattttctttctttcttttttttttttttttgttttgatcacaggcatgagccaccatgcccggcccagtcatgtattttcgatacaagccgggtgtcattgacatctaccacatgtccacacggcatttcgttcttctgcatgtagtgttaaagaaggtgtagataaaattcctgtcattccttccttttctaagcttgcatttcttttcctcctcctaaaaagaaatgataatagcttaaccaaataaagcaatttctgattatgcatgatataatagattatgttatcaggactaggtaagacaatcaacaactaaccaaatatcttaatgttggaatttattatgcgctacctatatgcatatattctatgggcaaaatattatattcatataatgcatacatatgtgtattttaagatactttgtggtttttctaaataattgtattatatttaaattatgagaaaagttaaaatattaactaatgaataaaattacatgtgtatatatgtatctgatatatataaccatatatattatatatttatatatgtgtgtaatatataacctatagtcttccctctttctccattacaagatagacctacagttatagtttttttaacacaaacttctactgaagatgcagagtattagaatttcctttcttgctatcaaactcaaacattatcatcctcatggaaacattaataatagctgtttactgtaccattagtaggtaccaagtactactctaggagatttataaaaattaaattgtttaatcataaataaataattgtgaagtgaattttgagaacatggaagctcaaggacacactgtaagtgcaggagatggaaaaaagggtatataaaattggtctgaatatccagattaaaatttctagcattcttagttggaatggtatatataacgaaatactgtgtggaactcaaaacaactactattcatcgtaagcatatttctcacagtagcatcagccacagcgtcactgagcaaagtagagaaagtggttgtgaatctgacaggccgtagcttaacatctggcacaataaatcattattatcacattcttaaggttagaaaggagtgataatttaaatgtttacataaaagaagtcacgttttaaatttctgttttcttggtaagttatacttcttagccacagtttccttgttcataaaatgggggcatttgttagatctgtaaggatccttcaagccttacaatttctacaaatttgtgattcctttcaattaacattttatcaccaaactaaattatcttaaaggttgaaagaatatgagatttaaacccaatgagttattctattgcattagattcagaagaccaatggagaaaaaagtataaaacaaatatatgcaatagagaaatatcaaaagttttccataatatttctacatgtatgtatacattgaaataacaattttaatacttaccatttaagtaaaatcatatatcgtaacttagagaataaaagcttttctaaggaattcaataattagagactttcatggtatgttgccttatgattctcttttgatttgctttgaggtatctgttacttctttgaagtttatgtttttcttacatttagttttggatattttctcccattacatttttcttccataatctctaagataaacacatttattattaaaatgcagtagatttcactagatctttaaaactcagtaacaaagtatcattttctatgcattattattatcactactaatctgtaattttatagtattgtatatacttatattattttcaggtttttggatcacatttcctagacaataatgagaaataagggcttctatttaaatggatattcaaaaagtatcatatatttgctgtggaccttcatctcagtgaatttgtgaatgtattatttataatgaaaataaaataagtgaatgctaaaaaagtttttccttttgccaggggatttaccagaaagagaacaaaatggatcatggtatgatacttttctgtgtaaatatatagagaagaaaatctaccaaagatttaacaatgattttcctacaattggggtgggaatggaatggtgagattcagaacaggttcaactctctatgtggtatctttctgaattagaacattttgaatgaatttgtatttctttaataactactaaaatatgttgttatattaagatagtcatatttagagtatttatactaattcttgaaatcacaacaatttatttcatatgtaaagaacaattgcaaaaacctctgccttgatggagtttacggttcagtgggggagagggtgataataagaaagtaaaagatggtatgtagaaaaataaaaacacagaagggcagtaggaagtgtgtatgtgtgagatataattcttagtaagagaaagaaggcctgtaactgaaaaattaacatttgagtgaaaactgaaagaaggcaagtatattattagtccagacgttctcacactgctataaagaaatacccaagactgggtagtttataaaagtaagaggtttaattgacttacagttccacatggctgcggaggcctcaggaaactcacaatcatgatggaaggcaagagggaatccatgaccttcttcacgtggcggcaggagagagaagagtgaggagtgaaggggaaagagccatttataaaaccattatatctcatgagaactcactcattatcacaagaacaggatggaggaaaccacccccgtgatctgatcacctcccatgaggggtctccctagacatgttgggattatggggagtacagttcaagatgagatttgggtggggacatagccaaaccatatcagcaagggaagaaaccacgcagttgtctgtaataggaatttcaggatgaaggaactgctaggacaaaggctctgagtcagaagcacatttggatagtcacagtaagtgggagtgtggtaggagatcaagtcagagacgtaatgaggtaataggaaacttgggccatggtgagaaattttatattggctagatgagttaagagtgaaataagcattaagaaggaagtaagtggttgggtaattgagtaaaatatggtttgagtgcctcaaaacaaagagcaaatatgaatagagaaaatactatttccccagctagcaaagtatttttggaaaaattaatatcttctcactagacatatgtatatatccaagctatttaggtaaataatttgatttaaactgataaataaattaagatattttacaatctttcattcttttcatttttttcatttatttcttgagtatctattatgtatcagaagacaaaatcacatcatactctcaagtttacagtctaagtctacaacgtaagtctaatatatccagccaaagttagatttgcatttattttgcatgataatgttagaatggtttcaagtaacacttggaaagataacctaaaatgaaaaagtttagagagtgaaatgcatattattttttatgtgggaaacatgaatcttagttgtgaaaaatagccttgatgatactctgaggaaaagtaaccaggttttttttttaaccattaagtgtgatgttagctgtaaattttttgtgaatattctttgtcttgttggggaagtccacttttattccaaattttctgacagtttttattatgaatgagtgctggattctgccaagtctttctttacatgaattcatatgattatatgatttttctttagtctcttgttgtagcggattgcattaattgatgttttattatttttatttttattagtattttttgagacagagtctcactctgtcacccaggctggagtgcaatggcacgatcttggctcactgcaacctctgcctcccgggtttgagcgattcttgtgcttcagcctccctagcagctgagattacagacatgcaccaccacatctggctaatttttgtatttttagtagagacggggttttgccatgttgaccagggctgtctcaaactcctgacctcaagtgatgcgtacacctcaacctcccaaagtgctgggattacaggcgcaagccactgtgcccaacctaattgatgttttaaatatcgaaccagcattgcatacctggtataaatcccacttgttcatggtgtatgtaattttttatgctttgttggattagattatttaatagttcattgaagatttatgcatatatatttatgagagatagcttttatttgttgtaatgtctattagggtttggtactaagttaatactggcctcttggaaaaagataggaacaattttctttacttctgttttatgaaatatattggaagattaatatttcttccttaaatgtttggtagaatttcctggtgaaataatcaggtccttgttcttttgttcttagaaggttattagtaattaattcattgtatttaatagacatagacctattgagattatctgtttctccttgtatgagtttgtgtctttcaaggaactggtttatttaatataatttatccaactattgaccatagagttatttctactgttgctttattaccatctaatatctgtgggatcaatattttacttttgatattggtaatttttgtctctctcattttttcttggctagcatggctagtggtttgtcaaatttattgatctttccagagaaccagcttttgatgtctttttttctattttccttctttcagtttcactgttttctgctctaaattttgatgtttatattcttttttagatataaagtgttgttttttctctggtttcctagggtgaaagcttagagtttcagatcttttcttcttttgcagtacatgtacctaatactatacatttcccttaagtagtatgttcactgcatcccataagttttggtcagttgtattttcattttcatttagtaatattctagaatttctcttgagaattctccttgactcgtgatttatttggaagtatgtttaactttcaaatatttggagattttcaaactgtctttctgttattgatttttagtttaattccattgtggtctggaagcatacttcatgttatttctattcctttatatttgttaaagtgtgctttatgggccagaatgtggtctatattggtgaatgtcccatgtgagcttgagaagaatgtgtattctgctgttgttggataaggtactctataaatgtcgaatatatcaagttaattgatgatgctgttcagttcaactgtatcctaacaaattttctgcctacttgatctatcagttactgaaagaggagggttgaaatctccaactttaatagtggatttatctatttttcttttcatgtttatcagcttttgcctcgtgtattttgatactctcattaggtgcttacatatttaagatgttatgtctacttgaagaatttacccttttttgttatgtagcgtccttccttatccttgatacttttcttgatctgaggtctactttatctgacattgatatggctattccagctgtttttttaaaataatgttagcatgcgatatcattctttattcttttattttcaacctatctgtctttgatacttaaagtggtttcttgtaaacaacatcaagttcagtcttgtcttctcatttactcttacagtctgttttttaattggtgtattttgaccattcacatttcaagtaaatattgatacagatggattaatgactgtcatatttgtaactgttttctatttattgcatctgttctttggggaaaggaagttaaagtcactaggtttattattccttgcaacataaattaatggctctggggggatatatgcaggtctctctgaaagtgtctattgtgaacttctagttttctttttttcgaaagccttgaccatgcagaaacatgaaactgttcatatagcattgtttcctgacagtttatagccaatctatgtcagttccataatttttaaacttagaacatttcattaacctccttatttcctttttataaacatcttcatttttcaggcattgcatttaacttgattctgaaccttactcagatgattaactcaatcctttaagaagatattgaatttctgaagaactttctcaataatgttgatttaaaatgattaatgatagtccctttacttcccattcatgcttaaattttataaaatacaatcctttttatttagaatttaaagaattttccttaaatattgtgaggtgtagcagtaacagctttttgttttgagcaaaacttttctctggttatagtaaaaactggtttattccccttcgcaaatttgcaaactcaccaaaagccctcaatctgttcttccacaaagatgtaataaagcaatttgctgttgaattctcaaaatacaagtatggctttaaaaacaacttcttctggatatattttgtgcaacagcattttaaaattcttgtttattcttttgaccacctgtgaaatttggagtattgtattttagccaggctaatataatcaattctgccaactctatgtcaactacaaggaaatattcttacttaaaacaaataaataccactaattagctcttcatttcgtgaagtctgagaatgtgaggctcagatagtaaccattgaaaaaagacaactcagaatgttgttatttgagcataattctattggttctctgacatgaaaggaagcctttctcccccaaacttcaagggattttctttatttgatctgagaatcactgataacttttgccattctcaacccaacctgattccttgtttgttatgattttaacagtgacaacaaggaaaaacatttgatgttagtaatatgtgaaatcttaggattctgtgtcattccctttattttataggtcaatacatatttaatacatttctactgcatatatagaaaaggaaagtgagatttatatactaaagcatgaagtacagtgtcacaaaagcagaagaggaaagaatttcaagaaggctgaaactgtcatcagtgttaggttcagcactatgttttcattaaaaaaagaagaaataattttcatttgaaaagttaaaaaaaaaaaacgttttgtaaagcttttggaatgagtcttactatactacacttgtttttgtaagactgcctgaccctaggaattctaagatagatgactaatatagataatggttgctgcttaagtgtgcttatgtgtaaccctaattcatcactgtccaatggttaatagatttagagtagctgcattaaaaaaaaaaacacgtgaggtctttttttaaaacataatctgtcttgtctttgtcattttggcaatagaaaatgtagttttattttgataaaggttgaagaatttattgggagaagatatctgatggcattaaaaatgtctccctcaaagcaatttaagatatcaaagttacttattgaggctcaatctgttgacacagtcatacaccaataatttcctaaaagcagtacagaatactaatgggtgattattttttagcaaagaaaatgcaaatatattctgaattgaatgaatgttatattaaaattagatgacgaatatttgaaatgaaggagaaaaagttcattagcagaaaaatctcatgaatcattaatatttccactatagagcaagttgattttttattttagtacagtaatgcatagtatcacatcaagtcatcttttgtttatacggttaaaaggaatttttcaggaaagtatttacttcataaataaagcttttttttctggaagtaattgaggttgcatagcagtgtcttcagtacggttaatgttcaaagtgaaaagaaaatatacacaaactttgggtggagaataatacagatttcaaacacatcaataattcatttgacatgaagcaaggaggggcggtgtgtcctacatgctctgccattttctctgctagaattccacttcccccattgtatcctctcaactcccacaactcctctttaaattttagttcaaatatcacttcctcaggaaggcattctcagattctcagatattgtcagtacctactctatacttatttataccaagtacttatcacatatagaattaaagattggtcgtttaatggtgttatctgtcactaaaaagaaagttcttattgtcatggaacatgaccacattgttcacagttgtattcctatgtccagaaatggcactttgaacataatgtccactcaataaatgtttgcttggatgactaaaaaaggagattttttaaatggggctagaaggtatattgcttccaatcgtcagggactttggatttgtgtttgtgtgtttaggctactagggagccatgaagagtttttatcagtagattgacaaaaggaaagcaatactcttgtcaggttgtaatgtgtagagagctttaagtgtagcaaaactgcagggaaggacactatcagagtactgatggcagttcaccttgaagacagtatggtaacaataacatacgagatggtagcattgggaaaatattcatgatacattccaagggaagaatttatagcactttgcctttgattccatgtggaggaggagtatcctagataattttaaggttttgagccaatggataagatgaatggtaatggcattactgaagaaaaggcaattcaagaaaaagagcatgtttggggagggataacagtagcaacaaaggcaacaaattgcctcttaatgagaacatgctgtcttatatcatagtagatactacacacattctttctaatttgtgcagtaattcagtgttactcttccatttgaaccgttatggaaggtaaggctcttagaggttaagaaacttgcttaaagtcaaacagttaggatgtggcagaatttggattttattccggattttatgctggctccattatgccatttttgagaggataagatgttaaattaagatagagaaatgatagaaaaaatatgtgtatatatacacatatacaaacatccatgtatataatgtctgtatatataactatagatgtatgagtgtgtgtgtctccgtgtgtatatttgttgtgtatgagaaattgaaacacatttatgtatggatatttagcaagtggtgaggaactttgagatgaggattctgcagtgatattgatgttggaaatgggcaatttattcccatatcaggttctaacatttaaaatgcacctgaatttgtattaagaaacttgtcttgctaaattttaattctatcagattaataatagccacagagcttgtaaagggaatcattattctaaccttttgaaaaaatttttttgtagctcagtttaaaaaaatggaatcatcagcaaaagtttatggttgttttgtcatccagagtgtttccattaaaaaggttttgtgattattttattcagttatattaataataaaattcgttttaatttatatttattgtgttccatcagattcttctatttgtggtgacaggtaacttaacacccttgaaaacagctgtttacaagatgccattctgtaatgtgggtttctttctcttctaatgggaggtcctaatgagcaatgtaatgatccaggaagatgagcaaaaggacttaataattgaagattgagtgcaagaagtgttctgtagaagtttattaaaaataatcattgggtattttggagataattatttcacattagaatggagaatatgattgtaccagaaaggaacatgggcaatcattctgtctatccttgtaaattcttgatctgcacctctagaattttggttctggccagtttatgctgactacatccatttttgaattacatacataattttagattgtacttcatagtcttatgcttaacagtgtgttgcctttgaaaggtatttcagtttcaatgtaagcatttcttagctcctcaaattgatggcaagctcctcctttaaggtcagcatatgttttctggagatttttatatcctttaaactgcctaatggtgagctgaatacaaaataaaaaataatacgtaggccaactatttggaaggctgaggcagaaaaatcacttgagcccaggagttcaaggctgcaatgagctatgattgcatcattgcactccagcctgggtgacagagcaagacgctgtttctaaaaataaaataaaataaaataaacttagggaattagatacagcatctcttatggcatagaaacatgaagatatttgtttctgtcaactcagggtgaaaataatctgatgaaatggaacaatctagttgaagttcagctctggctatatgacttccgctttctcacctataaaatagtgataatcaaagcatttaccagttgtatgttatcagaaattgaattttaggtactcctgtgagcatttggaatcttgttaatgttatcatttttcctaataccatcatgtgatatataatactgagaacttggaaatactaccttgtgtttttatacccagaaaactcaagtagatacaaataattagggtaatttgaatgagataaatttcagaaattaaactagtcaaaaatttcaatatttctacattttttatgtgctaagtgaagacctaggaaactcagtgggatgacagcaaatacctagacattgtgctggatcggtacagaaagataaatgaggtatttacctcatttatggactctatacttaggactctatacttaggaaatatggactctatacttaggaaacttagggaattaacataagcacaggaaatataacacacatatcaaatgtagagtcatcaattatttgaaaaatgtaaaatgttcatcatatagccatctaccattgaataattttagatgatctcaagtctcattattgtaagtcacttcccctcctcccacaaatgaccttaaattattccaccaactctgtatcttattacttcttttgtcaaagcgaatatttggtaagtaaaattttaagtaaattgcttcagaatgtcaccatcttatttcagactttcatgtacacttcaacatttgaacctttttttttgtacttaatgggactaaaaatatctgcactacctgtacgacacattgttatttgaatactttgaaactgtaaaacactttgcaaatactgagtatcattatttaactccagctaaacaaacaaggttgatatagatgttttcaatgttgctgcctgacagcaaaacatgtgttagctcagcaagagatattctgtatatactctatgaaaatactcgcagatgaactttccattaataaaaactaatcgcttggtaaagaggatattatttgtttcttcttctatcccatttgttacaaatttaggcatatgaactacaggcatatgaaaatccaggttttacagtgaaaactgtagatcagtggcccccaacctttttggcaccagggaccagttttgtggaagacaatttttccatggacagatgatggggggcaggggcaatggtttggggttgaaagtgttccacctcagatcttcaggcattagttagattctcataaggagcatgcagcctagatcccttgcatgcacagtttacaatagggtttgtgctcctgtgagaatctaatgccactgctgatctgacgaggcagagctcaggcggtaatgcttgcttgcccaccactcacctcctgctctgcagcccagttcctaataggccatagaccagtaccagtccacagcctgggggtcggggaaccctgctctggattcttgcttcattctctgatattttaccatgttttaagaagagttagggaagattataggtctaggcaatataatgtaatggcaagtcctcaggctccaaagtcatagatttccctttgtatcttggccccaatgctaatgatgtttctttagaaaagttgcttaaaaataacgtttattgaatgcgtataacatctcaggtactgttgcacatactttacatgtatgggttatttactattcccagaaacactagaagtacattattattattgtttctatttgatagattaggtagctcaggtattaaagagttgacgcgagatttgatcccaacagtgttttccagagcctgttatttttttacaccatgcttctcaggctctgtttattatctataaatgagattaaaaggtgatctactttatcagtttttgagaattaaatgagacaataggtgatgaataaattacaattcaacagcacctgtaaatgctcttgatatattccaaacatctgttggccaacatattcattttttttaacttgggtagcagtgttaacactagcatagcttctaaatagtgaaaaagaaaaaacaaatatatctatctatctatatatgtatgtgtatatatatatatatatatgcttgttaatttgaaatagctaataaagaactaagtgaaatcagctacttacaagtagaatgaaaacattaaaactaagtacaatttaagaggatgtagtgcattttgatgggctgattgttagtgtggaagagactttatttcttccctactaacattcactgttaaattggattaagttcctaattttagtcagtcaagcatataaaacctagaataaccacagagagtaggagcaaatgtagcctacaccttggcccccagcatccctaatgagggcacataactcccagaaacactgtttccccattcttaggtcaattcttgctgggacactggctttttattctcccagcttacgtcatcattcaggaagttgtaaataacaatctatgaacatgcattcaaagggaatggttacaagctcagaatcaaccagggtcacatcttcatttgggtttaacatattcaagaactagtgtaccccaagcctaaaggtagagactacctccagcgctctagcccagaatagctgtgtattgtcaagccctaacagtttatgaatagatgctctgcatgtgttctttagagctgtgctagaattgtgtgtttgaaactttaatttgtgtaggaagcacctgcagagattgttaaggggatggtgatctggttggcctgacttggggagtgagttttctgcatatccaccagattatcagaggatgcccatgcagctggtcattggagcaaacttggaataccaagcctgtaaagcacagatgatgcattacctaggtgagcttcacacatttgtaaggaagttttaagatcgatcttgtcagatacccagagccagatgactgcattttaaatctgtgtgctgctctgttttttaaaactaacatttctattctaggaatcttttattataatttagatctggaatgacttttttctaaatggctcccaatgtaatgactgtgtcttcagattcagcaaccatgttttcattatcctctgaatcacagagtataattgtgcattacagtttggggtttgtttttcctactaagaaactccttttccttgcgtcctttctgataaatatcattaatttttccactatggaataattctacttcacttttgaaacataacctcatttgaatgtattttaactgggacttcattgcctgagggaagatggattattagtgacatgtgtcttgcttcttgatacagaaaagataatataaaagtagtgtttctactatatcttaaaaaaagcttcatataagccaattttctttaatgatattgtagcaagggaaaatattgtacaactcatttaccttcatttttacatatttttcaacctcaatgataattctggagatattcatgtgccttatcttgaaatcaaattaaatcattcttttgtgatatgacacgcaatttgtgacattttgagccaacagtatattaagatttaattttcagttcattatagacctagtgcctaaatgaaatttattgagactaagtaactctgcagtgattgtgggctgatggttcaagtacagtgattcagtgattcttagtaggggagaagataggccatgtaattgaacttatctctggatttttgaaaggttgaggcaatacctgttcttccaacccctcactggctccacatttcaaacacactatacctgagttggaaatatcagcaaatgtgtttctagatggatatgtgaaaataaataattattggcttactgtgttttttaaaattgtggtataccatacgtaacatttactgctttaaacattttaagtgtacagttctgtggcattaggtacattcacattgttatgcagccatcatcaccatccatgtatagaactgagctactattttttaagatgtattttttcccttagattcttctcttctgagtttgttaatgatgtccaattaaatgtatgcttattttatatgtatgaggttactttttaaatgggaaagttgagctccatctgcctgagggcactgtaaaaatttaactttcaaaatataattcctgttttgctgttgttgttcctcatgatttccttttttatatgaatattttctttaaacatattgacagtcaatttgacaagctgtcacttctggcaaatgccactttttccattagtaacttccttctttcaagaaacactattagtcactatatcttattatattaaacatctccttttaacactggtaacataaaaatgttttactaacagttctcacacaaaaatatcatattgaaacaaaaattagaggaccagaggcatttactcagaaagaacaaactttttcttagtaatgacagtgacccaaccaatcaaataaattgaagaagtaataaaatgaatgcatttttatctgaaacggatgccaccagtaacattttgggaattccaatttaaaaggcccaatgccccccatgcaagattagtttttcaagatacttttacagggctaggacattaaaatatttgcttctctattggagcagctctttcaacaagttggaggactgatcacatccctttgccaattgcagttcagataggctctgggaaggcaaagtacaggatgtcatgcaagtgaaaacagaagtgattaatcttatggatagatcaaggaaatttatctgaactttagaagtgagacttgatgctaaataggtgtttggtgtatgaaaactaaggatgaagcattcctggtaaatagaaaggcctgattgaaagctctgagctgggaacacagcagagggaagcctactttggaaggagggattggtctggcaaagtgctggataacacaggttgtaggtcatataaaaccttgtagggggtttgagcttcttgaagcctatgagtgcaatgagaagccactgaaaggtttttagcaggaaattaacattgtttctaatttttatttttaggaaaataacttgctactaagtggtgaatgggagacaagagtgtctgtgaggctaaaggctgttcttgctgaagccccaaaatacttatttactctttcttggtgtaaatgagatgaaagatactacaggaacatcacatgtgttcaataactgcgcgagtgatatacttccctacggggacatgaacagtacttgaacagctgttaatgtctgttgcccttaggaaatttatttcatcaagcatacagtgtttcaacccttattaacttatttcataaggcataatatatctgactgtgatctgttcacttaatgctactctgctctttgcacgagcatgggacaaccagttgctctctgtagtcgtagtttattaacgtgcaattaaagacatttatcatatctctgaaaatgtctcttctcccataaaattaacatcatctcctcaaaaagatgcttacgatatatgctggattatagttactgttaaaatgtattcagaaacaaaaatagaattgaaaactatagaggaatttttttaaagcatgggctttggaatcaaacttgtgtttgaattctagttctgccacttaccagtcatttgcacttgagtaaggtacttatcccttctgaacttcagtttttcatctggaaataggcataatgacatctactttatgaagttgttggttatgtaaagccatctatgaaaaatggttagaccagtgactgacacatacgcattccataagtgatagatacataaataatataaataaaaaatgaatgctatagctgacaaatgtgattaaaaagtctacaatgcaaattatttttataaagtataaaatccatgtgaccatataatatactaggacaagaatgcctgttagatttcagattcaagacaacatactaagtttaagtgtagttatctttgctaggttagctttatgtatttgcatgaataattgtttaaatttgtctgattgtactacggactggcaggcaataaatttcattatctagtcttaaaatgtgaagagaagacagctcaaagttcatttctcatgcctgatctttctgggggatacaatgtacaacatcagataattcttttgccttcttttcttttgtgcatccagtaacagttatatcatttttttctgaatcagccttttcacaaaaccattatgtgataagctcttgtcttggaaaacctcaacagcttcctcaacacctatattttaaatcctgcttaaatgagattaaaatacggcactctgttaagctgtaaaactggctttttgcttctcagttgagtgttggtttgaatgtgtcatttgacctatattgctgctctgaatcttcctcggttgccccaatgatgacagtttcaatgatgtgggtgtttgcagcagagttgttcctaataaggaagtaacgctattgtctttcagacatcattcagcctgaaaagtactatttttcccacctagagctataaatgtctgtaaaatcttttcttcttttggtagcatttgcagcagcagcaggaaaaaaaaatagtcctagtagatttgcagcttttgtagttttggggtgttgtggttccaggctaagattcactcacccttcttcaaaagttgtatacaaagggttgatagctaaatggtgactgaagtacttgatttattagtatctggcagtcatccaatatgtactagaatacaagactctctgtcaacaatagctgcataaagagcaaactgctctgcctgaacctaaaataaggccttctgctgtctgcccgttaattgaagacaagtgggccaggagtggctgaggaaaaacgaacaaagaataggcaattgtcatgcacatggaggcactacctgtgcctctttgagaaacagaaatcccctgacctggttcttacattgagagaagctaacccagcccagtaatacattttagctccttgcatgtataattatgaccattgaaaaataggatactacctttttattgggtcaggtaagatgcaggaggagggagagcaaagtgccctacttgagggtgggattgagattagaatgtgaagagaagagcagaaagcttccttcttacacaaataaaggttctgtggattcatctagaaaaatgagttaaaaaaaaaacgagtggaactatagtttctaaagtctgtggagttgggacaaatggtaattataaagactaaatgtgaatactcatagttctttaatttgattgtattaccacttaattcatagttttgaaggaaatagccattatattagatggcacattaattttaagatgcaacccaattttcaaaatgttaaaatggaaaagaaagttaaagggtgattgttaggacaagcatctccaaatactctgtgtggaggcattttaattccatgctcttgcaaaattaaactcaaaaatgtttcaaattactgggtgttatatgcccttctggtggaagccacattttctctttcctttctttccctgtctaccctccctcttccccttcctccccaaatctatcagtaaagaccaccttgctgtgggcagctagctgaaagagaccatctgccttaggaatagcctacactagattcaaactacaaagaagcaggttgggggaaagaggaagtgaggatttcaagtcaagaaagcatcctgcctactctggcaaagtattctgccagcagcatatttggattcacactgtgggtttaattctttccgtttaatactttttgttgaccttataaagccaaaaaataaaggaacacccatggcactgctggaaagaggtaactgatttctgatgaaccggtaggcattttagccactaaccaacgtatcaaagtgggcacaactaacacatgttaacagttttcccaaagtaagaagcttggtttggagtgaacaggccttgtacttttgagattttattttatgattttgtgaattgatgttctgtggggaaaaaacttgccttagttttaatataatggtcaatgactaagaaaaatcaaggagttgggctgggtgcggtggctctcgcctgttgagaaatttacatgtccatcagtttcttgtattgtagtttgaaatcaagaaactacctcagtttcttgtacaagtagtttgaaatcaggcggtcaagtttcattctaccctgctagaatatacaagaatccaaagcaataatgtaatttatacatttcaaaaggctaatgccaaattttatcagcaaattggtcataagtctccaactggaacaaagtgagtgattgttgggcaatgtagtcctgcaatgtgaaattcttgtatgcattccttcttaaaaggaagcaaaataagcctttcctatagaatttccacttcaagattccatcatcggcacatatcaaatactgttggcaatgctgaaagtaaaagcaaggactcacataaagtcttttgttgctgaaattaaaaatagttgtcactattttcaatatcaaaatcctatggtttttgacaggtttaaattctctgttgattcatttcagaacagggtcatctttttatacttctttgacattttaaaaaataagtagtttggctagaaattgagtgtttcaagccatcttggccctttgcaccctaaaatttcagtagcactgtcaagcgaatcagttcttaagagctggaaacacaaagaagacaaatatcaaagaattaattaaaatcttttcttgaatgacaaaattgacattatctactacttatataaggagactacattgtggattaaccctgaaatcagtacttggaaagtttattccagtgtgtttcactgaaatttaaattcatgacatttgaaaaatgtaagttataattaaacactgagagtaattcttgtggttattgtatatttgttaagtattccatggtaaatgtgacctgtaaatctgttaaattaaatacttgggagtaaatttacttttactttctgtggaaacatttggattaccccaacagtaaaagtaacagattaaaaatataatattctttattttcaacttttatttcaatatatatgccagtcaaatgccagtgaataataatcacatttgattgtcaaagctcatggaatggtacacctaagatttgtacgtttctttttctttcttttctttttttttgagaaggagtttcgctcttattgcccaggctggagtgcgatggtgcgttctcggctcactgcaacctctgcctcccgggttcaagcgattctccagcctcagcctcccaagtagctgggattacaggcaagcaccaccacacccagctactttgtagttttagtggagacggggtttctccatgttggtcaggctggtctcgaactcccaacctcaggtaatccacccacctcagcctcccaaagtgctggaattacaggtgtgagctatcgtgcccagcctgtacgtttctttatatatgaagtttgcattaagagatcatgaatattgaactctagtgaatgatatgcctgctgaagtgttttaagggtgaagagtactgatgtctgcaacttacactgaaataaaatggagtgatatttggattaaacgatgaatagatgggtgggtatgtaataaagcacatataatacaatttattattgaacctagatggcgggtatatgggtgttcactgtaaaattcttccaacttttctgtgtgtttgaaaatttttcataataagatgcgaggaaaaagcttaaaacatgcttgaattataattctataatatattaatattaaaatactggaagtactcttgcttcatcaaagttactttcaaaaatattggtttttgtcatcttcaaagcatgtaataagaattttttaaattaagtattaaaataaaacttttaatgtttgaaacttaaatctcacatggcactgttcctattatggattttgggggttagacctgtagctacccatggtatcttctttcagtggctcatatatacaagatttcaatttgtagttccctcactaaaaacaaacagcctctgatgaaatttatcttgatagggacatctgaaagtgttgatgaatgccaaggactctaatggaaaacaaacaaacaaacgataatttaaaaaatactgtttgctttaaaattctactaaaatggagttagtctacatgataacattaatcccatttgctgtgccaacatttaagaaggaatctgtggtttatcatctggtttgccaattttttgttaaatatgaggaatattttagtaataattttttaaagattacatgcaataatagcttaaactttaatacccattaatgagtatccataaagaaaacaattcagtaccacttaaaaataatttgaatatcagtcatcataatacgatgaacacatttgatagagaatatgtgaatagaagtacattgaatcagttttattctatctacagatgctgaatggcatagggaattgtgggtctcatgaaattttctcagaagtacccggaggatcttcactaccagactgataaacacaattttttggttctttgcccacacaggaaacttttctagaaaagtttcaaagaatacatgccgaaacatgaatcctggaaaagaaaagtgatcttctaaatttgaaaatgaaagatttatgtggctctcacgtgaaacatcctctggcaagggagtaggtacatgatggaaatacatggattttcactgaagaaatgaaaatataagtggcaaagtaaacttcatttatactattgaaatattcaactgaggaaagtacattacttttaaattggaagaagcaagggcacatgatttttttacaggccatgtcattctctcatttctttcatattgaaattagttggacttttctttatcataacgagtgttgccacagtttacacctgccattctgacttttcgtataccacctgttgagaggaatttttttttcattctgttatctacatcattgaaaaacttaacacaatccatgtaaagaagaaacaaaaatatacttgtaatgttcacataaatatagaaatataacttaggagtccacctaatgctagaatttttatcgcattttaagtgttatggagttttaaaatttccatgtgacttaatagctggaaggaagcattaatatttaaatattaatttcaataaagataaaacaaattaatacttttaaatgaatattttaaattccctaacgagaagacaattgcataaaattaagtatgtattttagtttgaagaactaaatcattcgtgatacatgaccgtactacctgccggattcatctttttgccaaatatttcaatagtaattcttgaagtcaattctcagcacatatcaacttttactgttgtggtgggtgagagagtggagaatcaggctttaaggtgaatttataatttactatgtgaatattgccaggagttagaatgacctttaaacattttgtgaattgcctatttcaatacttaaggattttgtatacgcaaccctgtacagtaattatcaagcatactaaagttttagaactaccaagttaaacttaagaaccaaaggggccaggtgcggtggctcacgcctgtaaagcactttgggaggctgaggcgggcggatcacaaggtcaggagtttgagaccatcctggccgacagggtgaaaccctgtctctactaaaaatacaaaatttagctgggtgtggtggtgcgtgtctgtagtcccagctactcgggaggctgaggcaggagaattgcttgaaccagggagtcggaggttgcagtgagccaagatcgtgctattgcactccagcctggcgacagagtgagactctgtctcacacacacacacgaaaagaaccaaaggacgtctgttttgcagatatttagacattctattatttgctttacaaataactaagaaatacctagtgatgaataagagttggatgggtgattctgtagctaagctgttcagtaccgtagccattagccacctgtggctacttaaatttaagttcattataattaaacaaaatagaaaatttggttcttcagtcacagccgccagatttcaagtactaacagccaaatgtgcctagcagcttcgtattgagcagcacagaaagacatttctatcattgcagaaagttctactgaagagtattgttctcaactgttcatctccctgggattttatctattttgttaaaagatcagacttctaaaaacataacaacttgttttgagaattatagaagctatttgagattcaagttatctcatagaaaaagttgattgtacattttaggtgttgtattttctgaaaatatctagtattgttaaaacaagagtacttagtaagaattattgatatggcactgtacattccttgtcattaaaaaagtggtcagcacaaggaaaaaaaaaacatatatagtttaactaaaaatcacttttcctctcctaaaattattctttaagttgtggtttacaggcttgattatagcaaaccatctcaatgcctgcatgcaaatagctaaatattattgactaatctcattttgaattcatagccacaacaattctcaaaggagattcagcctctccaagcaccaaacatcctattccatttccacttcttattctctaaactgattttcacaccttcttctctctcttcaaacctccctctcacaacagttatgtcttctttttacttcattgaggaaaagaaatatgacaccccatttccctcattttttcatctgcaaatctaccagctcatctggatccaaatctacattctcctcttcccaccttttttttagagatggaatctccctctgttgcccaggctggagttcagtgtgtgatcatagcttaattactacagccttgaaatcctaggttcaataaatcctcccacctcagcttcctaagtatctaggactacaagtgcatgccaccacgcctgggtaatttttaaatttttttgcagagacagggtctcactgtgttgcccaggctggtctcagctcttggcctcaagtgattctcctgcttcagcctcccaaagaactgggattacaggtgtgagccactgtgtccagcctaaatctacactcttggcctgcctttcagttttactggaattgacaagtttacctgttctcatatcatgtccagcctttccacttggactctggatttcatttacttttaacttattcatgcatgttcttttgaaattatctctctcctccttcaatatcaatttttttgtgtgtgcctataaatatgttctgctgttttctaactttaaacccatataaaaatacgctcttttgattctcttttctctttcggatattaccttgtttttctactctccttgctacatgcaaacacacatcaaaatctagaaggaattattcatactttttattgcaattatttacctcgtattctcttttcaaattagttcatcagggcttccctgacataggctggttttctttcctcctttccttccttttttttttttctttcttgtttttgtatcctatggtcacatgactattgcattgtcaaattgaatggccatgtctctgttcttcccatacttgatccctccacagaatttggcacagttgactacttgctccttctggaaaactgtcttcttttgtactgagccacataaaatcatcctggtttcctcccctctcagtttccttttctcatcatttctgtatccccaaatgttagtgccagttctagcttcatacttttttttggattaagtcatccaatctaatgtctttaaaatgctaactatatgcaaatcacccttaatatgtttttatatttaattctaacttatctcgtgaacatgaggcttttttcccctcaaacagcttacttgacatacccatgggagtacgtatctaatatgaatgtcaaacttaacataaacagaccttttgatttttttccatcagacctcccagcataaacaacaaacaaacctgctgagccctcactgattaactggttccattatgacccgatgactaaagtcaaatttataaatgcttttataaacttcatatctaatcatcagtgaatcttgtctcctgtacctcgcatcccccaaatctggccacttttctgtttcttcattatcactaccttatctcaacccttattacttctcacctagactgttacaattatttcctgtcatgttttttttcttttgtcaccatacaattaaatctcccttcttcctctacagatacaataatctttgaaaaggtagaccaggtaattttactccactgacttcctataaccctaaggcaaagatctgaatattttaacctggtctacaaaatccttcatgtcctaacctctgcctagctttttaccccacgtcattccctttcccacttgcatctcaggccaactcctacattagcatctttatgtagttagtagatgtttctctgcatgaaatgttcttacttcagatcatctctatgtgggcttctcccttaattgatactttctcagaaatcttaattaagtgatactttctcagaaatgcctttcctgacctaacgaaagtaggaacagtcactctcaatcacttcaacctattacagttgtcagtgtggaacttatgctctctaaaatctttcttattttacttatttactgattaattatgtatctttatctgcacaaaataatctccattttatccccactgtctggagctttgcctgttctagaatctgaactctttgtatgaattaaataaggatgaagtcaaaacaaactgtactgttttttgtttcaagtatcaggcgatatttaactatttgaagttatgggactaccaaagttactccttctggttgacactttactgagacaaacaccagtgatatgaaatttccatatagtcatgcatcacttaacaacaggcatatgttctaaatgcattcttagacaattttttgttgtggaaacatcagagtgtacttacagaaacctagatagtatagcctactacaaacctaagctatatggtagagcctgttactcctacaaacatgttactgtactgaatacttaggcaatttgaacacaaaggtaagtaattgtgtatctaaacatttcttaacatagaaaaggtacaattcaaatacaatattataaccttatgctaccactatcatattatgtggcctgttattgacagatacattgttattctgttcatgactgtattagtaccaggttgtggctgtttctaatatatcctctcccactcctctcattccttactgaagtcaccagggtagtagcaaatcactggaaccagacctataatatatctgacttggtatctgtaactgttctgagaaacatgtgttgaaaggcagccaggctgcctgatgattatttagtagctgtctttctttactgaacaacagtgaataatatctttgatctctgccactgagaaataaacagaacccatcaggaatttaatccctgggaatgattttcacatttcctggtatagacgtttgattttgaagctcatatggtttgcacaataaatatttacctatttatgtcaaaatgcatgttaaatcatttttatggttggtgtgaggaatttgtgaaacaatcccatccttttgttattactgtgtttttgtaagaggacttctcacaccttaacctcatcaatagtttttcctgtgtgttaatgcaacaaaatggaagcaaaaagatatattttgttttcatttattttattcacctgaatctatccagagggaaagcactggaagtgttttctttttaagagtgttaacttgtattcttggtaagatctcatcaaaagcttaaataacgaaggtaagagtcagtattctgtggacagcttagctctacacaagaccttctgtccatcttgctagttattttccagttaatggaaatcttatagacagaaaagctcatgttagcttctcccgcatagtattatgtcaacaatccttactctaatccttgatgcagctctttacctaaatgttatagagatggagaatcacagctgccagcaattcaaaatataacatgcagtagctattttttaaaaaaaattttatttgctctcataaaaataccatcttaaagggtttttgaaaatttacttgtgattttgtctttttttaaagtattgagaaaactattgagtctgaagtaaagtctctaaaatacatcttgtcttattgtaaagtaatatgactgatattttgtgtgaattttagaattagttttttcactttatagattcattacatagtggcacttgatttaaacattgcatcagtactgtagcccttgggcatcgtgtatagagtgtctattagctttaactcatttctaaaaaattaacttctaagaataagaaaaatattgaaaactcttgaaagtaagttagaaacgaccatgattttatttttatttttaatttttatttatttatttttttgagacggagtctcactctgttacccaggctggagttcagtggcacaatcttggctcgctgcaagctctgcctccgaggttcaagccattctcctgcctcagtctcccgagtagctgggactacaggcacctgccaccacgcccggctaattttttgtatttttggtagagacggggtttcaccgtgttagccaggatggtctcgatctactgacctcgtgatctgctcgccttggcctcccaaattgctgggattacaagcgtgagccaccgcgcccagccgattttttttttttcctgcaaaaccatctaagggaggtgtttgggttttcaaggaaataccggctataagcatcattggatgttttggtggggtgggttttttgaaaatgtgtatgcagataacagtgagtgatattgcataagtattttaactacttagattgtttaaatttggttaacataaaatcaaggaaatggcttgcattattctatcttttcttttctaaacagtgtttccttaacaattaattctaacaagtcttggaaccatgggcactttctttcctcctgtcaccatgattgatccctattttgttggaaagtgaaaattgagcagttttaactctaaaggctaacattatggaaaaaaatttcaactgaatttgctagtaaatgctttgtatgaaaatatttagaatttaagtacttctctttacagacaaaatcatttattttcagtgtattatgaacatagttcctagtagggtatgtaaatgattcacttttaaattatgaatattttcttccaaattccattgttaaaattagtaagtgtaaagtatgacttttaagcaatatttcattagctatcattaacaagtatttaaccaccttgtttcaaattagttagctaatgaggtataaattattaaatctgaaaattttatttggacaagtattgtatcattaatttaaaatgattacaatgtagttgaattgttattcagtatttaatattttattgcctataaaaataaataatagccatgcaaacttatttttcaaatggtgttatctgtgctatatttaaaataggccaggtgcggtggctcacgcctgtaatcccagcactttgggaggccgaggcgggtggatcacgaggtcaggagatcgagaccatccttgctaacgtggtgaaaccccgtctctactaaaaatacaaaaaaaaaaattagctgggcgtggtggtgggcacctgtagtcccagctactggggaggctgaggcaggagaatgtcatgaacccgggaggcagagcttgcagtgagccaagatcacaccactgcactccagtctgggtgacagagcgagactccatctcaaaaaaaaaataaaaaataaataaataaataaataaataaagttaggtttgcatatatgagcatatgcatttataactagatggaaacttccttaaatatttaacatttctccttaaattttatattttatagtacttttttatggttagattctaagttctacttacattcagtgtgtatacaaattgagataggggttgtaatggaatatataacttgaatatttctatttgcattgccatagcatcattttattttgctcttagcaaaatctttctatagaggctttttctcctttcagttgtaaagaatctcttatctttaaaaaatatgtctcattattttcttacaatgtaatagtaaaaacaaaaataccatcaggtttttctcgatccttcctattttcctggatgtgtgcttttgtgtttttattgatatggataaatacatcttcaaattcaagtactagcgtttcagagaagtaatatgcttcttttgttctggttcctcttaaatgttagtaataaagaaacaattaacctagatatagaacaactcagtgaagggaaaatgtcttcatgggtcccttgagaaagacctatttagctttttatgtttctaatttttaacattgagtatagagtatatagctgtctttacacttttttttttttacattttagcttatttgtaatgctaacaggtaaagtagaaaaaaaaaatcactaaaaaaatggggatttagtagaaaaagaaaactcagtccctaaataatatcctacacatttacattatttccttatgatattttaagtgttccctatgaatatttttattttcaaaatgccaaagttatcagtaattttaaagctaatactgccaatcttactcttccaattctactcctaatcttttcctcctaaatgcttgatccaagtacctccctttgggacaagtaccaaatgtctttctccatatgattttttgaatgaattctgagtgagttaattaattaattctaggaattaatatttctttgatttctagcaagccagagcattttcttcaaatgtgcattaaccatgtgttaattatatctttatgtatacactgtagacattgtgtatgtgtctgtagatttccagcttggatttatacattttaattttcattggtttgcttttactgtcttaggcccctcaatccgtgggtagaccttggaggagcaagctttcagatcttttccactggagttctctcccccattgcagctcagtggccatcatgatatctaccagaacattcagttttctgaaactgtgtaaacactcttgtaaaaacacagtgtagagtcactgtgggagagtgtcttcaaccaccattcctatcctgtaactgaacatagctgataatatgtcagtagttttatttttgtccatcattcaaatagagttccacagtaattgtttcctcttggaagataacttgcttagcagtggggaaaaaaatggattagacagggtaaaatgttatcggaaatgggccctgatccagaaccctagagagggttcttagacctcacacaagaaagtattcggggagagtccgtacagtaaagtgaacaccagtttattaggaaagtaaaggattgaagaatggctaccccataggcagagcagcggcatgggctgcttgactgagtatacctatagttatttcttgattatatgctaaataaagggtggattattcatgagttttctgggaaaagggcaggcaattcctggaactgagggatcctcccccttttaaaccatgtagggtaacttttggatgttgccatggcatttgtaaactgtcatggtgctgatgggagtgtattttagcatgctaatgcataataattagcatataataaacagtgaggacgaccagaagtcattttcattgccatcttcggtttggtgggtgttggccagcttctttactccatccttttctgtcagcaaggtctttgtgacctgtatcttgtacaaacctcctatctcatcctgtgactaagaatgcctgacctcatggagatgcagcccagtaggtctcagcctcattttacccagctcctagtcaaaatggagtcactctggttcgaacacctctgacaaaaatattctaagtataaatacatcaaaccacattgaaaaattcatcaccaagttactttcagtacagttcattaccccatatctaaaagcgatcttgaaatctgcttggttgttagtggagacgtttcacttccttgttattaaaaaccttttcgctaactgccttattaagatattattcatataccatacagttcatgcctttaaagtgtacaattaaattttttttagtatatttacatagttgtgcaattatcaccataatcaattttacaatattttcatcacccccaaatgaaacaatgtacccattaacagttaccactcatattgctcctaacccttccccctcagccataggcaactactaatttatttcctgtctgtatgagcttgcctattctgcacaatttatataaacagaataatacaatttgttgtttcgtgactgatttcttccactcagcacaatgtttttaagattcatccatattaaaacatttatcagtacttcattctttcttattgttgaattacattccattgaatggatataccacattttatttatctgttcataatttaattgtcatttaggttgtttctagtttttgcctgttataatgctactatgaacatcatttacaagttattgatgtgtttttctgtctttatgaatagaaatgctgtgtcatatagtaactctatatttaacttcctggggaacggtcatactttccaaagaggatgcaccattttatattctcattatctaatgtatgatggttccaattcttccatctttctcaacaatacttgttgttatctgtcttttttattatagccataactgttttcagcagttctgtggatttatttcactttcttgatagtgtcctttgaagcacaatagtttttaattttttataaagtctactttatttttttttagtttttatttttggtgttatttctaagagatcattgtctaatccaaggtcacaaatttgatcctatgttttcttgcaggttttgctatagttatagcccttacatttagttaatcgatcgatttacaattaaatttttacaaagcgtaaggcagagttccagcctccttccttggttatatatatatatggatatccagttgtctcagcaccatttgttgaaaaaactatttttttctccctttaaataacctggcacctttgttaaaaaataatggatcataaaagtaagttttatttctggactctcagttctactcgttgacttatgtgtccatctttacaccagtaccacactattttgattatcagcactgagagaactttaaatggtttatggggagagagtagctttgggcttccctgagggttatgtcttgcaaaactggaagctcagccatgctactgttacaggaattattggctcttgtatgatgtgagacttgtaatccagggtgactcccacgtctatcaaatgtggacactggtttatcttctggagggtcaaggagaataatttatgaattaacatattgactgttgaacgtattctcattgaagaggaatacctaatgctgccccgctaagatgctgttcttctgccttctgttctcagaatggatctgatgccaagtatagactatagtgatcttgtgagtctcagtgttcagcagagccaaagatgaagactaggtttgtgcctagacatagaaacggggtgtaaaagggtttaagctacttggcatttgtctgtgaggaagtgtatttcacacatattggcagagtatgtttgtaattaggcaaatataggtcactggaattgatctgctgtgaactaattgatctaccttgaacaaaccctgtaaccactgagccacagcctcttcaactgtaaaatttaaagactagtaattgatagtctctatccctcatgctgaatcgagcatcctatgacttgtctaagattgttcacactgtagtttgatactttcttacattcctgaaaatgtgagttttgaggttttttcagatgattttctctatgggaaaaaatagcatacagaacattctcatgacctcagactagataataaatgactgagcaatggaactgtaactgtgaatattgaaaattataaaaaaaaattagccagacatggtggcacgtgcctgtagttgtaactacttgggaggccgaggtgagaggattgcttgagctcaagcttttgaggctgcagtgagctacgattatgctagtgtactccagcctgggcaacaaagtgacaccctatctcaaaaagtgagcccctgagtgtactgtaatgatataataaccatttctatatacttatgtgtgtatatatatatgtatgtatgtatgcataatatgatataaatcatattatggtgatgcttttgattgaaagacaaggagatcttagagtgagtggttttaactctgattatgctgctccctgatataccacaatgggtgataacacttccatgagcttcaggttcctcctcttcacaataaaagttttgtgtcacttgagttcagattttcctttcaactctaaaattatatgattaatgacatgatattcttcatatacatccatgcttctttgactatttaggccatagtgtctctctctaatacaaattttcagataatttgccaaactgaattttcaagacattccttctcagaaacatggcctccaataaacaggttttacatattttttccttttcctgttggccctaacgctgtcaatcttagcctcatcgtctagcatagtcatttatgcaggatcctgtgtaaagttgatgaaaaattctgtcaatatgaaatatattgaagattgccagtttacctttttattcatttattgtcatgtcacttgaaagatattaacgtttatatctgtctaaaaatttactctctgaaaacaataaataacatttggccttttgtgttaccgtttctattgaataattattctgaggtcccctttcacccatgaaagcacagtaacttgtactctaaagtcctacaaagtattagatatataatatctaggcataaggtaaaatctattattatgcttgggtccttaggctgtgagagtgaccagtttttactttcctacctacttgattaaggtaactccagtgaggtagaaaataagggaactgagtcaagaacacaaagtgtggtatgtaattgccattttagatatcattagtagtcacactcccgaaacattaaaaattaatgacagagtcaggaagaggagagaaggtgtcttttgcattgccataatttttacaatgtctacatgctgtcctatagcctggaatatgagatttttaaaatcatggttactatcatcactcaagtgtcttaggctgaaaaggacattttccatatttcataaattcaagtcccagccagagtaatcaggcaagagaaacaaataaaggacatccaaataggaagagaggaagtcaaattatcctgttggagacaacatgattctatatctagaaaaccctatagttttgtccccaaagctccttcacctgataacttcagcaaagtttcaggatacaaaatcaatgtacaaaaatcattagcattcctatacaccaacagcccagctgagagccaaatcaggaatgtaatccgtgtcacagttgccacaaaaataatgaaatacctaggaatacagctaactagtgacatgaaagatctctacaatgagagctacaaaacactgctcaaagaaatcagagatgacacagacaaatgggaaaacattccatgctaagggatgggaagaatcaatattattaaaatggcaatactatccaaagcaatttacagattcaatgctattcctatcaaactaacaatgatgtttttcacagaagtacaaaaaataattttaaaattcatatggaaccaaaaaagagtccaaatagccaagacaatcctaagcaaaagtacaaagctggaggcatcatgttaactgacttcaagctatacaacagagctacagtaatcaaaacagcatggtactggtacaaaaacaggcacataaaccaatgaaacagaatagagagctcagaaataaggctatatacctaaaaccatctgatcttcaaacaaagctgacaaaaacaagcaatggtgaaaagactccccagttattcaataaacggtgctgagataactggctagccacatccagaagattgaaactggaccccctccttataccatatacaaaaatcagctcaagatgcattaatgacttaaatgtaaaacttgaagctataaaaaccttggaaaataacccaggcaataccattctggacgtaggaataggcaaatatatatttcatgacaaagatgccaaaagcaattgcgacaaaagcaaaaaattgaaaaacggtatctaattaaacttaagagcttctgcacagcaaaagaaactatcaacagagtaaacagacagcctacagaatgggagaaaacatttgcaaactatatatctgacaaagatataatatccagcatctatgaggaacttaaaaaaatttgaagcaaaaaacagtcccattaaaaagtgggcaagggcatgaacagatacttttcaaaagaagacatacatgtggccaacaagtatatgaaaaaaaggtcactatcattgatcattagagaaatgcaaatcaaaaccacaatgagataccatctcgtaccagtcagaatggctattattattaataaacagtaaaaaaaaaaaaataacagatgctggctggttgtagagaaaagagaacacttacacactgttagtaggaatataaattagtttagccattgtggaaagcagtgtgacgattcctcaaagacctaaaaacagaactaccattcactcagcaattccattactgggtatatgcccaaaggaatataaattattctaccataaagacacatgcatgcatatgttcattgcagcagtattcacaatagcaaagacatagaataaatctaactgtccatcaatgacagactggataaagaaaatctggtgcatatacaccatggaatactatgcagccataaaaagagtgatatcatgtcttttgcagaaactaggatggagatgaaggccattatccttagcaagctaacacaggaatagaaaaccaaataccgcatgttttcacttataagtgagagttaaatgatgagaactcacggacacaaagaaggtaacaacagacacaggggcctacttcagggtggagggtgggaagagaggattacaaaaaaataacgattgtttactacgtttagtacctgggccatgaaataatctgtataaaaacctcctgtgacatgagtgcacctatataataaactccacatgtacccctgtacctaaaataaaagtttttaaaaataagtcaaagatgtaatcttttctctcatgtttttatatctctgaaatcaagacatattttacaattgattgggagcaattttcttgcttgaacataaaataacattgaatctcgtcatcagagtatcttggattagacaaatttagtatgttcagaggcaactttaggtagggaatgacagacctcaaattccagtgtgtcacagacttattaaataggaatatggtatgcaaaaatttgctgattaatcagcccatcataactgaggcttgactctatgcctatgtgcatttttactttgtctttcacttcaaagcaggtgcagctgcacagtatgaattcaatacccatggtaaagagtccctttaaaaggctatatttttatatttaatatgtggatacagaaataacagaaaaagataaataagctatccaaatgcaaagaaaattacattcatagacatacctcttattaccttttcctctcaactctgcagaaaatatgaagcaggttggaatgttcattttatgtggctctcaaggtactattctcataaaggtaaaatgagaaacagtaaattattgtgaagtttagtaataagagcaaaaaagacatatatttatgagagcaaaaatattgagtagcatttggccaaaggatcttgaaactgatttgaattgatttaaccagtgtaaataaaaatgatttatcaataaaagcttatttctagaagtgtttttttcctgtttttactgttcttttcagaagcgttcctttgcttatgaacagtttagaatatgatctttttgtcaaataaaatttccagcaccttgcaatatcagagacgattttctttctagaagttttagaagacgtcattatgtgtcattctagacaaataagatgtgtttggctgaaatgttttagaagtctctaaggaaagaaataacctgttgattatattttgacttacttggggaaatggaaagtcacagccaagataatgctaagtctccaccaatcacattttattatgtggtgtgcttgcctttggccctctctctaccccttggaggaacaggtaaatattggcacaagtcagatgaaccctacccatcactttttggatatatctacatgtcataagaattatgacatgatcaatcaatgtaccagctaattttcataaatgctgtacctcatgaatggagaattgagttgagcatgagtgaaaattggattttccccactcagaaaaaaataagccactatatatattttttgtttagttctttttattttggttattcttcttttcctttatattattacttaaatttatttatgatactgcttcaagcaatatttaacgtatcaacattttgaacagttttaagtataaaaaaatttgaaattctgttctagtgtgaaaatacaccagtgagtgacatatttgaatgaacatttgtagaagtatgttgaccttaaaaagcaaaaggatttatttttccttttattcaacagatattcatatttgtaccagtcattgtgtaaagctctggggaatgtttcacattttcaaaagggtagagattagcgtttcattttgtttttgacttatctctcttgttacaagctctctgcaagatatttacttaagagttggatgaaatgggtaaataaaaagaaatttatgaggcagaagaaaatgtggaaccttcagacatccctttttggtaccacttttatgacactttcatctaatctagctccatctcaattgacctccatctaattagtcataaaagagaatcaagttctatactgagcaagcatgcctgtgcttcatcagtaacatttaagaaggggcagaaatgagtcaaacacttaaagatgctgctttaaaaattttaatgtgttcttcaaagatgcaagcttattaaaattttagttctgaagaagtaagcacagtatctagtttggctccactgatccttttagacatatgtcacacactttcttctcatgctcaagagggtgattacatcatttgcatagatgtccgttttatctctaatagattatgaattccttcagggaaatacttgttttaaggggaataccatgtttttaaaatctttattttgcagagagtaactatgccatcaccttgcatgtaataggtttttaataaatctaattaagtaaaagtaccattgacttctgttcttggtggtctcaaagataatacttgagtctgctaaatttggaggactaccatgtagaaaagaaaagaaaagaaatgcttctaaagattccgagtaaagctagaaacatagttccgtagttcctagtctctccgtagagagaatacgataactgaagagggctttatatgctgagatgaaatttagtttgttcaaatccgtaatgaattgccatcgggaagtactggactgcttgccactataagtgttcaatcagtctggacaagattttgagaggaattttctagagagatcttagtcatctaatttgcggctggcctacttgacctttttcttctttactcctgaatcttgtttataaaaaatgcaatgtaataaaatataatttatattgtatgtaatataaattatttatacctctgtgaatatatatgataaacaaatgaatatatacaatgtaatgttatattacatcatgggtcattttcttcctaaactataatcatttttacagttttaaaccaaaaaggtagtgaaaataagcgagcccatattaaatttctaggaagtatccctaaattgtttcctcagtcttttgacttatttcacatggaatcctaacatacgtggttgtctgtttttcatgtctcaataaaaaaagttgaccataatataaaggataattggaacttggccacatataggaatataagacatctaatagtaaaaaaaaaaaaaaaaaaagtttataattaaagagaatcgtaagttttataatgacttagaggcatcagatgaaagagaaaacttgttctgtgcaatcccaggggaaagaattaggaaaaatgaggtcaaagctgaaagaagtacaggtttctgtttaatataaggaagatatttttaacatttttctgaaaacggacaattttgcctcaagtagtttcatcttaacagataatatattttcaagcacaaaatgaaaaaccatgtaataaagatattgcagaatacatccaagaatccgatgagacattatcttagttttctactttaaatatgcaagctccttaaaacttctatagatcaacacattatgtgatggtttcaatatgcctaaggtttgatcgtgtagtatagcgttgacttagaagttgtaaatggaagaattaccttttatttctcagccagcggaacctatttatctctttattccagatacgttatgtgatatataatgggcaatgaaaaggttggtcattagagcagctttaaaaaaaaaaaaaaaaaactcatcacagcaagtggaatctgtgttgaatgtttaactgattgtaactgaaaccttggcagggggatagagagacagaaatgagattaaggtagggacagttaaagaaatagcaagagtgtcattttgaagaatttgaatttgatagcaagcattattgtgagctgttgatgaggacaatatggttatgaacataagaataatctatcagtaatgtatatgaacccttaaaatgagagaagtagatgtcatggaggaagaattgtaattttatgatttactatgctgtgatgaggagtaggatggggaattgaggggtggatacgtaacatttttttttttactcattaaaatttccccagcccctaaataggttgtcatattttaaaactctttattattttatccttgattgtctggagttgccaagtatattagtaagtacaaaaagtaatggtattaagttttaatgacaaaaaaatgaatccactgggtataattagtataccaaactagaaagggcctattcaaagatctaatgaaatgcactcagtactttaatttaaattccacaaagtgctgaaatgctggtttatcttcccaattccctttagtgtcattggtataccacctttactattgtttccttaatgtattttttctgagtttgattcgacattcacctcaacatagatttgtaaatctacttttgtgaaagttatgcaactgctgcatttggacaagtcagctcatctatgaaataaaattctccttagtcactgtgaaggtaaaataaactaactcatgtggacgtattttgtaaatataagtcaatttagttatttttatttttagttatggaagccaaagatcgaatattattatttttaataatcacaaattagttgtttttatatttattatgggggcagaagctcataatattatttaaaaaattatcgtggagaaaattttaaaaatcacatattcctcaggataaattaagatttggtaagttctccctaacaatttatggtagtttcttaaccttgcatttgatatcaacagtattcaaatattagggtaatgatttgtaagttatcttttaaggagttgtctttgtattctattttaaattttctaagaaaatcgcacgttacttgctctccccacaccatttttatgaaccgatctcatatccactgggtatgcagttgaagtttaaatgatttcacaatacacgtttcctggcttttagacagtgtattatgtgtttagattacaaatagttagaaatctatttgcataaaattttaaattatttttataatgtcagtgatttaaaattattgataatttcttggattttgttctgttcacaattttttaaaataatgattgtaactgaaagagtaaaaatatccgacatgaaaaaagctacattaaataattagcatgttttaagttacagttgaagaaaaaagtgaaaatagactaaatgagatttttatcacatttccaagtgcaaaaagaatcatccagtgttggggataggaagtttttttttttaagataagaaaaaagatcattttaaaatttgactatggttttccatcttgctcaattaaaaaaagtcatagcatgtcactttcactgttaattacctaatcatattcaaagtcagtgattgacattttcacgaatccttatgtggcataaacacgcacacacacactgtgtgtgtgtatatatatgtttgtagaggtcccttgcttacctgtagcttttgacttagtgtattaataattcattttatgcaaatcaaaaccacaatgagataccatctcacgccagtcagaatgacgattattaaaaagtcaaggaacaataaattctggcgaggctatggagaaataggaatgcttttacactgttggttggaatgtaaattagttcaatcattgtggaagacagtgtggcgattcctccaggatctagaaccagaaataccatttgacccagcaatcccattactgggtgtatacccaaaaagtatgaatcattctgctataaagacacattcacacgtatgtttattacagcactgtttacaatagcaaagacatggaaccaatccaaatgcccatcaatgatagactggataaagaaaatgcggtacatatacaccatggaatactatgcagccataaaaaggaaggagatcatgtcctttgcagggacatggatgaagctggaagccataatcctcagcaaactatcacaggaacagaaagccaaataacacatgttctcactcataaatgggagttgaacaatgagaacacatgacacagggaggggagcaacacacaccagggccagttggagggttggggatgaggagagaaagagcattaggacaaattgctaatgtatccagggcttaaaacctagttgatggcttgataggtgcagcaaagcaccatggcacacgtatacctatgtaacaaacctacacattctgcacttgtatcccggaacgtaaagtaaaatttaaaataataataataataactcattttagttagttgtttaatgagggtatgtttttacccaagttctgcttttatgggagtactggatactaattatggtttactgttatatatgtatgtatatatatatatatatgtgtgtgtgtgtgtgtgtgtgtatacactcaattaactattttcaaatatttaaaaggatatatttaatccagtacatagaaaagcaaataacaatgtctagcataattttaaatgaagggcatttatgaataacacatacagtgtgatacaaatatatagtgagcctaccaattaagatctgataaaaaaagaggtacatggttaatattatcaacaaatggttactacagaatactagatgagggttaaaataaaatcattaatttgtatctgacgcaaaaataaagcagtcaaatttctaaagactgatttatgcatgtgtaacacagtcattcggttatctttctgtctacaataacttcaatcatttattttacttcatttaatattaagcaaaactctttgtgtgtggtagtttgtaggggaaagcaataggggtagtattttaaagtaaggcctctgaaaatgatgctgcttaatttgtcatctaggcactgccattattaggtatataattatagaaaacttactttctcaacccctcactttctcattcatattatgaagattaaaatatgcaaaaatattgtgagataacttatacaaaccactccagagactgcctggtaccttttaagcattcaaatgagccataattattaaaaagaataaacttatcctccagtgtatggtaattctgaaacactagatgtctaatagattttctcatttcaatccaaacaatatttattgggcccttggtatgtttaaggcattgtgcttgattagggacataaaaatgagtaagacagggtttccactctcaatttctcccaatttagtatgctccttgaaggcagtgtccatatgttttgatcatctgcagcatttgatgtagtaaagcgtatagccatgacatcacttaataaaaagcacagtgctatttgtttatatttattacaatgtcttcttcctcctgaagagttcaatgagtattttatcagtgtcaattctattatctacttaacaaatttgaacactgaggaaacagtaagggaaaaactgaatgctaataagcactcacagtctttgacaaatttgtgtctgcaactgcaggccaaggaagcatgagtcagagccacagtaatcaagttgttccatttttcttttgaccatgcaatgttggataccgttgctttcttgacttttccttttggtctgttttaggtgtctcagactcgaagtttgtgtgatgagaggagcacagtcccatagcaatgctaaaagatgtgtgtgtatgtatgtacatgtgtatgtttgtgtatccgtgtgtccaagcacacacacatatatgtgtttggaaaattgggttttgattttcatcattctgaagtttaattccccattagagttgattcactacataccaaaggatatactggtttattcacgtattcaaattgtactgagtggctggtatggtaagtgccatgagaggtacaaagatgaggatactgtggtccatttcttggaaagcccttaaaaacttactgtttagccactgcatgttctcactcataggtgggaattgaacaatgagaacagttggacacaggaaggggaacatcacacaccggggcctgtcgtggggtgggaggatgggggagggatagcattaggagaaatacctaatgtaaatgatgagtattaacccattagggtgcagcacaccaacacggcacatgtgtacgtatgtaacaaacctgcacgttgtgcacatgtaccttagaacttaaaaagtataataaaaaataacttactgtttagcatgtaatacatcaggaaaacaagtagttatatgtactacttatatgaaataataaaaatatatagagaaatattctcagtaagaatgtggaaattttatatttgtttttggtgctcactgaaagcttcgagaaatgtagcacttatgctaaaaattcaaggatgtgataggctttagaaatggaaaaatcgtgtagaaggacgttttggcaagagggaagaacatggctgaaacattaaagaggctattaatgtttcttccaacactctgcttattgtgagacctagcaggcactaaataattaatagcttgagttaatcagcttgtagttaactgaaaaagactgttctacagaagaaatatgacttctgactgactagaagtctactattaaggcctgaagacagctgtagaattcataatgccttcttcagttcaaaaaatgaaaaatttggttatgattcagcatcccatatattgaagttattatgtaaaattatttaatgaatttactttcttcatttaattcttctaatattaataaagtgcctacttctggatacatcagctgtgaaacactggtttcattctgccttttacctccttagatatgagggtgggtgaatttgctctttttgaccctcttctttagacccattcactgtccctgatctgatctgaacctagaagtctctccccagtcctcaggagacagacaggattgaaccccatgcagagagaaggtagtatgatggaattgaattcccggacagatgtggcattgaactctggcactttatctgagtgccactggtcataatgctgtaggttaatttcctcccttaaaaaaggatggaatagcagtctccttgaagtgttataagaattttagatggtacatgtaaagcacctgtaacattcagcacctttaacattaatgcagtaagcattcaacacatgtctaaatggaaggtgatggaaaagtagtccctccttatctgcatgatacatgttctaagaccttcagtggatgcttgaaaccacagatagtactgtgccctatatatactgtttttccctatgcctatgcctatgtacctatgataaagtttaatttataaagtaagcacagtaagacattaacaataatagctaataatgaaatagaacaattatagcaatatactgtaatgaaagttattttccttctgaaaatatcttgttgtacattcccacgggcaactgaaaccacggaaaatgaagctgtggatggaggatcactactatattattgttattattattattatttgaatctaattattagtctctaacaatagtgtttggtaaacatatctttattaactagtagagtgctttaggttaggaatgaacacaattaacacttcagacagtctccaaaatgttcttttaaaaaaatccactttatttcagctatattttgtgtactcatcttgctgtatgaaaattcttcaaagataactgcagaaaaatgttaaattgagaaaaggtgttttttgttttttttttttgtttctcaacataaatgagccttgtgtgctttcatttgcacatacctttaccaaggtaaaagtgtttatatattgtcaacaatgtattgatagactctgccaaggactggcttgtggatccctttggctcaatgcctgtttttgtaaagttttattggaacgcagatattggttaatatactgtctgtggctattttcacactacaacagagttgacaagaggccttatggcctgtaaagctgaaaatgcttactatctggtcctttgtagaaaaaatttgtccctatttctccacatcctctccagcacctgttgtttcctgactttttaatgattgtcattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtacattctggatattagccctttgtcagatgagtaggttgcgaaaattttctcccattttgtaggttgcccgttcactctgatggtagtttcttttgctgtgcagaagctctttagtttaattagatcccatttgtcaattttgtcttttgttgccattgcttttggtgttatagacatgaaatccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatagggctagccagttttcccagcaccatttattaaatagggaatcctttccccattgcttgtttttctcaggtttgtcaaagatcagatagttgtaggtatgtggcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgcggcactattcacaatagcaaagacttggaaccaacccacatgtccaacagtgatagaatggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggggagggatagcattgggagatatacctaatgctagatgacgagttagtgggtgcagcgcaccagcatggcacatgtatacatatgtaactaatctgcacaatgtgcacatgtaccctaaaacttaaagtataaaaaaaaatgttcaaggatgcaaatttgaagggaattctcaccaaaatttatagacttgtagaagcataaagactggaaggaattttttatccttcaattattctaacttcatataaatgtattggaatccatgataaatggtaaaaaaaaaaaaaaaaaattgtcaactacacttttacatttagtgtgccatagaaaattgttttacaatttagggttttatttttatagaatatcagccttttatgactagtatttataattgtgaatattaaaaatatagtacacatttattcaaatttgatggatttgaataattagggaacagaattgatatctgcttagcctcattagagtgaatattatggtaggtttcagaaatacagtttctacttttattttatcatttacagccccaattaaattctcttgcctttctttctaggacaattgagaaaaataaaaaagtgcgattgacaaagacaatgtagttcactatagtggagcatctgagcttcctgacaggctagatggaaaaggaaacacagataaatacttttttaatcatgagaaaataggaagtgtatcaattactacagtaaaataaactttatcttgatgctggcttttaatgaccttaattatatgagctattgtgaggcagtatatggtagatgttaagaaggataaaattggcatcagggagatataagactgcagtcctcatatactctctggccgtgggcaagttacttattcttttagaaattcagttatgtccagttatactataactacaataaataggtaccgtagagaatttccccatacacactttcatttgtcttaatttatggtgagactatctataaaaacagaaagcattaattttaaatattaatatatttaaggattacttaaagttaaaaacacatttccaaaaatttatatttttagtttaaagtatgcacttattaagttgttaaatatcctgggcttgatgtatatttaaaaacaaagaatttaaggaaaccaggtatttggaataattaatgggcatttaaaaaagttatgtttataaattgtagggttatatgtacacacaaaaagaaatttaaatgtaacatacataaggacaacgtaaaagtttatttcttaaccttcttaatctacttaaaacttttagaaaagctcttctttcagacataaagatcagccttctgccattagcaaaaaattggaaaaatagaatacacattttctcatctaagcaagtatttttagagtcattatttttatgttttttttccaattgaagaaaatatagggtgcatatcaggaaatacaatctgctagtatcactaagaataaggaaactaatgttgacatatttgactcgaagaaaacaaaaccattattgatgacatccatgtttgaaaagaaaggaaaagtgtttttatggaaatatgtagtgtttaacatccttagaataaagtacatttggtgatatttttaaaaggttaaacaaaggcagatcttcaatataatgatatttatctccattttatttctggcttttactttgatattaacagaaatatatgcacagacatattagcaggataaaacaagggtcatgataaaactgaatttatttttgtttgaattataagtagttttacacattaatgaaagtccattgttatggttaatcccctggcaacttgatctgtgtaatgggttttcattttctttataaataattactcgctgtttaatatttcaaaaaactatagtgtaggcatattgacttgttcaataaagctcatttgtattcattgtggactcttgaatatggactatagcagccagtgaaattggtggtgttttcttgttacgaataatacaaggaaaaacccaaatctattcaattaaatttttgtgtgcaaaatttcagctatagtctaaaaacgctacataatttatattacaatcattttggctaatcagatacccaatcatattttaatagatttccctgggagaagaaatgggatttaagcttattaatctgtatggcatgcaattaagctaacattaagatgaccaaaccagtatgttttattccatttggaataggatcacttctccagagtagtagatatttcggaatttacaaagaccaagaaaatgtgtattcctttatgatttttactgcatgcttaactatttattattccatcttgttcttgaaagatttttaagttctttataaaaatacatacattacaaagtaataatacgtagaggagggaattgggacagtgttgggaagaaaagctgtgccagaagtgaggctgtccagaggtggatcataaatttgtgtctaaactttttagtactcattgcaaaaaaacatgatatcaacataattccacctttatgaattgtaactttttttacattaattactggagctcagatcttccattctagatacaaacaaaagtttagttttaatgccagatcatttaaaggcagttactttaaaatggcatcctacaagactactttctgtcagctgcctatttccacacatctataggttaaataaaccaatattgaataccattggcattacattttttcaagatttgaaagtgactcatgaatcattaaggagaggttgaattacgtcaagtgtagtttcactactacatttaactgatacttttaaaaatgtactcactttcatatggtgcataaagctctgttaactcaaatattttcattgtccttgatatttaatacctcagttattgatagcagtcaattgctcataaccaaagaaatgcaattgacatagtgtaaaagttcaatttcagtgttctttctttaaaaacccttcaaaatgagttttaaaataaagtaataaaatttctaagtcaacacttagaaatctagataagccaatagtttcatatagcgtcttcaatgttacaagatttgtgagtactggcatgtgggtcagaaaacaaggggtttgaattccagctctgctccatttttattgcaatttcagttatcattttagcacttcagaataaaaaagagatttatttaatttctaattttttttctacctctcagctttttttcaacctgtgtgtgactggattgcccccactttagttaggttatcataatatacctgtattatttaaacatacacaatctcattgtcacttccccacaaaattaaaggaaaagctctctaaaaaatggaaaatttttagcacttcagaataagagatttgtttaatttctaaatttttttctatctttcagcttttgtctatctgtgtgtgactgaattgcctccactttaggttatcataacatgcatgtattatttaaatatatacaatctcattgtcaccttccccacaatattaaaagaaatctcttcaaacaaaatggaaaagattctgaacaacgtgaacctaagaggcctaaaaatgactaggcaaaacaagtgaagttagaagtgataaaggatattgggagaaatacagtaaagacataaaaatatctattctcctttcctcatttacccccacattcatgtcatttgcctggtttatttacctgaagatatatgcccattgcagtgaaactgtatcatgtcattttatgctacacgtaaacagtaatggatatattaccatttaaagcatattaacctattcatgatgtgaaagatataattgatctttaaatgttttatgcagaaatccttgatggattattagttgttagactattttgattggggctctgggtgcactggaaataaattattgtttttatcatttaaaataatgaaatatagactcctactagccaaaacattttatcaaacacgtgacaggaatggattacattgatataatgacggatatatgtaactgagataatctcttcatgtatggccatagttagagataagatttgtgctatttttttgtttttcttgataagttgttttttcttccttcttttgtgataatttagagagttcacttttggctctttaaaagcacttcacacatactagagtctttacctaataaactagatcttcaaatacattaggtcgaatcattaaaaattactaatcttgtataaggtataaggaagggatccagtttcagctttctacatagggctagccagttttcccagcaccatttattaaatagggaatcctttccccattgcttgtttttctcaggtttgtcaaagatcagatagttgtagatatgcggcgttatttctgagggctctgttctgttccattgatctagatctctgttttggtaccagtaacatgctgttttggttactgtagccttgcagtatagtttgaagtcaggtagtgtgatgcctccagctttgttcttttggcttaggattgacttggtgatgcgggctcttttttggtttcatatgaactttaaagtagttttttccaattctgtgaagaaaggcattggtagcttgatggggatggcattgaatcttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagctcactcatgatttggctgtttgtggttggtgtataagaatgcttgtgatttttgtacattgattttgtatcctgagactttgctgaagttgcttatcagcttaaggagattttgggctgagacagtggggttttctagatatacaatcatgtcatctgcaaagagggacaatttgactccctcttttcctaattgaataccctttatttccttctcctgcctaattgccctggccagaacttccaacactatgttgaataggagtggtgagagagggcatccctgtcttgtgccagttttcagagggaatgcttccagtttttgcccattcagtatgatattggctgtgggtttgtcatagatagctgttattattttgagatatgtcccatcaatacctaatttattgagagtttttagcatgaagggttgctgaattttgtcaaaggccttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggatattggtctaaagttctcttttttggttgtgtctctgcctggctttggtatcagaatgatgctggcctcataaaatgagttagggaggattccctctttttctattgattggaatagtttcagaaggaatggtaccagttcctccttgtacctctggtagaattcgactgtgaatccatctggtcctggactctttttggttggtaagctattgattattgccacaatttcagatcctgttattggtctattcagagattcaacttcttcctggtttagtcttgggagggtgtatgtgtcgaggaatgtatccatttcttctagattttctagtttatttgcgtagaggtgtttgtagtattctctgatggtagtttgtatttctgtgggatcggtggtgatatcccctttatcattttttattgtatctatttgattcttctctcttttttagcattgggagatatacctaatgctagatgacgagttagtgggtgcagcgcaccagcatggcacatgtatacatatgtaactaacctgcacaatgtgcacatgtaccctaaaacttaaagtataataataaaagaaaaaaaattactaatctttaactcatttgacacataagaatgacaatttcatatattttatttcccacctttcattttatttttagtctccatttaatgataactaaattttaaatattttaagaattttaatcaagcgcttctcaagatatgattaacttctataattttattatgtatgtatatgtgttaaatatgtaattattatttgcacatattttacctattccaatgtctcttactgccttcaacattcatttctgtttcttttacacaacaccagcctcaatttgttagtgtttttttgttcgtatatcactgattttgagtttatctctgatcacttgtagaacgggatttagtttttttttaatgttttaaaatattggccaggctcggtggctcacgcctgtaatcccagcactttgggaggccgaggggggtggatcacgaggtcaggagctcaagaccatcctgaccaacatggtgaaaccctgtctctactaaaatataaaaattagctgggtgtggtggtgggcgcctgtaatcccagctactcaggaggctgaggcaggagaatcgcttgaacccgggaagtggaggttgcagtgagctgagatagcaccactgctctgcagcctgggtgacagagcaagacttcctctcaaaaaataaaataaaaataaaatattatttatttatttgtaattgataaatattgtatatatttattgtggacaacacgatgttttgaaatatgcatacatttttgaatggccaatggagccagttatcatatgcgtcacctcacatacataccatctttttgtgatgagaacacttgaaatctattttttttagtaattttaaagaatatattgatattaactgtagtcatgatgttgcacaatagatctcttgagcttgttcctcctatctatctgaaaatttgtatcctttaagcaacatatcttcaaccctgcccagtcaccctctggtaaccaccattctactatctacttctatgagttcaactttagtagaacatgaatttgaatggcttcactcctaacgctgtacacatctgattatgagggtcttttcatttcctatgggtgtgattgaaagcctgaatgtatgtaaatttgggggtcataacgttttcttgcaatgtactatagacatgcatgcaaatccatactggggcaagtaagctatggagtgtctgtgtgataggctttagacattaagaagaggaagtgataagtagtagaagaggccagcatgattccttcaaggattatgaaggaagatagtaaaagtcattttttaaacagtttgtctactttagatggtaaggcagctaaagaattttgcaaaactcctctaacttcaaaccttctagaaagggttagaggatctcatgtcatcaaacagacccccaccaacaggagcagatggggctgaatgtagtttctccacttccgtagagttttaagtaaatacagctctaattacaatttgtattggacattgattctaataatccataataatgaattaaggaaagctttagtaaaataaagagaaatgtctctgacaaaaaaaagtttttctaagtaattagatgggaataaaatgtttactgtcatttttcttttgttacagagaaaaaagatctgaagataaatatcttcagctctttttaaaataacctatattttcctctttgatgtttatcaagatacgtgacgatcagcatattttaactataaagaaatgtaacatcatttttgaaatgaaaaagtaaggacaaataattaaagaaaattacttataatcttactaccccgatatttgtttagattgacactttattgtgtatctaatttttaatacatatttcttatttaaaataaaatgcagatcgttcagtacaaactattcataacttgctctttttacatgcaaggaaacattccttaatatccttacatattttaacactctcatttataatggtgcatgtggccttttatcctagtgctgtatttttaaaatcaattataaatggaaattcattggaatgtagttaataattttatttcttctcaaatatcttttcataaaaattgtgccaatttatactctccagtataagagagtgtttgtttcatccacttatcaccaatattatttaagcctttgccaatttggtaggtgaaaaatagtaatgtaattataattccaaattatttagcaattcatttgaattttatcatattttcatacttaatacaaatatgtttctcttatgtagaattcaggattatgttatttgcatatttttattaatgttttcttactgatttgtaagatgtttatgtagcaaggacattcatattttgcattctgtaaatatttggaaattttcttttagagatgttaaacattattcacttttactgtattttggatattttttcctaaatttctgaatcactgatttgattttctgcagtactaaatctgagttgtattgcttgtagcacatattttatttcaaccattgcagtctcatttctttttactttaatttcactctacatttatttaataaatgaaatgtgctcttttctgtccctgaacatgatgtaatgtaactacatatgtttataccatggctcaaatggagagaagaggacccaggtaacaaaggagaaagataaaagatagataaagatacagttgcatattggataaagtcactaatttgcaaaggtcagaagatatttctgtgcagaaaaggaattggccattaggtaggatgaggcacgtgtatacctatgtgttaaattatgtgttaaatatttgtcattttacagatgatcgtagattcctgctaaaatctcacatgacctcagttcctattactcattaatttttctcctgaatataacttcattatcatgacgtcatgataagttcaaaaagcattaggaaaagggggtttagcatttttatttacttcaacattttaaagtatttcccagtatgtgtctttaaaataatctcttatggaatatcaaaagacagagggactgataatagttacggcttgagtcaaccaaactgttcaataggaaatagcatcagtatattttctgaaaatcctgccttttgcttgaatattatggccattttgttcaaaataaaaatactcagcaaaacccttaagagaaaccttcaaaaggacaagtacatgccaagtaatctatattgtaagtgcaagggcaaagatacttctccatccttatattgaagcggttgaaaatttgctacacattgctagagttctccaaaattgtttagagtttattattattgttgttgctgttattgcagttgtttctgttaagaaaatgtgggtaaagggccgggcgccgtggctcacgcctgtaatcccagcactttgggaggccaagatgggcggattccgaggtcaggagatcgagaccatcctggataacacagtgaaaccccgtctctactaaaaaaatacaaaaaattagccaggcgtggtggcgggcgcctgtagtcccagctactcgggagtctgaggcaggagaatggtgtgaacccaggagacggagcttgcagtgagctgagatcgcaccgctgcactccagcctgggcgacagagcgagactccgtctcaaaaaaaaaaaaaaaaaaaaaaaaaaagtgtgggtaataagaggaaatatttatgaaatcgggataaatattgcgagtaatgtaacaaacagatagcttatgcccataaaatgctacattttactagctacggaagggtttgagtccactaagaatatacagaaagtacttcttgtacatcctcatttgatactgttgttgctctgatagggaccacatagcaatgtaagcacaccacagttaaagaatggttgaaaatagaacttaaggacaactgtaaatgacgtttggggagctattttctctctgtattttattttatttcatctcattttattttactttaagttctgggatacatgtgctgatcatgcaggtttgttacataggtatacacgtgccatggtggtttgctgcatctatcaacccatcatctaggttttaagccccgcatgcattaggtatttgtcctaatgctctcccaccccttggtccccaccacctgacaggccccggtgtgtgatgttcccttccctgtgtccatgtgttctcactgttcaactcccacttatgagtgagaacatacggtgtttggttttctgttcctgtattagtttgctgaggatgatggtttccagcttcatccatgtccctgcaaaggacatgaactcattctttttatggctgcatagtattggggagctattttctatggctgactttgttacccatgtgactgttcattccccctctcccaaattaattataattgctttggcttcatatttaaatgttccatatattgccagttgtctcctgggaagcaaaattgccactctttgagaaatattggtctagataaatagataccatttaatttttttgagacaatagtatgaacttttctatctgtatagacatttgattcagccaaagaataaactagattgttaaatcttatgtttcttatataaggtgttactctcacgttaagagcacccaaactatctaaattcacatatttacatcattttagcccttaagacatagcctgggaggaaaaagtatagcttaagaatggcataagaagatatatatttgttcttttctgaaatttaggaacatcaaatattttgctatgagacctgtcttctttggaagaaaaattatcagatttgattttgataatctggttctctattggaaaacataaacattcaaatgactaagcttcatatagggctctctagcaatgttttgttttctagtccgcttacacattatgagtataatctttaataatgttgaagatcctttggcttaaaattcaaactacctcttcttatgtttagcttatttttctggcagtaccactgtggtttcagataattttcttttccttttactctctcatttccaagtttcagttattaaattttggcatttgagacccagaatcctggtagtaagacttttgtttaatttttttctcccaaaaattacatttgattttaattatgtcacatgcacagagagcgctccttatccatgtgttctacatccatgtattaaccgactgtagattgaaaatattcagaaaaaaataataagtagttatataccaataaaaatattataaataaaacaatataacacagcatgtgttatactgcacagtatttacattctattaggtgttataagtaatttagagatgatttaaaagtatatgggaatatgtgcatagattatatacaaatactacaacattttatttaagaaatttgagaatcctcagaatttggtatccgtggggggggtcctggaaccaatcccctgtggatactgagagatgattgtgtgtctgtgtgtatgtgtgtgtgtgtgtgtgtgtgtgtgtgtgtgtatgacatgttgcttgttggctttattagctactatcaagtttttatactgcagcattttttaattcatgattttgataactccctcacttacttagagtgctttttgaaagattttgttcaagaaaaatacatgggtaatatgttttctaggattctctaaattggaagatatattccacttctgtaatttcttggctgaaaattcaattattgaatcacaaccattctttgaaaaaaatctgtgggcactgcctcaacgttatttgacttttaatgttgcaaaggaaaatgacaatttggatttttattcttttgagtgcaacttgtttttgctgcctagaagtatattatacttttttctttgcctttgtcgtttaaatctgtggccagaatatgttcatttttggttgtatttcataaatattgccttaataaagatgatctctattttacattatatattcctctgcatacccccaatatatctatatcaatttatgaatcaattgcatgttttactcttacaatatatctgtaattgatatcaataattaatacatagaaattaataaatatatatacaagtagatgaagttaaaattaatgaaaattgaacttctgatatattcttttatgctgcaagggattaatcaatgcgatgtctaggaaggtgcccatcctcctttgaagactatggtcctggaacaccgaggatccttaaatatgcatgtttgggtgttattacttccctggaaagttttcagaagttgtgtgtttaattctggcgttgattttaactgctcttgttccatcattccagaacctctataattcttaggtgggcttgtttttctgtgcaaacttccatcatcttctctctcttatttcttcttttcctaaaattttaattgtggtaaaatacacaatataccctatttcaccttacttccctcaccctaccccaccttcttgcagaaacttattcctttcacaattcattatatttttatatgtatcattctactcaattttctctgtgtattgtgcttatatatgtttgcataaattatactctatattgttttctgtgcttcgtaattgtgacttaatcatatatctaggaaattgtttatgagtgtatatttaaatatgacatcatttaaagtaatccttgaaaatattttaatacttcttttagttttataaatagatgtgagtggttaaaaattcatcagtgtagaatggtataacataagaagaagccatcaaatgcttccacttccatctggcaccaccatttttatttccaggaataaacacatttgagacttgcctatccacttttaacataaagtatctacgcatatacagacatatgtctattaagtaactggcttcttttttttacataaatcatatcaatgtgtctctgcacatatagatttctttatttccctttatttgctgcatagtattccatacgatggatatattttccacttaatcacgaaattaaccattcattttgttatgggtggttggctcatatacaaattttgttattaagatgcatgatatggtgcttattcatttacacctatttttgcatattggtaggaatttagcagtggaataaatttctagtagccaagttccttgggcaaaaggtatgtgcagtttgtttctagatatttccaaattattcccccaatttttacactatttgatgcagcataaatttgcttctttgctctttaagtgcaagttttaatttttccattttatttttctttctggattttttctcatttcttggcatctcaaaatgttctccttttgtgagacctaggtcttctcttacatcctatttgggtaagcaagtagtcttgaaataatttccataattcttttttttctctaaggtttgggatcagagtcacagtttatggttttgaagtagttttttaattgcgtacatgcatgtgtgaatttttcttttgactatttctggaatatacaccttagtttagttctcactaaagataacttgtttgtcttgttcttggctttgtatactctccacttgtgtagaattgtaaaagaatgttatacacacacacacatagacacaaagctcaatctcatattacattagctcagaagtcaaagtcctttaagaaatgggtgaaatggtggtaaacaatttatttttcatccatacttaggaaatgctcattccccatactacaggttgaaaaagaacttcaaatttctcttttaaacatcccatataatagaattgaaccttaatagtaagataattattaatgtgcatatgagtaagtttattatttaatatccttaaattagcacctgcatttcaaggtacagaatttgggttaggttccagtttgatcatttatttaagaacatgttgagcttatagaaggaaagtgagccttttttctctctcagaagacaggcaacaacattaaaggtctgaaaaaaatgctttttgcataaaatagtttacttaattgaacagttttttgctccccttaattcagttcttttacctagtagagaaaataaaccttaggaattaagttatagtctctaaggacagcttcaaaacttcacaactcattgaactggcataatatcagagagacttgcacttgattttattttaaatcctctagttctttgcctataagattggcattgatttcagcgtagctttcaaatgggcccaggttgcaatatctgtctatcagggatacaagtactaatgtgataaaaataataaagcaatctgtgcgctcttagtgattgtgtccttatgagatttcattttcctttataccatgaaattatttagtaaagccatctatcataaagagtgctgttagaaatacaattttctcgtgacgaatgatgtaaaagtaacctttttcaggacaatttattgattaatttgataaacatgtattttgtgccttttattcttggggcaccatattaggcatgtactaaaaaatactcacgaagcccttttaattctttgaaatgggttagatggtggggctgcataatggcaccaatattaaatagacattaagttaattaaggtgcgttaccttagttttcaaacatatatacacataggtccccaatttagagcaaaacagaaattttacaattagacttctaatgaaacttgcaatttttgttagaataagccaatctttagcatttataattgccaaattatgtttctctgcttttctgaggaaatacatggttatgctttgttttctgaagcataaatggatgtttttacttattagtcacttgtgagcagaaggtattactctcgttccttttatttcctcttcttccaattagctgacagatcaagaattcgaaagatgagaatgccttgaggtattcagatgtcatctacaacagggaagaagggtgactgtgagagtgccaaactttgctgctggaaggcagtgttatttcttgaccaactcatgtgcattctaatagtcagtgattttgcttccttatgtggctttgcaaaatgatcgtcctctgccaactctcccccctcctcttgttgttgcttttggtttcagtctgtatgacacaggagcgattttaaagcctttcatggccagtattgtatataaagaacttagtggttgcaatgtatcaattaagcaaacccaaaagttatctttatacagctgtagatattgaatgctaaaacactgttttatcaaatatttggttctaatatcatcatctaaattttaatgtaaacgtctacattaaacttttactggaacagttacagctgatttgaggtctactcctctagattagtgacattttctattaagcatgatttattttttctttacctgtaatcatttaggcaccacaaaggaaaccattgttattatagtctagagactagagcttgttggaagctttctgaatgtttttccacaagaggtggccaactcaattaggactggttcaatttttgtcaggtttagtttggttgcaaattccaccttttggtttgtaaattgattgctgctgtgatataacacaatgaccaatgggcaaaagctaggccaaaacagtgaccaaacagttgagcttgtggaactggtctcctttgcccagttacatgaacactgcaatagtttctaacttctgccactcaaaatatgtgaagcttctctaccaaagacaaggctccctttgcaaagatcacttggtagctccatcctgctggagttggtgtaaccgttcatgatttaagtcatataaaataggcactgaagctttatatactattggccacaatcagtttcataagtcttatattactctttcagcctcataaatgttcaatctcaaatctagtatttagatttatatataacttcctttccttctttacccttatatctacatactgttctaaatcagaactctttaatttagtccccttggccaatgagaaagttaagccattaaaaaaaaattctactttcaatacataacaaattttcttcttattctttaaattaaagatctccccctaaccctttacctttaaatcttttgtctttctaggctcactactttggtgatttacctattcccatgaccttactcatcattacaagcacttgacatttaaatacctagatcaaaccattcctgagttgcacatcccaacttctaacttccttatgaacatcactagttgcctgactatatattgacatgcacaattgagagtgttacagtgcaggcatgcacagcctaacaagcaagatacactcactgaatgaatgttaaagtggaaaaagtcttccaccttaaagattattttaaataatccctaaggggtgtaaaaatcatctttacttacattttaatttgtaaagaggagaaaaatattgatgaagcagttagaaatcttgtgcctgagagagagcgtccctcacttttggtccctgtagtgtgtctcttttcagttacagtaagtggcttcccacattcttttctcataagggcagtgcggccagatggcatgctacttacttattgagaaacaaaagagaatttcttccttacaaatgttatctaaaatgtagttttgaaagtctcttaggtaaagatctcctttataaaatgtaatatataattataagctggtggacttctttttgatctctaagattattttgggtatacttagattactgacaacccttagtcaagagccattagttccgtagccattagttaattattactgtatataattattagttagctaatgaagtgtaggttattattaatttggggggctgagatacaaagtaacatcaggtataaggagtttatggaagttcaaaaatgcaaattgtgagttatttcatactcatgacttatcatatggaagttctggtcccgccacttccagactctatgatctcaggcaggcaaataatttatgtccctcagcctctttaacccaagcgcaaagtggaataataagattggcctcacaaaactactttgaggaaaacattagaaaatacatttgtaagatgattctataataaccaagggaaattgttaataaatcacagtattcccataaaataacatgagttaagcattgtgtagaaggaaaataaatttcaaatatataataaatatggaagcaatgctcaaaattcaattttatgtgaaaaatgcaggaatcaaaattctacagaggttatgcaaatttatgtgtatactcacatatgtgcacatttgtgtgcatgtgtgtgcacatacacatatagagatgggatgagtgcagaggcaataacaaaccaggaacagtggtgggaatacatgttattttctttatatgtttctttagaagtgattagtagtcagacttattaggtgttgtatacactttttagactaatttattgaataaaaacaaaagccatttttaacaatggaacaattggaatttgttgttttctatagtaaaagctgtctatcttatcattcattcagccctcattctttgacatctgtatcaaacccgtatgctgtatggttaagccaactaatggacagtacatccttcaataaggaggaagtctaaaacacatagcttccaacttgctttaaaccagatcttgttggtgtgaagccactgtatagttatttttatttatttattcatttaaaaggatttccaagctggggttttggttacttattaaaacctacagagacaaacatgtgtttgaaattaattgtgttattccagatttttcttataccattacatcatgctctttcccaatctggcttcctgaattttcttcttaaagttacatgatttttagtctcattctcaagagacttggaaatgtaaattgagttattcaggcaaaacactgaatttcaagacattgttagaagccagcttcccattatatagaaagctttttttttttttcagtgtaggcatttttgctcagtttttagaagatttagaatgtaatacttgaatagccaaatactgatttcttaatcctatctattcatgtacattaattcctatgatgatgtttgttaggtttacaatcttggctggtcttggtaaggtagattaaaatattataggttttagactctcacagcagtaatgtccaccgtttttctccctagtgttaattttttttaatactaagaaattgtattcttagatattcgggaatgcaaattttatactgtagcactatatatttcggtctttggatagacaatattttggcttatttttttcaattcatctttagaaacatatatatgtttctaaacatatatgtttctaaacacatatatatatgtttctaaacacatatatatgtttctaaacacacatatatatgtttctaaacacatatatatgtttctaaacacatatatatgtttctaaacacatatatatgtttctaaacacatatatatgtttagaaacatatatatataaagataaagttttgctcttgttgcccaggctggagtgcaatggtgcaacctcggctcactgcaacctccacctcccgggttcaagtgattctcctgcctcagcctcccgagcagctgggattgcaggcaactgccatcacacccagctaattttttgtatttgtagtacagatggggtttcaccatgttggccaggctagtctcaaactcctgacctcaggtgatccacctatcttggcttccctaagtgctgggattacaggcgtgagccactgcgcccagccaaaacttttacatctttatgttgacataaaattctaaactatgtaagcaagcttcactttttttataaggatttagaaatgaacaaaatgggtacacaaagaacagattctttatttaacaaacattaattcattgaacaaatattgaagtgtatactttgtatcagttatcatgtcaatcatactagaagaaataagttccaattgtgtcaattggatgttctaactgttcttaacttctatgattcataagtttataactccctaataaatctttacatataattacgttggagtatcacaataatgaataataccattttgcttatataagctttgtgaatgtgaaacaaaaagcaacaacagcattgaagttagaaactcttgaaataattttctacaaaaatttatcctttttaaaaaaactaactttttaagctaagcagagttcggcctggttagtacttggatgtgagaccacctgggaatactgcgtgctataggctttaataaaacagaaagaaaaccctaacttaaaatatatatgtaagttcttaaaaagcatatcttgccataatttatgaaaacccttatatatataatttttattgtttttcagccacataataccagtctaaaaaagcacatgtagaatatttatatgtagtatatatatacattcaactaccttgcatatccagtctcatgaaaaacaaatcaaaagggaaagagaagtatagaattttcagtgtagttaagccacactgctttccctgattttgaaaaatcacttaagacataggttttacttgtttccttggccagggtatgatggattacctgtttcacaaccatctcagtaactaacaactgccaactacagaaccgtattgttctaccaaaggaaaaccatcatgagaagataagatgtttttcccctaccccattgaaacttctaaattacctataaaattgtcataatgtattagtaattggaaaattctgaatgatttttgtttatagtcttaaaatatatggatgaaaaaagaagaaacagttttggcaaaacaagctcagaattcttgatgaagctgttccttggagtcaaagggagtgtgatgccattgccactcaaggttctccttcgtaatctctagcagataatctataaatcccaatgacctataagagcaagacaaggactgcaggtgctcaggcaccatgatatcattagcaataatcaatgcatggctgtgttttctcactaatacatgggtagagtaccaaattattgagcaatactagatctctcttttatcgagctcattagtcttggaagaattcattaatcttttaagcttagaagaaaaatgtaacctaggatttggcagaacgatcaatgagacatacgtgagagagtgtgtgtgttcaagaggaaggtaaggagaattgaaagttttagcattggatttagcataggatttaagtggacccatctgtatttggggatgagggggaggtcatacacggggctgccaacatgggtggagacagaaaacaaataactctgaaaattgtgtgtgtgtgtgtgtgtgtgtgtgtgtgtgtgtgtgtgtatttctgtaacagtttagggttttaatttttttccagaaaccctaatcaacataattaactttctagcctcagatctaattggtcactacatcctgtcatggccaccaccaaattatatcttatttacttccttcttttatgcctactgccggaaacttatttcaaagatacctgtattttcatctgaactgttgtaataacctactgactggcttctctattattttcccgtgttcatcacttatattgacttccttatttaaaagcagtccagatctattcattgcctacccatgaaatccaaactttttggcatgaatttgaaacaataataattattattatcatttattaagaaacttacattgctagacataaaacatgagtatctccaactcccaaactgagctttgaagatagggtattgttatgtcttgctttgcagcagaagaccttgatatacagaaagattaaagatctttccaagttcaaggagctggtgtaagagacggaactaaaattcaaaacatgtgctgtgggtcgggcgcggtggctcacgcctgtaatcccagcactttgggaggctgaggcgggcggatcacaaggtcaggagatcgagaccatcctggctaatacagtgaaaccccgtctccactaaaaatacaaaaaaattagccgggcgtggtggcgggtgcctgtagtcccagctacttgggaggctgaggcgggagaatggcgtgaacctaggaggcggagcttggagtgagccgagatcgtgccactgccctccagcctgagcaacagagcaagactctgtctcaaaaaacaaaacaacaacatcaacaacaaaaaaacaaaaacatgtgctgtgactgcagagttcgggcattttccattacacctggttctgtttaaacctgacccatttcacctttatagattcagcaactaccagtctcaccttctcgtacatcttatacatatttagctttacccacccgccatgatttaaatctctcatactttttcccatcctcatcctgttggtcatgcccttcctgctgttgtttccttgatctttagtaattttcatttagataacatctactaatctctccaggttctgtgcaaatgtctcttcttctctgaagtctcttttaacctattgagttttccccttacccatgcaatatttccagagcatgtgatacatacttctattgctgcaccaatctcatttttgtagttatttatttgtgtatccataagtcaccatgactgcttgaaaacagagcacttttcttcttactttgttgtttatgacacagtgattgtcccatcaaacatgctcatacatattgaatgagtgaattctctacccatctcaaaccaatgcgttatggcaatggcacacaccattagtttttgtaagtaacttttgaaagttaagccaaaagtatcttcatgttaattaatagtgcaattttgcacgtgttggaatagttgagaattggttattcttaagatttatttcctgcccaaacaccacagctccatatttcacgattttccaatataacttatcatcttggctgtaaagaataccttaattttggccttaggtaggatagatatgtttgattggactttctctgactgattaggttaatttgtcagctggactcacggttcttctttagttttcttctattctacacttatgataactctgtgtttggatatttctttgtttattacagatattaaacttgtaaatttaatgattctctgtaatttttcagagcccatcagcccaggtgtctttccacatactgatgtagtaactgtgagtgcctttaaagctcttgtatctaaaccatagctctgttatggttagcctctgcttcattcatttaaaacctattttgtgtagtcactatttgcaaagtgtttagctaagataaaccacgtactttccctgttcttgagaaattcatagtgtatcctttggtttatgatctagcctaggactcaattagaacattaattttgaaaagttaaaggagacctctttggagattatgcgtttgttttagttgtgctattagtgagtttaatcatataattttgctcaaacaaatttcttaagggtctactacgggcctgcagagggggaccaagggctcagaataaattgatgtagtggttacagatgctggcactggattaaacctggatgtgactcctggcttcccccatacttgctgtgtgatgccctgcaagttacagtaactatctgagttttctctttgacatatgaaaaatgtaaataatagtatttcccatataggtatttggtgacaattaaatgagataattaaaataagcataggacattatatgacctttgctaaacgtccaatttttgttgtttaattattgagttttcaataaatatttgccaaataaaaaacttaaggaaaataaacactgaagttattgtcatgactttcatgtatatctccattcttgaagttttgacagagttataaaaattgaactccgagttttggctcaagaaacctctgttaatctgatatgcataaatcttgaattaaggtttcctttactactgttactattcctactgataatatctttttatagcatttatattttaatgtatatttcccattacctcctaaaatccttagagcaatccctgtgagggctggtattattttcctttatagatgaatagactaacatgtgcagggattaagagtcttgatctacgccatttggctcataaatggccagctcagtcctggaactcccaggtgtcctactcctgtacttcttgcctctcttccctaaattttggttagttgaaaagtggacaattatcatcttctggaatcttctgtatgtaatgtaatatagttacagtgtgtttatatagagtggaatataaggagatggagattactggcctaaggatatgtatagatataaatggaatgtgcacacacattttaaatgcatgctaagtggaacatggaagtttttcatattgactcaaagtgtggtttatttgaagacattcaattataaatgtcaagtcaacttgcattcaagtaaattattatgtccctactcctaaaatttttaatacaaagtcatctggccaatgcttatctcttcagactcataccccgtcatttgttctttttttcagaatcaccatatgattcagctgtatagaagtattgtggtgaatacttgtttcatacttctgtcttattatattccctctatcagtgtactccctgccccttctgcaactcttgtttatcctgggaaatgctggatgatctttgaagatagcaaatgcttgccccctctgtgataccatctttcaactctgtagattgaacattttctggcacttatagcactttaactgtcctatcacattaaacaatgttgatctaagtcaatctgggattccttagctctagtacaaaacctggtacaaatgtggaaacaattaatatttgaattgggctaaaaaactaggatacatgtttctttgggaatttgctgaaggaaaattagaagtaaaaaaattgagcaactttctaactgttttctttcaactccaagtgttcattcaatctgcacatgttcctgaacacctatgaagtctcttctcctaaccagggatccagcagtaaatagaacatataacaatcctaccctcatggaaaatgttttctaatgtaaagagatatacagtaagtaagataaatatatgaaatatcttacatggtgataaatgttttagagaaagataaagcaggaaggtagaatatacaatactgagaggaacttgcagttttaaataggatgggcaaggaagactctgctgaataggtgatatttgagaaagaggggaaggagataaaggattgaggtattaggatgtctcagggaagagcatcccaaatgtaacagcaaatgcaaacaacaagagaaatgaacacgtatgtcatgttcaaagaagagctcagaggccagagtggctggagcacagtaaagaatggaggagaaaaagaagacaagttcataaaaatccataaaaatcatgtaatgtcttgtaagttaaaagattgatagttaatatgagtaaaatgggatgtgaatggaaggttttgaaaaaggcttaatgtcatctaacttagtattttgaaaggataactctggcttttatattgagaatgaaatgaaagagggttggcacagaagattgaggataggaacaagggaaagaacagggagaccagttatgaatccattgaaatagttcaggccagaaatgatgatgacttggtttatgatggtagcagtagagataatgacaggtggtgggttgtgaatatattttgaagataaagataagagaatttcctaagagagcatatatatgtgaaagagtcaagtatgaatccaagatttttgttttaagcttttgagaggatagagttgccatttactgagatgggaaaaactgcagaaggaacagataagggggaaggtcaggaattcagtttttgacaaattaattttgagatatgtttagtcatcaaagtgaagtttccaaataggcagtttgtcattaaatctggggttcaaggaatcattccaggaaagatgaaatttaatgctatgggcctggattaggttacccaggaagtgagtataaacagaggagagaagagatccaaagactgaatcttggggcatttccacattaagaggcttgggagatgaaaaggaactggttaaagagcctaaaaagagagtgaacagtgaggtgaaaggaagacaaggatagaagtcaagaagaagttagggatcactggcaaacttcttctgtaaagtgccagatagtaaatattttaggcttcataggccaaaaggtctctgttggaagaatacaactctgctcttttagcaggaaaacagctatagatatcaggtaagcaaatgaacatggttatgttctgttacaactttacttaaaaatgaggcagcagacttgatttgatccataggctataatttgctgattcctgttcaagaaaccaaacaaataaactgtttccaggaggaaagaattattgattgtatcaacttctgcttatttgtcaaaggtgaaactgaggaattgaccattagatttaacagcttggtagctgtattagtccattctcacactgttataaagaaatacctgagactgggtaatttacaaagaaaaaaggtttaattggttcacagttctgcaggctgtacaggaagcatagcagcttctgcttctggggaggcctcaggaagcttataatcatggcagaaggcaagggcaaacaaggttgtcttacatggccagagcaggagcaagagagagagtggggaggagccacacacttttaaacaaccagatctcataagaactcactcactatacagtaccaagaggggatggtgctaacccattcatgagaactctgccccatgatccagtcaacttccaccaggcccgacctccaacaccgggggttacaattgaacatgagatttatgtgaggacacagatccaaaccatatcagcagcctttagtgaccttgatgagtagtttcaaaaggtgttgagaggaaaggcaaaattgaaagagggatttgggttaagagagaattaaggagagaaataagaggtaagaacaagtcagcactttgggaggccaaggcaggtggatcacaaggtcaggagttcaaggccagcctggccaacatggtgaaaccctgtctctactaaaaatacaaaaattagctgtgcatggtgatgcgtgcctgtaatcccagctactctggaggctgaggcaggagaattgctcgaaccaggacccggggggtggaggttgcagtgagccgaggtcacgccattgcactccagcctggggctacagagtgagactctgtctcaaaaaagaggtaagagaacaagtgttaaaaagtgaacgcgtttcagtttcacatttgaggggaacaaagaaatggagctgaaactgtaagtgggaaatacggtcaagagaggatgtttttaagatgggaaaataatagcgtagaatacacacaggaatgacccagaagagaggaagaaattggtgatgcaggagagagtggagctaattgctggagccatgtccttgagtaggtgagagggaatgagatctagagcacacagggtggggtccgtcatcggaacaaagactggtgatccacagtgttggtcaccaacgcaggcccatgggaagatatgttgacatgaggctagggagcaactgtttactgattacttcaattttctcagataaatgagaaacaaggtcattgactgagagtggggaaggaggtgttggaggtgtgaggaaaggggagagaataaaatagccattcagactggaggttctcaaacgttgctacatactaaaatgacctcagagagcatttaaaaattccaaaggccagattgtaaccaagacaactttactcagaattttggggtgatgccttgctttagtactttttaaagattccccaatattcaggtaaatttgagattgagtaagattactgagtcatactaggagccaacttgaatctagtgttcatgaattcaaaatgtgactagtcagattatgtgttttcctccagaagtttccatagcatgagagtgaacagtgaatgagtggagagttggtggtaaccggggtttaagatttatcaagtgggcaccagatttgagagggagcagagcaatttaaagatgtattcaaaaaagtgtttacaatacactgtagagtttatgcttgataaaaagagaagtgatgccacgaagggcataaggaatagtgaaaagccagtagaatgaatgcattggagggcctggtaatatcaaagtgttgttggaatggggtactagatggaatcatctggagacttagaaggtggaggtcagaaagtgtgatgtttataactgagtttctaacaacatctatcgtatgaccacagaaccaagtggccaaggcagggtggaggacaaggtctctggagtcaaaaagttcagtgaattactagggcaagatggtgagagaattgttttcaacagacatttaaagtaccagaagttatgacaagcatcatatgttggagagggtaacagttaggcaggagctaaaatcttcaggtagtgagggaatgataccacccatacttagatagctcctcattttcctactttcacagatactgattccatctttagacattttgaacaatgcaacaatgttaattttcttatactttgttcaatatactttcatgtgtagtcaggtactagcgttttcctttttgccccgttttattctggttattagtaattcactagtttctaaagctaattgtatcatcattgctttttacacttgaaatatccagtcactatttgtgcagagccaattcaatttttcttcttgaaagaatataactcttagctacaagaatggtccagcaatggtaatagaattattctccatggagaatacctttttgcttctctagctctcccttttaacattagccttaatctgatagcaaaatcagcagtcctaaaacaaaaggaaaaataatgatgtttctgaaaagagagagtcagaagaattaccagcacactgaatatgtatttcagtctcttgtgtaacaagtttgttgttgtgatggttgttttttgttttccctttggcaatggcaatgtattctggggaaaaaatgcagtatgttgattttttaaaaagcctattaaaaatttccaaagataaaaatgcctgaagcccttaatctaccacatgaaattgtaaatgatccccagtggtggagttctctgtgatgcaagttcatcatagttgactgatggatattttcagatcattcctgaagttgtagtgcatttgaacaatgagtattgtaggtatagtgtagaaatgttcatctttctatgactgagatggcagagccttttagctaagactcagtgtgatttattacctctatctacatcaatcaccaaacatgcaaatcatcttgactctcaggagagccatgactcattcactgatatagaatgtttctccgtcacttggctggagctctcttctctcacctccagtgttttacacagtctgtttcacaaatgtgaacaaactgatttctctgccatcccagttttctcatctcttcaaattgatggttttttccagcacatctttactgattaagctagatcatattcccactccattaaatcttactgaccattcttacctgctcatatttatatatcaagtcaaacgtctgttaacgtgtgaagtttattataatcagtctgtgttctctgtttaaattatcctacctcatttttatattaatttcttacataattcttttgtcaaacatgtataacttggagttgaaatagccttgtgtaaatcttgaatcttactccccgcaccttctgccacattgtccatttatgatgcttgtaattagtttgtagatttgactttttaagtgaaatattccagagcaagagttttctgtcaagagggagtttgcagttaggttgaggacaaatgcatatatgggtcacctggctaatttttttttattttgtacagcatatacattccttatttctagcctacttccacaaacaagtctgttaaggctcaagggtcaagtatctcaaatctgataaaatattatgcttaggtcagacacggttgctcacacctgtaatcccagcactttgggaggtcaaagcaggaggatctcttgagcgcaagagtttgagtccagtctgggcaacatagcaagatcatgtctctactaaaaattaaaaaaaattagttgggcatggtggtgcatgcctgtagtcccagctactcaggagactgaggcaggaggatcacttgagcctgggagattgagagtgccgtgaactatggttgtgccactgcactccagcctgagggacagagtgagaccctgtctcaaaaaaaaaaaaaaaaaaaaaaaaaaaaaaaaaaaaaaggaaagaaagaaagaaaagaaaaaaattctgcttagtcccatgctgtaggtagaatgactctggcttttaatggcctgccttgataagaggtcaggtgcactttctcacacatcatgccatgtccctcaaaggaggactccttattaacattgatactaaataactgataagctaatcatggagtttaacttaatacacctgaaaacgatcctaaaatgatctaaaaatctcctgggtttttttcttttcacagagaaggaaattgaaacagtcctctttcaggacccctgaaccaatattttttctattatgccatactacctctaaaataattgtttgctaatagccagctatatgcaaagaaatatattaaggcattaaaaatgtttgaagatatgatttattcctcaaggcccttaacatccctttggcaagataatgcaaactacctgtgcctctcttacacttcttagcaagatatctgtattttgtgatggtctatattgtgttttcttctcttctcctcccagccttgtcttcctgtttaccatctgaatgtggtaaaaatgcagatctacctttcttcccaatgctgaaatagggcctggctcatagttggcattcacggcagttaggagaaggactgaagagaagcctgcactttctcgtttttgtacatgctctgcacaaatcctgaagtatcctaactcaacccctaattatccccagctctttaagccctacttatctccctttaacctttgcctgcctcactgttcataccccctctcccatcgctgcttttgggtttgcatctacctcctgtccctgttttatcctattgtatttatgcatatgagtattaaaatcttaaaatataccagtaccttaaataagaactgagggataaagcagatatccctccaatttgagggtactttttttctattttattctccagaactgatcagtgccacaaaatatgatgagagagcaaggtgtctgttttctctttcagtttcattgttctaaagacaacactttcagtgtaggtgctgtgtatccattgcctgtttgaatttacagttgttttccagtggtgctgcctaactctttgctaatatctatatttgacattaggtcatctgggcagcttgctgtaatcatctgtgagaaagctcctctggaacccaccaatgggcactagaatcaaaactttggttcagtcttataatttcctcatttataatgtggggataattatagtaccttccttgtggagttcttgtgaggattaactgagtcattgaatgtaaagcacttagaatacgggaagcactcagtaaatattgttcatatggcgctcttcagtagccaaaatataacaccacactatttgcatttagtacctttctgttgtggaagcttctattcaaacaagggtatgtatttcatttatttttaacgttttgcttttgagaaagcttgagatatatttcatagttgcctacaggcaaagggagacaccaataaattgaattctgcatcctggatcataaggtaagtgccgaatctgaccacaggatcagtgcttctgccactaaacccgagtatcatcaaccttactggttctttgcttagatactcttgtccaaagttcttaaacgtatcagcaataccatcatgcatctttcttttattattatttttatttaaataaaaagcctacagcacccggtattcccaggcactctcccattcaagtactaaccaggcccaaccctgcttagcttctgagatcagatgagaccagccatgttcagagtggtatggccatagactcatgaatcattcttaactagagagcaatacattttagctaggaaaactcctgcattcaactataatttcatataatgtaaatatgttttaactatattaaataacttctccaaatatgaaacacacatatatatcatttggtctagatggatccttgactgtaatttactttgctgaagtgtccatctctctatccacatttggattatttaaattacttggagagccaaggtggctcccagactaaaatttccccaattgtccttccactgctacttgttcatgtaggaaatttctccatcctgtacacagacatcagagtactctactccaaagaggccctaggatttttatctcttcccctttcccagtccttctgacaactctccctccactgtttaaagcagtattaaaattatccaaatgttcatcattgcctctttctactttcaatattcctctagcagtgccactaatctaaagcatatgctgatttctcttccctcatgaattatgatttataatggattagcatgagcctaggaacaatgtacttcctcttgtcccagacatgtttagagctttccaatttacgctaacattggagtttgtcatgggggcatttttgcccatctatttttattatattttagtcaatactgtgttatatttccatatcatattattctgatataaacaaaaatcacaaggtaaaatacaagtattcattattttcttagtatttatcttatccactgagtagctttgactatacttaaaaaaattctcagcttatttaatagattaaaaattataatctgtaatgaattaattggaaataaccaattaatatagtgagggaatgaaagtatgtcacaaaaatctttctgaaaatgtttcaacgacataagtacaaacaactctgagaagtacaaacaactacagagaaggcataacaaatatgtcatgattgtcaatattttaaattcaccacttcaggtaggacaaaggatgttaaaatatttttctttgaatatttaatatcactaataggaccaaaaacattggaatagcatgtgtgtgacataagctcaaagttctagagcagtgctattcaatagaattttctgcagtaatggaaattttcaatatctgcactttccaatatggaagcaactagctacatgtggccattgagcaccagaaatgtggttagtgtaactgacctgatgctgaattttaaattgtctataaattttattttaattaaattataaatttaatgataaatagctacatggggctatttgtctgcaatattggatgaacagtaaaactttagagacttccaggcttctgttaagactgtaattcacacaaggctgggtcatcttgtggtcactattaggccagtgtcacactacaaagcaacacaaatcctacattaaaacaaccacataaaacgacctataagaaactaccacatcacactgaaaaataattttgatatttactgttttgcaagcgtgtcaaaatatttaaggatccttttcacacatctttctccttgaaaacctctcactatgcttcttcagtgctttcttcttgtttctcctccaaatattttccccaaacttacctatatatctcaggcatccttcctttctctcatcctcatctcttctctacaccttttaagatctgtctctttatccattatccccacacatcaacaggtccctgaccatgcacactaaacacaaaatcctcatccccagagaagagacttgctatccgtcacaagaataaatatttgtaaaggctaaattgggggctatatattagaatcatttctagatgtcacccttttttcatcctctaggcaagattatttctaatacgaatttcatgaggcctctagagtttaagaaaaaagctaatgcttattgaatgctttgagtagtaggagcacctcaaggcaataagaacatctcaaggtctcttccacctctttgatctgatgaaaaattgaataataaatataaactgggtatgatacaaaccaatgagcaaatcactttttatgtaaaagtaattaacaggggaaaagatttaaaaaggatgcccttcatcttccctagattgggagcttatcctttagactttaggttttgttcatttgggatacagtcaacaaatatttgttgagccttgactgagtgttaggcagttttaaaattattttatttgtattggtaataaaaacatggtggtccttgcccatatagagcttacaaatgttaaaggaggcagagagaaaacaagaaaatctataacctaaatataaaattatcaattgtgatcactgtaattaagaaattgatggggttgaataatagaatagcaggatgggaatgccatactaacgcatggccattagaaactaagtgatcctacataacacatgtgcacagagatgttctttatggtttcatagatttgatgttagtgtaacccatccttttacatgttatatgttgccatccttaaatggtctttggtaaaccacatctgaatttttgattagcaaatgtgaaataaagacttcagcttattccgtgtaggtgctgaataccaattaacaattcagtatgaataacatttccatctttacctaacgagcacattttttttttttttttttttgagacggagtctcgctctgtcgcccaggctggagtgcattggcgcgatctcggctcactacaagctccgcctcccgggttcacgccattctcctgcctcagcctcccgagtagctgggactacaggcgcccgccacctcgcccggctaattttttgtatttttagtagagacggggtttcactgtgttagccaggatggtctcgatctcctgaccttgtgatccgcctgcctcggcctcccagagtgctgggattacaggcgtgagccaccgcgcccggcccctaacgagcacattttttaaaaggttgtccattttatgaaaatgagtagaaatcgaaaaatgcagtgctgataatgctaagaaggatagactcatggagattattatgcatattgtattagcatcaggtggctgtaaatgcattagatataagctggtagatggtgggctacatgaggaagaaaaataaaatcaaagaagacataaaacttgctgacactacaacaacctcaaagttgtgcctaaaagatgagatttaatcgagtatttttaaaaactagatgctagatcttatggaatagaaacttgtttcctatcatgtaagtctattaaaatttttcccattaagaatttatttaaaaattcgtaactgcattatgtagaaattacatggaatatgtcttatactttgtcttttccccaaaagtgttatttcttcccattttatacctaatagagtagaggttaagtaaatggaggaacataatagaactagaaagttgcatagataggattaaaatgtagaatgttttggcttcaaagtctctgttctttctagttcatgacttctttataaaaatatatttatcagtgtttttggttggatcatcacaaaagtgggttcttccttcacttgtgtagacagaaataaagagtgaaattataacatacaagggagtaatttgaaacatgctcatttttcttgctgttgtcgaaaatgagtattttatattgttttctttttaaaacacaatttgctcccctgcacagaaaaatatacccgtttttctttagaaatttactaaatttttaatttgctaatcccaagggaaggattattttcttaggattaagtatagtcaattggtattatgatgttgggaagtaaagtgcagaattctattaaggacttagtgatttggatttgtcaaagaagagccactccgtgatgtaatttgcatggtcatatatatatgcaaagttctgtttcagcttggagactttatctttgaattttcactgagaagatattggcttattcctattttagaatctgtttagccatgactctggacacacatgtatagaaagagtaactcctttgtacatgtgcttttgaaatattgcctatgatcggtgcctccttagggaaagtgagttttttgttaagagtctgaaagtctatttaggaaagttgttttcaaagagtgtcctgaaggttacttggtctgacttaacagcaaagtcaatttaacagtagtctgccttgcagaatcctggatctatcagagattgagttctccatgctgtgtgggaaaattatactggctgattttgggagaagttactgtgggaacacattttggcacatttctgctgaagccagaaacctgaatgctttgttctttgtgaggtatcaaaaataaaaattcctgaaattctgacatcctgcctgctcccttatctgggttaaatgctgtggtaaacttctcttttggttgaaatatttaaaaaggaaagcaatacatatgaacagacacatatttatacacacacacacacatacacacacacacttgcatttctttacttgaactatcttgttgaatcctaattactaaactcacatactgcttcttcccagggaatatagaatattactgttatcaagatacgccacacctatcctcattggcgacctaccccctcaattctccttgctggtttattggattaaaatagagaagcagaaatcttatgtaggaggaatatgttgacaaatggtgggttttgtcttgataatttcaccaaatatgtgaattgactttgtcagtcattaaagtaagtgtgctgaatgccctctgtgtgtgtatcaggataagtggtctaatcaagttcaaatgttctgtgtctatttggctcagcttaattaaaattcagccctgcttttgagcaagccacagtgggttggcagaccttcaaagggctatattgcagcaaacaataaaagtgataaaggcacacaatagcaatcaatacaatgcaaatgcccctgttactcaaaaatccagtggaaagtgattgcttgaaacatgcttatccacttctcatcataaaattaaagtttttgcatcactttatttgtaagtttgcctacactctccttgtcaatgggcttgctttttttttaactacgaatggagtgaaagaaaatgatagtaagataaatcagctcaatacaaatcaaatactgtttaaatttttacagcttttgttttatttgttacacatatgggtgaaaacttactcaaaggatttttacctgtatgaggaagacagccgtaattcatcctccattcatttgtagtggaggtggtatattcttggtgatcatcctttttttttcttccagtccactgtttttggctggctgccatggtcccagattttctcacaaactgccatctggcattcttgctgtccctcacatatagctttgtcaggacctcctccaagcaggctggagaatttcacagcttgggggcatgggagtatacacgaagttgcagccacttcagggttgatttctcacctacaacccacatatctgtcactgctagatgtttagtggaaagagctgctagggcactggagattaggggacctggaaagaagtacccactcacctctgatgagctgtatttttagtcactctgtatttgaagaatagagatttttaaaacctgatctctgtattttacataatcatcgtggaacatcactgtgggtaaattattatgaaagatacttctagaaattcaagatggagatattgatattacaatatctcttatagcacacatgattgttgtatcatctcaaagttttcaatgaatgcttttatctgtaagcattcattgtaagactgaatctgtatatataattccacaatgtaactaaaatataagagaaggaaagtttcacatctcatccaagttaggtacatgaggccaccaattgcagaactctagaagtatttttgttacagtttttcaacccagtgaaacactatctcttctgtgtgtatgctttaagtttcattttggcttctaggctttaatcaagcactgagataattattataaaggtatgcttcaccattgtattaactacatcactgacttcaatagctgaaagagaggcactgggatagcgccatcacaactgttcacaaaattctggccagtggaacagctagtcacaaggccaaggttttgtgaactgtgtctatggctgtatctcagtacatctcttatcttctgcagtggaagccaatgcttctcacttcttttatatttcatccattacctacttattgcccttaaatcatcctaaactttgattgttttgttattctgttaaaaccataaatggcagaaaataaatttgaaaactaattattaacatcagtaacatgctctcttaacatgctgaagaatatcatactttcaagtgagagcagccagatcaagtgttaatttttgttttagatgccatgttaagataatagcttttagaaaagacgtacacctctattgatacactgacgcatatacaaggttcaatgaaattcctactgtagagtattgactgtgacatttatattttgtgtcaaacaattatatagattctgaatgtctacgaagcaaaattgtaaacacaactaacatcacttctttcttagataatttaatcaagatttccctgtgaacataaaatatagaatagttagtggttaatatttttgggaaatttccatcatagtataataaatatttggggaagacaaacctatacttgtaaagaataaaattttcttaaaaagtgtcatgaatatattgctcaaatttattctaatatagtttatgatagaaaaattatttctaggtagttatgttaaatagttacgaaaaatgccaatgaatgtcaggttaaacaagtttgcagtactttcaagacatggagtaatttggtaaattattgtattttaacaacagatgtattttctgatttttttttatgttctgaattttaatgtgcagaacttacactatagtaaccaagcaaaaatctcaaagggtattctttttccaaagccaaaaacaaattaaaaattagatggaccagtggcccccaggtcggcacccctactctccaattgaacagttacttcattcctaagtgcatgtgaccataatctgctttgagcattatattcaaactttatcagtctttgtttcagtctgtccaacttctgagcccaatcctccagccttcctttgagaacatatctagaataagcttaccttgtattacatctcagaagtttcttaaaactaaatcggggatagtatcattggtaagtaagctttcgttgatctggataggagatatctgcctgaaatgtgaattaatctgaaatccttagacatactaaatagttctctatttcagtgaaacagacaagtattcaccgattcttttcagtttgttatctgaagcttaagtttcctacttagttttttcctgttgctcacttttgacctataactaagaatgaggccgaagatatataccatcaggttgccaaaggagaaacaaagtaggtaggttctggggccagccactctgccagtgaccgtctgttgagatctttctatatatagagtcaaccaactgcaaatatatatgagaccaggatgtctccagtatagaatcaaaatgccagatttgagcatcctgtgtggctcacccaacaatgatggtatccatatgttagatggttttattttgtactgctttcatataaactcttcggaggcctttgaatagggatttttttcttctataattttaaatacctcaatgccaatgagatatgaaactcatagctataacttctcctacaattagggacaacaatttaaatttggaaaagtagatgactaaacaaatgtatatgaacatatacatcttcaaatataaatgctttcttaatggaggcttgctcatagaaatcagaaatgtatagtttgtttgctgttgtatcaacctgcatttgactatgattctgttctaaatgtaagtcttgtctcaatttttgaatttgttatggagtcttttaaagagacaggaacatatcaatagaagaaacagattctactgtgtgtatacttgtgtttgtgtatgagagcattcacaaaatattcatacttttaaactaactcccacagaaaaatttaaaactaaaatcacttaaaacatatgattggcaagagcttcaacaacctgagaactctatgcttatcagatgaaagaagaagcagcattatgaaaatgtatctggataccataagataatttcagagtacatcaggtgaaaacagtgagaggggctctttgttcatctgaccttatattttataaaaactcaaccttcgattccatgataaatagaatatcaaaatcccataatgtcagatatgtatctcatctttgatcttctgaaatgttatgtatgtcaagttaaaaaatcttgaactttgatggtaataataacatgcaaatattttgatcaaaactggttactttgcaaagaccgaaatgatattgaagtacttgttttttcaagagtcatatagagacataaatatatttggatagcataaaacttaggaacaaattattgttaatgagagttctgagatagaattttatatttagatttaatacttttaaaataacatttttcaaaatgcaaattgaaatattatatggatgcataccatattatgcacaggtagcgtttatttaacttttgtttcacaattatttattgaatgtctttttttgtgggagatgctatagtaggcactagtaattatgtgaataataaaatagatgcaatccctgacattgtggacttactttcgagtttggtgctataaaacttggttctctttcagtcaaatctaggttgaattattggcttcagtttttactgactgaatccatttgaatttcaataccttatgagaaagctatggcttagatagaatataaaacttggtagtcaataatggaactaggaaataaagccaagcttgcctgactctcaattcaataatttccccgttattctagattagataataaatgtataagtgtgaatttaaaactgcaaagtatgggctgggtgcggtggctcacacctgtaatcctagcactttgggaggccaaggtggtggattacctgaagtcaggagtttgagaccagcctggccaacatggtgaaaccccatctctactaaaactacaaaaattagctgggcatggtggcacatgcctgtaatcccagctacttgggatgctgaggcaggagaattgcttgagcctgggagacggaggttgcagtgagctgagatcatgccactgtactccagcctggctgacagaacgagactctgtctcaaaaaaaaaaaagaaaaaaaaaaaaaaagaagaaaaaaaaaagaaaactgccaagtatggtagaaataacaattggctttataatagctatttaattttatttaatattccttggcaattttatttatataattaaccaatattcattgagtgcctactatttggcaaacatagtttgagatcttggggatattttcaggaacaagaaaataagtcccacttctcagagtactgaagttttagcatgaaaatatagacaataaacaaatacttgagaaaatgtttagtgctaaatgctatggtaaaaagtaaatcagggaaactagatgctcaggaaatctttcccaagtggacctgaatgactaaaagagccaaccatgctaacatgtggggaagaatgtttgagaaagaaggaaaatctagtgcaaagccctgagaatggaatgaggttggtatgatcaaaggtccaagagaaatcaagtgtggctagagcactagcttttaaaatgtgattaccagatcagcaacctcatcatccaagtatttatcagtattctaggcatgttaatttccttgatttgaaaattatgctgtgattcggtaagaccttaacattcagcgaaattgcgagtaaagggtatatggcaggatttcattgtcctattttttgcaattttttgacaaatttgaaaatatttgcaaatgaaaatttaaaaaagaaatgagcaattatacagcaaaaatgaaaggttttaagcagtgcaaccagtggaatactgtgatctagtttgggttttaagaaaaatattattgctatatgatataaaaaatgggttagaagagggaatttaatgcaagcgcaatgaccggtgaaggagctgttgccattgtccagaggagacatgatggtggctggcactggggtggcggcagtagagatgagctgtgaacaagtcgatccaagataatataatttgaagatacaattggcaaggcttactgatggattgattgtgagaaagagttaacagaaatagaaaagtcaaggatgcttaggttttagaccagagccactggcttgatgctagtgatatttatttattgagaaggcaaagattgaagtaggaggttgtcaaataatggcacttgattaatttttacaagtaaattattaaaggaaatctaaacggacaatttgcattatctttgagtatttgtgattattagctggtagtgacgaatttaacttgatgaatgccatattgtctgtaaataaattaactcacttgagtgttctcatatttttcccgattttttagttgaatgcagctttagaacattaaattgtgccatatattaaataaaataattaaacaataccaacaagcactcttaatttgctcttctaaattttatatccttatgtagtttattattttattcaacaaatacttgtggagtggctactttgtaccaggtactcttttcatcactggaaatataacactgaacaaataggctgaaatctctgccctgatagagctttcattctggtacattctagaatgaggcattttaagaaaaaaaaaagtatgatatgtgggtgaaatagacagtttaaacaagaagtaaaatgactattaagccagttaataccaaggatatggaccaaattgaagccaataaggagcattgataatatgagaaaggaagggtttgggtctggagggggttttaacttaaaataaggtcatttggaaagacctctttgattaagagttaagggatggagttacaaagtgctaagaagagaggtcataaaagtgggggaataggcagatataggaagctttgtatgcttatttcaaagacgaccctgtgattgccggaatgactggaaggatggcattgccatttatcgaaatggagaagacagccgaaagagtgggtctggattgtgggcatgtttgggaggtcattttggacctgataaatttgatatgccctttagacttccaagtagagattccagtggctggtaggatctaagagatcatagatcacatgagaggcccatacctctgaatagcaaatgttgtatcaaattaagaagttatatttcagggttttttgtgtttgttgttgttgccaaggaattgatatacaggaataagttcctgataggtttaaatgcagtgaagagtgattttctcaattctcgtgagaatttggatcagaataattttatttcaatgaaaaatctgaaatatcaaatgcagcttaattgcattgacattattaaaagaatgaggacttaagcatatggcaaatttaattaaaatattactcttatagaagagtgatcatagtagaggacttttttctttcttaaagcaaattatatgccttcagcagtacttatttttacaaaatgcagaagactgtatttaagatgatttctagttcatgttattatgtggtgaaataaggaaatgcatgaagctgtgttatgttagtttgggttatcttcgaagcctttgattgggaattgactactaaacactgtaaataatatataagtactaagttctgaatgtgaatgtgatcttacatagtcatcaagccattatgtgtcctttgttttcctatcaaatgtagggggcaataatgtcagctattatatatttattttaaaaaatattttgaaaatgagaacaaggctatagatatacctataaatgtgaatatattttcaattcttcaataaaatatgttttaaaataagaaaacctgttctttttctcatcttcactaatctctttttagcaggaaagattattttttgtttgcaaataacaaggcttaggcattaagtaagcgctagggagaggaacaatagatctaccctagaacagattgaggaatcatacttaaaagacccatatattaacttggaaataagaggtagaagaaaaggaggaaaattaggagaaattactttgctagagattgttttgcattgatcatcaaatgataaaaatgtcttctttgaggttttcatttaggatctctgaactaatattcatattattgctgtagaggtattataaattcccagtcattagcataaggatttagtgacagatctgaggttctccaaaaacacctcaatgccaagcaaatgattctgctattagtcttcttaatgcacctggcaatttcctgtctttctactttgatcttctttctcttctcaggtttgcaacattaagaaaggggtagtggcaaaaagaaagaatgtcaacttagaaggctaactttgggggaaatcagtatagccgaggcatcccccaaaagcttcctttgcgttaatgcaaacttccacacaatatttaccaacttctatgaaccagaaaaggctcattcttaaaaaaaaaaaagacagctttattgagatataatttacatactatataatttacccatgcaaaatttaagatgcagtggattacaggatattcacggtgttgtgcaacctttaccaaaattaattttagaacattttcatcattccaaaaagaaaccccatgcccattagcagacagtcttcattttcctccaaatacaacccctcccttcctcagtcctgggcaactaccagtcgactttctgtctttatggatatgcttagtctggacagttaatataaatgaaatccagtcatatgtgtcctttgtgactggcttctttcatgtaatgtaatgtttttaaggttcacccatgttatggcatctatcggtacttcatttcttttgatttccacacatcgtccattatatggatttagaacattttatttatccactaatcatttgatgatcatttgggtagtttctattttgggctattacgaataatgttgccataaaattttttgtacaagtctttgtatgggcacttcttttgggtatgttcctaggaatggaattcctgggtcatatgataattctatgtttaatcttttgaggtactgccagaatgttttctaaagtggctgcactgttaacattccaaacagcagtgtattagggttctgatttctctgttgatctccaccaacaattgttattttgtgtgtgtgtgtgtgtgtgatacaatacactgaacataaaatgtaccattttacgtgtacaattaagtggccttaagtacattcacaacgttgtgcaaccatcaccattatctagttccagagctttttcacaatctgattgtagccgtcataggatgtgtgatatggtaactcattgtgattatgatttgcatttccctgattgctgataattctgagcatctttttgtgtgattattggccatttgtgtatttttaaagaaatatatattcaaatctgttgccaatttttaaactggcttttaaaattattgaattataatagtgaaaagactcattcttaagttaacaatgaatgtattacatgaaaaactcaaccaccccatggtttcagtttaaatgtattttccagggatcatggacttacccagtgcgcagataggacatctttatgacatcagaacattgatgtcaagtgcctattggttcagggtagtgtggaagaagttgtacaaaagcaggcacttttatacccttctctctgagaacattcatctctaaaaaacatacatgaaaaaactgccaaaaacctgatgcatttgtggtgtaatattaatttattggatatgaacttgttttgttgtaaactaccagagtgctttgaagaggaattttattaaatcatattcttaagaaaagtattaaatcagaaggtgcacatatggatatgcttattagtaagataactctatgttggtgatattcagtgtatagttttccagagctgaagtgagttttctgtttccacagtttaaatgaaatgtgtttcaaaatgacacttaggatatctgatggagatgttgtcccctgtcatgtttatcatttaatcttatatggcctcaaaaagagaaaatcatctttttggcatactggcatacttaatttatgcagcatactatataaatcctaaagggaggactgagccaagccagagaatggaataacctactttatttgcaaatggataaccatagacatgtccagttattattaagataaacaggaaatgatgacaaaaccaagatcttggctatgttaacaaatttcagtttctcagtctatttctgaaaatgttgagttccttccaagatcccatgttccccccacccccacaaccagatttattccaggcaatagtaaatacacctggtattcaagggaaaatattcacatattcacttttaaagccagttttgaaggagtctccaagacattgaagggaaccagatggtgtgcagaccattctacaaaggtttatgattagtttggctaaagcagctggtctctgcaatgaaagagttgtcatggcagaaaaatccccttttccctcagtgcagctgggcttgtccagggacgacttttcccaggcaagtgttctctctccattgggtgtttgcaaagtctgttgtacttagagaagttaaaccatttctgttgaaccaagttgacaaaaaacacaaataagccaatgttatttatttattttttttagctcaggatggtttaattgccttaaaaaaaaaagttttcacctctgagtgggccttttctgtccagtattagaaataacaactgagactattcaggaaaaaaaaaatggcactcttccaaaagagaaagtgaacttcaacacaattctcagattcaaaaggactgcaaaggaggattatttctgccagctttggtcatttgacagctacaattctccttcttcaatatgtcatcacaaatctctctcaacatattaatgggaatcctgcatttaattctttcatgtttatggagagggaggtggggtggagagggagactgagagagaactttcaccttctatatgtgataatatgtttaaatgtaattaactgttctgcttttgccgttaaaatgttattttgcattcccatcgtattgattttaaattgaaactcaatgcttttgcaaagacagtcttggggttataaaatgataggttttattgcaaagagaggaatatttatctgaacagatacatgagtgtttccataaagaatgggcctattttactttatcagcaactaaggggaaggttaatggctatgatgtatcttttctgttgtgtgtgaaacatgcagtgttcttgctgttgagatttatggtgtggaggacaaagcaggtgctattccaagccttctttcaacagcggagtataaactagggcctgaacttatctgtcaaaaagtaagttaaaataacgttagagaaagcctagaatttcacacttttccataccttcctgtctctagctcaggaatttaggcagggtgattaatgaccactgttatttgtgagctttccaagtccctacagacataatgaacttgacttttcagccacgtagaaggaaacaggctgttagagctctacaacatgacatgttcataattatgagctctctgcaattgggaagaaagaggaagaaaagagaataatcttctcatgtcccatagtctcaacttcaaacatcctctactccctctctttcttctttccccatcttcttcccgcctacacacacactcacacacacagaatgtatctatacttttattaatccagaaacaaagtctgactctacttaatcttgcctcttatttttccttcatatcaagcaagcaaatcatgcttactgatttctttgtcagaatatcgtatggatttgtccttccctctgttctattcaccctgtcgtcttgtgtttatgctagcccaatccctgagttaatttaggctccaggcactgtatgctttttgaggtaatacaacctcttcattttcctgtgtcttttattttaaccccagcagtttattttcttgcttttcaaaatcttttttattctgaccccacctccaaagattgtatatgctccctctttttgttatcgctaatgtaaatatctcttatccttttgaagttcaacattcatttccatcaagatgtactttaaatgcatcttcttgtataatccttttcagaccagcttcacctggtaaggtccattctgataaactgcttacaatgtttttaccccgtaatactaatcatatcttagactacttacttaaataaaatacaacttcttgcgcataggtatttgttctaaggatagttgctttgttatctatatagtcagtattcaatgccttttcaaatataattcaacaaggcctgttttcaacctcaaagaagtgaatgaagagtcactaactttaaagttccagcaatcccacagcattccccggctcctccagagtacctgtggaaattagattccttgtaagccactggtaattttaagagtctgctgctcttaaggaaagagtctgctgcttgctacaagatagcagaaattagtgtgttggttagttctgatcctgaaaaccttgcctttatcaaagacagaacatttcctgaatctcccgatgatatagtaaagtagtggggagaaattaatctccatcctccgccaatgtttttaccggatactgcatggcatccttcctattatggagtgttattttgactagaaaaaggattaggtggcaccatgggagaaaggcatagtctggttgaagcttatacgaattttcatttacatcctttctttttgtcttgcaaattactattctttttctctctcatttccaccctagaagtcccttagatgctctctttattctccattgctctctgatgctcttttattgaattctatgctccttgaatacaggtcttatgtcttgtttacctttgtattattacagttatctctgtgccttccacacaacaggtaatcaataacaatttgcttaatggaattgagtaattttagaagactagtctatattatagactctgataatttccttttattctacaaaaaagattttctatcccaatttttcttaccagtatcataccactcacaatacagcatgctgctattccatcagcccagagaatgtgtatgaacacagctactcaggtattccttatttttttcttttgaactaatcttaaagacactgattatatctctcttatgaagagcaattatacaattttgtggtagttctctttttacaagtttatcttcttagagaagtataactcttttttttttttttccaaaaaggagactatttctcagtatcctggggacatagcatgatgtgtgataaatagttattgctcttttttttttttcagagtgtgatcttcaggtgatcttttcatgctttttccatcctttcttcatattgtctttgacttgtcatagtttctgcctggcacagtgcctcctaaattcatctattactctcacctttctttccacttttctcatgtgagaaatacacatttatcttcatttaccctggaaggttttctccttaacaacagtgtcacacatgacatactatacattgcatgctctacaaaataaaacataacctatgagagaacaaattcataagttttattgtaatcaaaatatttttttgaaaaatcttacatacagtattaatttttcagttttctctgatacaaaagacaccctcacttaatgagaaaaaaagtcttagaatacgagagctggaaagtgtctttgggagattacttggcacataaatatgatgcatagaaggtaggaaattactgcataattacacaagtaatcagtgacacagtgtctagatagcccaagtcttctagtataattataaggccacatatccgtcatggtgactcatgtctttattcacactgaccctgtttttaattgtgtggattttcacagaggaaaaaaaatggtggtctttgtagagctggaatgagtgaatactttctggtagatacattcatttttcacatttaaatataatcttagtggattttagtttttactaaactacttaggaaaataaggttaaataagtatattttttaaagatttgaccttctaaaagttcatttaaaagaaagaaaaaatattttaattgatggaaaatgagcaaatttattcaaagtgacattagttgcaaattcattctgagatcatcagatattaaagcaatgcatttagaaacgttattcttcatattaccaaactgaagcaatttaaatgtctatcaatagtagaatggataagaaattgtggtaaattcacacaatgaagaactttttttttttttttttttaacggagtctggcttcgttgcccaggctggagtgcagtggtgtgatctcagctcactgcaacctcccccgccgagttcaagcaattctcctgcctcagcctcccgagtagctgggattacaggtgcatgccactatgtccggctaatttttttttgtatctttttagtagaaacggggtttcaccatgttggccatgctgctctcgaactcctgaccttgtgatctgcccaccttagcctcccaaagtgttggtattacaggcatgagccaccatgccaggccccaagaactattttatcatgaaaatgatagaacaaaactacatgctataacatggatgaagcttataatcataatcaaaagaagttagacccaaaggaatacttattatataaatctatttttataaagttataaagttcaaatctgtgagattagaaatcaaggtggtaattactgctggaaggagggaaggccagtgttttggatgaggcaggaaaggtgcttctaagtactggtaatatttcttgacctattgatggttacacaggcctgttcatgttgtgataattcagtaagcttgggatttatatacttttctatatgtatgtttttttaaagccaaaattaaaaaaaaaaagactaaaggggaaatttattgaataccattagcttttaaaatgtatttttgtttttacttaagagttttaaaaagtagtcatattttaaatttacatattgttgggaaaattctgccaatggtaggataaaacaatagatttcaattgaaatattgaaagcaacttgtgttggtaaaagatgagaagtgaaggtggaagactgattaaaactaccaaaaatatcatagtgataacacttttatttttctttttttgtgggggtggggatagtaccattataaaaatacaaacataagctgcttttgtacatcaccaaataattcattgaaatttaaggaaatcaaccagttatgtgtgtacacacacacacacacacacacacacgatctcatagagtgaagggttaattggaatactgactgagtgcaatgtacaagaaaatgtacacactgaatacaaacaagggaaaaaaatcaactttgcctaggagaataataaatataattataggaaggaggggggacagggtaggtgttaaaaaggagtttcctgggaaaataaggaagtgaagaaaggcattccaggcataaaatatgcttgctatgtgcaaaacaacagtgggaaatagcatagactcttccatgtacatactgcaagtgggtatgtgatggtggagctacagttggaaaggtaggtaggggtcgtatcatctagcccgatttactagagtttaactttatttactcatgaataggtagatcttgacagattttaatgaggggagggacatcaggtgccaagtacctacaaacatttaaacaagggaagggttttatggttgcagtgattaggacacgtttgaggaatatttagacaattaagttagtggaacttatatttttataggatgtaaatgaaggggcacagggaagccaccgaaggtgatttctgagattctgttttgcataacttggtacatgatatgccacagacataaaggggaaatgctttcaaagagatctgtgtttttctcaaattttacccaatatatttgcataaagctcaatgtagattggaactatggcaatttgattcagttccacagcttaagtaagtgttattttgttcagttaattgaaaatgaaactatacctgacaggaagctgattacttatatgctaatgtgacagtattatagatcataggacttataacacctattaatttggtaaatgggaaaaacaaaactgtatactgtgaaataagaatttacgttatgtatataagaaatagttgatttaggctgggtgtggtggctcacacctgtaatcccagcactttgggcagccaaggcagctggatcacctgaagtcaggagtttgagaccaacccggccaacatggcagaaccccgtctctactaaaactacaaaaattagccagatgtggtggtgtgtacctgtcgtcccagctacttgggaaactgaggcaggagaatcacttgaacccaggaggcagaggttgcagtaagcccaaatcgcaccactacattccagcactatactccagcctaggccacagagtgagactgtctagaaaaaaaaaagatgaagatacagttgatttaataaatggttatgatgaatgcatattatcatacttgcaagtaaaaatgcatatgcttataaaatatttttgaacagatattttaaaatcatagcaggttttagaaatcaaatttatggaaaacgtactagtttcatgtgtatactctaacaaagtagaaagagacaaaaatgtagtttgagatcctctgcaaatgccaaaatttagccagagtaggtaaaggacttgacagatgaaatgcactctgtctcttacactgagtttatacggagaaaagtaattttcgtaggcagtgaacacataaggaaactggtccaagtcttatgaatgtgaacattagtagaaaataagttatctttgagtatttagtagaaacaccaggaatactgcatagagggaagaaataatccaggaggtactactaataaacacatttttaattttagttcacatatttgggagaattcttacaaatttcatcggctatataccaaacctgaagaaaatattcctaatcaaattctgtggtaagccaggcacagtgtctcacacctgtaatcccagtgctttgggaggctgaggtggaaggaccacttgagccccggagtttgaggctgttttgaggcttgattgtgccactgccctccagctgggtgacagagtgagaccctgtctcaaaaattaaaaagtaaaacaaatcctgtggtggccactcctcatgatagtgacaggtacagacagtcttgttaatctgtggaaacactgaagtgagccaaatcatgttgtttaatggttcccatttggcattttgagcttgtttaagggtatagcaaatagagctataaatagtgcattgaactatgaattaatatggtctgtctgaaatcaatggaattttcaagccctttctgttaatatagagaaaaccaacttaaaaattatgactagcatgcagttaagaaacttggcaggccaaacatcttagaactaattaaacaaaagtgatacatttactcacatgatctactaattcattattattggtacgttagatgtttttcaaaaaaatactgttgtaaaaatttccctcaggtttgacaatgataaggagtgttgtgaaactactgtgattaaagcaccaaaggtacaatgggtcattttatatatacagcattccgttaagtgaagttgaatgcataatgactatattagcatagaatatatgagattagaattaggttttttttcctctgatttgaaattattggaaatcaaatagtgacaagaatgagtatattttccttcaaggcccttgaaaaacaagtcttctgtgtcacgttttatcggttcttttaaaaagagtaaacttttagcagcaagaaagatgtttgaacattattcgagtagctgccacttttaaaacctattgactagggaaaaatgaccccaatttttccccattatggtttgtctgtgtttgcgagtaaagacgtgtcttaattaaaatgttttaaatatgtacctaaaattaatatgagaaagtcataataaaaggccagatactctttagcatggttcttaaccatcaaactttcacttctggttctaaaattatacacctagaataaaatgaacatgtaaaaatattcatgtgtcttgacattggccttctgataaatctaatttgctaatataaaatcttgtaaaaagactataatctaccaaatgaatttactacaatatactcttctaaatagatcttacttataaacatatatgtgcaaaaagagagagaaaaggtttaatttatagtcttaaaaccaatatgctggctatcttagtgtatctccccagatctacatccaccttccagaacatgctctatgccatgggagggggatctgtaaagaatgcatcaatgggcttcctgtcctcctgccagctgggtgtggccagtgaggaacaccagaaaattaatgaaagggggagaattgggtggaggggtctttgttcttcttgttacatttttgtaagtgattcttgaggtgaactggagaacagatttaccacaccttcatcccagcactttgggaggctgaggcgggcgatcacctgaggtcaggagttcgagaccagcctggccaacatggtaaaaccctgtctctgctaaacatacaaaaattagccgggcatggtggcaggtgcctgtaatcccagctacttgggaggctgaggcaggagaatcacctgaacctgtaagagagaggttgcagtgagctgagatggcgccattgcactccaacatgggcaacaagagcaaaacgccgtctggaaaaaaaaaaaaaaaatcccacacctcctgtcagaaagccctctttatccatcttgccctcaatctctgggttctggtatccgttccatcctttagctttgtcttgcccacatttgtgtgtgtttatatatatgtgtgtgtgtgtgtgtgtgtgtgtgtgtgtgtgtgtgtgtgtgtgttattaaatattcctcaaatttcccaactcaagtatgctgtttgtttcctggaaacaggaagatatctagaatctacttctaactggctttgaaaatctggcagtgacagctgggggctcaattttgtatactttaaactttaaatttatatcatttatatatttataaaatgcatatattcattcattgttaatagtaataaaatatatagcaagcatttgggaggcagttttaaaagaaggccattaattttgctgctttagaaaatgttttatgtaaggtgtttcaaaatttggaatttgactctgcatgtagcaattggtatgtgttttactaaagaattatactctacctgtaaaagttcttttaggtaaagacctggaaattatattcaacatttgtgaattgtacactctttaatgcagtcaggattacaggcaaattttctagtagagtaaaaatatacatgaattgtaaaagtaataagaaaggaaatttgaattttgctatagttgttagagagaaggagttagatgatttttattcctgttgccagtaatactaagataaaatgattagagtcacatacacgttatatatgaaaacttataggaggtatgaagaccagaattgtttaggagtttataatctgaggacttatatgatgttctttaacattttttatgctgagaaagaatattattaaacaatgagttaagtcagaacataatgtgacagttaaatgtctgttaaaaaatacatttttgaaggcagaacttctggttatggtagaatatagagatcagcaaaccctttccccaaaaaagtaaaaataaagctggataacattgataaaaccatgagttcagttttttggaaattggccagaatcataaagtaatctggagagatttcatggctttgtagtataaattacaattattctaaaatatttaatctgaaggctatcatgagattttaaaatggaggggacatgctaagtaaaaaatgacaacaggtgattaagcaaaagtgaaaaatattaattttagtatatgattccagcaagtatgtttggactgttgaactattatgaatatttacctatcattatcatcttttaaaatgtctactcactagaacatctcactaattatgtatttctttatttctccccaatagttgtgctttgatagtttttgcaaatttatttaatcatactttatttgaatgtattacattcatattttattttttaacgcagacatttgatatattcagaatggtagaaaattaaatgtacttttttagtattattattatttgagacagcttctcactctgttgcccaggcggaagtgctgtggcacaatctcagctcactacaatctctcccttctgggttcaagcgagtctcctgcctcagcctcctgagtagctgagattacaggtgtgcagcaccaggcccggataattttttttttttttttattgagacggagtctcactctatcgcccaggctggagtgcagtggcgtgatctcggctcactgcaagctccgcctcccgggttcacaccattctcctgcctcagcctcccgagtagggtagctgggactacaggcgcccgccaccacgcttggctatttttttgtatttttagtagagatggagtttcaccgtgtgttagccaagatggtctcgatctcctgacctcgtgatctgcccgcctcggcctcccaaagtgttgggattacaggcgtgagccaccgcgcgtggcccgggccagataatttttgtacctttattttttgaatttgttaattagcttgatttaatcattttataacataaacatatatcataatattacattgtacccaacaaatacataaaattatttttcaattaaaagtacagttttttaaaatgtcaatttttctttttcaatgattcttttatttattcactttatttttttcagctcttgttttagattcatgtgtacatgtgcaggttttttacctgggtatattgtatgatgctgcagcttggagtaagaatgatctcatcactcaggtactgagcattgtacccaatagttagtttcaacccttacttcccttcctccctccccccacaatagtccccagtttctattctttccatctttatgctcatgagtacctaatgtttagctcccacttaaaagtgagaacatgctgtttttggctttctgttcctgcattagtttgcttaggataatggcttccagctgcatccatgttgctgcaatggtcatgatttcatactacatagccacaaaaaagaatgaaatcatgtcctctgcagcaacgtagatgtggctggaagccattagccaaagcaaactaatgcaggaacaaaaaagcaaataccgcatgttctcacttgtaagtggttgctaaacattgggtacacatagacaaaaagatgggaacaataaacacgagctccttcttgagggggtagggtggtaggaggatgagagtaaaaaacctgtctattgggtactatgctcactacctaggtgataaaatcatttgtacaccaaatcccagtggcacacaatttactcatgtaacaaacctgcacatgtaccccatgaaccaaaagtaaaagttggaaaaaaaagaaattacctatacataaagtttgaggtcttacatttaaatctctaatccatcttgagttaattttcatatatggtgaaagctaagggtccagtttctttcttttgcatatggttggccagctgtcccaacaccattggttgaatgggggtcctttctcttttatttatgccgactttgttgatgatcagattgctgtaggcatgtgactttatttctgagttttctattctgttccattggtctgtgtgtctctttttgtaccagtaccgtgctgttttgattactgtagccttgtagtatggtttcaaatcaggtaaagtgatgtgtctggctttgttctttttccttagttttgctttggctattcaggctctttttggttccatataaattctggaatagttttttctcattcagtgaaaagtgacattgttcatttgataggaatagcattgaatctatacattgctttgggcagtatggccattttaacaatattgattcttccaatccatgagtatgggatgtttttccatttgtttgtatcatctatgatattttacagcagtgttttgtagttctccttgtaaagatattttacctccttggttagatgtattcttaggtatttttatttatgtgtagctatagtaaatgggattgcattcttgatttggctctcagtttgaatgatattggtgtatagaaatgctacaaatttttgtacattgcttttgtatactgaagctttactgaagtcatttatcagtttcaggggccttttggcagagtcttctaggtagaggaccatatcatcagtgaaagagacagtttgacttcttcttttcctatttgaatgcctttattttgatctcttgccttgttgctctggctagcacttccagtactatgctgaacaggtgtggtaggagtgggcatccttgtcttgttctagttctcaaggcaaatggttccagcttttgacagtttagtatgatgttgactgtaggtttgtcatagatgtctcattattttgaagtatgttcctttgatgcctggtttccggagggtttttatcatgaagggatgttgaatttcatcgaaagctttttccatgtctcttgagatgatcatatggctttggtttttaattctgcttatacattcatatttttaaagtcacaaacatatagagttgcagttattaacatgatctctaatttttgtaaataaaattcaaatatcgattttagtgattgatgtaatctctaaataagatctaatgtgtattcaaaaaataaataaataatttgcaagtatttagtaatgtgtagatggtggaggggagtgtcatattgtaattaagagctgatcccttgggcttaaactgccagatcatgccaaagactggctttgtcacttattagttttgtgactatgggaaacttacttgtctcctcagcttcttcaccttttagattgattcagttttagaacctacttacatagggttgttgtaggtacttctatgatataatacatattaccaacttagaatacaagcagacacatggtaagcactcaaaaattgttagttgttcttatttttatattttccttcattataagctgttacttgtgagagggaagaaaaaaatctacttttatcattgtttagaatagtcaacttatgttccagttcttataaaatgacctcaccatatatcgtatatattgcacagtgaaaagatgcttctgtcttaataaatatacagatagcccatagggaccaactctttgtgcggatataaaatagtacagccacaatagaaaacagtctcttaaggcagttcctggaaaagttaaaaatgaacttaccatataacttagccattcaagacctatgtattgacccaagagaaacgaaagcatatgtctatccagagttgtacatgaatgaacatagcagctttgttcttaatagataaaaactagaagcaacccaaatatttatggaggtgaattgatgttttaaatggtggtttaactatagaatggaatataactcagtaataaaaaggaattaactattgttagcctgcgacagcatgtatgaatctcatgctgagtgaaagaagccaaaccaaaagagaatgcacattgtgtgattccatgtgtatgaaattctagaaactgcaaactaatctgtagtgacaaacaacagatcggtggttgcctaaagacagtgaaggtaaagtttgaagagacagattactaaggagcatgaggaaacttttaggtgtgatggatatattccttattttgattgtagcgatgatttcctgggtgtatacataagctaaaacttataaaattctacctattaaatatgtgtggcatttacatttgtatgtcaattataagtctacaaagctatttttaaaaatacatttctctcataaactaaataaatgcagaaatttaacattttggatgttgtattattgcatgttttaaataatgaattcaattggagttttctcattaaaatctaaagttgagtttaggttcacagtcaaatgatgtcctataatctataaaagttattattgcacagtgataaattggaaaccagagagaccgacattatataatatttcagttgagtgtgatgtgtctgttatgtacagattttggcaccacagtgcatggaaatatatacaaagagtcttcaaaaagttcatggaaaatgcatattatggaaaagcagttcagagaaatcaaattttgttgaaccaaaataaactcatactaacatttaaaaacacgtctagatagcatctagtttgaggtactaagatggataagtcatcagtttaaaaagaggccctggcggggtgaggtggctcacgcctgtaatcccagcactttgggaggctgaggcgggtagatcgcctgaggtcaggagttcaagaccagcctggccaacatagtgaaaccctgactctactaaaaatacaaaaaattagctgggcatggtggcggccatctgtaatcccagttactagagaggctgaggcaggagaatcacttgaacccaggaggcagaggttgcagtgagccgagatcatgccattgaactccagcctgggcaacaagagcgaagctgtgtctcaaaaaaaaatcagatttatggtgatgcttgagaggaagaatggtgaaattattgatgttttgcacaacatttatggggacaataccccaaagaaatcaacagtttacaaatggaaaactcattttgagaagggatgagacaatggagaagatgatgctcgctgcagcagactgtccacacagagcagaaaattaatcttttttatgccctgattcaagaggactgaccattcacagcagaaacaatagtgaacaccatagacatctcaattgcttcagcttacacaattctgactgaaaaattaaggttgagcaaactttccacttgataggtgccaaaaccattgaacccagattagtggagacaagagaagagctttcaatggaaaatttaaacaagtgggaccaagatcttaaagcatttcattaaagaattgtaacaggaaatgacatacaactttaacagtatgatcctgcagacttagcacaatcaaagcaaaggctaccaagagctgaaactggtcctgtcaaagcaaaagcatatgaaacaaacatgtgagaaaagttcaacatcactgatcattagagaaatgcaaatcaaaaccacaatgagataccatctcacaccagtcaggatggctattattaaaaagttaaaaaaaaaaaaaacaatagatgctagcaaggttatggaaaaaaaggaatgcttttacactgttggtgaaagtgtaaattagttcaaccactatggaagacagtgttgagaatcctcaaagacctagaggaagaaatgccatttaaccaagcaattgcattactgggtatatatccaaaagaatataaatcatcctgttataaagacacatgcctgtgtatattcattgcagcgctattcaccatagcaaagacatggaatcaatataaatgcccatcagtgatagactggataaagaaaatatggtacatatacaccatggaatactatgcagccatgaaaaggaatgagatcatgtcctttgctgggacatagagttggaaaccattatcctcagcaaactaatgcaggagcagaaaaccaaacaccacacgttcttacttgtaagtgggagctgaatgatgagaacacatggacacatggtggggaacgacacacactagggcctgttggaggtggatggtgggggagggagagcatcaagaagaatagctaatggatactgggcttaatacctaggtgatgggatgatctgtgcagcaaaccaccatggcacacagtttacctatgtaacaaacctgcacatcctgcacatgtacccctgaacttaaaagttgaaggaaaaaaaaaagcaaaagcagattagtcgagagaaaaggtcatagcaacaatttttgggtatgctcaaggcattttgcttgttaactttctggagggccaaagaacaataacagctgcttattatgagagtgtttaaagaaatttagctaaagctttaacagaaaaacatccagaaaacctgcaccagagaggccttttccaccacaacaatgctcctgctcattcctcacatcaaacaagggtaattttgtagatgtagaagttttgatggaaaatcattaggtatgcgccttacagtcctgcttcggcctcttcttactttttttgttttctaatcttaaaaagtctttaaagagtattcattggcctggttaaattccgagcatcttcagttttttaggagtaaactaaatggtatcattgtttacaaaaatgtcttaaacctattttgaaaaataaaatttatatttttaaatttttatcttttatttctatttttctaactttttgaagtcccctagggtgtgtgtgtgcacacatgtatatttgtgtatatatactcttaacccccacatgtacatccatgctgcatcctattgggggaggcagtttgtgaaagcattatccaagaatggtttagttgcccttgattttatatatagtgatccagtcataaaactgtagtttatgtgtataattacaggaagacaattcatttgaagagaggcatatgcacacagttatttcaagaagccattttttatttatgaattttcaggtcaaattttttaataacctaagcaacctttggtaggatgttttaacagaattctaaatattctatattgtagtcccccaaacagtgaaattttcaggaatgtaatactttgtcattatgttagctcatctatgtaaaataggctacatttattccaaaacgagaatactttgaaacttctaatgcttagatatttaaatgtggtgattatgctctcatgaatatttaaatctttggagtcagacatagttgctgctagtgccaatcaaatctaggatgaccaaagaaacactgctttcatgaataagtaatctttctccccatgagttttctgaatagtctaagaactcatgtgggaatagggagagcactgttagaatgacattttatctaaaaaagggagcaaccacgggagcagatgtagtatattataatctgcttgacctgttcacaatgatttgtgagttctgaactctaaaggaaatgctttgtttgattctaaactatagctaacaatgttggatcagtgtatgaataactgaagtatttattattctcaggaagtacatattggtcatccaatatgaattctaaaataatttaatgattgctattattttaactctataatggtaataataataatcttcctacatttcaaaggtcagctttacattaaaactttcgctctgaaatttcatattggccatattactctgtttaaaaacattttctaaatatcacagtgaattatatagaattctgtttaaaatttgaattatacagatactatattgatggtagatgccatgagtaagttgaaatatatattattagaagaatatgtcacaacagaataattaaaagtgagtactaagaaataccttatattagacttaagcctccctggataccaaaaaccttagtgtctatttggggaattcctgagatttcaacatagagcattagccagtgtatttgcaaggccactcaaattcactctcatagaaaggacaagaaatattttattcagaaagaagttcatctcggtaactcaagccaagtgaatcaaaagtctaatgttctttgggggcaaaatttctctattgtactcagaaaaaaaaagtcaaggtagtaattgttactgtctaaagaaagtcattgaaataacaggacattctgaagtttgtacttttacaattccttaactttatacatgcttaattaaaagttaataaatatttaccaaacaccttgtttgtgtgctggggaaagaggtatacatatatgtgtacaacagttcttcatttctcaagcattttttagtgggtagagaaagtggtcattagacatatacagaactgataataatacacagtagattgtgataagtgctaatatcatttaatattcattagtttaataaatacagctcagttctgttgctaggaagatcaaaatggctaatgcatggtctctggtctcaaactcacagagtagtgtgggaggtaagcagatacaatacagaatgataaagcctgcactagaaggttcacatgaaacatagaggcagacgcatctcattctctttgtgaaaaggtggcaagtcctgaagaacttctagtggctttggctaatatatagcttatagttacaaagtaagcagtatgacacagggaataatttaatatgtgaggcattattacatagttcctctttcaaggaaacatagctgtttagtccaatgggatcatatgggcaaaaatatcataaattaatatatataatcttcttaaaattccatatgttactctagaacagcctttgtaagccctttacagtaattaagaattttaaaccttattgtaaatatagtagatttgaactctaggcagcataagaagttttatatgtatattcatacagaaaaggaacaaaatgtacattgtgaatgattggttctttcggcataccaatgtgtcacttactgtggatattttcatgccagatattcagaaaagtttgtgtgtgtgtaggtttctatagtatcagtatagtaattctgtaatatagttcaaattataagtatatttttatataatttactgtgatatttaaacttttttaatatttaggatatacaagttcagatttcttacatgcatatattgtgcagtggtgaagtccacgcagagtaaaacatatatacacatggacataaacagatatatatgtatttacaataggtccacaagttatattttcctagagtaatatgttcattttacaggaaccaataataaataggaaaacaagcaaaagtactacattatacttttctttaaaaattgagattgtagattacatttaatagtaaaccaataactcactttttcctttattctgaacattggtatcagaaaagtatgacttctgtaacactgactagattatatgattcgacgtgaatctgttagaagcaaagagaatgatgaaaaagctataatatttagttacacatggtcattttaagaagagaaaaagcatggaaggaacattctgattgactggtgaaccactaccacgtattacgtgttgcctcaatgaattaaccgagagtggatttgtgtgctcacaatctgcttctgtagaataagaatgaacgtggagtctttacctgcttatagtaagcgtttatctctcaaaaacctttaatcatctgaatatcactaatgcaaaaacaggacccaggtaaatcggagaaaatagttcattctttgagcctttaggaaccagaaatttctgtagcaacaagagactttcttttataaggttttaatacctctgatttatttttcattgcaacagaggtttacaaagccacgcttggaggctttgtcaggattttgtagagtgtcagcatagtcatggtggatgttgcagttgcactgaaggtaccttaactttatgcaggaaaagaaacttaagtgtaactaaaaagctaaattttaaagtgaatcttaatctatgtggtaaggacaaccaccactacattcatagaatggacagaattgatgtttgaagaaatttagtactcacagaaatttggagtttttctgacataatatttgtaagatctgtacctatcatcatggcaaggatagcgagtatgtagctcattttaaaaatagttgatatacatttaaaatattttagattcccctttcttctaaatatattgctgttgattgttcaggttagtaatttgccttgactgtcactgtttttcagtttctctattaaaaattgtctgaatctatgtggatatatcatttattattgattgttccataataaaagaatctcgatttgtaggatcatggaaataactgaatttgaagcatttataatttacctggttctccatatccaattcatgattatcacctttgtattgatattttctgatgaaaacaaattcactgtgtgccaatttctacatttccactctcattgttttactcttttgctctagcaattgatctatgtcttttgtttcattgcctcacagactaaaccagtctctagtattaactccagtaatatttaaggtccttcaattaatcattccttaatgggtttacatattaattaatctgttgatgtattcatgcatgcatttgcaaatataatttgaagccctaccattttctaggaattctgcgagaacctagggaatagataggactacattgattttgtcatcatgggattctggaaacattcaggaggagcatctcatctctagcctagggtgtcagaaagaacttgagtaatcaaggattgggtcttaaaggacaagtgaacatgtgcaggtgagaacattctaaaatgaagggacttgaacaaaagcaaagccatgttaaacagcttgtacttcatctgtaggtagatcagtaaccactcaggggttttaatcagggaaatgatcttctcagatttggcttcatatgaatctctctatttgccttatgtcacagcatatattaggagatcatcagagtagtccagacaagcaggaatgaagataagcatttggaatctagaaatgattacattaaaacaggcctagacacaaaccaccacattttttgccagaaaggcatagaaacaaattgtattagtgcttgccaggttctgggaggagttggagatggagaatgactgctaatgggtataagatttctgtatagtctgttctcatgctgctatatggacatacccgagattgggtaatttctaaaggaaagcagtataactgacctcaggaaacttacaatcatggcagaagggacagcaaacacgtctttcctcacaagacagtaagagagagaagattgagtgcccagtgaaggggcaagctcctcataaaaccatcagatctcgtgacacctaactcactatcacaagaacaggatgagggaaaccacatccatgattcaattatctccaacggatccctcccatgacccgtggggattatggggactacaattcaagatgagatttgggtggggacatagccaatccacatcaatttctttttggaatgatgaaaatgttctggaattagatagtggtgagggttgcacaacattttgaatatattccaaattaataaatggttcacattttgaatatattcaaaattaataaatggttcactttcaaagggcaaattttatggtgtgtgagttatatctcaagaaaactgttattaaaaaaagaacactgcatttagtgatgaacgaacaatagagcgagatggaggtacctaagaaaactcccaaggttcttgctttggtgactgggtagatgactgtgttatcaacaagatggagatcaccaaaaaaggagacattgtggggtgacaatggggataaaattgaggtagttggtgttgatttatttttaattgtgtttaaggtctgtataacatccaattgtacttgaactggtgtttggtctacgccatagatacaaatctggtaaatcttatcccagaaagtgaatggctccccaaatttttctgcctttacatattccagaagtacaacataatcttattaatagcatctccctttgcatgccagtgattctcattcaaggagtggagcatgtcagaatctgccatgtacaagactgtagttcaaaaaggccagcttatcagagatgctgacatattccatagggaatttttgtcaaatctttctatatcctccattggaaattattgatatacatgatggctaaatccatgagttcaggtgtcatcacctacagctttatgtcaagtgaggagaacgttgaagggctcaaagaagtaaaagcagtatttgaaagctcacataaagaacgaacgaatgaataacaactgcaggaaagattcttggcagataatagtttcaaaattagtatttattgagcaaatgcattaataagtgaatgagtgtgttttccagaaaccgaagaatttcaagaataataaactattttaaaatcaagatatgaatctaataagacaaaaacaggtatgtccattgtacagttatgctctgcatgatgttttggtaaatgacagaccaaatttaccctggtggtcccataagattctaatactgtatttttaccatattttttctatgtttagctatgtttacatatacaaatacttaccattgtgttacagttgcctacagtattcagtacagtgatatgctgtacaagtttgtggcttaagagcaataggctatctcacagagcctaggtatgtagtaggctatgccctgtcgcattgtgtaagtattctctgtgatattcacatgacgatgaaatcacctaacgatgcttttctcagagcatatcctcatcgttcagtgatgcattactgtatttggtgaccatagtaggttgactatagtagtacagggatgactaggaaagtaggaggaggagatgagaaggcgatgggtatgaactatgctcttaagaaatgtggataaaggagagggactgagaacataggagggctctagaggaaagaagatagatttaatgctacttttcgcatataaagtcattcttctcctaaataaaagtttctatgattttgttcaggaatcatatttaaccagttttcaattttcctatgaaaccagaattaaactgcacctaatttctgatcattttctttcttaatttgtgtaatttagaaataggtatgacgggccaggtgcggtggctcacgcctgtaatcccagcactttgggaggccgaggcaggcggatcacgaggtcaggagatcgagaccatcctggccaacatggtgaaaccctatctctactgaaaatgcaaaaattagctgggcgtggtggcacacacctgtagtcccaggctgaggcaggagaatcacttgaacccgggaggtggagtttgcaataagccgagatggcgccactgcactccagcctggcaacagagcaagactccgtctcaaggaaaaaaaaaaaaaaaaaaaaaaaaagaacaaagaaataggtatgacatcatcccttcaaaatgtcatctttctccacattccatcttacccatttataggaggttaaattcatgtgtcattttttagtagaatttactgataaaagctggccctttagtggtatcaggtctgtgactgatatgtcacaagttgatgatgactttcccattgttaataattctacagctgtctatcttattcatcctggtccttattcttggtacagctcttctttaaatcacagaagtaaaagttccatatgtatttattataaaagatatgcatatggatactttaaaacgttttattgttccctgtttaagcacagtaatttctactagaatttttgtcatagaaagataaatcttctccctttgctactttctgctttcatcttctttgattcttccttggatcctgcccttttctccgttattttaaatttttaatctgctatttattcactgtcttcgtctatgcctaaaagcagggacttttaggactgttgcaaaacagcagtaaatcttatttaagtgtttcatgtatgttttcagcttcccttttcttcctttcaggatgaagaattccagaattatgtctgcaactgttattttcttgacatacactcactctttaactcattgccttcaacgctcactacactgtgcttttgaaatgcagtcatctccttattattatctattaatattttatacatcttcattctctttaaactcccagcaaaagtagagaaaaggttaattacccctttctgcactttttggattccctttttggacttttcagctcccgattttttctccgtattccatttgcaccttcaccagctccttcagcaagtcctcttcattctccctctcttccaatgtctatgtgtctgaagctacagctttttccttctgcacctttcttccagttgaatttcgccccaaccctcatgagagtcctctattctcaaggcacctgtcaccacctcggtgtgaccaatttttccatgtatatccttttcttctctggtaggccttacctactctctcccacttttgcctggatacatttacttatcattcctatggtaaatttaactttgatatgccaaaaactatatttgatagaaaagtatatttcttgcttgaaagagagattgcttccattcaagtcataatgtgtaccataaaaatatcaaatatggaaatcaggtgatcagaatatagaaacaatgaaaagtagatattgagaaaataacttttaagttccaaatattacctaaatagtcttgaaatgcaaatgtgtcataatgataagttttactttatttgtttttggttatcagagtcttaaataatgggtgattagcttagaagtcccattctgaaattcattaaaaaataaaatatttctctgaaaaggacttatgcctaaagctgccgtcattctttctcatctggcaccccaagcttcatttgattccctgtttccttattgagcataatttaatgcaacaatcttgcttaaataagtattacaagatccaatagattaactttaactctttatcaccaatctataggcttcatagaaatattaaacaactattgattttaatgtataacattgtcataattcttgttatttagaaacaagatccaatctccagtaaaccactcactgcagcccacacttgttagcataatcaatttatcacacttgttttataaagttgtaagagaaccccacagaagggtgttactaaaaattacagctgatgtaagcttttcacttcatgccaaaaggagggcagttgacgctaccatgaaataaactctactgcagcctctttaatcatttgtcaagatgtattatgtccttgtcaatatcaagggaggtaaacactgtcattaatctgcaagtgaggaaataagtaaccacgtcaatgttcaagtgcctggctgttaatgcaaattcatctttattccatctttctccctctttcattttatgatgttgttcctttttcataaaatgtgcagttacattgtaatgtttagaaaatatacataatgcattattaggatgttggccattgtgaaatttgctgggtgtgcttagcaagacaggcactgacaatgcagtagttaagctgagccagcatagattagtctaaagagaacataccagctataaatttaacaaactgttcattttctaaagtgattgctttatgcatctgcaaatagggaataacagaacattcaactctattttttccctaggcaaataaaaaacttagatcttgaaaagctttctttagaaactttaaatagttattttaattttagatgctgtcactgatgtgttatgcaaaagagggatgttacttacagtggatatgaaatggaattgcagttttagcatctattatttgacttgaattgccacttatgtcttgataccttcctatggggaatctatggcttatctgtatcgattagataaatatttaaagtaaagctgaatatagcagtgttttatatccaccagattacgctacaaaatctagtggcattagattttttctttataggatttttaattgaaaccaacacattggcaatataccttgtttatctagcatagttaccctcaatgaattagcaaatcagaagcttaactgagaaaatagtgaaactctaggagatataaaggctgaataaccaaataacaaatcactacttattgagtttatgcctgtgtaagatagtgtactgtcatttcatgtaatttatcaaagagcactatgaagtatttattatcatgcagacaaattaaatgactttctcaaaccacacagataagaagtcatagatcttagatttgaacccgtgtgactagatgaaaaatctcagctattgtgcaatgggtcacactacttctcagagcaattttacctaggaaaatcttcttatattttactttgaaagatgtccggtgtgtttacttaagttatttaagtaccctaattagggataagatatccaccttcctaaagtcccatatttatttttttagaggaccaacaggtaattcttttataaggaatgtgatagattgaatcacgtagtgattaacaacacagattttagccaccaattgcattttttcaaattatgactctgacatttccagtgtgtgatgttaggcaagttacttaaccactctgtgcctcagtttaattacctataaaataggcaaaattacattgggttattgtgaaaattaaatgtaatgataaatttaaagtaattgaaaaaaggtctgcaataaggtaactgcttacttagcagctatatcttatcatttaaagaagcaatgtctttggctcacatatttgttaacatgaatgggaataaatatccgatttagttccttaatgtctttaatgtcagtatctattatccagtcttgtccatccaaagctttctggctcactcttgctcagtctgtcatttttctacagcattatcatgatataattcatatagctacaattcacttatttaaaatgtataattcaaaggttctaatatatttacagggttgtgcaaccatcaccacaatctaaatttagaacctttttgttccatttaaaagaaacaccatacttgttagtagtcactcctcatttctctcctccctctctgcccagccctaggcaaccactaatccagtttctgtttctataggtttgcctatactggatatttcatataaatgaaattatgcaacatgtggtttttgtggctggcttctttcacttaaagtaacagtttcaaattttatgcctgtgatagcatgtttcagcacgtgtttattatccttgccaaaaaatattgcattgcatgtatataatattttatttagtcttcagttaacattcatttaggtggtttccattttgtggccattgtgaataatgctgaatgaacgttaatgtccaagtgtggacgtatgttatcatttttcttgggcgtgtaactaggagtgaaattgttgagtcaatagccttgattatgttttacttggaggaccacatagcctcctagttgggcttccagtttctggcctagcttagcctgtgaatgtttgtacactgctgccagggagatctttgtagatcttaaatatgattgtgttcatctcatgttcatggcctttagtggttcttctgttgttttgggaataaattatagataccttaacttgacatgcattatttaatcattaaatacttattgggttcctactatattctaggcactcttctagatacttgagtatccttgaaatccttgaaatcatgtcacattggaataaattattactaaaatcagaatcaaatttttgtagaatctttgatttaaaaatacactccttctttagcctatttttcactacaccacggtgcctaggattaaagataaatatggtaagataattacgttgctttccatgttgcattattggcaggttattctaaattatggaataatagcgatgtgttgtgtttgcctgtctctttacagagatgcttattttatgtgaatttccaacatccctgagagaggatcatggcaaattactcacttccatcttacacctagaaatgttgagactaaatacgtaaataaagtacagtgtttgctctactaaaggtgataaatatctgttgaagttaagtccaaccatactaggaagtccctggaaaatttatgaactaatttttagtttttgcctttactaagggaaagaaaagcaagaagtgggcaaatgaaagctgagatgactgcaatctcatcaggacctagtatcctggatgcttttacatcctctctcgtgtttttatttgaaaccaactctataatgttgttgataactgtattactttaaataaattaaatgctaggtagtgtgactactgatttgatttgatttgattatcagaaaccatgataacttctgttctgtaacaaattctaaaagccattaatccaaagcaagatttgttttcaaagctcatccaaatttgcagtagtgcaattttaatataaatgtagttattcacacaccagggccagttgggtggtggggggtgaggggaggaagagcattaggacaaatagctgatgcatgcacggcttaaaacctagatgatgggttgataggtgcagcaaaccaccatggcacacaacctgtgtaacaaatctacacattctgcacttgtattctggaacttaaagtaaaagaaaagaaaattaaaatagaaagtgtagttattatagcataaatatttcatcaaatatcctgtattttcagagaaatttgatcatatatgaatattttatttatcacctattcttatttttaggtgagataatggcacaatggttatgttttcaaaatgcatccttaatttttagaaataataactgaaatagtttatggaagatacacataaggatttgtatcaaaataatgtagggagggataaataggagtagagatgaaacaagattggccatagttttagtttttgtaatagactttatcttttagagcagttttaggttcttagcttaattgaatggaaggaacagagatttcctatatattctccaccccatctatacacagcctccccctacaatttacatcctctaccagagtggtacagttgttgaaattgatgaacctacatcaatacatcattatcattcagagtccatagtttacattagagtcactcttagtgttgtacattctgtgggtttggacaaatgtgtaatgagctgtatctaccattatggtatcatacagaatagtttcactctcccaaaaatcctctgtgctctacctatccatccttccttcccactaattcctggcaaccacaaacctttttactatgtccataaatgttccctttctagaatgtcacatatttagaatcatacagtatgtagacttttcaaataattagcttttttcacttagtatcatacatttatgttttttccacgtcttttcttggcttgatagctcatttgtttttgacatgaataatattccactttctggttgtaccacagtttattcattcgtctatggaaggacatcttggttgcatccaagtttttgcaattatgaataaagatacaatcaacatccatgtgaggtttttatgaagacctaaattttcagctccttcgggtaaaaaccaaggagcacagttgttggattgcatggtaagagtatatatatttttgtgaaaaactgccaaactgtcttccaaagtggctattccattttgtattcccaccagcaattaattagagttcctgttgctttacaagcttaccagtatatggtgttgtcagtggtttggattttggccattctaatagttgtgtagtgctatctccttgttgttttaatttgcacttctctgatgacatgtaatgtgaagcaactttccagaaacttatttaccatctatatatcttctttggtaacatgtctgttaaggtctttactgcgtttttaaattggattatttgtttttccattgttgagttttaagatttctttttgtgtgtgtgtgtgtgtgtgtgtgtgtatattatatatatataaatgtacttttaattgaaaaaattgtatgtgtttatcatgtacaatatgatgttttcaaatatgtatccatagtggaatggctcagtcaagctaattaacatgtgaattacctgacataccattttttgcaatgaaaacacttaaagtctattcttgtagcaatttttaagaatacaatacattgttactaactgtaatccctattttaaacaatagatcgcttggacttattccccctttctaacttaaattttgtgtcctttgactcccctcctcctgccagccctggtaggcaccattttacgccctactgttttttttgtttgttttttttttttttttttgagacggagtcttgctcactaggctggagtgcagtggcacagtcttgactcacagcaatctctgcctcccaggttcaagtgattctcctgcttcagcctcccaagtagctgggactacaggcacacgccaccatgcccagctaatttttgtatttttagtagagacggggtttcaccatgttggccaggatggtctcgatctcttgacctcgtgatccacccgcctcagcctcccaaagtgctaggattacagatgtgagccaccgtgccaggcctttgtgccctacttctatgaattcagtgtttttagattttacatatgagtgagatcgttggcatatttgtatttctgtcgctgatttttttcacttaacacaataacacaatatcctccagttttatacctggggtctattctagttctgggaattttctgagcctagagctgctggggtcagcctggcagtaaggtctgttcaaacaactagtccaaaaggtaagcctggatcttagaggtgcaagatctcatctggcactggggtgtgccgggaggtgcagtccatgagtactggcctagtctaggatagtgggtgtattcatccattctcatactgatataaagaactgcccaaggccgagtaatttataaaggaaaggggtttgattgactcacagttccacattgctgggaaggccttgggaaacttacgatcatggtggaaggcaaaggggcagcaaggcaccttcttcacaaggtggcaagaaggagaagtgccagcaggggaaatgctagatgcttatgaaaccatcacatttcatgagaactcacttactactgcaagaacagcatgggagaaaccacccccatgatccagtcacttcccaccagccctcccacgacatgtggggatggaagctataattcaagatgagatttgggtggggacacagccaaaccatatcagtggggtcatgtttatcactgggttttactggggtaggccaagtgttgtggtctaaggcaaaatccagtgctcacttccttaattttcctccaagtagaaggtatctctcttcacagtgctgcctgggattgggggagggctcacacaggtaatgtaaaactgcccttcctactcttttccatacatcttttctcatttttatgctacacccaggtgctataatctctcaactgatttctttagctcttgtgaaggtgattttgcttgtggatagttgtgaaaattgatgtttctgcagagagatgagtgctggaaagtcctattctatggtcttgctgatgtccatctttgtgtattttgcatgacagtcttttatcagatatgtcttttgcaaatattttctcccatttttcactggtcttttcattctcttgacattatcttttgcagaacaaaaaggtttgattataaagtccatcttatcaattctttctttgataaatattgcctctagtgttttatttacaaagtcatcacctaacctaaggtcacctagattttatcttgttatcttctagtagtcttttaattttgtgtcttacatatcaatctatgacccattttgagttcattttcatgaatggtataaagtctttatcgagattctttttttttttttttggcttgtggatgtccaattgttccaacaccattggttgaaaaggctatctttttttcattgtattgcctttgcccctttgtcaaagatctgtcaactatatttatatgggatctatttctggaatatttatttcagtccattgatctatttgtctattttttttcactagtgccacactgtcttgattatcatagctttagaatatatctcagaattgaataaagtcagtcctctgaatttgttctttttcattactaagttggctattttgagtcctttgcctctccgtataaactttagaatcagtttcctgatattcacaaaataacttgctgggattttgattggaatttcattgaatccattgatcaagggggaaagaatggacactttaacaatattgagttttcatgtaatgaacacagtatgtatttctatttatttggttcttcttttgtaggttattttctgaacctgactaatgggtacataggtatttgttttactcctttacctgtgtattttttacctttttatgttttgcctgtatatgttttaccttttacaagataaaaggctaaaatattttatatttttgcctttgtgatactagttttttggcaaggatggggtaaaaagtaaaataggacattgacatttcgaattttgaatttcaaatctcctatcagggaaattgaataaatatgttgaacatggtagtttggcaataaagggctttggcaaagagggcagattcggtgtaatgatagttctattgagatctagaaatactcctatttgaagagtgaaaaagtgctaccaggtgttcagaagaaaagaaatgttaatgagaaggccaaagataaggtgaatcttatatcaaagtactaaagagaatgaaagtgggattcagttccttctgggtgataagactgtcttaaattatttctcaattatgacatcatatttcccccccatttcttcatcttgcataactttgtgtttaaatgagagtttttaaaatgtgtttaaagctagtaatgtatttgactttgattttgcaaggataacacttcccaatatcctttttgagctcatagaatttgttcatgttcttttaaatctcctgattattagtggtttacttttgatgaaggtgatagcatattcttcatgaaataactatcaagcttagtgttaagataatttaggaaactaaagcagaattataacttcttgatttttatgatagtgtcccttggatgtgtaaattaaattacttattttcatttctaatttttgctaaccatttcagaaaagtggttcagcacaatcgttgccaattctacttcaaatcaagaaatctttaagcatccttaaaagctaccataacaggcctatggcactgtgtgtctttaggagattgatttcttttgtgggtattctgtttacttaatgacataaagaatgagtgagggagaaggcaaaatattctcccaggaagatggagaagagtggtcattgtggattagttaggcttttagtaaaaacaacattgtaatgaccttgtgatttttatgaaaccacttataacttggtcttaatttacaaataagttcctttaagtttgcatcaaaagtacagagctctttcttgttattcttaacaaggtttgatacacagcatttcctcatggataatttgtgggtttaaaaaattgaaatgctattattggtaactatcttggtcattgttgcaagatgatttctatagtgggagcatcctttcatacaatcatacggatccttttacggtttttctggttataatatcagtaaaaagtaccacttggccacaagtgacttttgtttatacgttgaatgaaggaagaaattatttctaggtgtgcaacatggagaatatttaaagttctcggaatgtaagtttcttcatatgtcaaagaaggtgataatacctaattttaaatgatgttgaaaaggttgacatataacttatggaagtactacctacgtacccacctacctacttacctacctacttatctatctgtttttatgtctatctgtcatgcttagcatagtaactggcagattgtaggcagttaggaaatgttagttgtcttctcactcatcatatcatgtacttttaaagggatggttttcacatctgtgcaggttgtctactgtaccactttagagggcaatgttcatgtagcaaatattatgaatggcaccactggaattctgtagtatgcaacttgaaaaactaaacatagtgtctgtatatttttaaccctctatgttggtgattctccaaaagggagcaattaaactcttgcatcagaatcacctggagatgatttctaaaaatgcagcttcttctgttcatttccagatctacctaagcagaatccgttgagatggaacatacagatctgtattttttaaagctgctgaagtcattattttgctaacagctatcttataatatgattcatatatcatacaattcacctattttgcccaggtcattcttaagcatgctgaaccattgctctcttgattgtctttgtgagaaaaaaaaaaggtgtcccctggtcttttctttctctgcgattcttcatggatcaataacaaattcttgcacatattgtattgtacatatttcttctataactttcatcacattccttcattcttagtgcttaatctccattttttcttctagcttgcatgcatgcatgagcgtgcgctcacgtgggcatgcacacacacacacacacacacacacacatacagagacacaaaggcttagagtcaaattgaactgagtttgaattgcgggtctgccacttactgtttatggaaccatgggcaagttaccctttcttgattaactgaaaaatgaagcccctaataccaattttataaggttgtatgagaataaaatggaataaaatgtgagatgcttattatactgtgtgacaaataaggctaataatatgttttcattaggtcgtatgagaataaaatgtaagttgcttagtatattatgtgggacatataaaaatatgttagctataattaaatgagagctataattaaattgaagacagtaatatgtactcccttatattccttgaagttcctaattttaataaatttatcaatttattgattacttactaaatacaagatactgtgcctgatgcagtatggaatataaatataaatattatatgagctctgccctgaaggactttgccgtttatagtacacagataaccaaatacaataaatatttcatgatggaataatagaacaaatgctagagtggattttcacaaaaaaatattgtcagaacacagaagagaaaaaaattttatttgagacaagcactgaatcagatttcacaaagagggtagaatttggtctgggactttaagggtggttgaaacatgtctatggagaaagggaaatggggtttggctgagatatggatacacggtggagagtttgggagggtataggcgagatgggagagtcttgatcttagaggataacacacgacaactcaaagtctttgaatgacattctttaagctattagaaaccactcaagacttttaagtaaggcagtgacatccgctgttccatatctaggaaaagttgttttagtggtatgtggaatagtttcaaggagtcagggataggaaatgaaaacaccatttatagggttcttcggaatattagcaggattgtaaaacagaggttaggcaaagaaggtgcaaaaccatctttcaaaattctggacatgtaagatattttaaagctcccaaaagtgaagttttgtgcaaaagttaggtgttgagctagggcagtaccaatgagaatgaaaagaaaagggaaaagcaagaaatgggacacacacacacacacacacacacaaacatttgagagataattggatgaaataatggccatgccacataaaaagaaattatagtacctgccataataacataaatttattccaaataaatcaaatgagtctaacttggaaaccacatcagtcatttatattattgtctaaaaccttttttgacaaaagtgaacacacatgtcaaaaatgttgatacttctcacttcagaacttagtccattttcacatttattcaagtctttatgtcgcaagtattttatttgtatgtagatttttagatatttatgattattttattttctaatgctgatataagtgaaatttattggtttgtcttaatattctgattttgtaaccgagttctctatttagttctaagtgtttttcagttcatatttgatatttttcagacaatcatctttacatgactgctttaccttttatttttcttgtgttataatattagccaggacttctaaagcaatattaactaatatttgtaaaaatctggctacttgtttttaacttaagctttcgaccactgagcaggctgttttaaataatcttcatttgataaagaatggattcctctactcttagttggttctgaatcatcaagatagacactgaattttatcaagtgctttcaatagacttttaatatttttaacatgaaatgtgcctttttcatgtcgttttctggagtaacatttatactagttttacaaaataagttaggaattcatctttttagtgctttgcagtaattttattggctttagaatctttcatttctggaaactttccaagtgtttattggtaaaattattgaagcctggggcttttcttagaggaacttcttcaccagtgtttttaattcccaatatgtattttaaaaatcctagaataaatccatgcaaagtatttaattcttttttttttttttctttattgagacagagtcttgctctgtctgccagactggagtgcagtggcgggatctcgcctcactgcaagctctgcctcctgggttcacaccattctcctgcttcagccccctgagtagctgggactacaggtgcctgccaccacgcccggctaattttttgtattttgtttgtttgtttttagtagagacagggtttcatcgtgttagctacccacagtagctgggactgctaattttttgtatttgtttgtttgtttgtttgtttttagtaggacggggtttcaccgtgttagccaggtcgatctcctgaccttgtgatctgcccgcctcggcctcccaaagtgctgggattacaggcttgagccactgattatcaatttgcctttccaatgttaaatctccaataatttttaaaggaagtattgttatagtgagagacagacacctatgacacatccatggagcagaataatgaatgcaaaaacagcaatgaatttagatccaaatgtaacatattaaaaagatttcatttcaaataagggcaaaaatagtttatttttcaaatgatgtttgtaattatgataccatttagaaagaaaaaagttaggtacctactatatagcatacacctaagttaactttaggcgggttaaaaatgttaatgtaggaaggcagaaggcggagaattgcttgaacccaggagtcagagctgcaatgagccaggatcgcaccactgcactccagcttgggtgacagagcgagactccttcttaaaaaaaaaatgttaatataaaaataaagttgcaaaagtactagagaaaatgttacatgaacattaatatagcattggagtgaaaaaaatgctttaaagttataaaccataaaggaagaaaggcatactggaaaatgactaatgaatttaactatatcataacatttaaaggttgttcttaaatatttgaactactacccaagaatgcccaaagcccgtggtggaaattctaatttttattgtgatatgtttgtcatatttaaatgataggtttttgttttaacattccaaaatgcagctcccttttctgcctttgactgccttctatagaaattcccccagctgccaggccaaatttctcatccagattcaggtactcttattgactatccaatagggcattgatgctgccaagttcgcattaactctcttattagcttcgagaagacttgagacagaagctatcaacacttcttcattggcatctatgtggctgtgaaagatggtcacattttagtcaaaagacataatcctgtccagttatatttgaagagaatcatagctaaagaacacatgccatcttccactcctgtttttacagtgttcacaaatataaaatagttactaacttcttatactctttccacctgtaacataaagatggaattctgcagaaattgagaaagagggcaaaaacgcggattttctgagataatttaaaacagttaagaatctgcagccaataagaatttaactcacaaaggcagagcaattgaaactgtttccggccatcagtacacaaatagcaagccaagcttcataattctgtgtttaaatgcaagagttatttaaaacaatttggttttagtttattttcttacatctcttaattactgctggaaaatattgtcaaggttgggaagttcttttaatcaaagtctagaatattaaattttagaatctatagaggtagaaacatcacaaccatttatttacttttatctttgaataagcattgggaattatgattcctttagttttcttacctgcaaaaacctgtatgttcttcatctaattcaccaaaagtctattattctcaaaattctattattttgagaaataatagaatcaatacaggtcaatttttaaaatgtgtgcaggactcagaaccattaatgtgctaatgtgcattctgatgttccaaggggcattcataacatccagcctgtcctataaatttgaacctagaaccctttttgcatgcaatatctattgagttctgttgggaatattgtattactcgaaacataattttgaaagtgctactataagagcttttagaatatgtggtgttaaaagctgtacattatgttaaaatagctcttgctattaatacatctaaataatatttgttgaggacattcccttgaaggccctgtgctaaatggctttgtaactaaacttctgttctgcttcagtgttatactgtggattatatctgatgttcatgtatgaacataaatatgaccagttaaagcaatttcttgccagctaaaagaggatgttttatgtctgattatttaattcaaaaagcaattcactagtcttacctccttatttgccattgtacatgtggttaataagtaaaatctgaattcctaacaatgtcttttagattaatatgttttggttattgacacttcatacatttttgatatggtcaaagttagttcctagatagggaggagcaggatttttctcctcttgcttaactggtttctaatttcttgtgagattcctttatgtgagtttcaccatactaaaaatggaattattttaaaaaattataaaatagagtccccttctctattttaacaatcaatgtacctctgaatcaactggttattcccgtgatctgtgaagtagttaccgtgcttttcaaattgtatttcatgtgtgttcaaaatgaaggataatgactcacattataataaatagtatgacatttatgacccacaaggaggaggagtgtacaaatgaactttaagggttttaccttgaagatttgtgagatacaaaggcacagtttttctaaaacaggaatatacctcagctgtcaggaagaactagaaattatagttctgccttattgggatatagcatgagtccagtgacccctgttctcattgttcatctatctccaacacttcttgttaagaagacacaattaggtcagttttcaatgatccaatatggaacacctctgacaaacgaggtttcaaatcaaggtatctcagacagttggcctcctagcgccctgtcatccctttggcttatgcccaaattcagcccagagccaattagtggatcacagcctctagaatggcttcactctgctcacactcaacaagatccagacagagctgctatgcaaaaaaaaaaatgttcacagggtcctttcgcagaggggcaatggtttaggtactttgagacttcatggcgcatcaagtacacacatgttgaagtaatgcaagtgagaaattttgctgacaactgatggaaagtaacatttaaatctagagctctacctttgtgggcagcctgagacaaccctagattaaacattttaatttttctatttactgtttgtaggtttctgtaattcactgagcctgttctaatatgtacaggtagatatttgcacctagaaagcatgcatcttggatatttatcatatataaagaaaaaactatatatacagccatttaaatatgctacaaatagtaatagaacactaataaatatgtacatgaaatgagtatgtgtttatccttaaattagtggtttggttttcaacattgttttattccttgacactgtccccatgacccatcatgttctgatcactaatattctctttgaccaaaccatgcttctggagtgggggccattggtactagtcttcatgtgtggggacaaagggacagagttttaaaatatactgttgagactttttccagattagagttaatttagctaatgtcatcaagaccaatagttgttaggttaaagtggggaatcattaaaaaattgcacacttgaagtaaacattttacttaaaatatacaagtacattcatttattaaccttttcttctagggtcaagaccttttccttaaatattggattccttagtgggcttctaattctttcttaaaaaaaaactctacccatgatgcatcatctacaatttccaatttcagtttctctaaaggagagcaaaagcataacggtaactctaaagcaatatgcatatagaaaacttatttatttttttacttatccccgtctttaagaattgactcatccacacctaatttaacagcagttgttttagtgactcattttaacccattcttttcaaacgttttgtcttacttttaatagatacaacctttttttgcactcacattttgttcttttgttcaatttgtaattgcataattacattacatattaaactagtatacatagattctggaataaacatgccagactactattaagtagacaactcactggtcaaggaagcatacagaatgctgagggaacaaacatggcctttaatccagcaagtctgttataaaaaaaaagctcactctcaaagcctccttctggagttcataataaatgcttcccagggaggcagtcctctgctctgctttcctacttcttttcttctttgaaggtttccactttaaatcaggcaatactgtctgttgaatactgtctttctcctgaatgaattgttttcttcttcctgtaaaaacggaattcaggatagttttagccctttggtgtgccctatttattgagaaggacattttctgttatgcccagaagtttaggagccttgcatggctcgggcaagactgaagaagcagctcacttcagcctgtttctctactttgtcccctttgtgctctagcttttcactagtggaaatcgcccactctatcacaaatgttttcagaggctacaatccaacttaaggaggataagctatgagcaacttgaactataataatacatgaacatcttgaactataatagatttagaggaagtccaagaagtaacaatcctcaaaaaaaaaaaaaaaaaaaaaaatcctgaggcagtctaatggcaactggccaaagaccaaatcaagatattaaagttgcctgatttagcatccctcaggagatatgcttccaccataccctatatgcaaacaacaacaacaaaaatagagccataaatccccatcctaattgtacaacaaaatcatctgtggaatttttaaaatgcagatatctgggtcctctctaacaattatcaaattgagaccttccagatcaggggcctagatttaaaaaaatgaaaaacattatgggttattacaacggtcagttacatttgaaaagtcagtttaataaagacatgaaatatatttgtactgttggaaaagtgagtttctaagtgatattttcctccttacatatggatgttccttttagtctatgatagcttctaccttaaaacacaccttctgatgtgaatctgcatggggaaaaaagtggtcggctcagtgaatgggtgacaggcaagcagcctctcctgggaggttctttgctgtttcctctggacccaaaagagtcctcttgcttaaaccagctgcttctcaaaacattaaactgcacaaggatcatctggggatagagtgttattaaaagtagatgttgtttcagtaggtctgagatggggcttgaaattttgcatttccaatgagctctttgtgctgctccagagaccacattgtgtagccagggtttaagccacattaatccaccagttttcaccagctgcaactaattgagtgtcaaaatttaggtctacattgtctcttttccatttacaacttctaaactttattaaaatccatgaattattactctaaaaaggaaaaaaataaataaaaagaaacccttttcactttaaacaaagagataatgtgtaaggtgtgttcacgctttatggtgtaggttttttgcctgtgaagaccaggaagtgggtcggctcctaatcaagatcagatcaggtgattccataatggaactaaccacctacagtttccccaccaggctcatgtcagtaaatgccagtgacttctttgtttcaggtttatttgctaactgtagatgttgcagatgattggttagtgtgaaagcacaaacatggtgaaaataaagaggacattttacctttcttctaatatattatatttggtgtagcatttctagtttaataggaattgtcctcttttatagtggaatgagttttggactgaattctaaccaagagtgtatgaatccttcttaatgatagctgtgttatcatgtttcctcatagagcataaatattttagcaaatgttgttactgagtttgtcttcaagcagcccagtgaatgtctgcacccttgagtattaaggaaaaactcattcttttcacttataaaaaggcatatgatgtagagaacattggaagcctatctcaaatcttaatctgctttccctgagatcccatgggacgtatctgcaggcaggggggtggaatttactctcaactttattgctgctatctggtactctttgtctgcatgtagccaccaacttttatttatgagtatttgctggacctcatgctaggtccactgatacagcttacagacttgagaaagatatcctgcctctaaggagcttatagtctagtttatctcaatttatacaatttatacaagcaaccgagcagaaaattttacagttaaacgatgatgtgttgttttaaagtactttcaagattcattgtcagtttgtcttcatttgcatttctggtaacaaagacagaaacagtatagactaggcaataagtaagtgacagtgtgctgaaggagaaaatgatgacaaagaagatggagttgagatgatgggaattctaataacccatataccgtgtattagttctttatttcttctacaaacatttactgaacacctacttaggttcagccaaaaagatgacagttttatgataacagtatgtttccagtacagtataattgttgtcacaatgagctgttcactaaagcacggacattctgtcatctcatctgtaaaaagtagataataatatcctccttatcgaaaatcaatgagctggaacaagtgatttctagttttccttctatgcagtaatagctaagagggggagaaaggaaatgagaacaaatatgagcccgagtttacaatgtcttcctgggacagtatcagaaatgaaacctaatttgtagtgtctctgataaaacatgagcttcatcttctccttcttcccccaaaagatatcaattttcattttaccagtttacccctactagctggagctcagaacataggcccacatgcctatttctgccatgagcagaacaactatatttagatattccagattgttcttattccatagaggcccaatgaatttggtaactaagactgaatggaacttggtatctcatcagtgcctctcaaagatttcctttcacttgtttcttcaggaagacaactactagttggacacataaaagttttaactgtggctaggccccactcttctctagttcccattggaactagaaactgttgtaagaatgactccaaggaacattaaagacattttcagattgactttgaaggcacatataagtgtgttcaatgactttgtaatttggggaagactcttaaactccctattagcagattatcatatataacatatgaatagacctgtttgaggatgtaatgagctcatgcatataaaataactagtaaagtgacctgtacattttcagccctcattgtaagcgtaattatattatattattcatcttttgtaggaaaagttttattgaattggagaacaacagaagacaaaagcgttcctcctttccctttctagatttgtatatattacagaacacacataaaaatggacatttctctgcagattatcttactgttatgtataaaaataataaattggctctctgcctatggagcagacattcttttgtttctttacttctctaataaacttgctttcactttaccatagatagcaatagtaataagtcatggagaaaattaataactacttggactttctacgaaaatgtagggaaagtgtatatagatttttaattgatgttttgattccaaacaaaagaaaaaacttcttacaaatcatttaatttaaagctaaaaattgccttagatcacacatctgtcctggttgtactaggaaaattgatataaatattctcatggctgtcacacacctgttcttcctaaggcagttccatctgaggcatgatattaaaaggaatcagaggtgctcaccaagcaacataacacccttgactaagacaccaacattgtgatgatgtgtgaaatacttacatttctctatggctgccatagtaccttatattggcttcagatctttttatgtttgtgatctctttatccatgaaatctagtttatttgcccccttttgaaaatccatcccctatcctcatttttaattcatccattcttcttcctattcagagtaacctacctctcttaccaagggtgtggccagatgtgatctttttttttcagggccttaaatccagcaaattatgtcttgaaataatgacacgtcataaagtcacttaactttttttccgagtccaccagttctttttaacgtttttcactgtctaataaagggtctaaagccctgactggaatccatgcatggaggtgtcaaagcttaccactgttataaaaatatttccccctacatggcatgtcttcatttgggcatgaatcatgaattcatcccatgcgttctcctttatttcatgaacacccaactgtgtcagaatgccaatgaccttcattggcttggctaatctatggatctgaaccctcctgtaatccattaaaagaataatagcaaattgaaagtgaatgtaaagatacccaatgggaccataaaactaactattcaatgtgacgtgctttggcttaatagggcttttatttatttaatttcgagctccccttggtttctgacagggttagtggaggaaacaaacccagacatcttgtaagctgtcaagctgatactcatctcaggggagcttagagggtatcatgttttaagttttatttttctggagcttggaatatgtctgctgacagacggctcccctgggttatagcaatgcaaggctgttgagacaattgaataagctgaattagacaaaggatttttattacaataacaaccagatggaactttgaaggaaatttttttttaaggtcttagaagttctgttacagaaatcatttaaaacatatttatgggctgggcgtggtggcttatgcctgtaatcctagcactttgggaggccaaggcaggtggatcacttgaggtcaggagttcaaaaccagcctggccaacacggtgaaacccacctctactaaaaatacaaaattagccgagtatggttgcaggtgcctataattccagatactcaggaggctcaggcaggagaatcacttgaacctgggaggtggtggttacagtgagccaagatcgcgccactacactccagcctaggcaacagagtgagactccgtctctaaacaaataaataaataaataaataaaaagatatttatgatgatttttcctattataaggttaaaaaaaacaacataaagatctcattgctctgttttttttaatccctaatgattaatatgtggccagttacagagactcttccagccaacccgtgacatatacacattaataatgttcttttgtatttgcagatcttatttcttcagagtaatggaaaatcctgcccagtactgttctattaatcttcataacgaatgctagggggctaggtgggcggcatttggtgttatccacatgtaatagattttttaaaaatggggcaatgaaaacaaaataagtcttgaaacttgttaacacccacagtggaagtttagcagtggaaatgaactaatattaccagaagacctcttattctctattgcttttcatgattagctagtacatttattatttttctcatgaatgacaagattgcctgtaatgtatttgacatgtggtagttttccaatctccggcaggctgtgtgcatgggtgtgtgtgtatgtgattaataaatacttaaatattttttatatagggattgttttgccctctagaggcagctcaatagaaggagcattcaatgttagtgattgaaaaatggtagatgaaacttggacaggaaaactcgagaggtccaaggtaccttatttagctactgctgtcacggtggatcataatgcagtgggacagtcaggactcaaagcctttcctataaccacatacgatggatattgagcacaatacagaagcaaaagatttgttttaacttggatacttcaactgcaagcgtctctgggcctgatatccagttcagaattcactgtactttttatttcactatcggctttccaaaatatggtaactaaatgagtaaatgaaaacatggcaatacaaaccaacacaagttcttttgctgacagagcatgcaattgccaagtaaaaatattgttctttattaggtttcttttcatcgtacatgtacatattcatttggaaacacatttttttgagacataatcttgctctgtcacccaggctggagtgcagtggtacaatcatagctcactgtagcctcaatttcctaggctcgagggatcctcctgcctcagcctttcaagtaactagaactacaggcatgggcacttgccgggctaattttttaaaattattttttgtaaagactgggtcacctcagccttccaaagagctgggaagagctgggcatataggcaggcatgagccaccatgcccagtctacaaacacattttaaaaccataggccttctagttttttgttgttgttgtttaggttggcttttgacatgctacttattgcatactagtctgtcatgttcctaaattccagttactcctgtagccatttttaaagattattttttaaatttttcttcctcctcctccacctcctcctcctcctccttcttcctcctcctcctcctccttcttcctcctcctcctcctcctcctccttcttctcctccttcttcctcctcctcctccttcttcttcttgcttctttttcttcttcctcttcttctcctcctcctcctcctcctccttctttttcttcaggcatggccttgctctgccactcaggctggagagcaggggtgcaattatggttcactgcagcctcaacctccatagctcaatcaatcctcttgtctcagcttcctgagttgctgggactataggcatgtgtcaccacaactagctaattaaaaaaaaaaaaattctttttagagacgatggggccttactatgttacccagactggtgttgaactcctagcctcaagcgatcttcctgcattggcctcccaaagccctgggattgcagggttcccaagtggccatatcattggatttgtcttcagagtgatgtacttgtgaaacatggatatgaacagggatagagggcaatagcaacacatgtttattaagcactcattgtatgccaggctaagcactttgtcacagagagcctatttaatcctcagaagaataatccaatgaatcactctattttctaggtgtcaaaaccaagtcttaaataagccaagtaacttacccagaatcatatagccacagaaccgagatttgaattcatacattatgacagagtcagataagctagccatcctgcccctacctccagttccagaatcagtgattggctttggtcttactcagcactgtcagttacagaaattggtgtcatcagattatctgtctgcctaccacctctggagcatggcaattacagcatcattgatttcgattgtcctaaaatggaggaaaacttgctgctggcaaaaggaagacccataatcattcatcagctcaataggcttgaatggctaaagtgctcacagccatcttcctgtctcactaattgctgccatttaaagataaagggggaagaaactaccctttacttcagtttacaaaacccaccgaagttaagatataccaaaggatgtatccaagaacccagaacttctggatggaaggttctggaattgaatcctcatgccctgcagtataacctccatacacccacatggcttgggcctcttagttttgcttggctgctactacttttaagtaaaaaaataaaaattggttatgcagttttcagaatgtctttcatttcaaatacattcttaatccatcaaaagggacattctaaataaagacttgtctctacatgatgtgttaatgaagaatggcaggggcaagtaaaacaaaacaaaaagctatgtagtgaggttctttcaagccaaaccacagctgtttgaagaatgacaatatgatatcatgcaactgccactatccctcattaattgattttacagatttttaggtattcactgatgtgtcttgtacttatggctgaaaatgcacactaacaatctgtagcaatgttacaacacagatagcatattgtcaaatgctgccatggatgaaaacttctcatttgctgtggatctgttaagataaacctcttgagaattacagatacatttattattggcattttcaaaatggcaaagacatctgttgctaaaagtctctgactggaaaggatttgggaccaagggtaaggttagctaacacttcttaaactagacaagtatgaacagtgaacatctgaaactacctgtgaccacagagcccaagtaatgtttaatggaggcatacatctttaaccattcaatataaattcaacctttttttttttttgagatggagtctcacactgtcgcctgcattggagtacagtggtgtgatctcagctcactgcaacctctgcctcctgggttcaagcgatcctcctgcctcagcctcctaaattcaacctttttttaaagttttcctcattaactgaattgggcacttccccccctataatctcttacataatttgttttaattcttttgacgtatgcattacataccacccttgtattggaactatgtatgtatctctttttcattcactcccctttccttccctgtcccattccttaagagaactgttatcttccatgagggaagcactcctgcaacttttacgtgtatgtgtgtttgtcaccatcttctaccacgtattaatgtcacatattaatgtgccagcccatattagtgtctcattctatgaatgaatgaataaattaatgaagaatgaattatgtatgtaatgtagttcaacttactacataacaccaagtaaactaaaccatccaagataagtttttgaatcaaagccaccatcctactaataaatatggtttcttttgtataaaggtgctagaattcctagccaaatattttattagtgttctatgccaaaacttccattcatcaatgacttatttcaatgataattacttcaagtctctgagtgtaggtatcagatgttgaatattagtatcctggtgctcaaggagtctttcacaggcttttacatatgcttctccatgtgattccaattttagcatacaaatcttttatttactatcaacctacttagtctacttgttgagaaaaaagtgttcatcatatttcttgattctgcatatcttatcaattgcaatttttctgctctattaatgtttagatagagaggaaaattagggaaggacaccaatcctgtgtgtaagacaaaactggaagtcattcacaaatacaatatgcatcaaatgttttcttctgagtggttctatattggttctaaatataatagtaccagcttatatgaaaagcatgagggattggcctcaccagtttttatcaaatgtaagatgctattaatttcaagatgcatcactcttttatgaaccacaaaggaagaaaagaaatgctgccaaattaacaatgatgttgttgatcataagttatatcttgatttcagagatattaaaatgggtttagaatgtatgtcttagaatagacgaaatatagtatttgttcagtaagtatggagtgcattctcaatgctctattactttcaacattgatatgcttcttttacaaatggtgaagatatgatagggtgtttgtgacacatgcttttctagcaatctgtctaaaacctagcatgcattgcaagacatgtcactgcaactctgcatgtgctaccacagctttccagaaggtaacatgcatcccacaaagcttccaaatttcttttcagaccgttttattggcctgatggcaagctaactcaaagcagtttgccatacacagaacacattcaccaaccttggtataatgttccctccgcttctttctaacaagtcacattttgccttttaaggttatccatcatccagtgttttaaagcattttgctttcaatgaggtggcacaaaaaaccatatttttacaatagccctaagttttaatggcaggcaaagagaatatgactacatatctcagcagacaattagagtaaggagggtgaggtaagaagagtggtgcaatggaaccgtgaagatagggagccctgaccctttcattttctgttccgtacatatttgaccttcagtcctgcaattgcagaaaacaaactgcccaatcttacccatgggacattttgtaattactttcttgtctcttctcttatgggtgcattgactagcacatagtacttctgctactgatagctcatatttatctagcactcattatgtgcctgacagtattctgtttcacatatattaattaaactgattaactttttaaaataaactttttattttgaattaattttagttttacaaaaacattgcaaagataatacagagttctcatacattttttatccaattttgctaaatgcaatgttaacgtattatacaactgtggtacattcgttaaaactaagaaattaatattgataaattactgtaaactaaactccagacttcatttggatttcaccagcttctccactaatgttctttttctatttcaggatccaatccctgttggatccatattgcatttaattgtcatatctccttcacctctttggatctgtgagagtttctcagtctttccttgttttccatgactatcacactatttttttcagagatggagtctcattgtgttccccaggctggatttgaattcctgggctcaagcaatcttcctgccacagtgtccctagtggctccaactataggcatacaccacacccggcatgactatcacacttttgaagattaccgattgagtattgcataggatatcctttcatttgagtttgcctgctgttcttccgatgattggactttggttatgggtaactcatccacttttcacaacagcctataagacggtactattatgattctcttttatagatgaggcactgagggagagaacagttgagtaatttgaaggcctgggtgcttgaatccagagggtctggttatagacctaaagctcataatcactatgttattattgagttataatttctaaatttgaatcttgacacactacatactaactcatatttattggtatcagatcactcaactgtgaagcaggaatgatcattttacttacctcatatggcaatgcttagcacagtatctcggtcacaccaaatttctggaagatgttagctgttagttttacttaactgtttgccattatttttcaggaagctggccatgttaattttctgaactgcacaatcacaattttgtgaaccttaaggtgttctgaaattacgggctcgttgattctgccctttgtcttgcttctcaaagaaggtgtgctggcactccatttaagtgctttatttgtcaggagaaagtgctcatttgaatctgaaaagcaatccatgtacaaaggaagaaaacttggaaaccctgatagtctctgcatgtttgagaatcaatgaaaaaagtaatgccactttccacatgtgcttttagaattctaggaatagatcagtctcaggttatactacaggaataatatctttaaataacaccatagaaaaacattccaaaattgtttggtagtggactgtgtctacacagatacttatacatgttttttggaaggtcatattatgacatatagcaatatcagaatttctacaccaatagcattaaatgataatccctctctgtcaaaccggaacatgtgttgtaggtaagcatgtacataacagtgtcgatatctttgcctgaagtaagaatattgagggaaaataaaagcgttatgagatgtgttcctttcattttaaaaaatgaaaaaattactccaaaatggtgttatggactcaacattgattctcctggtttccaatcccacacaggttgagttcttactacaacaaggcattttccttggtgccatgtcctagatcatacttttctgtttaatgcagaattttcttccaggaggctagaatgcttggaaaagtgtttgtcatatgtcggaaagtgagcattttctcttatgaaaactattcgtgcttttatgtaaaagtattgaaaaggaaacttcacaaaccataagaaaatacctgaagaggagatagaaagcaatccggctggggatcacgtagcaagtgtcttcattgggcagggtagaaaccttggctaccttttgctgctttccaactctgaaatcctaagtttctctgatgttaagttacctggttgtaattataaagtgcttatcattcagacgtatgtgaaatacttggaagtcagacttcctgccagtgtttaacactttggaaggatcaataagtaggctttattcagatattccaaatggccaccttcttggtgtcatgtgacgctatgtctgtggcctataatacatgtagttgtgattaattgacttttgtccagcatcctgtattttcggctctcttttagcggtggcaagcaatggaaaacattatttctttgctcagatttctcactatatgtgtaaaaaggtgatattgtgattccatgtttccaaatgagtgagactctatggacaccttccatatattccctccatatcaggagtaaagaaaggtatgtcccaatttaaatgggaatttagcacctctattaaatttttcacacagcttccattctgtatttttatgaactataccaaatcaaacatatttatctttttgttcagagaaatgaacatgaactccttatttctgttaaacctgcttttcttgcagtcttcactgtgtcgaggatgtctattccatcccactagttactcctagggaaaatcttggggtttaactccttcctctcacacctcacaccctaaccatcaacaaatcctcttagctttacctccacagtatgtccagaattcagtcatttctcgtacctctcttacaagcacccagttaaagccaccatcttcacatttaaaattccctgtgttagcaattttgaggtatacaatacattattactaactatagtcacctggttgtgtaatagatcaccagaatgtattctttctgtctaactgaaattttgtaccctttgaccaacatttccccttttcctaccctcccccacccacctcagcctctggtaaccaccactctactcttatcttgtctgaatttgaattttcagattacacgtgtaagtgagatcattcaatatttatcttttaaaaaaattttttttgagatggagtcttgctctgttgcccaggctggaatgcaatggcatgatctcagctcactgcaaccgccgcctcccgggttcaagcgattctcctgcctcagcctcctgagtagctgggattacaggcacctgccaccacgcccggctaatttttgtattttttagtagagacagggtttctccatgttgtttaatttttattttagttcagggatacatgtgcaggtttcttatatagataaacttgtgtcatgggggtttgttgtacagattgttttgtcacccaggtattaagcccactacccattagttattttttctgatcctctccctgcttctatcctccaccctctgataggccccagtgtgtgttgttcccctttatgtgctcatgggttctcatcatttagctcccacttataagtgagaacatgtggtatttggttttctgttcctctgttagtttgctaaggataatggcctccagctccatccatgttcctgaaaaggacatgatttgttctttttttatggctgcatagtattccacgttgtataagtaccacattttatttatccagtctaccattgatgggcatttaggttgattccacatctttgctattgtaaatagtgctgcagtgaacatacacatacatatgtctttatgatagaaggatttatattcccttggatatatacccagtagtaggattgctgggtcaattagtagttctgtttttagttctttgaggaatcaccacactgctttccacaatggatgaactaatttacactcctaccaacagtatataagtgttcctttttctctgcaaccttgccagcacctgttatttttaataaataacagcacctgttgagtttttaataatagccattccgactagtgtgagatcagttgcttttggaattttcatcatgaaatctttgcccgttcctctgtccagaatggtattgcctaggttgtcttccaggaatttatagtttggggttttacatttaagtctttaatccatcttgagttgatttttgtatatggtgtaaggaaggggtccagtttcagtcttctgcatatggctagtcagttatcttagcaccatttattgaatagaaagtccttttttccattgcttgttttcttcaactttgtcgaatatcagataattgtaggagtgcagctttatttctgagctggtatttatctttctgtgcctggcttatttgacctaggataatgtcctctagattcatccatgttgttgcaaatggcagattttcattcttttttaaggctggatagtagtagttcattatgtatgtataccacatttgttattcattcatctgttaatggacgctaatgttgtttccaaatcttatcatgtctctctccatctcccttagatcaaaattcaaattctgtgtaacatatagaaagacttgccccctttacctgactgagagcatcacctctacttctctcttccccctctacaccagctataccacccacctcactgtgtttcaatatactattgttctcctgctcagaagctttgaaattgctattccctctttttgaaatgttcttctccaaggtattcattttcagagtttgctccctcactttattcagtctcatcagagaggcctttcttgactatccgaaaccaaataccgctgcctcccacttacccctcagtctccttattacgctttgtctgcatatcgcttaccaccacctgttaaaagataaagctgagctcattaaacatttaaagattttatttgagcagactgattcataaattaggcagcaccaaatcacaagctgtatgggctccaccaagaaggtgtgagaggaaaatttttgtaaggtgttctaggaagcaagacaaagaaaatatttgatttattgaagtggaaagtccctagttagaaattagttggcagtttcagattaagttaaatgtttacactgaattgggttttggtttgtctacataggaacccagggcactggagccatctcagcctagtggcctcccaaattattttttttcgacacacgtgacatactattttattttctgtctttatccattacaacgtaagttccatgagagcaggaatgtatctgttccttttgttgccttatcttcaaaatgtagaatagtacacaatacttaataggacattaataaatacttgttgaacaaatggaagaatgactaaatgtgattgaaaggcagactagtagtaaattggactaggtcaaatacatgtgcagaccagtgttcaatagtatgtagcatagtttatatttacacatattcaatatttagcctttcaaaatgttttccagttacctaaatataagtatttagcattataggtggaaatctgtcaaattattttaactcataccacatttgagaaactgtgtggaacctttactattcctcagttttgtttttctataaatataatatatatttccttttcctactgaatgttcccctcagtgcaatttttttccagctattttacttgtagttttgatgtcttgctttgtttttacctatgaagtctaatgaaagtccagataagagcctataattctatccatataattcagtaacttccagaacatgttttatctgtcagactatggttcacattatcgtaggtgtaatgcaaagtttagagctgaaaatgtagccacgttcctaattcttgctctagttatcaatgtcaaatgcactatcaataggacttgaaaaacatactcagtaatattggatgggtactgacattctctcaaattatagtattgagtgcgctatactaaaaatagtaaaaataacatggcttagacaagtgagaaaacaaagctatgtcctactttattttgagaagcaaaatacaattttcctgtttgttttttctttttctcaaaacaactaaaatttgtaggaggataatgtttaaaatttgttcacatggttaaaattagaaaaataaataaactgacatgaaacatacattaaatttaaagattcattgttttgtataaacacagtgtatagcttataagtcattatgctattagattgactttttaacttacgagaaattggcattctaatttagatgcatgtatatgacttcccatgtctattttaggatagatttaatcataaaatgatttaccttgggcaaattacaataaactcacttgagtaattaatcgaggtgtttcaaggagttaatttagttcacgtaaataagaacgttgtttcaaggaatcatttaccactctgtattgccatttggcctagactttttccattttacatccagaagacaaactgttgataaactatttgttatttttttgctaaaaattgatacctttagtatagatagtactgtatcagaaaccatagaaactgatgctttaatatggacatgaactcattagacatagaattttggtcagtctctagttagaatcattgcttctatttattttcaagtttgtacctgaggataattaatattattgaaaatgggttaatttgcaactgaccttgaatcacaaagtggtaggaaaggagatctcttgttttatttatttatttattaacaataaggatttgggcattgtcatatgcattcttctgtagcttacaattaccacaacacttcacatcaataatatactggtgctgatttagtttaaatctttcatatacgtgtttattgtaaatttctttgagtaatgctgggcactgatattaacagaggattaactttatggcacattttaatagaatgcacaatattacttccaccaaattttcttcttttctttgtgaactgttattcattttcagacatgaagaaagtatttctttatcttattttattttatgttccagggtatatgtgtaggatgtgcaggtttgttccataggtaaacatgtgccatgctggtttgctctacctatcgacctatcccctaggtcttaaacccatcatgcattaactatttttcctgatgctcatttcttagtagacatggcacttcaaccattctgaagcttaaaaattatttgttattttaagcccgtaagagcattttaaaatctgatacatctgagcagaaacttttggtttttagtttttttataaattaaatgaaattaacacattaactatttcaagcaaataagatccacttacataaatgaccatgttagtttgagaagttatagcttactgatctgaaaacattaattgaacctccaaaattatacccgtggggtaatttctatcctcgcagcggtgtgcactttaggacaattaaagtgccaaaggaatctcattttatttcttggttattatgtctaggtaaactgatggctcatttttaagatctgtttagtatccaatgattaaaataaaaatgatgacctcatcatgatattcacatagcacatttatccatttctcttttgatttatagcttatttttacctaatgcagtttactcaagtctcctgggcttatacattttttagtctttgataatctatactaatggaccacaagggtagcaatataatctaatgaagtggttaacccagagtcttgggagtgaactattgtggtttgaagcagatcatgtttgtttggcctactttttttttttctttttttttcttttttttgagacagagtttcgctcgtcacccaggatggagtgcaatggcacaatctcggctcactgcaacctcggcctcctgggttcaagtgattctcctgcctcagcctccttagtagctgagattacaggcacctgccaccatgcctggctaattttttgtatttttaatagagatggggtttcaccatgttggccaggctggtctcgaactcttgaccccaggtgatccgcccgcctcggcctcccaaagtgctgggattacaggcatgagccaccgtgcgcggcctgtttagcctacttttatgactgattcacatttattaaatagctcctagctggatggatcattcagaatggcatagatctgagtagagacttggagactattagcagagctagcttctaggaatagaagtagaagtcaaatatttaaaataatcaccgtgaatcaacatttggtattacctgatcattctcaaaaccctgttccctatttaagctttgatagaattatatgttaaatattcagatacgttatgtaaatgacgaccaggacttagaagttgtttattattaccttcctttatgtggctactaagtatttctgtccatgaaaaatgactgaaatcataatgttaaaaataggaaagaggccgggcgcagtggctcacgcttataatcccagcactttgggaggctgaggtgggcggatcacaaagtcaggagatcgagaccatcctggcctacatggtgaaacccccccgtctctaccaaaaatacaaaaattagctgggcgtggtggcacacacctgtagtcccagctactcgggaggctatggcaggagaatcacttgaacccgggaggcggaggttgcagtgagctgagatcacaccactgtactccagcctagcgacagagtgagattccatcttaaaataaaaaaaaggggaagaaaatacacttacacccattcccaggtaaaatgtcacatctctgtttgaaatgctcatttgcatgaatacattatgaattgcagttccaatatatacatttctgaatatggaaacctcaataatattttctctttgtgttttatatttagtactaaaaaagtgatttgtggctaatataacattcaattaaaattaacatttatcctaggggcattccaggtactacagtctgtctcattcattagagcattttgtacttatctgcagagcatctctcctcagaagagaatctgctgaatttttgcatcttatccagcatcaatcactttgattaggatctcactccatgaaccaggcagcttctcttccacagcagttccatatgtctcctacagctgttctactttctaagtggaacgtgactctcttcagctcatagtttgtgtccccatcaaaaaagactgtcaatagctcctttattcttttgatttgctgtactctcttatggcttggaatatgacttatagtcagtattgaattaggatatgttcgattaagagaaattgtgtccatgaatgttttgataagtgaaatatttacatcaaagctcatgctaagaaactatttgaagagcaaagacagagcagaaactttgcttgtgaaggaatttctccagggaaattttcaccgtgcaactcggtggtggaaggctgccataattttggtttatgttaatagaggttaagttgatttttattattttctttggttggtttataatcagcaaattttatcttggaaagtagatttttttttgcccaggtactatgtttgtgtgttagactatggaaagccagaacaactattatacattgactgcaaagataacagaattttgtgtgtgtgtttgaaacttcctttcaacctcaacacccgaaatgtttgctgcaataccttttctatatgaaaaccatagaataaatagaatggaagtaaaactaattcagaataaaagaaactatcatttctacaaatggcaacctcatttatttacacctaaaactatagttttcatagggcttaatgtgaaaagataaaagaagtgaaaaggtccttgagaaaataatagagtattacctgaagcttgctgagcaaacatttttggggaatgacaaaaaaagcttttgaacatgaacttctgggatttcaactgaatgatcaagcatgaagaaacttgattatcctgattaaagaataatgctgggaagtctttgcataatttgataatatttttagtatgagctgatgtctttaaccaaaatagctaccaaaattttagaaaacactatcacaccatgcatgttgtgaatgaaatttttatttactcacttgttgatttgggagagctatatgaacaattattatcaccaatagtattcatggtcttttttaaaaaaagactaacaggtcaaagaaaaggggtttaatggattcccaattttagtatgttgtacccttgagtatcagatgtctctgttcttagcaactttccttgcttgtggaaatctagaaatggtttactcaatgtcagttgatcatgttgttttatctgaaaggcaaaaacactaggatactttcaacttcccatagagaattacacattcaaactaaagtctagttgttcaaatggaaaaatcgagaggcagacaaattaatgtaattatagacttggtagggtgttgcaaatgaataagaaactggcaatttgagtagttaagaaccattgtatattttattatagctgtaatgttttgagttcataaagccatattgaagtaggaatacacacatacactcatttttagtaagcacaatagaagtaagtcatttcattatcattttagggctgattcttacactttttagcccacaattccgtaagttgtctaattcgactgatacagaccagttctagctaccaaaatattatgtgcacaaaactccctttcattctatttttctgatcacaatatccatgcccacaatatagctaattagttaagtgtgggaggaaggcttttgttagaattcttactccaatggattaatcattggaaatcctcaaattgcctgaagttgttagcatattttaaaatcaccagataaatacctaactagaacatcagataatacatgacaattagaattattctagcgagctgtagtcacatctgaaagttaccatattcttgctcctcaaacaccttaaatttaaactctgatgaaatccatctgtaccttctctaatatctccccagatagtcatgaggagtaaataacatactacaaaatgttaaaatatttcaaatacaaagttctatagaaatgttacacagtgctattatcactatttctcaattaaatgtacattttaatattaaatgttactgctaaaattattttgatagtagttatttataaacattcactattagtaatagccaactattatgtatggttactttcacttaggatgaaataaaaaatattggcttatttatatatttcagagtatgttctagattcctataatggggttctaatggggctaaatatgtcaaattcttataatatatattaaatgtgtgactacagcagtgccttttaatgtgggtcttcttttagtatctgaagaaagctaaccaaattttccattgtaaccaccaatatcatatttttaatattagaatataatacttaacaaatacaatagttaaatgtttatttaatactaactaaacattgaacaataattcttaaagagattcacaaactataaaacactataccagactataaggtgcttttactaatcaatttggaaaccataacacctgtctgatgagcatgcttattttaaaatgaacagatgcagggtgtgataatataccagattaaagttatgagtgaatagatttccttgtaattacaagtcatatagtgaaggtatcgatgctatatatatttctgtcaatgaagaaactgtataatttgaagtgttttaattttggggggatgggggacggagttttgctcttgttgcccatgctggagtgcagtggcacgatctcagctcactgcaacctccacctcctaggttcaagtgtttctccagcctcagcctcccaggtagctggtattacaggtgcccaccaccaggcccggctaatttttgtatttttagtggagacagggtttcaccattttggccaggctgctctcaaactcctgacctcaggtcatccgcccacctcggtctcccaaagtgccgggattataggcgtgagccaccgctcctggccacgtgttttacatcttatttataaactagcctttggaaaatgggtaagaactgtagtgctttttgttggtaatactgtgtagttgttctttagttgtcatttcaaaaccaaagctaaactgtttacaaggaaataaaaacttaacctgtgcacaaatttagcattatggatttacatactaccaagtactagaactttttcagtctcaaaaactaagcccttttgaaatttagctatttaatatcaggaattctgaaaacaagggatatgggatgtaaggagaaaattattcctattctatagactttgttatgtatgttttaaaatgtaattaatatcaacgtaatattgtatctttcagacactgacttccatttcctgattggttataggtaatttgaagatttttcactataccagtagagatacaaagtaaaacacaggtatagtctcctagaaaattaaataaaataacccttgagtagacttgtaaggtgacatagaaccagatatgcctgtcttctgttttgctaaaaagaccttgtttccaagtgttattgaaaagtgtcataatgaaatcagaatttaatgttatttgccctggcaaaatcatgtgtaatggtaatcataaatcagttaaggagtaatacaagatgttatgcaaataagcactaaagtttcacaccaggtaaatggctgccttcgtgagtcagtggtgaaatggtaaggttctagaatatggatattgcaatggacattaaaagcaaaatgcgtagagacattttcttaaagtagtaattaatggtacatggaggtgtgcttaatgtgaaggaataataaaagcaataaaatttcaaacaataagcattcatactgatttgatttgtgcttgtataattctctttacaactctatcatatatgttcatctatttattacattttggatgttactgcattcttgtcttagtttattaagcttcccttttaatatttgcctttattttaccctcttctcatattatgatttccttgatcctagcttcttttttcaagtccatgcatcttagtatttcatggctggcatcaggaagttttctaaaattttgtctggttttcatggaaaaaattgcaaagtctcatttattttctaagcttcaagacaagtgtatccatatggattcagaaaatttctataggcaacttctattgttcttttcactgagccttaaattagaagagctgtatgtagacttagtgttaagtacaattattgatgtactgaccttcttctcttatttttcttcataagtggagattgatatacataatctatacctattcccagtaccgacttagcctttacccagcactgctttcctgatggatgtggagttttctccaaataaaactaccatatcttgtaaccatattaaaaagtagaagcattctgtatttatattttaacttaaatatttattataaaaaattctaaatatatacaaaatagagaatgataagtgaagattcatctacctattagcaaatttcaataattataagcattttaccaacctttgtacctattttctatgtaggtgtaatacatggaagtctatatcctcactatgcactgttgtagactcttctctcaacacttctgcttttcctgaagtgcctagctatctgagcatacaatagggctaccaatccatttttgttctccaactatatttttatctgtgatttataatatctgaatgaaagcaggaagagacaagatagaaaggaggaaaaggaaaaaataaaaactataaataagagtgtagtagtttaaaggaaccagggaagtaaatgcctgatttgtggttagtgcagtgctgtatactagagtgaagaaaccttacactcttgacaatatcctggtaattcctgttgagagggcaaaacacgcgtagtccagaactgcatttctttaactgaatcatccccaaaaacttaaggtcgtggaaattctctctaaattttggtgtctggttctgacatatttttaaaattcagtgcttccccaacacctgtaatatgtatattttaacaggtagttggacatggtatttcaggctttcctatttttttcctatgtaaatatgaaagttactctatgggcctatttccctgaaatgttggacccactaacacaatcagactttctacaaactgccacactgattctttgccttcaggtacacctatagaaagatgagtgtgtggggatggcatagacccaaccagcagcaagagggagtcattatttcctacccaagagtagggcagagagaaagaagacacatttgctcagccattaagcataaaccaatgaatgccagactctttatgatcttgccagtcaggattgatccatcctttcatttagaggaggattgagcaagaggtggaaacacacgctagacatatttttctagtataggtcattacaaggaaataccaagatgaagaagacagttcttcctaacaacctctgccatgaaataattactgaccaaatatatttgggaatatgattatgctgaaagggccacatgaagtccttgtttttttattatttacagatttgactattttttttttctattctaatactgtgcttcctgatgctctattataaagaacagaggggattgggaagctggggttcaagccaaagaataaatccatgatgtattttaaagaagttggtagaagaaaagagaacaagtagatttttttgttgttgttttttgtttttgtttttgtttttgtttttgttttgttttgtttctttgagatggagtctcgctctgtcgtccaggctggagtgcagtggcgcgatctcggctcacggcaacctccacctcccgggttcacgccattctcctgcctcagcctcccgagtagctgggactacaggcgcccgccaccacacctggctaattttttatatttttagtagagatggggtttcattgtgttagccaggatggtctcaatctcctgacctcctgttccacctgccttggcctcccacaatgccgggattacaggcgtgagccattgcgcccggccgagaacaaataaatatttatagagtttggtgtagtaatatttttacttactctttcttattctctttattatttgctcctgaggatatgagttaccatctaactagcatcatttccttaagccaatatatctttgttcccttccacctcatttgttttgttgttgtcaaaaatgttatgtaatacataagttataggtcccaaaataaagttatatacatgttgttttatacagttgactttgaaatcaggtgaaggaaattgcctttatacttttttttttttaatatttacataattacctttactccttgtttttctgcaaggattttgcttatggttactttcagtttttgtttgtgtggggatgtctttacttcatcttcatttttaaaagataactttactacatataagattcttggttgatgattttgtttctttcagtactttgagtatgctatcccactgtgatcaccattgtttctgctgagaagtgagctgttggtagttcccttaaagttattgaagttcccttgtaactgataaattgtttttctcttgttgagttaaagattttctctttgtatttggctcttagcatttttcctacaatgtgttaggatgtggatctctttgtgtttattatacttgtagtttgttgagcttcttggttgtgtagattatttttcatcaaatttgaaaagctttcagccgtatttttatgtttctcttcactttctgtccttctgttctgatatgctcattacgtgcatgttgtgtgcttaatggttgcccaactttctgtgaggctctgttaagtttttccattctttttcctctctgttcttctgattgcataatttctattgatttatttcaggtttgctgattctttcttctgtcatttcaaacctactcttgagcccttctagcaaattgttatttcagctattataatttttaactccagaatttcatttggttcttttaaataatttctgcttcttcatcaaaaactccatttgatatagcattgccatcataatttcctttacttctttaaatatggtctcctttattattttgaacatgcttatatggctgctttggattatttgtattaatatattaaacctgacatttggcctctttcacagtcaatttatgttgcttggtttgtttcccgtatatggggaacacttttttctttctttgtgtgtcttttttcttattgaaaaatggacattttagatactttattatagcaactgtggatactgatatcccctaatctggagattgcttttgttgttgtttgcttgttcatttattctgttacataactggactattttagttaaatgtattttcctgacagtatgaagcttgcaatgtccttcctcagaggaggcaaatttgggcatgtgcatagtcactctgggatgacagtggttttaggaagattctctttgactgtatctttccctgatctctctgttaagctgtcttcctctgctggtattagaccaagtttttgtactacattatttgcctgcttattgttttggataatacgttggggtataaattgctccacattctgatccagttaaactcaagcccctttggaagccaattttgctccaaagttcagggcaaggccactggcctacttctcttgaagtgacacctgtgctttatgagcagggtgttgaatagagtctgtagcctctggccttctcagcttatctccctcagcatagaacctctgccctaggaacaagataaggtgagggcagtagaagtgggaggagcacctccagtattctcagcatgcctcacaggagctgaagcccctgccctatgtgcaggaattgggtggaggaggggagctccaattctctcaaatgcactcactagaaatttagcctctgtaacatagagcttcagggcatgacaaatgctggtagcctgctgctcttcagggagagagtcgtctttgtctgggagctggggagagtgttaagtcccacttttttggccacacctgtccagattggagcttccattctgcggtgcagagtggggaggaaggatgtagaccatgtgtaaacgccacagactctccttgttcttactgagatttggtagagtttcttcatttgctgcttgcccttagggaaccttatggagacttgaaatggttgttattgtttgtttgtttgtttttaataattgtcagtaattattgttgtttccttgggagttggactacagagctcatcatactgctgttctggaagtgaaagtactccatgctgtattttaaaggccttctgggatccctgttgcataaagattaaattaagtgttaaatgccactgtacgtttcatgatactagcaagaaaaataaaacaggattttccaaatatccttgattcagactgagaaatagcaaactctcaaaacaaaacattaatgtgttggtgaaatgtgcaaaatgctagcttctcaatcatctttggatgcggaattgcttaagcgaaatgaagaaaaatattccctcattgttaagctacaactgtttcatcattggagtgttccacgaaacagcctatttcataccagttaagggcctagctagaatttcaaatgaatgcaaataagaacgtttgtaatgcaagttgcaaggtgggaggaacaactgtttatgtaattttcctctcttttcaactttcacagagcattgcataatgttagaatcagactgcttgtattttaatcctggcttcatcactaagagatgtaggcttttgaccagttaatctaggtttcagtttcccattaaaaaatagaagtagtacaggacctacttgtaggtttattataaggagcataaataattgatcacttgggtaaagtgttaagcaattccccaatgtataaataataaatttaagatggtaataaaattaaaaaatcacaaaagcattaaataaatattatctctttagcagcttggcataatcagtagaaatttgagttctacaaaacttattgctgaatgaggtatagatttggatattagacaagaattttttaatggtccttatattcattggttttaatttagtgggtttccttaagcttaatgtatctctagtatgatcatctccacaagaatagataatactttttattaaatgctagcttagtccacaaaactttgttttattaaagtagataaattaagcaatgaaactattgatacaagatgtctttatatctttcactccaatcagttacatagctttaaaactcagaattatttttgtgtacatccactgtgtagtacctgaagtgagatgaacttttatgctatgctttttttctatttggtattcattgagtagcttttaaccaatctccttcttctattatacgagttgctctactgggcttttgggatgcagaaatgagtgagaagtggtttcttcagccaaaaccagatagccatttaagcacacaaataggatacatttttagaggtactattggagagatacctacaaggcgttgcagaaacacaaaaaacaaagagtccctggaggtatagggaaaagcttcaaagaggacacgaaggtgaagtcatttgagattgattatataacctagtgaagaattttccaggtacagagagatgcaggaagaccatttctggcacagggaacagcagatacaagagcatgaaataattaaagtactgtgttgttcaagagatgctgaaaagttcagatatttggaaagttcagtgaatgggatgcggaaggataacggaataggatagaaggggcaggttgaagccagatgtaaagaacttttatgccttttttaagagttcaggcttcattctttaggcaaaggcaagccagaaaggattttaaccagtaggagtgacatggtcagttaggtctttagaacaataactctggcttcattgtgaatgattgaagggcatggtgcttatatttccattgtaatagtctaggtcagagtaagtcagagctgaattaaaaatagctggatacaaaacagcttttctcttccatgcaatagtgtgtttcctccctaagccccactctctcccagcgaatacagttagtcttgttttatgaaaccagttaagttattaagattcaagcacccagctttctttgcttagctagctcaggtaaattgctttaatgatgtccatactgtaagggaagcatattctaatatgggaaaaatggatcagatgtctttgaaattatcctttttagtgcaatgaggaaattgaagtgcatagtgaaatgttttgaaatgttgttaataatgatattatctactaccgacatgctgtaatatccatttaaaagaaataaagttaattttgtatttttctgctctaacaatgaggaaaaatggtaaatatttgggaacgtaatcgaatgtggaggttgtcataaagtgagttatttttttccaaaggactgtaatgggaaaaatacataagtgcatacatatggaaatgacttgatttggtagttgagatttatatgtgacttttaaaaatgatttccagttgctattcctaatccattattttgttgtcttgagctgcagattgttgtctaggtcactaaatggcacactaaacacatttgctcaccatgcccctgtttcttcagatcttttcctatagaacacacacacacacacacacacacacacacacacacacacacccctccccttcacagtttttatattttcagagaaatctatgcatgatcttctgtcatgcaatcctatcaaacatccaattcttttaaacagctaattttttatttcttacttttgttcccaagatgtaaggcacttgtaagattgttctcctttcctgaatattagcaacaacagccccaccagccgttgcagattctgccatcaagttaacacatggggtgtgtagatttacaagtaggaatgaaattatattagagataatagctcttacattgctcaagaatagatcaccccatgaccacctggtcctatatcagttcatttctcttataattcaggaattagttaatgtttttggattgcacgggatgtgaaacatgcctagaagctttgccttatatgggaatctcttaaaatttatgaattcttatatcaaggaaatttttaaaaatgcttaatattacaaaacacaattctgttctttatattatcatatttgcttaaaacctttaggatccaaagaagtgtttttcattttgacatcctactttggttttaattgtcatgagcactagaatgatatgtattgcttccaaactgagtagattctattcgctagcttatgctgtacttagcgagccgtcatttgtcttaactgtatgaaccttagagtgtttataatttacttagaagcagcagatatcagcgccctaattaacaccttcaccattcctctcctggtacttgagaagttggcggcactacaaatggaacagaggctctgaaactaaacacggacctgacacaggatggacatcaattgtctttcatggccttgaggttcttccaattttattttgtgcaataattcccctggatcctgatttctatctcccagtgccatgttttcccacattgttcattgcccaaacctgatacatcatgcaccaaaattaggaagttgacacaagtctggatctcctagtatacgtaatgtggaatgaagatttgattagtaaagggaagtaaagatatgcaaaaaccacagaattattaatattttttcctgtacacttctatagtctggcaaaaaaaggtttggaaatttctaaagatagtagaaaatggactataaatgacttgtatacagaaaaaaagtgtttcaaaatattgattcatgaggttaataatagcttaatattaaagcatttatttgtgtcttttcttacatatctaaccatattgcacaaaaaacagggtcctagaattctatacagaatattacatatctatatcagacatgatcagaaatcagtatcagtacataaaatatactttatattacttaaatggaagaatttaaaatgatattaccatgtaattgaacagatttgaggtgcctgaagattgaaaaagaaataattattttcagatcttgagaaattctacaaggtaatcctgttgaagtcttcatcataagtgagttttccatttgtattattagtgtttgtattttttgttgtgagaaagcgatcctgattctgcttattttaacaaagacgagaataaatatatcagaaggtcattgggtcaggcaaagagttgtttgtttttcaacataggccacaaggatgaacaggaaaaggacatttctagaatgtactgttacagttttatgaaagtaattcaagcaaacaaaacagcaaaaagacatagctgccatttctcagtgttctagggaccaaagaatgtacttacagtgctaggatgtctgcatctttccagctctcacaactaaaataattcaagtatttatgccattattttaaattttgttattactgcccttgcctagatcttcattttcactcaattgaaatagtatgggaaattcctaagtgggatgcaaaccttcagtctttccaacaggattgtaataatctcctggctggactgtactgagtttatcttcttatcccctatagtatctagcacagagaaggaaagtgtgtgggaaatgcaaccacgccccttttcttcctttatgacagatggttttaatagattctagcattcttttcctcacaagtctcagcataacatgctgatttatcagagttggcacatgtcataaaatctacttaccatttctgaactgataatacttagtaggcctaaataaatgtttatcgaactaaagtattgcacatacccagaaatggaactgggaggataagtgaaaagaaattcttaaagaattatttcatagtttttctatttctattcctaaagctccccttttgtttccattgccttcagcggcaatggaagacttacaagagacaagtgctaggtctcatcaacttgagagtctgttcattattagtctcttctttgctcccagctgacttatatttaaatatatggcttccatccaatgattcccagcagggccattaaataaagtatgtattatggacaaaaaatggcaaaaatgtacttggctcagggacacacctttctccagtgacttggattcctttactcattaaggaaaaaaaaaaaatggttctatcgactcgtcattgttgttttatatcagcatgtcttaaccataggaggaaaaaggcagttacagttttaataatgaatcttaaattactggcacttcactcataaatgaagaaaggacagtataatattttattctcagaaacttttctcatctcccctttcctgggtcgtgaggtcaactaattttgattttatctgctctaaactcatcctaatcctataacttagtcacgttggttttaatatttgaagattgttttgtttcttgagattttcctacttctctctaaaattgcatctggggcatggagaaatggctttcatgacattgtgtagttgagaggaaatggatcccctcacctcctgctggttcttgggggattggtgacaggatttatctatgggatggtctttagcatatgctaattgaagttgacacttggtaaaattcatagtctaaattatctcagcttggttaaggcctcagaaagatccctagcttgttcatccactctaaactctaaactctgagagtgtctgctttgcctttcatctttctcctggtacaggctatccctttatttcaaggttgctagaccttcttttagaccttctttacagtggggtcagtggctaatctgcaaaacccgaggaaggcctgggagggcaaactagaccatctctctggctaatcatgccagtctgcttcataagctctgcgttttcacacaagactgtgctttcacagtcaccctgcacagcagccttgtgctagtgttcaaaatggcaacagaaacgtcctatttcctacaatttatggaacatatttcctcctctccactaaagcatgagggagggaagtggagatatgtatctccctcacctatatctgcctccagtccttttcctgtgagccttgaggaaaaagaaataaatcatattcttaagttttcaaaaatcttaatcatattacattatcagtagataatagaaattatagaaattttattaaactttttctttgtggtatctataaccttaatctcttcactctcactaaatcttcaatctgttatgtttgatgtattgcaatagtttttaacttgcttcttgcctccttttctctttccactccaggctattttgcatcctgttgccagactattcttcagctctctcgctttgattacaccgtttttcattaagacatttagaattttgtctcatcatttatctattattctttttcaatcatatgcctgctgagtcctaagactcttttcttcttattataatttctttactacattacccctaaatttgttccttcctcgtttctttatcatattaccttgtaatgataagacatccatatactgtctgattcttcaaagcctagctttagaccctcttgggtgaacctgactcactccataactagagtatttagtctgtagaacatatcttgatatgacattatgagtttgagtaggtattctctcttttcttcatatttatctttcccactaactcttttatttttttaaaaataatcttcccaacaacccttcagtgtgggtgttgatatctgcaaattacagacaagaaaactgaggttcagaaaagtgaagtcacctgcctaaagccacaaaactagttgatttttggagctgtgattcagatccaaatctggtttcagttttaagttcctcactggattaggctgcctcttcttaacagaaggggttttacagtatattttgagggatacttcacaaataaggtgatgtttgagggggcaatttattgattactaaatgctgaacacagtatatcatgttatcctttcaacaactctgagagttaggtgctaccaacagtctcgatttttcagttatggaaggtgagtgatagagggaatgcaggggctaaataatgaattgaacacaaggccctaatcatcatactgctctacttcccacttattgaactcaattctacacatcagacccttctcaatctagtttctgggctctggaggttgtggcgatggatggcctagcatttcctaggatctaagccctgggcatagcctgcttccaacattgggagcatagagatgagtcaggaaagcctgaccatggcctaactcatttttaagcatcttaaacaaagaatagtgtttagtatttgtccacggttattataatgtctaataggtggtacagagcactaaatatttacttcattatacaaaatctaataggacttaaaaaataaaagcacgtactgcaaaacacaggtttgaacaataagaatattgcttttttgctgttctttagacttcttttccatgttttcattaataagcatgtattattcttataatttacatctgtgttagttcaacaatactgtaatttaattacattgtgatccaaacaattagactgtgacattttatttaccaaacattactaagtctgcagttaatcataaagcagtatttctggtgttcatctccaaacattttatctacattattaacttagaatatttgcaacatgctgcttctcaactgtgactatgattattcacttatatttgtatttcatcattaaaaagaagccctcattttctcattattaggtcttaaactgaatcaacctgacatgaatataaaaaaattagagtagtttaaaacagttggttcatcagagatttgaactgaggtaaacaaaattaggtagattctgtaaataatcaaggcattttattttaattaatggccttgttacagttctgtttcaaaaactgaaggatttggatattacacccccttaggttttatatacatataatgacaacgttggtttggatgacgtctttgttctttctagctgttacattacattctgtagttatctgaactgcttgccagactgtttagggaaatgcatgtatcacagttaggggggattcacaaatggtaggtttctctgcaaaattgagacatatttagagtagaaaacactttgcctcttggaaatagaagtatagggtaatctctttttgtttgtaggccagaagtttctgtggactataaatagaaacagctcacagctaggatggagaaagctagagaaatgtacctatttgattgaaagggatagctaatgtactcaaaaattgctcttgagaaagagcaatgacacattcattctgaaggactacttaattgcccactcttggaacaagttggtcttcagctctaaactaaactgaagattttgaaaatgatagaaaaatagtgcagcaaatgttaaatttatgaaataggcttgcaattttctcatcaaacttagaccaaccttaacgatattgtaagagtaatatattctcaaggataaaatgttctctagttcaacttctacatagaaaatgagtttaaatgagccagtcgtcttaatatttggatacaatggtcattttgaaatatgtgaaatgtgttccactattattagaaaggaaaaaaaataaatatgcttatctttgatttgggcaatacccaggactgattcatagaaaaaaatctaatatatttatacataggagtgctttctctctacttgtacctacaataaaaaggtcgtcgtttgctttttaaaaattattttcactggagtatacttgaaactgtacatctcaaatgttttaacaaatatacctaaatattaaaattactaagtaattttgtccattgaaaaatgtggctactgcatatataataagacatagtttcttctcaaaagtgcctaataagactaaagagagtgaatcaatggaattatttatttgttaaaatcatgttaaatgtcttaaaggtgttattctttctttcctaattttcaaaagaaaatactttgtcttctttcatactcattgtttctaactctttctaacttttagtaattgtcaataacacttatattacttaaaatcttttccttaatttatcttcttctacccttctatccaactcttctttattaaaaacatgtcttcaggataccacaggagaaaaggtcagaaaaagaaaagggagttttagtgtatacctacctccaaacagtcattattactgtcaaggcataaagccatatgttgcatatgacaaattctgtatttctactggggtgcattgtactgtattttcataacatatgccaggcaacttctatgtatttcaggtcactaagtatacttttcaacaagacaaggaaactttctccctcccatcccttctgaaatctttatttggagatctagctctaagttttatgttttcctggtggtctttcgattcattccattccattccattccattcattcattcattcattcaaaaacattattattcacataccataggtcataaacctcattacttatgggaaatacgaaaatacttaccattctgtcttctctcttctttgaggcttgttctcatgaaataagacagatctatctatctgtctgtctgtctgtctgtctgtctatctatctatctatctatctatctatctaaacaatgaagtgatagattaagtatatgaaaggaaaatgaaaagcaaagaaaaaaggaaaaaggcctctgctagttgcgttgtggatttggaaaaacttcatggatgagatgatcctaaaagattactctgggtattccatgcagctaaaggtcgagggccaaggtggctgtaatagtccaagtaatgtggaaagaatttgggtgtgaaaagacttgccaggaagttttgactccagaaagattctaaaataaattggtaattataaagatgataatgtatggcctcgaaggccatgttcaggaatttggactgtgtacagacagattgtggaaagctattgcacgattttgggcagttacacaataaggttattctattggggagtacacagatttggctgggtgaaaaaggctagcagagaaaaaggccattttgaaagctgttggaaatagtcctgtgagaaataataagaaaacctatcaaataggccaggcacggtggctcacgcttgtaatcccagcactttgggaggccaaggtgagcagatcatgaggtcaggagttcaagaccagcctggtcagcatggtgaaaccccatctctactaaaaatacaaaaattacctgggcatggtggtgtgcacctgtaatcccagctactcaggaggctgaggtcggagaatcgcttaaacccaggaggcagaggttgcagtgagccgagattgtgccactgcactccagcctgggcaacagaaaaagactctgtctcaaaaagaaaaaaaaaaaaaagaaaaagaaaaccgaaaacctaccaaataagtggagataaaataaagaataagaagcataccagactatagtgagagcatatgaaagccaatttgatggttgaaggagaaaacattcagtattagaacaatcacaagacacggcaaatctaggggggaatactgtttagttagaggcatgttgcctttgaagtgcctgagttgagaaacattggacatttagaaagtgagggtggtggtcataaatctgggagtcccagagaggtagactgatccatgggattgtctaagttgggagtgggaagagagcatcttgataaagaagaaaagccacgctacaagactagagaaaatcaacataaagaacaacaggcggcccagcacggtggctcgtgcctgtaatcccagcactttgggaggccgaggcaggcggatcacctgaggtcgggaccagcctagctaacatggtgaaactccgtgtctactaaaaatacaaaaaaattagcccagtgtggtagcgcacgcctgtaatcccagctactcgggaagctgaggcaagagaatcacttgaacctgggaggtggaggttgcattgaggcaagatcgtgccattgcactcctttgcactccagcctgggcaacaagaacaaaattccatctcaaacaaaacaaaacaaaaaaaacaaaaacaaaaacaaaaaacaaaaagcaaagagagaggtttgtcaatcacagtttaaaaaattaaggcaactgggataagcaactaatatttcagccatttgagaatgactctatctcttcgtacacttgcaaatagaattgtaatcacatgagatttcaaccagataaatttggttacccagaaaaaaatgaggtcatgacatagatttgaaggccaacaaaaattacataatcagtgctccgtaaattagctattacgtaggtggatgcacattttgtttcatgtccatgaagattcgaagcgttaagttattttactcatgataacaatctacttcctatcgaaatttcatggagagataatagatcagtatttattctatactgagtatagaccatgaagattaaaaatagctcatgaataagggaaagggaaactctatatgtgggattttatgtaattatggtaacaattccttggagatattgtggtctgttatgtaaatatgtgtaattatgataatttcaaaaaccatgttatttactcagtagtttaacagctccttcacaaagcagtcactttcagaactcaggaggggtatagcaatactttccataaaaatgaggtaaacttaacatctcatgtgaatttaaaatatatttttataagaaagacatcagaatttaagggtatatttaccccatttttactttcacacaataaagtactgctgtagcacagatcattattacccaagttcagggatgacatacacaaagattattattgataaataatcagaatgaattggtagtatttgcatagatttttctggaccatagttgtttttacctgttgtttgagggcctattatggggggcatatttaatatatgagtgctataactagaaattcaaactgtcagagggaaggaaaccatccatctacccattcattaaatgaatatttattcaaggccaagatgtgctaaatgtgggactgaattttgggaccaaaatcttaaatgatgcatatgtcctactattacatgctgtctaacaggcagaggtaatcaggtaaataagtcagtgaaataacatcattggagtcttcacatttcacttttccgggggacaccattcccattgttgtgaaatgcaaagaccctgagtgttctaggtgttataatagaaagaaaagtagggtacaaaaggggaacaattttatatggtagagctaaggtcacttaggatgatccaagttttaatgtctccactagacagccagagtaataggtgaatgtgtgtgtgattaagaaaaatcatccattgccactcattgatatgtaagggacaagcagaggaggggaagcactatcagaggagaatgagaaggaatagttaaggcagaaaagaaaaaaagtgaaaagtacatttttttctgaatgtaagattccagaaggcagtcggtaaaagttccaagagatccacggaagtcaagtaaaatgagagggaagagtccattggatttgaaaattaagtcatgagcaacttcacttagagcatgttcagtaaagacatacaaataaataaaagtgactttgatgataacttttggttggcaacaccaacaaaccaattttgaataattcctccaagaaccgtcatagtgaaggaaaacggagtggtgttcctattctaggaaaggtttttgtttgttctattttggttttgttcttggattttttttagttttagtttcctgtggtattaaaacatgtttatataaagtaaagggggctgggcacagtgtctcacccctgtaatcccagcacttttaggaggcggagacagaaggattacttgagcccgggagttcaagacaagcctgggcgacaaagtgagaccccatctctacaaaaaattagttgaccgtggtggtgcatgcctgtgatcccaagtacatgcgaggctgaggtgggaggatcacttgagcccggaagattgaggttgcagtgagccgtatttgtgccactgcactccagcatgagtgacagaacaagaccccgtctcaaataaataaataaataaacaaaaataaaaacaaaaaaataaaaaagggaagaatggttatatatggtaaaccaggactcctcaagaaagggagaaattagattcagaccaaagaaggagtaagtggctttaatctatgaacaagataaagggttcatccttatctgaagcaggaaagaggaagggaaagagagaaggatggattctaatataaatacatgcagaaagttcttaaccatatttttcacttagaatcacaaaaaaaagacatataaaacaaagtcactaaagaacataataatgtgcttatattacactgaaatgatactctactttcctctaattattattcttccaagcaaatacttttttttttttttttgacacagtatctcactctgtcatccaggctggagggcagtggcgtgattttggctcgctgcaacctcccactcctgggctcaagcaatcctcccacctcagcgtttgtagtggctgggactacaggagcccattaccacatccagctattttttttaaatattttttctttctttctttctttctttctttctttctttctttctttctttctttctttctttctttctttctttctctctctctctctctctctctctctttcttttcttttcttttcttttcttttcttttcttttctttctttttttttgatggagttttgctcttgttgcccaggctggagtgcagtggtgcaatctaggctcactgcaacctctgcttcccgggttcaagcgattctcctgcctcggcctcctgagtagctgggattacaggcatgtgccaccacacctggctaatttttgcgtatttttagtagagatgggatttctccatgttggtcaggctggtcttgaactcccgacctcaggtgatccacccgcctcggccccccaaagtgctaggattataggcgtgagccaccgtgcccagacacacacccagctaatttttgtatgttttgtagagatggggttttgccatgttgccctggctggcctcaaactcctgggctcaagcgatctgcccacctcagcctcccaaagtactgggattacaggcatgagccaccacgcccagcctcaaatacttttttgacccgaatatcctgcctaattgtgtaagagttaatctatattgtccaaagtaccagtaaggtttttcttcttaggcaaggatgttagaaacatattaggtttttctgatcaatatggctcactttttaagaggaaattgttaatatttttgagtcattgactgcctttgtgctgtttcagagaatgtacaagagtgcggcaataaaaaatggcatacgtattgaaaatattattgctctggttttcagttatttagctcaggttttagaagtttcatctgcctggaaatattttcaaacatccatctatattattgccatgtgagtagtggatctagtgtgacattgcctcttctactggcaatgatatggcataactctagtttgaggagtcaaaataggaggtagcagatctattgtgaatatccaaagtgcagactgcctgttcataacaaattctcttatgaaattatacctttgtaagagcttccataatatatatcttatagagaaactcccaaatggaatttctctaacagactttgccaaactttgatttcttggttaccgggctatagttaatgtgttcataatagcatattgctaacacaaccattaacatgacccttgaaaaataaaatttgatttcacaatgtcacagccgtacatggaattttgaaactaagtcttcttataaaatcattttgagaggtagtttatttctaagtgaaggttacttgtaaataatggtataaccattagcttttgacttttaccacaatattgttggctagtcataatgttcccattcataaaggataactgtgtaatcatttgttattcagatgttgtgccaaaaatccaaaataacatttattcttatttctaaaagtatcagaacatttacaatgaagctgcagttgttttttggtttttgagtgaaatatacaaccaataaacaggataggattacagtatattctgataaaaagctaatttggggcaaatgagccatattacagttgttacctatcacttgattgaaaccaaatcattatctagctttggataaccatgcaccttaaattgaaaattctacaacccattctatggcatacttctgaaaggctctggagtttctctagatgaaatcaaacacccaaagaacatgaaattttggtcagttttcttttacgtgcacatgaaatcatgttctgtcaagtgtgaagattgcggcaggtgttatgagtcagcacacagcataagcaaagctgtatgattgtctacctaatgttctcacgatgatgtttctgcatagttatggaaataaatgtctgtctgaatttttagagcttcatcaccacttatctgaggctaaggtaaatccaaggaggatgtaacatctttttctttacatttttgactatatatatatatttcttttaaaagttagcaattaagccatttctatgtgcctaacacagtgctaaatccttgatagctgtggaaaaatagctgtcataaatcactgtccttgtatttgtggatgctggtatataattttctgtagaaaggtttctgatttgtatttactttcatggaaatcagtgacaggaaactggaaagtatgtagggggtggaaagatcatttgagaatgatgcaaatattgtttgaaaaacttgtatttatatttgtatgctctggagatgcatatatccaaatttaacctcatgaaaattccaggaactaaaaccttgaagaccagaagatgcataatctccttaacaaacaggcttgtttcacatcagcaagctatgatattaaaagggtcagcctatctcaatttgattgaccaaattagaaacctatttaggatgcaattataatgcataagagatcactgtgctctaataaatcctgaaacacatttcatggccagcaccaaggtaaggggctgcccaagttaaatatagaaacatgtactgtgaagggtcagaagtttgcttcttggcatgcttttattcagcactccatgattatgcagtagtggccagtgtggtgtggactttgaggacttgccttaccaccaactagccaagtgagcttggaaagaccccttgaactgttctgttactgcaatgatctatgagacaatagatttgaactaaatcattcctaatagtcttaatgaatagcagtttcattagtttagtaatgggataatactaaagaaaataaaaaccccaacctttgttaggtacatagagtatagtaaagtgattcagataaaggttatatacagagaacaaactaagaattttttttaagaagtaattgacaaaaattgtgtgaaggcaaagagagctaccagtataaaaaccattccaggtagtgtttgtgtcttcagagagaaagaaaagagaccagacaggtctggttaggatattgttggggaataggtagccaagcaactgcatgaaaagccaccaaagggagccttcttcaaagggatgggcgcatcactgagataatccctggcttagcctttgacaggcttgcatctcagcattcacttctgtttgagctattatgtgctgacttcagcatgggagcaatgaaattggggcatgactacacatttcattaccgactcccaagccctgggaaaataatacttttttaaaaaccctgtacctaccatctaataaggtaatagtcaagttgtcttattagattattcattaatgaaacaaatctgtgatgaaacagacttcagatgaatatagctgtaatttttttatcaatgacataaaactgacctgctaaaacagtatagcaactggtaaaatagtttattaaattcttttaaaatatgaccagttacattatatagaaataactggactgtggtccctaaaaaaagagaaatctgcttaggaaaaatgtaattaaaggcgacaaaagaattggactgtcttactcaatgtaaaacttttaaatcaatcttattattttaggagattcatacatgaggactgttgcttttgtattagcttaacaagcacccagggagtcctcctaatagttaagtttatagaattaaaagaagtagggctaatgtgggcttattttcctaatgtgcaacattatttggtattccaaaaaaagtacgtgatcatttattcttttctttgacagagtttcagtcttgtcgcccaggctggagtgcagtggtgccatcttggctcactgcaacctctgcctccccgcttcaagcgattctcctgcctcagcctcccgagtagctgggattacaggcacctgccaccatacctggctaattttttgtatttttagtagagacggggtttcgccatgttgggcaggctggtcccgaactcctgacctcaggtgatccacctgcctcggcctcccaaagtgctgggattacaggtgtgagccactgcgcccagccgcatttattcttttaataagcatatattgaaattccactcaaattaaagggatacatatgtaaataaggactctgcactgagaaggttaactttagtggtgatccaatagaattctattagaatagactaatggatttatataatgatagtacataataataaaactaacaaatatataataaagtataatattatattctagagaatttggaggaattttatctagataagccagatatattttggtcagttgtgagaaagagtgaaattaaaagtaaacagctgggaatagtgcatattaaaaagctgtagcaacagtagtggtgataatggtgatgactgtgatcatgagaaaaagaaaagaagatagaggaggaggaaaaggagaggaatgctagctaaccctgtagatcttactgtgtgctagacatttttctaagagggtttttatatatgaacgagttaatcctcacagcaatcttttgaagtatatgctattattggtcccattttacagttagggaaactcagatacagaggatttagcttgcccaagatcacatagtaagtgtataattgcttttaaaatcagagcatacccattaaatataaaggtaaatattccagagaaagtctgaaaatgttgacagtttatatcactcaaatatctaccgtagccaaatagaaatgtgtataaaatagggcataagaaggagtggtgggcacgatagcaaattggagagcatggatgataaactggagagctacagcccagctaaacatggctagtgaactacaattgttgtggcccgctagaaatgctgtctccgtgttatcagatcatccaagtttggaaaggatctgaaatctggattcataagtgaaacctccaggttattaaatatttggcatttaattaatttttaagataaaatgttagtgggcttgagaaaacacatcagtcactgtgtttgatatatcctgagagccaccagttcatcattccatcattatacagaggcatttattgacttttcccaaatgtctaataatctgaactcagaacgaaatatgtagtagctaaaagtcactttccctcaataataaatattgcttatagcttagtgggttgatttcagtgctaagatattcatttgaagaataaacacaggaacatgtgaaaatcaaagtctagcaacctattttcagtttgttgctttagcttttcagctccaacattgtgagcatccctacgtttagtctgaataacttctcatggactgtggctgtcttattttatgtctctaataccagattatgaaaatcacagaaaaaaggaaaaaatattatttccaaagagtaagttatgaagccatgttagaaacccatatgacaatatgaatttcttttatctgtcaatctcaaggtagaattcctcatatttctgataatgccaaataccatgaaatgtctcaaaaaagacttgactttatataccagttgtttgtcttgctgcctcacttcttcctttcttttctttctcccttttatctgcacccaagttatttctattctgtgttttattggttcttaatatattattatccttgatctctagtcctatcataacttcattttttgtaccaaatgttgctttgtaacatagagaacttaaatgccaatcacctattaacaagctaataaatgtcctggctagaagtgtcataaatggtgaagggtcttgacacaataccatgtgaggattacttaaatagattagggaaataaataatatgtagggaaaatataatagctatgctgaaatatttggaagattggcaatgaagaagctatagtgtttggctagtttgaaaatttattctgacttggaacgtgtggaagctatgagaggtagagtttagtttaacaagtgaaaatatctcttcataaagagattaacctaaaaagtataatggatacctcaaaaaatagtatgttatagagaaagttccagaattgtcaggcagaaatagttaacctctgaatctgtgctctgtctccagaaatctagacagaagctattaagtaatattatcatttaagatgatttttatgacatgacagaggacattatttaaaaattttttttttttttttttttttgagacggagccttgctctgtcgccaggctggagtgcagtggcacaatctcggctcactgcaacctacgcctcctgggttcaagcgattttcctgcctcagcctcccaagtagcttggaccacaggcgcatgccaccatacccagctaatttttgtatttttagtagagacggggtttcaccatgttggccaggctggtctggatctcttgacctcgtgatctgcccgcctcggcctcccaaagtgctgtgattacaggcatgagccaccgtgcctggccagccagaggacattattttatcgacagcaactacaaacattgaaagagactacaacataaactgttattattagagaccaagggtttgttgctagataagaatatgaataaataccatattctcttgtattgagcttgtttttcaataagtcactgaacaacaataattaagcaatgaagccaatacatctagagaaaaaatttaagaaaacatcacaatgtttcaataactatttccatctatacatatttcacacattataaaataatcagttatatcacatggttttatttttaagttcaaaaagtcttcataggctgagctcaatggctcacacctgtaatcctagaacttgggaggccaaggccaaggcaggtgtgcttgagcccaggagttgagaccggcctgggcaacatggcaaaaccccgtctctacaaaaaatacaaaaattaaggcatggtagcatgtgcctgtagccccagctattcaggaggctgaagtggaagggtcacttgagccccatggatgttgaggctgcagtgagccatgattgtgccacttcacactaacctgggtgacagaacgagatcctgtctcaacaacaacaacaaatgtcttcatagcactttctccctactcgagtcttccataaagctgttgaaacacatgcacattatatctgttttttagcactctatctggtaatagtttgtcaaatacgtgctggactcactattttaacccatatttaacccaaggttgtggcaattatcaaagaaaatcaagcaacattactgaacaaaaaaatattttctatgttgaattatgtagttaatgttccatcttctctttgctttcctatccaggtctagctttaggtacattacaaagtgaactgggaagaaaatgctgacatttaagtggttcttgttgcatgtttacattaagaaataataaggccgggcgtggtggctcatgcctgtaatcccagcactttgggaggccaaggagggcaaatcacctgaggtcaagagttcaagaccagcctggccaacatggtgaaaccctgtctctactaaaaatacaaaaattagccgggcatggtggtatgtgcctgtaatcccagctacttgggaggctgagccaggagaattgcttgaacccaggaggcggaggttgcagtgagccgacatgcgccattgtactccagcatgggcaagagtgacactccttctcaaaaaaaaaaaaaaaaaaaaaaagaaaagaaaaatgcactactgtagaatatcttaataattgtcttcagaataagtagattttaaataactacgaactaacacatagtgctttgcaagtgaagtggaaataaattcttaaacaattatatttaatgcaaaaaagaattataaaaaatccctataaagaaaataatgtagactgcattataatcttagtctgtggccctgaaaattttagtcactaccattagtctctacagacttaaccatgtcatgcttcagtgttcgccagttgtcaagaaaaaaatgtttcctggagaaaatgagaacagtcctacctttaagcaaattgattttgatgccttttgtcctagaaatgcacttgtactttattaatgttcttatgtggatcattttgttttgctggtgattttttcaggtaattctgcatgagggagacagcagtaaagaggggagtagtaaagagggaagatgtagaaaaaacactgctggatttagggtagacatagcttgaattactcaaaagcatattccccttcagctttattgagatatgattgatgaataaaaaagtatacatttatggtgcactacatgatgattttatatgcatatacattgcaaaatggttactaccatcaagctaattaacatactcatcaccttacatagttaacttttttttggtggagaggacatgtaagatctactctttttttgtagtctacagtttataattatacaaaacagtgttaactgtagtcatcatgctgtccatcagaattcaagaacttatttatcatataaccgaaagtttgtaccctttgatatttcactgtcttttttcagcatgtttttaatatgtttgtacctttttttttatttcatattttgtgattcctcttcaatctctttgcttttactctacaggtttggcttaggggaagtgtggagatgttggtcaaaagtgtattttgatttaagtttgaaatctttccctctattttccttatggtcgtcgttcgtttttctacatgaaagcagagaaatatgaatatatatatatatatatatatatatatatatatatatgtgcatacacagacacacatgtatatgaatgacacttttttgcattccctgttttgcccaaagctgatagtgaactgttatgttagaatatgagatgaaacatctgattcaggtcagcatgctcaaaacaaattgtagggcttcatttcctgaagtctttttcttattcatttcatcccagagaaatagaagccctctcatagcttaaatttgaagcctaggtgtcaacagaaccggtcactatgaaagtacaactgtaattaagtggtctgcaggtcatctcaacattactgcattgtataatgttctggggtgcatatctcaagctctttatttctgtttcttccctacacctatgtcagctttttcactgtgcaataataactcctatttatcagtaaaatagatgttttaaaacatgatattcttaaagctagtttgacaacttaaaaatagggaaatatgttaaacagatatgtttttaaattttccgtacgtttccttttatttgcctactccccactattgtagattatttaaaactgccctctgtccaaattgtatccttttggagaaagcattttaagtaggagaatccattaaacgcttttttctaaagctcaaactgagaggaaaacttttacatttaattaatgagaattcagctctttaaaagtttgatgacttttcaaacttatataatctgattccatctctggggaggaaaaaagacattttggttttattaaagaagaaatgaccaaaaacattgaccacacgtttgctgttaaagataaccgtacttaattcaacagaaatgggtttttcaccgagtctaaatgacctgcagcattatagaattggctgccattctctctcagtcagaaatcaggctgtggaaagccagaactcttctctacatctagtacaaagattgtgcttagggtttaaataaaatgaaaagaataaggtggaaaattagaatatgttgaaggttgaaagatttgattctgtgacttttacataactcaggaaggaaataacccaattcctctccacatttagtgaaaaagcaactcaaaaccatagaggctgagaactttctctgcatggcttttcaaacgatttatataaagatgttggagaaattcacaaagacctggataatgttggaaaatcttgtgttttgaagacaggacagagctgtatgatgcaacaatgccatctattggcttccaaggaatggcactgaccacagctagtttgtagtgtctggaaaaggaagagattatcagtttggaacatgtgaatataaacttattaatgaactagatgctatctttcgtattctttactcctgaatgtggaactatacatgatgcatataccacacacatataaacataatgcatagagatatgctcacctgcatcttcaacaatcctctccttgatgctagaagatgagcttgccttatcatcatactgatacagtagctgggttttgtcttcctgtggactagtagttgtcatacaagaggatgtgtttttaccagaactctttattcagggtgttactcatgtcttagtctcccctgctctgctaatcccaactgttactgtaatttctaagcacactcagacaaaaacgtacaggactggggcttctctcagttgagccaaatcaattctacttccagatattgcaatccagagtttgatagagaatttttggctgctttgaggaaagaataaaacatttgattgtgactgtcttagtttccttgtttgccctttaagttcattaaaagatacgtcctataagagtcagttgtgaaacctgtgcaatcatttgaaatgagagtatagatttaaaaataaatacatgcctgatatttacatgtgatttagaaaatatacagggagtacacatattatttcaaataatattaatactaagaggctcagaagtgccataacctaaaaacaataaagacatcaaaattgtttccctaaaatggaactagaagttaataaagcaatagttccaaaaactttttgtttttaaatattgagaaaatacaaaacaataaggattttgttgggcaataaattgggaggcattttcccctgattttcttaaagatggtcaaaaaaagtaaaataaaataataggttcccaaaattcttccattgtatgtagtttttaggttgatggttgcacatgtgtagtatagtttttgaacaaccattgcaaataaaaaatctgtgctaaaaataacctttttatttaataactcccttctcattttcatcaatttgatcacttgctttaattcatgggggttctaggtggcacttcaactgactgctactgattagtaatttaactaattgattgtcaaattgtaattattgctatgcagcataagtgtttacttgaggatagtaaggagtagccaagtctttcttatttaaaacacttacactaataagactctagtcaaacaaacatatttatttgaatactgtggctcatttgaaagcagaattaagttataaaacaataacccattgtattgtttctgctttctgagtaaaaacaaaatagcacactgtttcccaaacttaagtgcttctaggcccaccttgtctatgtctgccatgtctgattactaactgtggtttatacacaatatatttccttaagttgactctcattttttactgaaatatattttcaaaggaaattttatatcactttcataaatgaaaaaaactagaatatctataaatagtaaacaaccatttaaaaattgatcataatactactgttttaattaatataataaaccattattacatctaattgatttatcaaaaatgaaataacttcttcaggattaaaaaaatatatgtcatcagtcagcaataatgacatgtttggcttaatttaagttaaggaaaggttcttggttaacaggaagtttctatttttagttctaatgatgactagcagtgagaatcacaatttgcatatgtaagttttgaaaaaaataaacatcatttaactagttattgtgatagtgttggacactgaaatcaatcctggcaacatgttgtgagtgactttgactcagcaaatctttgtgtcaagaggccatttgaagcttctgctctttagaatgggctacgttatttaatagaatctatattaaccagtcattactgccatgttgcttggaaactgcaaagatgttatatcaagttacttagccatcttttcataaattttcattaaaatatgactgccaaacaagatcaatcaggtgaccttgatatattaggcttttctcatattgctataaagaaatacctgagactgggcaatttataaagaaaaatggttcaattggctcacaattccacaggctgtacaggaagcataaggctggcatctgcttggcttctggggaagcctcaggaaacttacaatcatggtggaaggtaaaggggtagcaggcagttcacatggccagagcaggaggaggggggtgggagataccagttacttttaaatgaccagaatctcaagagagctcactcaccatcactagaacagcatcaaaggggaaatctgcctccatgatccagtcacctcccaccaggcattggagattataattcgacatgagatttggtggggacatagatccaaaccgtatcactttgttattggtagttgtttgtgggttgaaagcatgaatgatagaaagacatgttctcaggatgcaggctgggataaagtagaagaacacgttctataaaggaacacttattatgtgttaggtactatgctaaatatgttacattaattatcatctcatttaatcctcactacaaccttcctaggtaggcattatttctactcctactttgcagctagggaactgagatcagacaaggtgaagtgatttgattagtctcttaagttaaacttactgccttggtgagcaatggtaaggtattagatgctacaggtctgctgcatacccaaaatcctgaactttggctccaggcctggtctgtgggtcccaagaaaccaaagtgtaggcgagcctagccctgagggatcattcccaggtttctcctcaacccttcttgcccagcctttccctggaaacccaatagcagagagcataatcaagaatgtataaatgtgattataaggagccagagcaagaaatatttcttttttcttccttactgtctacctcacctggtttaatattccctaccacctcattctcacagtctatgcacctatactttagtctgggtacccctaaaaaattatttcttgtaccatgagtgtgcatgcccccctttgggatcactgacgattaaaaccagttccaaatttacaagcctcttgggatatgtttgactcccatataaatgtagctattttatatatttttgtgtatatatgcccattttaatatatgatgaaaatgagttctctaaaaatgttaaaatatgtaatgcatttctgaaatttacaatgagtgcctttcaattcactatggcattgttataaggcggatttttagttgtatcgtagttgataacatattggttttcttttaaatttctagattttttgttttacttaaagaaacatctattggctgggcatggtggctcacgcctgtaatccctgcactttgggaggctgaggtgggtggatcaactgaggtcaggagtttgagaccagcctggccaacatgatgaaactctatctctacttaaaaaaaaaaaaaaaaaaaatcagccgggcagggcatggtggcaggtacctgtaatcatagctactcgggaggctgaggcaggggaatggcttgaacccaggaggcggaggttgcagtgagctgagattgcaccactgcactccagccttggtgacaagagtgaaactccatctcaaaaaaaaaaaaaaaaaaaaaaaaaaaaaagaaacatctatttaatagaaaacacacctaaaaactaaaaaaaaaaaaaaaaagaaaacaactactgatctcactgcctggtattaactacttttaagatttttgtgtatatctttctccatttacattgatttttaatttcagttaagtgagaattccatctcttttttatagctttcactttaggagtaatttactttagttgagaatttcacattcatgtatcttaaagtcctttctctttttggattatattattattttatttttagtatagacaaagtattcttgcttccccaacaagatatggaaattcatatattttgacaaaatatgatgctattttccatgtaaaggacagatatgttttctttgatttctttttctcatagacttgtttatcatttctcttgctctaaattttagaaaggtgttgtttttgccttcctgttaggcttcacctgaacagttatagtgatggtgtggaaggcaattcttactatattagtcatttgatggtagtctgcaacttcaggggctctgtcttaatagttttacattgctataattcagtggctttgaggtctagcttaatacccaaattactaatatatttaggattgttgaaactgcaaatgttcaagctttacctcaaacagtccacaagatattccctaggcttcagggtttgagaatcctctaaatgaacaaagcccattaatccatgctgtatcatagtgactgacacatggtaaactcaataaatttatctattttaagttaatagaattctggcaagattatctgttcattgcatgtataacatggtgaccttaatcttttgggtagaaataaatcagctatcacttatgattttctcaaggaataatggtaccttttcaaaaggataggttttatatactatgagatgtcctgatataatttgaattcatggcaatactgcatttgcctttttttttttttttaccatctttcaagagggctgcctagagataagaatttaagggccatgtgttgtatttttgctagtaccttgaaagaagtttttgctttgtttttaatggcaatacaaataaaatccaaaaatcctggacacatatgataagttcagttgtttatttgaaaagtaaatgcctcacatgccttgctcataccactttaaaatgggattgattgataaacacaaactctaactctcttacattaaagagtatcaacactctgaatttttaattatctttgataatccccatgaacatttttaggactcacacgtaaaatagtcaagtctatttcaagttatgtcagacaatgctttttaatatactgttcagtgcagcaccctaccaaaaactagtcctgtggttgctttatctaattgtgccttggtaagggatttgttaagagtggggaaaaaatacccccagaaatgctttaattaaacagcttcaaatacagccattgttcttacaacagaattgtgtaagtcttctccctgaagagaaatattgctgtagccaatatagctatacaattagtctatgtatattaatgtaaatataatttcattataaaaatgcttactcgtacagaatctaatttttatctgattattttttcaaacactggccagtcccatgagtgaaaatacctataatgtaaggtcagttgccaattataaaaaacattgtttagatggaaacccagggtattcacccaatgtggttattacttgtgcttacataatgaaatttgatcagcttgttttaaaataatctatttaggtcctagtattcacaatatctcttcccagaaataaagacttccttgaagaaagtaaatgatttgaactggaaaaacatgtaagaaatttaaaaaaattaaatatatatttattttaatatatgtatgaagaaagtttttcaagatgttatgatgaaattgattttctttgaggtccaaaatggcctttacatgaggtataggactaagattttagtaaaaagcacgtaccttggtcatcacagaattgttgggaatcattcagagaccatgtagaaatgtttcccagggtgagaaagactgaaccctagactaatattggctctgccaaaaataaaataaaataattttttaaaaattaaagaacttatggagggcacaccctttcattctgtgatttccacgtcaagaggtctcagtggagcatacatctgaaacaaatcatttaagctataaatttagtcactaagatcatctttagatccaacattgatatgttaatttatgaaatcaaaaagtaatatactttatagcttcctcctaaatcttagaaggtactggaacacccatactttgaccattcttttacgttcactaaatttcctaagagtgtcatggaaacagaagaggaatagaaaatctatcaggtaaccctgccctacctggcaaatttttgtgttgtagttgcttttgtttaacatttcttttatcagttaattatacgctgatagagattttagatggactcttggaactccaagaaaaaagaggttctgattcagatgctcttggaaatatagacacatttgagtgtcttaaaagcatacacgagacaaggtctattttccaaaggtgcagagcaagtactgaagcttctccacttgaaaacaacagtataaaaactaccattaaggccatttgttcatttgcccaaagtatccaaggagttgtttaagctttcagccccttatgcatttccatcaaatatgaatatgtgttgctccttctagtagttaagaccagtgacacccatttcttccttgatggtctatattttattgggtatttaattacagagcaatcaactacactgaaaaaaaaataacttgattcagttaagttcttaccccacaatgctcacaggctttactgattatacaccacctcttatgtgcaattgtctttggactaatcagatgtgatgggcttaatgttgtttttaaaccctaacaaatctggtcataggcaaagcaaacctgctaaagatgaagggactagatttaaatgaccttgctgacttccagacccttcttttgatcgtgggcagaatggatatgctcttgttgtggaatataactatgtatggatttataaaagtttgtcaaatgaaagttgaaagttctatattcactttacccaatttactagaaagggaaccaattttctcgttaattacaggctgttagaaaggcgtaatgaaatttcacaactgtccaactggtgcttgatgagaagattactatctatggatgagggttatgtctacagttctttaatctttcctttctttctttttttcctctatagtgtctcctctgtttctcccaaacatctgctctattccttttgatgtcctgttagtcatccccattccatgccactaccactgctctccttttacacttcctttcttctgtcttgtgtcttctacttactcattgcatcccctgaattgttgttgttgttgttattgctgtagtttaaacacatattgacctccatggttaccctgttcaccttttgtgtcaattcatcattttacaattattataatgtatcattttatttatttggaaataatatttatttggaaaaatgtatttatttggaaataaatgtttcatttccaagtttcatattagagcttggatactcaacttgtggtccttggaccagcagctgcaacatcacctagggacttgttagaaatgcaaaacctcagcctctaccctaggccttgagtcagaatctgaaattcaaaaagttactgaggtcactggtgtgcacctgagagtttgagaagcactgtgttggaatacattctcattaacagaagaatttacaaaatagtgttagttatttggtatttaatgaggaaaatggtaaaagatgtttagtcctttttttctcattacattggaagcatatgaggatgcagacatccttcttaactatttaataatgttttaaaaactttaatgtatggccgggtgcagaggctcacgcctgtaatcccagcactttgggaggctgaggctggtggatcatctgaggtcaggagtttgacaccagcctggccaacatggtgaaaccctgtctctactaaaaatgcaaaaaattagctgggcatggtggtgggcgcctgtaatcccagctactcgggaggctgagacaggagaatcgtttgaacccgggaggcagaggttgcagtgacccaagatcacgccattgcaccctagcctgggtgacaagagtgaaactgcgtctcaaacaaaacaaaacaaaacaaaacaatctttaacgtatgatggtattagctgtcatttaaagaagatttttaatcagtaggtcttgcaaacgttacgatttatcacatgtatacagtcaaaagacacaggtaaaaataaacttcaattatttcctttgaagtctgaaggccataaattatattatattgatgtttggttgataaatcaattatgtttgattattaataatactattataggtagtgtttgtggaaaatttactatttgacaaacagtgtacaaaacactttataaaagttaacttatttggtccttacaataacattactaaatttcaaaattacaactttcattttcagaataggaatctgaaggcaagtttcatagcttaaatagtgggcagaactgagatttaaacccaagtctgtctcatgctacaactgcagtttgtaaatcccatgtgttattacctccgttagtcgataatgtacagtttagttcatcagctatgctagtgatagaaaacaatgataccataacagcagcaaattataggcatttgtaaacttttcagaatgaaagttggtagttcttttaataatctcactggaataaataatctcccttcattttagtctttttatgttagacacgttttctccataatttctaagaccttcaaaacattgcaattatatattattaattattaatagcttttatttggtaactttgtaattatatttatatgagtttctctcctcagtattatgtattaggccgggcgtggtggctcatgcctgtaatcctagcacttagggaggccgaggcgggcagatcatgaggtcaggagatcaagaccatcctggccaacatggtgaaaccccgtctctattaaaaatacaaaaattagctgggtgtggtggcatgcgcttgtaatgccagctacttgggaggctgaggcaggagaatcacttgaacccgggaggtggaggttgcagtgagccaagatcgtgccactgccctccagcctggctacagagtgagactccatctccaaaaaataaataaataaaaactttagacaaatttaatattccaggattaattgagcaaataatgatttacaaatcagacagccctcagaaccaacagaggttcagaaatctccacttcacaatgtggacaggcagcctttatggacagaaaacagaagagctgtaaagagaccacttgatgagttacagtctggagcttgcctcccttgaacatggtatgatcagttggctacctgtgattgactgaagttcacctactagctactttgattggctgagactcagctagttgttatgaaagtctactcctgtggtagactttcagttagtttacatactaagttatattgtagtttgttacataaggactcaagtacagaggcatgcttaagtcaaatttagtttaacatgtggtagttagacccttagtttcagagtccaactcttcgggttctgatctgggctttagcatttattagatgggtgaccttagacatattagccttctctacttcaaatatctattagccttctgtacttcaaatatctcattgttaaaatgaggatataaaaaaggcacttatctcacagttttgttgtcaggtttaagttagataacttatgtaaattgcttaacacattgccttacaaaaattaaacactcaataaatagtaactattactattatattttgaaatattgacaatagagattttatcacatgcatccttttatatgtgaatgttggtatacaatgggtagttttgggaatgtgtataactgtaagcatgggcaacctatcagtaacttaaactgataatggcttattttatcatataaaaagaaatccaaactggggtttttgaaggaataaataaaattaacaaacctttagccagactaactaagaaaaagaggggaaacccaaataaataaaataagagatgaaagaggagacattacaaccgataccgcagaaattcaaatgaccattagaggctactatgagcaactatatgccaattacttggaaaatctggaagaaatagacaaattcctagacacatacaacttaccaagattaagtcatgaagaaattcaaaacctgaacagaccaataacaagtaatgagatcgaagctgtaataacaatcttccagcaaagtgcagcttcggactcagtggcttcactgctgaattttaccaaacatttaaagaagaactaatactaatcctagtcaaactcttccccaaaatagaggatgaggaaatacttccaaactcactctacgaggccagtattaccctgacaccgaaaccagacaaagacacatcaaaaaaagaaaactataggccaatatcccagataaacattggtgcaaaaatcctcatcaaaatatgagcagacataattcagcaacacattaaaaagatcattcatcagctgggcgcggtggctcatgcctgtaatcccagcactttgggaggccgagacgggaggatcacttgaggtcaggagttccagaccagcctggccaacacggtgaaactccgtctctgctaaaaatacgaaaaatgagctgggtatggtggcggacacctgtaatcccagctactcaggaggctgaggcaggagaattgcttgaacccgggaggcggaggttgcagtgagctgagatcgtgccattgcactccagcctgggcaacaagaacgaaactctctcgaaaaaataaataattaaaaaatatcatttatcatgaccaagtggaatttatcccagggatgtgaggatggttcaacataggcaaatcaatcagtgtggtaaatcatatcaaccgaatgaaggaaaaaaacataggatcatttcaattgatgcttaaaaagcatttgataaaattcaacatcccttcatgattaaaaaaaaacacccttaaaaaaaactgggtatagatggaacgtacttcaacacaatgaaagccatggatgacaaacccacagctagtatcatagtgaatagaaaaaattgaaagcctttcctctaagatctggaacatgacaaagatgcccactttcaccactgctattcagtgtagtactggaagtcctagctagaggagtcagacaagagaaagaaataaaaagtatccaatttggaaagagagaagttaaactggccaggcacggtggctcacgcctataatcccaccactttgggaggctgaggcgggcggatcacctgaggtcaggagtttgagaccagcctgaccaacatggagaaaccctgtctctactaaaaatacagaattagctgggcatggtggctcatgcctgtgatcccagctactcaggaggcggaggcaggagaatcgcttgaacccaggaggcagaggttgcagtgagccaagatcatgcctttgcactccagcctgggcaacaaaagcaaaactccatctcaaaaaaaaaaaaaaagtaaaattatccttgtttgtagatgatatgatcttatatttggaaaacactaacgactccacaaaaaatattagaactgataaacaaattcagtaaagttgcaggttacaaaatcaacatacaaaaatcggtagcatttctatatgccaacaatgaataatctgaaaaaagaaatcaagaaagtaatcccatttacaatagctacaaataaaataaaatacctaggaattaaccaaagaagaaaaaggtctctacaataaaaactataaaacgttgaataaagacattgatgaagacacaaaaaatggaaagatattccatgttcatggattggaagaatcaatattgttaaaatatccacactatccaaagcaatctacagattcaatgcaattcctatcaaaataccaacaacattcttcacagaaatagaaaaagcaatccaagaatttatatggaaccaaaaaatacccagaatagccaaagctatcctgagtgaaaagaataaacctggaagaagcacattaccgagcccacgttatgctacaggccactgtaatcaaaacagcatggtactggcctagaaatagaaacatagaccaatgaaagagcatagagaacccagaaacaaatctatacatctacagtgaacttatcttccacaaaggtgccaagaacatacattgagtaaaaaaccatctcttcaataagtggtggtgggcaaactggatatccatatgcagaagaatgaatctagacctctatctcgaccatttacaaaagcaaaatcaaaatggattaaagacttaagtctaagacctgaaactatgaaactaccagaagaaaacactggggaaactctctaggacattggactgggcaaagatttttagagtaataccccacaagcacaggcaaccaaagcaaaaatagacaagtgggatcacatcaagttaaaaagcttctgcacaacaaaggatacattcagaaaagagaagacacagccccaagaatgaaagaaaatattagccaactatccatgtgacaaggcgttaataaccacaatatacaaggagctccaacaattctatgggaaaaaattaataatcaaattttaaaatgggcaaaagatctgaacagacacttctcaaaagaagacaagtaaatggtaaataggtctatgaaaaggtactcaacatcactgatcatcagagaaatgcaaatcaaaactacaatgagatatcatcccaccccagttaaaatgggttttatccaaaagacaggcaataacaaatgctggttaggatgtggggaaaagggaacccttgtacactgttggtgggaatgtaaattagtacaaccactatggagaatagttttgtggttcctcgaaaaactaaaaatagaactaccatatgatcttgccagccccctgcaaggtatatacccaaaagaaaggaaatcagtgtattgaagtgatatctgcactctcgtgtttgattactgcactactcacaatggcaaagatttggaagcaacctgtgttcatcaacagatgactgaataaagaaaatgtggtacatatacacaatggagtactattcagccataaaaagaatgagaccctatcttttgcaacaacatagatgtaactggaggtaattatgttaagtgaaatgagccaggcacagaaatagaaacattgcatgttctcacttatttgtgggagctaaaaattaaaacaattgaactcagggagatagagagtagaatgatggttaccagatatgagaaagggtaaattgggagggggagtgggagtggttaatgggtacaaaatttagttaaatcaaatgaataagatctagtatttgatagcacaacaggctgactacactaagcaataatttattgtacatttaaaaataactaaaagaatataattggattgcttctaacacaaaggataaatgcttgaggtgatagatatctcatttactatgatgtgattgtcaggtattacatgcctgtatcaatacatctcatgtaccccataaaaatatacacctactatgtacccacaaaaaaaaatttaagaaaaaatctaaaggcaggcatatgagaactgatgtgccactaagcattaaggtttctttcatttttctgccccgctatcttttaatttgtaagtttcatcctcatgttcacagaatggctgcagtaagctggatattacattcatatttcaggaagatatgggggagaagagcaaaaggggaaatacaaaaacctgggaatgatggggaatgctatctgagtctgtccatgctaaaaaatccttcctggttttcctatgaaaagatttctgcttccatcatcttggcaaaaacctggctaggtagctacccctggctgcgggaaagtctaggatggtaagtattttagttttctattctctatataaaggaagacattggaattgaatggctttggggtaattgattcataatatctactatagtactcattaatcagtcagcagccagtcaatgaaccaaagaaaaaagtcaatatgaaaccctttaaatgaagcatatcaaacctttttaaacaaaatgaaattcatgtatatttaaatatgatgatccctcttacccagtattttgccactaaagtgttagaagtaaggaatgaaactttacacagataatttattttggcagcattgctatggtgctaggaaaaaaattgtccctagaacagaccctgaaaacaactgctcatagcaaatactcataggtgtttctgctgctacagataatcacagaagttgccagaaattaaaatgtgcaaaggataaatacaaatctttctcctttgcaatgttggagagatcttgcttcttttttaacctccataattttgttgccctgttttgcagcatctttgcaatgtttctgggacagctcagtcatcaccatctcaatctcattcaccacagaacaagtgcttgtcaattgtaaatgtgtaatctcaggaaattcttgcctgctctcttcatctctggccatttgtcctccaacccatccattcatagtgctgttataagcttcccaccccagggttagtaatcttccagggctctgtttcatccagaaagccatcaatgggctgtacctgctgcagggggatctttcactttccacacccttacagcctcacatttatgaaagtcttctccaaaaaatcttccttattctattttgaaggaaataccttctacctagaatatgtttcattaatcctcaaggcaagatataattcttccatcaacttgacttgaactaaactgacaccatgctaattttttctttccattctttcctcattgtcaatatgtttttactgattccttgcttcattcattgattcatctggcaaatactttttgagcatagaatatgtgcgagaacttttgtgaaagataggatttatagagatcaagaaaatttagggcatgttctcaagggggtcacaagcttttgaggaggaatgattctacgtttatattgggatagcctctggtgttttggaagtcttgagctgtaaccgaccaacctttcattctccctttccatcacccctttgccaaacacacataccttgctatgaaaaattcttaagggcaacagggattcattctttccttttcttttggctttacatcccgttctacaaggactcagtgggattctaaaaaaaaaattattttttctaaaatattctggaaaaatatttggaataaaattgagatggagtgagataaggatattttcttgacttgtgagaaaaataacacaaccaaacatcatacaatgtgattcaatgaagattcatgaaaaaaatacaatttcaaacttcagaaattaaaaataatagacctaataatatttccctttgtatgtatgtggcatgatgttgttatattacttggtagcagagtggaaatttgagcataatctaggttgagagaaaaggtcattattcttagttctgtgtttttccaatatactgtgttcttcaaaatataccaaaaattataaatcagtaataattgatactttgtacagatttttttattttatattttcttgtttctcttgcaatatcttttctttgattttttgtttgtttgtttgaaacacgtatttgccactgttcaactcttacacctacattctcttttgcttactgaggggaaatgggccccataaaataggtgtaactcagtatctcagttcatgttcaaacatgtataaagatgacctctttttctattcttgagcaaaaactaaatgctcatgatatattcttttatgtaaaatctagttattcaagttaagttctaaatgaatttttcttcatcttatttaagagtaagtactttttttcttccatagtactaggtaatcgttttcagtgatctgaaatacttacgaagaagttaggatctttgcaactgtttgaatctcaaattattatttgttctctgttggctgtaagagctcactcattggaattacaaaaccctttctctttatagctgaaagcgtttaatgtatgcaaacttacatttggcttgagaacatttttaaaaataaacttttcaaattggaatgttcttactgaattcaggcttttatgatgctgtttgatttggcatatgttcctcctgatatctgcattgaaaacactttgcatttgagagacttttcctgccttattgggacatttcaactcaatttatagttatcagtaggaaaagaaagaaaacatttccatccaaaagaggtttcagtaggatttagcagtaagtgctttaaaaagaacaacagcagcaagcttgaacctttgcccattaaaaaaaatatatcaaaaacaaagaaacattacaagattctctttccctttttaaaggatccacagaaggaaggttcttcctagtctatttgaaaatatatcagacttactcaagagactttttttgtctattttacctgatccacttacattcagaatcagtctgaatttattacacaatgttacgtttactgctaaaatgctggtcgttggttcaatacttggatccttcagagagagcacatatccatcaggatgcatttggctttacgtaatagtcaatttttggaagtttagaccatgaagatgactactctttacttaacagaagtctggggtaggtgttgctgtggttggaaaggtgcatgtatgataggtggacagctccctgtttctttataaatggcacatacctggagaactagcacataggtagctcaataaacagaatgttaccaggacccccagaaactccctttttattctgttttggttctcactctccaaaggcaatcagcgttcagagttctgacaatgtaagttatttttcctatttttgtaccttttataaatgcaattatgcatgatatactcctttgtgtcaggcttcttttcttcaacattatgcttgtgagatttactcacactgtggcttgtagttgtagatagttcattctcattactgtatagtgttacagtgtcagaaatatgcaccaatttatatgtctattctactgcttgaggagtttccagtttatggctattacaaataatgttacaatgagcattttgtttttgtttgtttgtttgtttttttgagacggagtttcactcttcttgcccgggctggaatgcaatggcatgatctcggctcactgcaacctccgcctcccaggttcaagcgattctcctgccttagcctcctgagtagctgggattacaggcatgcgccaccatgcccggctaattttgtatttttagtagagatggggtttctccatgttggtcaggctggtctcgaactccagacctcaggtgatctgcctgcctcagcctcccaaagtgctgggattacaggagtgagccaccacgcccagcctatacaatgagcatttttgtatatgagcatttagtatacgtctttgagtaaatacaaacatacaattcggcttgatatatatctaagaaaggaattactgagtcatagggcatacatatgttgagcttcaatgacgctgaagagaaaataacacaagcaaacattatgcaatgtgattcaatgaagattcatgaaaaaaatgcatttcaaacttcagaaattaaaaataatagaccagttttccagagtaagacatctttttttttcattcttagatcatattttgcgttttgtaaatgcgtttcccaatcagcagggaaaaaaatataatatgcaaactaaagcatgtatacaatgaattgcatttagtttaaaacaaaagatttgaaaaacgtaggaggagagagttatatttgtattagttcacaaaagaacatattcaaaaaaaagcaaataattgtattttgagtgtatcatagagttaaaaaggatggagtcaggctttttgaaaattgacttgttttccttctccccttttaaagaagataggttattgaggaaaaataaatttttgtcatttcagagagtacctgttcttttttttttttttttgtagaaaataaaacccacctataaaacatgaagattaagcttggggtagctcaagggaaatgactcaaaccatccaaacacttgttttttcttttttcagtttttctaatgtaaagttaaatcattaaataaaattttggtagctatatttaagtctcccttattttattttttagtaatattaaattattttaggacgcctgattttgtggtaagaaacatcaaaggtcttgatataatttttgaccgatgggctttgaatcaaccaattctagcctgtgggtagaggacagagcactgctgtctcttgcatattaacctttatggggctgctggagttgtggacattgagtatatagtgctagtttgtactcggattgatttattttcaaattttcaaaagaatatctaagttcaatgatattcttttagtttatctctcactgtcaaaaagtctcctccaatgtcattttaagtgagaaagttaaatgatattttgaaacactggcttggggaaaactgcagttcagtttgcttcaatgagaaggaaaaataatttccaatattagattacagtgaaaagaaatataaaagagagttttactggaaggtctgccttttatccttttaacgtttcatggaactagaataagaatatcccattttgtctaagatgtacctttaagcaactttttaagcctcaaggcacttatcttatacattgtgctcttcagctgtattaccagaagtcttttgtttaaaaaagcctttggtaaaattcttcaaatatgaatttaagcctgaacaacaacaacaaaaaggtacttaacattgctgcctttctttatgtaatgatcaagtcctcccatgttctcctttatatcagtaagccattttcttgaatccctttctaaaatgaggttaaagaaaaatgtgacataaatcctatatgtatgttctgatttttaaagggtctttatctttacttttactggttcgaatatagaaattatctcctcccgtttccttctcctcaattagctgccaatggtctggaatttaacgattttacctcatgtgattctatttgtttgtaatcctatattcaacattgtactgaagtctgttaaacattgataagccggtttttatgcagcaggtcctcagagagcattgcactaaaatgctgcaaagactgggattaggtttacgtattgtaaggtggtttcgagacgttttcctagtgtctgttctttcaaaggtgccaaatcaagttggccttgatttaatattgcgaaaattgtaatgctgagctgacttggagcttcacgtacttcaaaacgagtttttccgggggtgatttaacaaacagttctaattttttgagtgctgccgaatgtaacgcacatatgggacattattgtgtagtttctgtgagacgctgaactctttgccaaaaacttaagtttctttcattgctattcaagttataccttcttctgttatctcttgccaggattccaacagcctcagctgatactggtttcatttagtaaggagagtggcattggattgtatttcttctgatttttacaaaataaaaatcctcctgcatcccatagataaccactattagcatttgggattatatctttttcatatgtttcctataggtagatataaattttgaaaaaaaaggtattttgtttgaaagattcttttgtaactcactttaaaaattttttattatgtaatcatatatataaaagaatatatatgcatatatgatacaaagaataataaaatgaacacctgtgtaaacaccacctaccttacagaatagtaccaatgttttgaacccccatgtgtctctaccaaatgttcatcttttccctatcttgcaaagataactgcgcttctgaattttgtatttgtcattctcttcctttaaaaaaactgtttcactaaatacatacgtgttcctaaataatatattgttagtttgggtgtgtttttgaactcgatataaatgtgataatgcatataatcttttctgactcgtttataattccacattttctccgaggtgcctccacactgatgagtacactggtagttccattgttttgactgctatttagtattgtatgatataaacatatggtgctttttacttaagttcttgttgatggtgggtggcttgatctcaacttttgcactgacaagcaatcgtcttatgaaaattcctgtatacgtctcctggtgcacatgagcaagaatttcttcagggccagtgactagggatgagactgttgggttattagataaatgcagtcaaacttcaaggcgatgccatattattttccaaaatgattcacaaataacgctaagatgtcattgtgtcaaagtttctacactttcctcgatccttaatattgttctaaagccttcataaaatactatctcattgaatttacatttccctgatagtgatgttgcacatcattttataagaggtaactatctgtccctcctgttctgtattataattttcatcagcttttatattgttaaatattttctccctgtttgtaggttgtattttcacttttcttttttttttttttttttttttgagacggcgtctcactctgtcacccaggctggagtacagtggcgccatcttggcttactgcaacctccatctctcaggttcaagcgattctctcacctctgccccccgagtagctgggactacaggcaggcaccaccacgcccggctaatttttgtatttttagtagagatggggtttcaccatgttggccaggctggtctagaactcctcaaagtgatccgcctgcctcggcctcccaaagtgatgggattataggtgtgagccatggcacctggccatattttcactttattaatagtataatttgaagattagaagttcttaattttaaatattatcaaatttattgttaatatttgccttaacggttagtgatttgagtctcatttaaaggattatttcctaccctaagatcatacaaatattctccaatattttcttctgtaatgttaatacattttctgtttatctttataatctaccaggaattgagtctttgaatggtgtgagtgatttgatttcttttttttttttttcaataggaacagtcaggttttccatcactgcatattgaagagtctattcttcccctactgaactgcagtaactaccctggtcctgtatcacatgtattagaatagaaccagctgctataataaatattcgccaaatgtcagtgacccaatacagtgtgactggttttagtcaatgctttcctccacttgcttatttaatgacccaaggtccttctctttcatgtctgaccattcactaggacattatagtctactgcagccagctggcagatggaagaagaaagggtagagaaggcatgtcaactttggtttttttttttttttttttttcctgaggtggagtcttgctctgttccccaggctggagggcagtggcgagatctcagctcactgcaacctccgccccccaggttcaagcagttctctgggcctcagtctcctgagtagctacgattacaagcgtgtgccaccacgctgccaccatgcccagctagttttttgtatttttagtagagacggggtttcaccatgttggccaggctggtctcgaactcctgacctcgtgaacctcccacctcggcctcccaaagtgctgggattacaggcgtgagccaccgtgcccagtcagcatgtcaacttcttaaacaccttgtttagcaagtgattatatcacaaccgttcataatccattggtgaaaactagtcatttagccctatgtaaatgaaaagattgctgggaaatgttccctgatggaaagcagcttctcagaagcatctctatctacagtgtgggataatatgaatttggggtgtttagctagctgtctcaattatatcaagttttcgtatatgcactggtctttgtctggtagggctagtccctcctctttattgatcttcttcaagtgtgtctcagctattctttgtcccttttcaagtatcacaaagaaaaaagtcactgtttgaattgggaagctctgaatctacagggcagtctggaaataatatatttacataatgaggctacttacccattagcagtgtacctctctgtttacttacatggtctgaaatgtctttcagtatactttacagtcttattcaaaaggtcttatatcacttttgttggatttattcctagagattctgcttttttgctactattataacctgccttttctaaacttccctttcatgtctgccaatacatagacatgaaattgatttttgtatgtaaattttgtatcttgacatcttggtttggtttgttattaattccagtaatttgtgttcagaacttttggagggggcttgtatgcagatgatcatattatatatgaataatgataagtttttatttctcttctaatttttatcttttatttgcttgtctaactgaaaagcagtgataggcatctttgatttgttccttattttagagggaattattttgacatttcatcatcatatatagtttgctctagtttttttgtaatgcattatatcttctttaatacattgcgtgattctgtttgccaatatcttctttagaattttccatttatgttcacaagtataatattagtttatgattttctgttcttatactgttctgtgcttagttttggtatcaagattattctagcttcattttggagttgaaattttcccattttctgtttcctaagaatttcttatgagtttggaatcatctgtttttcaaaagtatagtagaactcacccataaaaccatttgaggctgctgttttctttaagaggacattttaacgctaattttgattttctaatagttaaagagcttttcagttttctcagctcttcttagatcagtgttgataaattctgtgtttcaaaaaatgtgtttgatttattttagctttcaagtttatgggcatacttccttcatggcttttaaatctcttgtgagaatatatgcacacctcttccctttattgatgtcttctttccttttgtcctgatcaatttttcaagtaatttaaaattttgtctcttcaaatattgtctctttaaatattggatattttgaagttctatattgatttctgcccatttatttttttttctgctgctttattagtatttgtttggtttttcttttgttggtttgtttgtttttttgagacggagtttcactcttgttggccaggctggagtgcagtggtgtgatctctgggctcactgcaacctctgccttctgatttcaagcaattctcctgcctcagccgcccgagtagctgggattacaggcatctgccaccacacctggctaatttttgtatttttagtagagatggggtttcaccatgttggtcaggctggtctcaaactcctgaccttgtgattcgcccgcctctacctcccaaagtgctgggattagaagcatgagccactgagtccagcctatttgtttttccaattaagtgtttattatgtgtatttatgttaactttctactataaatattacgaatttttaaaattattccttaaaggacctcaaatattttgctcatttacttctactatgtttacatttccattatgatttcttcttttacccatgaattatttggaactgtatttttaaattttcaaatgtattttcaggttatctgtgttatttctgtctaatttgattatattgtatggtatcaattttttaaaattctgagaatgttttattgcacagtgcatgacagctttctgcaactgtttcatatgtgcttaagaagaatgtgttgagtacacatttggaaacgtgatttttgcaggttcattaaatcaggcttgttgattgggttaatgggatcttccacatgcatgtgttgaaatgacccactaagctcccagatttgattagttaccttgtagttctgtctgtctagtttcccctatatatgcggaggctgttttctgaactcatttaaagtttggaataattttattcaccaggaggattgacctttttattgttatgtagtcttttgtctgatatattattatataatttatatgttagctttcttttagtttgtattttcctggcatatctttagctcgtatcctcaagttttctgttctcggtgtttatatgtctctctctcccttataaaaagtctattgctggatttaaaaaatctgtaactccacagatatcctgtctgaccacttttgcctttcatatagggcttttagttcactcatattttcatgtatatttattacaattacttttatacttgaacttatttatagcattatattttctgatgttgactttctttgtctttgctcctctttttccttctttactgccttctttttgagtggttgagttttatattcttactctaattttccttcttccattttggaatttgtgcactctttctattattttaggtgttactcttaaaattttactatgggttatttagcaaattaaagaataatcaatggtttagtttttctttccagataaattaagaacctttatgaataataacttctctctcattgtacccgttctcattatccagtgtttagttctattttgtatactttaatcttcaatattacatattatagctatagttttatataattaattttatttaaatgtattcacatgtttaccacactctttgtataccatttccaaaatgcttgggtaagaattgatactttgtccaatagcaagggggggattatggacatttttcatctgaggaaagacatgatcaaaatgatactttaggaagattaatctgatgcagtcaaaaaagaatggagggaggaggagatgataagtagaaacacaaattaaaggctatgacccgggaacttggtacaatgatttgaactagaggggtggtaaaggagaaaaggagtaagaacaggaagtaaaagtcactgtgaaagaggaatacacagaaattaacaagtggtttgcttgaagtattgaagaaaacaaaaataagaatgagatttttgaaccaaggttactgaaatattggtgaaatattagcaagtaggaagtcagagaaaagagctgctttcaggagaaagataaagaaatgcccatggcatataccaatgatacactcagcacagaggtctacatacaacagagtacttgtaaatacaatagggtacttgagagaagttaagactggggaaataggtgttatagtggtaagcatatatgggtcattagtggagaaaaatatcgaagagagtgaatgatgtcaaataaaagtgctttgtgtaatgttggacagagatatacccccaaagaaaatgttcaaattttgaaagcccaacaagagtcagcactggagatacagaagtcaagtcagggagaatctgcttttgtggaatatcatctatatgtggtactgagatagatatttcatatatattacctgatataactatcaaatgaggaggtggtatggtaccagtggaggagaatcattcaaaaagaacaaggtgttcagcagtgtcaaacgatgcagaagcactaagatgagaatgagaattaaagaagatgtaattgtgtgattaggatgtgattgaaacgtttgcagataatgagttcccagggaaagagacagaaacaaaactgtaaggacttgatatggaaatgaatcctgtgccagtgaacactgaaatgcaaacaagacttaataattcagtgacaagggattgtagcaaggctcagagaagatgcttctgatttaaaatagaatagctaagttatgtgacgaccatactgtctatacataatagacactaaatttatttgttgaatgaaaagctaagtgttcagagtttgaaaaataggaaccagagggaaggacaaataagcaattgaaagttactgaattgataagttctgtgatttaaaaattccagcaatatctgtaagaaacacaacttcgtggaattctacagataaagcacaagctttggactttttgtgatttcttttctgtacgtgtttttaaatgtacagcaagtgtaggaagataagcgttgataaaacattacttgagaaatgttaatttgctattaataacaattgacatttaccattttaaaggccaaagagaggtgaattttgataaaagataggttcttacttggaaacgtgtatgcaagtacactgaagaggtcttcttaatatagcattttataactcatctcaaatgttagcagccctgtttttcattcgtttccaaaactcatcaaccccagtcataataccagccacttaatacagatcccataagtctgtcatgtgttgtttacttaaatgtgactgtttctgatgacttttaaagtccccaaagcagttttgtccacgttaattttgctctgtatctcagcattcattgcagtacctattgaaagtgatttcactagcataagataaaaatttgatgacacatttaataggcttactctcaaacaacggattgactcaaatattatcaacaatgcaaggtgggctcttatgccaagatgtgttcggtttttcaaattttaatctaacgcctgaaatttgtgttgcataaatgtttgtcttattctgtgtataacatatttgcatatgtatatttgtgttctgtataagtacagaatagttaaaatgtgttctctctatgcttacataaatgtagcagtgagatattgataatagcaataatagctacatttattgattgttaagtgcgaagctctgataaaaatgttttataggtatcattgtacaaatcattcaaataaacttctgtggaacatacaatggttattcctattttacagaatggggtgaataaagggacacagagaagttaaaataatttactcgtggttacagagccaggaagttctagagctagatttctaacccatgcatgctcactctattgtgtacccagtaatcaactggatatactgtgattttatattaatcaaaatgcaaagatgcagaagttgtgagaaaattccctatctctagccatttattttcctgaataaaaatacatctataaatttccccttatctgatgacatcttaaggaaatggtcatgtaagccaagaatatatattatagtttactactaagttgttagaacaagctaggcaccagtttatatagtctagaacaatatactcaagtactgatgcttattatgcccaggtggtagtggcattatttgagaggttatgttttgtgtgaaatttctactttaaaaaaaatgaatttgttttgacaaaaaatataaaatgggcaagagattttgaaacaagtttacctagatttgcaacaatatatgttagaaactgtttgctttgattatacacacatatatgatatcctaacatgtatgaagcaattctttagttgatagtgacttatcttaaaaatgtataatccaagaatcatggagcattgtatttagaatttaagagtatacattttaacaaaacacataagaatataatttttatacaaaacgaccaaaactgagtctttaggatcatagtttaaaaaatgcaatatatgttctcataaatatatgtaaatatgtatcatatatagtaaatatatagttacataaaatacatatatttacatagatgtaaggatgtataaaatgtacccttaaacatgtttaaataataaaagaacacataaacattatacctacatttattttattctatattctataattctccaaaagtgggaaccattttcttacaattacttatggacccaaattcctcaaaattaaaagatcatttcattggcacacttacaagagacttagctgacaggggtagtttttaaaatcaaattaagtggactccagtttcagattcatcagttaaggagcttagaaattaccactcaattcttaacaagtaaaaagctgaacaaattgaaaatcaacaacttttctcagatctgtcagacaactgaggtcacagggcaaaaagctgcccccaaaattgcagaaacagattgatggatacaaagaatcacaattttctgagcagaaacctccaagggaactagttccagggtacaaaaacctgtaattgacgaatctttggaggctaagtgtggaccaagtctgagagttaaaaactacaggacagcccagtcataaatcatagtagggggctgatgcttttgtgagttttaccttcaggagccttaccaagtcctaatagtgagcatcagagaaaaatccctggtgcatccatcaaggaaagggggaaaatacagattttgaattatacacaagataattctgttgttagcaaagtctgcccttaggagaaactatttttccagaccctagccttatggggtttaatcagagcctaacctacctggaaggaattgaaataattcaacttcagctccttctagtattctacaggggcatagggaaataacaaattccaccccgctctggccatcctgcccacccaaagagggaaagaaaacaactcagactcacttgtgaagctaacagtctaatcacacagacttacccaagatagtttcttttgctgtgcagaagctctttagtttagttcggtcctacttgtcaatttttgtttttggtgtacttgcttttcaggactttgtcataaattcttgcccaaggcagatgtctgcaatggtgtttcttaggttttctgctagaattattatagcttagagacttacatttaagtctttaattcatctcgagttattttttatatatggtgaaagacaggggttcagtttcattcttctgcatatgactagccagttatcccagcaccattgattaaataaggagtcctttccccattgcttatttttgctgatttggtctaagatcagatggctgtagatgtgtgactttatttctgggttctgtattctgttccattggtttatatgttgggttttgtactggtaccatgctgttttggttactgtagccttgtagtatagtttgaagttaggtaatgtgattcctctgattttgttcttttcacttcagatgactttggctattgaggctattttttgggttccgtatgaattttagagtagtttttttttctaaaattgtttcaaatctctacaatgtcttccagaagctagaaccagaggaactagttcttaactcattctatgaggccaacattaccttaattacaaaattagtcaaagacattacttgacaagaaaaatgcaatccaatttctctcaagaacatagacgcaaaaatcctcaactaaatattacaaatgaatccaataatgtataaatagcatcatgcatcatggccaagtgggatttatcccagttatgcaaaactggctcaacactcaaaacttaattaatgtaatctaaaatatcaatggactgaagaagaataatcactttatcttatcaatagaggcagaaaaagcatgtgacacatcccaaaaccctttcatgataagaagtctcagcaagtagggataaaagaaaacttcctcaactcgataaagaacatctacaaaatacctacagctaaggtcatagttaatggtgagaaacaccaagctttcctgctaagatcaggaacaagacaaggatgactccactcaccactgcttttcaacatcatactggaagtcttagctaatgcaataaaacaacaaaaaaagaaaataaaaggtacagatgctccttgatttatgacaaggttacatctgcaaaaacccctgatcagtagaaaatattgttaagtcaaaagtgcatttttcaacttaccatatttttcacttattgatgtgcttatccagatgtaacactatcttaagttgaggagtgtactgaatgtgtatcccttttgcaacatgataaggctgaaaaattgcaagtcaaaccactgtaagttgtagactatctatatagacagggaaagaagaaatagaattgtctttgttttcagatagtatcattgactatgcagaaaaccctaaagaattgacaaaacagcagcagcaacaataacaaaaaaacacctggaacatttccctctgatcctagacagaaaaggttctccacctttaggtccttaaggactcatgtgattcagttgagaccactcagataatccacaataatctcctcatctcaaattcttaaccttaatcacgtctgcaaagtcccttttaccatgtaaatttgcatgttcacaggttgccaggattagaacatgaacattttcgcaaagggctttgttttgccttctatatccagtcaattacttccagttaaaaaacttatttatgttatataacacttgatatttgccaggtgttatgctaggtgatatttaatattttaaaatatctgtgaaattagtgatatcagccttagaaacatagatggaggggttggtcaccactcattatttaatgtaagtaacttatctttgtgtttttatgtaattattctctgaaatactcttattcaacaagcaagagtattcatccagcattaggaaaatattttatctttaaatttaactagaactataacgttttagaagtaggccatcactatttaaactcttaaaaagtcatagttaattaacaccctcatatgggtctttgattatcgctataataaaatctccatttatagataagagcaatgtgcatcacatgtaatgtaaacctgtattaatagattagatgaaatattattttctaactgtaagagttaattactctgaacaattccacaataaatagtcatagaaattgatttgggatatatacatctctctctctctttctctctctctctcacacacacacacacacacacacacacacacacacacactcgccccccccacccccaccccacccacacacacttctttctttgcttcttgcctggctgtaaatcggctatttttccatatcccatcatgagcctaaagggaaacatttgtatatttcaggctcctaggaaagcattttgaaaattcatttaacaaaattgggcaatatcaatgacttcaaaattagcaatggcagaaaagaagtagtaattaatagcagcggaaggattaaaatgtgttaagattaagttaaacatgtcgttgaatcactgtaagagactgctgattgcagagcctcttagtgtttgatattactctgacttgatgctgtggaattatatttctgaaataaatagttcttagttctgaggttatgctaaaggacatgttcaggaagagctttcctttcttactgcctagtcatacccttaggcaaagaagcagtaattttgaagggacaatgtaaaatagaagaataggcaatcttggatatgtgtagtttcacatttcatgtttatagatgtaaaagtattatgttaattatagaatagcacgttttatttatttatttatttatttatttatttatttattttttgagatggagtctcattctgttgctcaggctggagtgcagtggcgcaacctcagctcactgcaatctctgcctcctggtttcaagcaattctcctgcctcagcctcccaagtagctggaactacaagtgcctgcccccacacccagctaatttttgtacttttagtagagtcggggtttcaccatggtggccaggctggtctcgaactcctgacctcaagtgatccacccgcctcagcctcccaaagtgttgggattacacccggcccaatagcacattttaaagtgaatttatgttcaggtaacatgaatagaaagatttcttgaagtttcaaccagcttctgaaactttgtaaacagattaaataaaatttgatgattaaaatatattcagttaatacatatgaaaagattcaactgtaaaatatgactaaggcttcccgctaataaatggcattatgacgaaatctgtagtaaactgtgggcaatgtatatggatatgattttaaaatcatgagaaagctcattactgttggctatgtcattatagcatgatttttttccttataatatgccaatcaagagtaactatgttatgttaaaaggagaaaatgtggtgttttaaaagtgataaacctgatgtatttaaaaattttttgagatttcctctggagctgcactgcccaatatggtagccactggccccatgtggctgttgagcacttgaagtgtggctagtagactgagacatgttgttagtgtgaacacacactacgtttcaaagacttcatatcaaacagtaaaatactttattattaattttaatattgattacatgttgaaatggtaatattttagatagattgtgttaaatatgcatattattaaaattaaatttagggtttttttcacctagtttaatgtggctactagagcatcttaaaattatacatggggttcacatttgtggtctgcatcttatttgtgatggacactgttgttctaaactttcctaattactgagacatttcccttcatcactttttgggatgcagttttcatttataagttaatggtaaaactgcacaagtaacggaaatatacttaaaagatcaaaatatgaaatttagcactttcaaaattcctcatttaatgcttgagtcaatccttggaaaataattgatccagaggatatttacaaatagtccatcatcaaaaataaagaggggcatagaaggtactagagctctatgtataaaatcctgccctctggcctattctattatactcagaagagtctgtgtcactaatatatagtaattatcgtcggaaattatttgctatattaggattccctatggaaaagtgaattgattgaaaagatttagcaaagagttaactatcaactttggtttttaaataacatgtgaaagctaacttactctaatcactctgtggccataaaaaaggctctgcctccaacctccagaatctacatccaacaagaagtcttggtgaaaaggattggcaaaaagactgcaggttctggcaagggtttgtaagtggaccaacgaattggcatttgaaattgttagtcttataaaatgaatcattgagactggaaggtcaatgtaattggcaagccatgtgtcacctttttcttgggagaaaaacacatcatttccataaaaaagtatagagcatataaaagaataagaaagtaatgataaaacagaacttacagtgacattaaacagaaaggtatttatggtaatggatttggtactgaataataattaggctaataggataaattgctcacaaatggtacatttgggcaggaatagtgtattgttcactaatgtatctacaaaactgaatctaatgcccagcattttgtggaagggaaaaatgaattaacgactaatgtcatatatacataaactagctatcaacaagacaagctagggattagagaagacagggaaagaggaagtaatgctgatgcctctaaacatgaccaagatttattcttcactccttttagtgttttcaacgttaattcctgtagtgttctcttgccttctcaaaccagacttatttttaaagcagcttaggctgagtagcatatttttataaaatggtcctctgcgccatttctaagaatcataggtcaaattagtcaggctgctgttctaacactgataattatatccacctcctaccaaaatctgtagttaattggtagaaattcaagctttgtagattttagttgttaaaagcgtcacatggagaaagtacaaaggctgtcctaagtaaatgactttaagattgatttttgaagccttttctttactcaaaaaaagtaatggccagcttaacaaatgcctccagatgaattgcttgttgtgttcatcattattatattacacattcccctggaaactgcagatgataagggtgcattttattctgaatgttgtgtaaggcacactgcattttgaaagagttcagtgatgttaggataaatgtgtatgagaaatacgtttgaatagattcagtaagtctattcactagtccctttttcaccatttgctgtttggaatcaagtttgggatgttccatgcatggtcatcttactttagggtatagaacatcaggagtttaagaaactggggtttttgttttgactgccatcattttgctgtgtattacttgacaaggaatagaaggggaggcagggattagatcaagcaaagaagtacccagtaagaaagacctttcaacaatgtataaagaatttattttaaataaatttctgaaatggttaaaaaaaaaaggcagagatgagttaggtgaggtgagtcaagcaaggtggctgagggtttagattttggaaagtcacaacataaccttttacaactgaaatacatcatctgtaccatgcggataattgcatttatgtcttggtggtgttggaagaattaaagggtataatatatttaattcacttaatagagtgcctgacatatattaaattttcaaattgttgttagagtggctgcttcaaagaatagctaattttacagtatggtatcatggacacagactgtcaaaagccaacagaataatttcaaattcaactttttttccacatatggctttgtgagttgagtgcatactttagtcaaaaatatgttttcacagagtgataatttctaggggtgattaaaagtttgattataaccactcttgggtttcataatctaaaaacattttcagaaagtctgtgattaatttttcccatttaaaattttattctcaataatgtgcagtattaaatagaatttcacaaggcatcttgggagttacgctctcacatattaaactacacagaaaaagttatatgtcatagctggtcaagaactcagagcaaaatgaaaagataagcagatagtgcaatgtggttcatggtccttaaaagaccttttaatgtggttggttattttctaatgaatgcaagtaacacattgaatgcccacctatgaacagaaccgaaattaacaatttagaaatgtgaaagtgacataaacttttactttcaccatttttcacagggtcatttgttggtaaaattatctcctgtacttgcttcttgtcttactacatcagtcacctgtgaatttaaattagaggcattttgaaaatataattagtaagtcattgcttggatctattgagtagtaaatttatatttttatagtacctcagatatagtgtgaaactttgaataattcatttctcacatgaaataggcacattacaaatatccagcaagttgtaattctgggtaagagtccttcaaagaatgaagaacaacagttaagctgtacctttggtcatgcatggcaatatgtaattactatctgcaggtcctcaagatcaacttaatctctagtatgtaagtcaaatgcctgttgaactgtacagtataatacatggataaacaatccaaatgactcattttataagtaggtaccactttttataaacagagcgttttataacaacctgctgttggtggtggtggtggtggttttgttctcctcctgtttcttattctttattattgtcatcatctatacttactagatacaggaaaaatgcttttacaaaaatgacccaattcagtggtgctgaaactctagagacatcagaatcacctggatggcatgtcaaaacacgatgcatggtgcttgcctcagaatttttgattcagcagacataatgtggaaccttaggatctgcatacatagcaagtacccagatgatgctgatgctgctggtccagggaccacactttgagaatccctgctcttgtaaatgcttctttgtttcctgatctagcccttcttctatcattttaatgctaattatgcccaaaagtatagtagtactgctctttgcgtctttgcacaccaatctctgtggacaatctcatccacacgtgtggctactcacaaatataaatcaccagccctaatctccttttgagtgtcagactaatatatcaactgcctacagcacacctccacgtggaaatcccacaggatctttaaatttaatatggctggctgggtgccgtggctcacgcctgtaatcccagcactttgggagtccgaggcgggtggatcatgaggtcaggagttcaagaccagcttggttaagatggtgaaaccccatctctactgaaagtacaaaaaaataaaattagccaggcatggtggcgggcgcctgtaatcccagctactcaagaggttgaggcagagaattgctcgaacccgggaggcagaggttgcagtgagctgagattgtgccactgcactccagtctgggagacagagtgagactcgatctaaaaaaaaaaaaaaaatattaacatggccaaattggatctcttaagtcaacccccatgaagattgtttcaatcaagaattgtcgcattttcatgaggagcatatttttatggtcttaaaggatccccccacaaattacttattagttgcataggaaaaataataactatacattgaggaaattgaagaacatcttggacaaggtgatcaaaaatatcatcaccaaggaggggcaaatgagcatcatgtaatgccctaagatacattacctcattgctcttaaagcatgacccaatacattacctcattgctctttaagcatgacccaaacccatggcctaccatgcaagtctcctcctttcccagcctcacttctcctcaattcacacctcacagtcagctttacagttttaccaatacacctgagtattgaagaacgtgccatattctctcttgctttagggtctttattcctgctatttcctttgcttggctcgccttgcctcctccccaagcaccttctgtctctttgactagtgaaaacccatggtccttcaagactaaaattaatattatcttttcagagaaaacttccatgctgattcccctttcatgagtggtttaacagctctgtcctgcttggggcctcctagcacttaccacagtttattataatttcttacttgcttctctgtttcctggcttgcctctgagttctgaaaggtgggaattgtgttattcaccattgtttcctcagttcttagaatactgttaattaagatacagttccttaatgaatggatggatggatggatggatagaaaaaattgaaaatgtcatgcattttaataaacacattaagtgtttatttttatttggtagaaaactgatggaggaaatgaacaataatgtttagttttatatttggtgctgagtcctggataaagacaattgaatatgtttggtgttcatctaatttgcaattcaaaaccaccacgtgtagggaccttttctgccttactatttaaaatagtttacaaaattttgagaaaacgtagttttaattttacctagaatctttttttttttttttttttttgagatggagtttcactcttgttgcccaggctggagtgcaatggcaccatctaggctcaccgcgacctccgcctcctgggttgaagaaattctcctgcctcagcctgccaagtagctgggattacaggcatgtgccaccacgcctggctaattttgtatttttagtagagacagggtttctccatgttggtcaggctggtctcaaactcccgacctcaggtgatccccctgcctcggcctcccaaagttctgggattacaggcatgagccaccacgccagcctacatagaatcattttacatcagtgttttagatatgaatatttactaatctattatatttgatagcaaccataaatgcttaaactcacaattttttgtttttatgtgtgggaaaatttaaaaaacaaagactaaaaggatatgtataacaaaattttatctctatattgtgagattaatcttctctttgtattttttaacttttctaaattaatgtgaattaactgtatatgcagaaataatgtaaattttttttttttttttttttttttgagacggagtctcgctctgtcacccaggctggagtgcagtggcgcgatctcggctcactgcaagctccacctcctgggttcacgccattctgctgcctcagcctcccaagtagctgggactacaggcacctgccaccacgtccagctaattttttgtatttttagtagagacggggttttgctgtgttagtcaggatggtctcaatctcctgacctcatgatccgcccgcctcggcctcccaaagtgctgggattacaggcgtgagccactgcgcccggccaatagtgtaaaatttttacatagccaatgtttgctatgaatgtggttttctaaagaaccctcatattttctatatttatttgaaagggaagattttgggtttttcaatcgttttctgaccaactatcattacatttttggctgtaaagtgaattgatacacaaaagtcttggaagcaatttactacccacccctagctctggtattcttacgagggatgatacaaagacactaccttttctacaagctcttgtgtttacaagcataagagaaaaacaatatgtttaaggtattaattacccagaattcagcagtacattcctttgatttttgtatacaaatgctaacatatcacgaaggggaaagtgttcactgttttgtattggcatttaaaaactttttatgtatcatttataattgtgagagtaaatctgtagttggcttcttaaaaattcttgattacattggttctttatccacttatttatgttgatccgatgacaaagagttgttaataagtcaagacattttaacttacttattgacaagctaactaagaaaatagccaaaatagaggtattacaaatttcttattcaactcagcatgttcactgttcacttagccaaacattctccaactgaagaactccaaactagtttactcttcatatgactatattgagcattaccttactttaaattgtgccacttaatagtgaagttcggtgactatttcagcattatgatggatcctcttggactaagatacaaaatttacagttaaatttggtatttgccatcataaatggcccagattagctggtccttcccctatcactggagaggagtaatagtagctggaacccagaaacccagtgggtactagtttcctttctctatcccactttactcccctttatctcctttgcttacttcaagttttaaaaattacttacctggctaaccatgttttaaaatacattttattctgaaaatgtgaaagcattcataatacggattttttaggtcaaacttgccacattggtgatagttggggattgcggctgatttgtcagatgtatcttaccattggagtctgtgataattaagagcagtgttggactgtggtcatgtcagacactgcggagaagaaaaccgtgttttacatgcatattcagctgctgcatgatgtgttactgcatttcacattacatatagtagcccagtgccaactcactgcagtaaatctcagtgctaggctcttgccatttgtcatagtaacagaaaaacatgtgcagttttccattttattgaatgaatttgaattcatagaggacatcagattgtgctcactctctagtttatatgcctgtgtgtgtgtgtatatatatatatatatgctggcaatacaaataagctgaccatcccaggcagactaatcgaagatcttgtctaatattttggaattgtgattatttctatttctctttaccttaacttagggtacttcatctgatcaccacccctctaaagtatagaggggggtatttttggctcttgttctcattaatttaaaagttctcaatttttttgcagaggaaaggaaaacctacctgttggctgttttgacctatccatttaaccagtaatgcaccacagttagcacttctgggactaatctggccctccaaccttgaatagggtttacatggcattgccttaaggatatgtagtctttctattcctctaaatcagtggctctcaaatttgacaggtgtcagtcacctagggaacttggtaaaaatacaaaaccctgattcttactccagtgagtctggccaattctgatatgcactaaagtttgagaaccactgctctagacactaaaacaaatcaaaacaaaaagacagatgatctgaccaaggtagaaatgcagacagcattgagttgtccaattggcctgctatccccgtgccccaggctacttttactgaactctctcctgctttatggctttacttgaaggcgacgttataagaaacagccctcccagtatctgtgaactgcaaatcacagatctctcaaaatggaatgctttctgtaagtctgatgtcaaaattcatttgggggtaaatttaagaaaatatattattccttgtagtgtaaatatttatgtgtttaagtgcagaaatgttaatacgcttaactctagggtgctgccctaaagcctgctagggttttttcaaaatatttgaaatgcatactgaattagcttccaaaatccaaaaaaagtccactttaataaacatcttagtcccaaagatttcagattataattataaacaatgtgcttattaatacagtcatatgccacataatgacattttggtcaatgatggaccacatatttgactgtggtctcataagattataacagagctgaaaaatgcctattgcctaatgacatcatattttctataatgtcatagtgtaacacattaccttttctatgtttagatacacaaataattaccattgtgttacagttgcctatagtattcagtacagtcagatgcagtactggtttgtagcctagaaacaaataggctgtaccatatagcctaggtgtgtagtaggctctaccatctaggtttgtgtaagtaggctctgtgatgtttgtacaacagtgaagttgcctaaggacgcatttctcagaatgtatccctgtcattaagtgatgcacgattgtggtgtgcttctggagaaatggcttatttttatcttgtggacattgaaaatgacttggcagaccatactgtaaagctctaagccaggcttttgtcttcccttgatcaggagctctgtgacgttattctacctttatctttttttcttggtatcttcctacctttttattggtattattattatccattataatgattttgctgagtgcatttactcgttggctttttagatttttttgaatgtgtataaactaattgcttcttcatttagttggatatatagggtgataaaaatagataaatatattacttgttctggggcattgtctgggggagatttagcatagttgtcctcagttgtctctttctttcatgccataataaaataacctctattgtgaggataatttttcaaaaggacttagtgtaatgagcatacatttttggctaggtcagatttctaatagttggcagcccaggtattagcaacctcatattctacttccctgaataagaagtctctaggagtatctatctaccaaaaccactcaaatccctacaatccaaagaattccaggcttttaagttatgtttctgattctaatcattatttattcagtaaatggttgtataaaagtgacacaccctcaactgcaatttcagtttccctgggggaaacaaggaccctgaagggaaaacttgtacatagtgttgctttcttgctccagatcactggctcagagcatgaaagaagtgaaataacaaaccactgagtttcccctcaggtcttaaactatcagcctggatagcaaacaatttttattgcaaatttgagtagttactatgctttaggtttttttttggattaatgcagtttattttagagctgttctgagtttatacaaaaattgcaccaaaagtacagagagttcctatacacaccttcattctccatcccacagttttccctattaatagcatcttgcatttgtgtggtaaatttgttacaattgatggacagttgtaatacaatatattgacatattattgttaactaaatccatagtttatgctggggttcactttttgtgttgtacaattctatgcattttgacaagtacatgatgtcatgtgtcaccattacagtatcatacagaatagttttattgccttaaaaatttcctgtactccacttgtttatccctccttctcccaacccctaacccttggcaaccagtgatctttttactgtctccatagttttgcctctcaagaatgtcatatagttagaatcataaagtatgtagccttttcagattggcttatttcacttagtgatatgcatttcaatttccttcatgtatttttgtgacttaatagctcatttctttttgctactgaataatattccatggtaaggacttaccacagtttatttattcattaacctgttgaaaaatggcttaaacttttggtcgtttccaccttttggaaaatataaataaagctgctataaatatttgtgtgcaggtttttttgtggctgtgttttcaactcatttaaataaatactttggagtgtgacagctggatcttatgggaagaatatatttagttttgttagaaactataaaactctcttccgaagtgactgtaccatatttgtttcacaccagcaatgaataagggtccctgttggtctatatcctgtctgccagcatttggagttgtcagtgttcaggattttacccaatctaatgtgtgccatgctttatttttaacatttaacaaatagaaaatttgtgctcatggcatttgtttcttccaattactaatgaatagcatcatggttaaatgggatcattaccctgcttctttttccacccaccttagcttcctccagagttcactgttatctcttctctcagcaggtctgtggttggctattcttgtcttaccagtttgctgttattcctgcactcagtttctgttcttgtatgtgcctctctagtgtctagcataaatccctcaggactcaaaaagtggtattaatatgtcagtgagtcctattctgattccatttttcccaaatgagcctcctctttcaggctcctttggtaaagttcttctaattccttgggtctattacctactttttatattgttatagagaatgtcaaacatattcaaatacataaagaatgatatactggactaacgtatacctatcacacagtcccagccaccaacaacccatggccaatagtgctccatcctctcccatttactttttctaaatgttgtattattttgaaacaaatatcagatatcatattattttacatattcatgtgaccaaagatatagagcaatgacttctttttctaacaaacacatagcattattatcacacctaaaataacagcaatcatttattatcatcaaatatctaaataatgatctcattaaagttaagatccaataatgtccatgtgctttgactggttgatgcatattttaagtctcttttaatctatgggctctccctctattgtttgccctgccaacccccacaatttatttattgaataatcaaaattatcctgtaaagtttatcttataatctgatatttttactgattgtatttccgagatgtagtttaacataatctctgtattctgtattgcctgtaaataagtagaacctccatacaggtttgacttattttgatgtgactactataacttaattttttgttttgtattaatgccagttcattactggttctctcctaagctaatcttagagggcataccagtgtatcaattcatgcttattctgaaatctttaataaagttgtaaatgaattatacaataaatttcacagtgtcaggaatctaattaatgaaatagctagattagaaccctggaccccagacttttacatacaatttcctttccctgtaagcactatgttagcctcatgatagtagcatgcctctttgtaacttttaaatatcctgcagcagcaaattgagaaacacatttgcagaacattccctttactgtgtaatgtggttcttagtagagaatttatttatttatttattttgagacagggtttcactcccgtcacccaggctggagtgcagtggtgtgctcttggctcactacaacttccatctcccatgctcaagcgatcctcctgcctcagcctcccaagtaactgggactacaggcacacacgccaccacgcctggctaatttttgtatttttagtagagatggggtttcgccatgttggccaggctggtctcaaactcctgacctcaagtgatctgcctgccttggccttccaaagtgctggcattacaggcatgagccactgtgctcagccattaagtcttacatttgtatacaactttaaattatctacgtaatgtcactgcatagtcatatagcttggtagttaagcatttgaactcttttttttttttttttttttgagacagagttttgctcttgttgcctaggctggagtacaatggcacaatcttggctcaccacaacctccgcctcccaggttcaagtgattctcctgcctcagcctccccagtagctgggattataggcatgcaccaccatgcctggctaattttgtatttttagtagagacggggtttcttcatgttggtcaggctggtcttgatctcctgacctcaggtgatcagcctgcctcagcctcccaaagggctgggattacaggcgtgagctaacactcccggctgcatttgaactctttattctaatgtctaaataggactcactatttagggtactcactgtgtgatcttttttattattattacttcatagagacaaggtcttgctctgttgcccattctggagtgtagtagtgtgattgtaactcattgcaactttcaactcctggcctcaagcgatcctcccaccttagcctcccaaagtgttgagataacaggtgtgacgcactgcacccagcctcactgtgtgatcttgaataagttactgagcctagtttctctgcctgccagatgagacttttactagtaacaaccttatgaatttgctttgattattcagtatggataatgtatggatgatgcttagtacaatgcctgggatataatagcaaatgttcaatatagtttggaactataggcagagagaagtgttattatgagaaaactgaggcagtgatagggttggggcattggcctaatattacatagctgacatgtactttcacataagagcctgtcttttgtgtgagaactgactctgtaagtgtctctactgttatgaaggcaggaacctacttaggtactaggctatgtgaaagaagctggtgattagttgaatctaaagttggtgatgcactcacattgccaactacacacagtcataaaatccattagcctattttagacggcttactgcttaccttggcctcagctaccttactgcttaccttggcctcagctaccttggcctcagctactgcttaccttggcctcaggatatttaaagactaagattgtttcagtttgtttaaaaaattacacacacacacttgcgctcacacacacacacacacacacacacacacagtgggagagtatttttgccaaaacgtatgaaataattttctcctcttcacagatattgaaatggtgatttgttttatacatattccacacaaggtatatatatgtaagggataatttttttgtggtgaaatttaagtaacggaaataacatccactattatttgggtaaaaattacaaaagcacttcatagagacttttttccttagtgtatgaaccacatttatcaggtggtacaatagctgaattaagttgaaattgttctaaaatatgcttgagattttcgtctttcttcaagttgtcctgaataggtagacagatacctgaaaataggaataaaacctaaacctctactttaaaatgaggatattttacctttaaatgtctatttcacttgatgaatatttaacctttttgttagttgacctatctaaaatcttaagttacttgaaaaatatattttcttgtctgtggcttcttaaatggtgcacatgtggttagcaagcaacagctattggcttgccaaagctaaaagttaaaatataagatgataaagttgatgtaatatgtgaccttttataagtcactttcccatttgaaattaaatgtgccagatttgacaaacttaatatattgaataggttaccctaatatttttgttgacttttagcaagaacactataaagcaactataaagtgttatttattttagcttttctaaataaaaatcactgaagcaattttaatttgtacatataactcttccttaaaatttaaatacctgttttacttcatgtgcttccatgccttatttcattaaattttcaaacacgtatagaaagccacatctacaagctatcagatttccctgagattactatattaaaacatacactgaatcagactccatttcttccaacgctgattcagcactttaaaaataatctttgattttatattaaaataacttatcaccctttactgcatgatatcagaatgacactagttatttcactacaaaaaaatgtcagtgatcaaatcttgctggtccacaaataactctccacttgctaatttgcattttagcatcaactgtaaatatgtagataaaagaactgacagttgacagctaggtataacttatatatatttcatacagtaactcaataataccagattaatatttaaaaacattagtaggccgggcatggtggctcatgccggtaatcccggcactttgggaggccgaggtgggtggattacttgaggtcaggagttcgagaccagcctggccaacatggtgaaaccccatctctactaaaaattaaaaaaaaaaaaaaattagcaggacttggtaatgcgtgcctgtaatcccaattactcgggaggctgtggcaggagaatcgcttgaacccgggaggcggagcttgcagtgagctgagatcccgccactgcactccaggctgggtgacagagcgagactccatctaaaaaaaaaaaaaaaaaagaaagaaaacaaacaatgaaagacattaacaggagtatggcagaataaagaaatgtcaaaatatcatcctttaatctttaatgttataatttgtgtttgaattatgaaggatatattgaataataacaaatagaagtatttcaggaagcatagaggtgctgtttaaacacaatatgaaagtaatgagaatcattttccaacacggcattggatccagtctcatgacagtgtaaagaaactgtgggaaaagtgctctgtattttccaggtgaacctggttgcccatctcttgcaaccagctacagaaggtcagccagtagcactggatttccatggtcactcatttctccattctacttgtagtctgtgtagtgagaggaaaacaaatgtgtcccaaaaacttggtttcacatgagaagttcttcaaataattttcacctttagaaaaaaaatttatggagcatgatgatagtcaggagggaagaatggcagtttggaaggtaaggcaagaagaataatcttgagagtttctaatgagaaaaataatggaaaagggtaaaaaaaaaatagagcagctatgttaaagtataatattataattattgaatagaactcaataatatataattctgagcactctttttttcttctgactttatcatacaattttatctttagcctacctttaccttaatttgtatattcttagccttaggttattgaatagatttttataaaccatttgttttagtcagcttttgcttagtaaaaatacaataatatacaatccccaaatatcagtgccttttaacagcattgatttacttctctctcattttacatgtggcagctctctatggttctgtgtatcttcttcattcttgagtccagaataaataaataacttctctctggggcaaggcatagggaaaagagcaatggcagaaacatgcaatagatttttaaaattgtatttgagtataatttgaaaaaataatataatttaccctaccaacaaaatccattctggaataagatgtcatatagtaacataaaatttatattaatgtatgtaaaagaataatattaaggttgaaacttaaagaaccatttagtgtcttagtcaattttgtgttgctataaaggaatccctgagagtggataatttataaagaaaagaggtttatttcgctcatggttctgcaggttgtacaagaagcatggagccagcatctgctcctggttagggcctcaggaagcatccactcatggtagaaggtgcaagggagcaaacataatatggtgagagagaaggaaagagagatgggagggaggtgccagacttttttaaacaaccagatctcacaggaactaggactagaattcactccatcctgggagcattctccaagccatttatgaggaatccactcccatgacccaaacacctctcactaggccacacctctaatattggagatcaattttcaagatgagatttgacggggacaaatacccaaactatatgaaatggttagcatcattttcacttattaaaattttatcaaacatctacgatacagatgataccaggaagaagcaaagatgaataaatacctgtactctacatttaaaattctctggattcagtgaggaatatagcaaaatatataaaaccaatatagatgcatccactgatgagtgctttcttgaggattaaaagaggtgctaataagcagaaactgtgaatgaaactgtcaaccactgatacctagaaaccttaggatagtttctgtgtaagaatctgttaaattatctcagtccattcagactattatagcaaaatactctaaattggatagcttatgaagaaaggcaatttattgctcacagtcctggaggctgagaagtccaagatcaagtcaccatcagattcagtgtgtggtgagggctcgttctctgcttcacagagggcaccatcttgctgagtcctcacatggtggaagggcttcatcagcctcttttataagggcactaattccatcgatgaaggtgtagcctttatgacctaattacctgctaaacaccccatctcttaatactgttacattggtgattaggtttcaacatatgagttttgagaggacacagtcagaccatagcagatgaggataataataaagatattaatagtaataataactatctgtcttatgcatttactatatatcaagtactttagaaacctcattgtactctcacaatgaatttttgacataaattcaattattattctcattgtacagatgagaatataaaggcacagacacatattgaaagactatttataaagcttgtagtacctgagtggattaatggtgtttatattcagtttgtaaaacaaaactattatgagattatatatatatatatatgaatgaaaagtttccatgcctgttttcttgcaatattgattgtgaatgttaccgcagcctaagctcataaagcattttcttaacagaagcaatcacaggctatttgcaaagccatctcaataaaacttacaaacatgagtcctaagggtagaatcaattggtgagatgctacatttctttgtttgaattattggggaaaataaaacagtatgaaccattgatggtgttttgaaaaatatttttacactctattacttttattcttacccttaatatgtagttctatcattattttccatagaattaatctccactcttacatatattctttatgtaaatgagaaataaaatttcaaaggggaaaaatgtaagtagccaaaaatttctacataatgctttattaatgagcaaaattggggcattttatcttctgggtgagaaatgtaatattcaggaaaagtgtggtataattaatcatagtttatgtatttattactctagggttctttttgtaaatgttccatagttctttagcagtgaactcttctctaagttgcaaacagtacacctctattgtcaaaaaaggaccaatttctttgtttgcagcatattgtcaatatcaaatatgcatgctgaaagacagcagactatcaatagctagtaaattcacaaaaccattgggtgatatgctaatatttcacaagacaaacagtgaagggagaatattgtagtaatatttgcaaacaatattttctttagttttgtatttaaaatatgtcatttttttcttactcttgtgtgacttctttttcagtcagaacagaaaccttaaaatagataacctttgatttttatatttattccatttttctctgacagagtatggatgaatagcatgaaactagtcaaaattgctaagggaattaatttatctacaaaccttgttcaatcttattatttaaaaataacttttattaagataaaaattactaaaaatagattagactcttatgatgcacttagaaggacagaagatcatttctctgatagtcttgcctcaagttacaacctgattctaataaggagaatgcattagacaaacccaaattgagttacatgctacaaaatggctgaccagtactctgaaaagtttctaggtcaggaaagagaaagactgtagaactgtcacagtttggaggagactaagaagacatggcaactaatgcaatgtgggaacaactggaccttgaatcagaaaagaaccctagtggacaaactggttttgaaatttgaatacgtactatagatcagttcatcatattgtatcgacgttaatttcctcattttaataattgttctagggtttggaaaatgttaacattatggcaacctacctgaaggatgtgcagtaattattttctattcttgcatgttttctgtaaatctaaaattatttcaagatgttagagaatttttttttttttggagacacagtcttgctcttgctctgttgcccaggctggagtgcagtggcactatcttggctcactgcaacctccacctcccgggttcaagcaattcttgtgcctcagcctcccaagtagctgggattacagatgtgtgccaccacacctgactaatttttgtatttttagtagagacagggtttcaccatgttggccaggctggtctcctgacctcaagtgatctgcctgcctcgacctcccaaagtgctgggattacaggtgagccaccgcgcctggccaaaatgtcaaagaaatatttttaacttcgggagcaaagaagaactccaatctctggaatcagaaaaaataaaatattatttttatttgaggttatttaaacctcccatggagtatattaatatctgcaaactgagtgcctgctacgcaaggctacaaggtgctgtatgagacggaaacatggagacaatttattttttttattattttatgatgacatttattaagcttctaaaattatgtaacaaaatgaaagacatggacaatcacactttttgatatgataagaaaagagattatttgaatctgggacacagtgttccagaatttagaagatccatacaaagtgttgaggagaatctgattctaatttagggtttagggggaacaaagatacagtagttcccccttaaccatagttttgctttctatggtttcagttacctgtggtcagccacagttcaaaaacattaaacagaaaattccagaaccaaacggtgcacgattctgagtagtgtgatgaaatctcgtgcagtctccctctgtcctgtccaggacatgaatcatccctttgtccagcagatccatgttgtatatgctacccacccatttagtcacttagtagcaggctaggttatcagatcaactgtcatggtatcgcatgacagtaatccttattttacttagtaattgttccacagcacaagagtagtgatgatggcatattgttataattgttctattttattattcgttgttaatatcttactgtgcctaatttacaaattaagccttatcacaggtatgtatgtataggagaaaatgtattatagatcaggtttggtgctaaccacaggttcaggcattcactggggatcttggaatgtattcccgtcagataagagggaactacgatatgtcgatacaacagtggttgaactattgagtcatgcttggagctcttgagtatgaatatcaggaaataagcctggaattaatccaattgtggccaatttttaatgccatattagggcacttaaccttcattgtgtagtcagtcttaagtgatcaaataaaccacacaattggttctatggttcacaaagttaatggcgatatcaagtgaaaattggagtgaggcaagatgggtttccaggagaccagagaggcaacaagggctatataccttaagagcaatttacaaaagattaaaggagggcagtggcaatggggatgagaacaaataaaaaatagcaaaaaataatatattgaacttattgtaattatgtcaagctactgttatctttaaaggtaggaaaataaagatcttggctgggtgcggtggctcacacttgtaatcccagcactttgggaggccgaggcaggtggatcacctgaggtcaggagttcgagaccaacctggccgacatggtgaaaccccaactctactaaaaatacagtaattagctgggtgtgatggtgggtgcctgtaatcccagctacttgggaggctgaggcaggagaatcgcttgaacctgagagacagagattgcagtgagccgagatcacaccattgcattccagcctgggcgacaagaatgaaactcagtctcaaaaaaaaaaaaaaaaaaaaaaggaaagatctgaataaataatctcctttccttaatataaattttaatgattacaattacaactaattgatgagactggccagaggagtaaggcatgttgatcttcttttttttttttttgagatggagtcttgctctgttgcccaggctggagtgcagtggttcaatctcagctcacttcaacctccgcctcccgggttcaaggaattctcctgcctcagcctcctgaggagctgggattacaggcgcgcaccaccatgcctggcttatttttttgtatttttagtagagacagggtttcactatgttcaccaggctagtcttgaactcctgacttcaagtgatctgcccgccttgacctcctaaagtgctgggattacaggcatgagccaccatgcccggcctgatcttatttttaaagagtgtaaatgtaatctaattataaatttaaactttagagagaatgttgagagatacggacataataataaaaaaaacctgagccggataattgtgcttgtctgaaatgagctaatgaaataattttgttcatatcctttgggggtatttctgaaaatcagtaaagactatgcacagccattttatgtttttacaatagtgccattaatgatgccttatgagtgaagaaagttggatgattgggtgtaaaagatgtaaggttaatgggaaaacttccctagtccacaaatcatcttattatccagtctgtaattctttgttccatgccaaaaatctatatttcgtcaagtaataatagatgctttcaggcaaacagccttatatgttgaaatgcaaatgattacttttaccccgtctcctatgcttctccttaaacactgaagtgagtcagaagaaagaactcttaccctttctatttacactcactgctttggtggtatcactgaatctcatggctttaaataccatttgtcttctgatgattaccaaatactaatctccagctcagacctttctctccaacacgagacaggccactggactttcaataggtagctcaacctcatcctcacgtggtggaaagctctggattgtcccccaaaactatttatctcatcattcttttcccatctcagttaattgcatcgtcattcttctagttactcggcacaaaaactttaatgtaattcttgactcatatctctctcacccatcatttgattcatcagaaaatcctattgtctgtaccttcaaatcatttccaaaatctgaccacttctcaccagctccaacgctagcatcctggtcagagccacatttcactttgcttattgcaagagcaccctaactgacttccaacttctgccttgcttcccatcaattcactcttaactctgctgctggagtaattctgttaaaacagagattagtatgtgtcacttatttgctcaaaaacctccaaagacctctactttcactgtgagaaaaggccagaatacaaaattacaagggtccgtaaggccccagaaagacttgacctggcctgacctcatctaccgctacctttccctcttgctcactcttgcttattttcagcaacacaaggcttcttcccttttcacaatcactgcaggaacactcctgcctctgagactcagaccttgctctttcctctagctgaactgctcttccaaatgccttttttgttcactccttcaccttcttcaggtcttgacttgaaacaccctataaatagggcatttccaggccactctaaaattgcaaacttacctccattccttgcaccctttccctccttacagctgttatcaccatgtaatttactatagtttttgcttacttgttttttatctcttacgcaaccatcccattagaaagtaaactctattaaggcaagaatttttgttttttcaggactctacactaaatctcataattataagacaatatttggtgactaattttaataggaaatattgcctagagtaagtccagattttcttcttaatttaatcattaggcaaaatattttgagcaccttttatgtacttgattagaacataagggcataatgcattttaggatgtctgagattattggggagtaggcatgaaaacaagtattaatggtccattgttacaagaaaaagagtgaaatctgggctgatgctctctagtttgagcaggaaaatatctcatagcctctaaccttacttaaattctgccagctctggcctgtagaagcagtgaggcaaaatgacccactggaagaagctacttcttttgcagaagcaacctaactctgagaagaaaaaaattaagcctatcatcttcagttctacttgagatcttaattataaaataaactcagatttctatttccagttcagatggtttggtataagatgggccataatccctgaaaagtggcaattccaaggaagtttggcacaagtcttaatatgcttattcaggctgaagttccagcagttccttcccataagcagacctgctagagtgtggaagacacataatgtaaatacgttaggagcaattgttgtttctttcattttcttctgaatcagtccacagcccaaggattctgtgaagtaacaaaattggctgttacagattatagccacattcccatcttaatagcagcagttgaaatttcttgggcatttcaaggtagagatttatgttttatttgcagttcatgattattctgattcaaatatctgtaaatataaagggagggggagaatgctaacacaaaaaatattgtacccagttaaactttatgtctgtattaataaagcagtctttgatttagaattcttagtccctttcttttagaggattgaggttagggtatgtgggtttgtgtatgttttgtcaccaaggttggggtgatattaccacagtgaccagaactataaccaaattcccatttatactagtgatggttgtatcctgtctaccagagaggggaaaaatgctttgacaaattcatcattgttatgttttcttgccacagtttattctcttctgcattctgtggaagttcttttggccctgtggcttcctcaatcataagctaccacatacaaagactattttttcaaagaagccaattagttttttactaatcatacgaacttagaaaaatagatattaaatattactgataaataacacagccttgtcagaaatctctcaaagtgtgtgatcattgtctatagagtagaactttttaggggcaatacagtactgtttttatattcaatgaagataagttagattaaaaatgtaagatatctttttgtgaattgccacatggtagaattttgtaagaggtttttataatgctattcaattacttctccatggaagaattttgctcacagagaaagagagacagtgtgtgtgtatacacaaacatatataaatgtacatatatctgcatgcattatatatgcatatattgtatgtgtatgtaaagtatgtatagacatacaaatacagtcatatatacatacatatatagtctatacataatagctatatgtgatatactctctagatgttataaaagcttttcaaatttcaacttattggatttgttttggtgagtgttcaggtttattggtggaagaattatgagtttataaatcactgattagtcctctattctcacaagagtaaaagaatattttaatgatacatagtcaccaagggattgcacattttcaaatgaactcactgttactgcccctgttgtcaagatggtatctccctctttctcctcggcaaaaacaccatgaatcaatttatttagagtgaaaacaaacgtcaatcattaggtgaagatgctttttctcaatatctaaatggtttaaaattgaatttctcacgtaactgcccatttaaagactcaaacatggttctttgtttttgaggaatattctttataaagtctctgaaaacacttttactctcttagcaagataccttctttacttggcaacaaaaaccacattgaaacaatcgtattcccttttgtcagcctgagccagctgaaatctttggagttatcaacctctgccaacaacttgaagtagcggttgcacaatggataactgagatgtagtttattccaagctaatgattttctgaagctttcgggatggttatatttatactgacagatacagacctaactttcccataaaaagaacagactgtgttcaacgtacccagataataccagcctcttttttgtataatcctttaatttcagatgcttatagctgcttcagtcctgtcaataccagcactctgaagtcttgccctgcttgataatcatttgtctctgtaatttctttatcattgctttacttagggacaacacaaataatctatttagaccagaagagaccaactttctttcttctttatgatcaaaatattttgtagactccctacaaaataattatgataattgtagtagccattgggtaagaaatgcataatgacaaaaatctagttttaattcagtcgtgctaagcatatactctgctttattacatcagctacatatgtttaaaaatactaatatatattatttatctagtctgcatttggacttgcctaatcctttcaactagaatgccctctcaaagatccgtatcttgaagcacgagaaccaatagtttgaaacaactgatataaagtggataacatcaggtgtccaatgacctaccacatttgacactgaaaatattttccaaagaaatacagagtatgaaaataagaaagaactactctatcactcattgtcccatcgtctgatggccctgttgactcattgtacaccaagggccttttgaagtagggaaatacatgtgaccaatagagatagaacaataagacaatttcagatttgaaagaaacctgagcaaccacggagcccaaccctctctttttctccagtaatccaaagaggtcaagtagcttgttaagggcacccaagaagttgatggcaaagccaggcctaaacctggattatacaaacttgaaactatcttgaaatgtagtaagcactatcgcagtgttgggtaatacccttacactcaatcccagaagattgagttcagaagatgaagatgtggaggctgaaattataaccctggggattcgttgattgtgatgtactttatgcaggtttagaggcaaaaacacatggcttggcatcagaagtggaaaggaaagtagagtgttgtagaatgagtgctggatttgaggtcagaagacctcttttaattcccggtactgtcaccgattagatgtgacctatggcataacccttaaatatccttgacctcctctgtttccttttatgttaaaatgggaataataatgcatgctttgaccatcatttagaaaggttgagagaatcaaaatcagtatcagaaaatgcttttttaatctgtgcagagcttgaggtaacaaagcagtatacctcaataaatatcgttgcattcctctatgccaggcttcgtgcaaggcactgggaatagagcactgaataaaatagaaatgatcatagtttaaggaattttcattctagaaaataattacttaaatgtggctctatgtaacttaccaggagctttcttatccgttgttcctcttgagctttgcaacagtactaggcagacaggatagataagtaatgataataacaaaacaacaataatagcagcagcagcagcagctaacatttctattatttcaatgtaaaaaaagaatttcagattgtttaaatacagaaatgtggtggagtagaaagaaggccaagatggggacaaggggaaccatgaccccaaaagcaaataaagcatctgagcattcctttctgtttggttatgaacatctgagggtacataatcataatgagctcctttcagtaaatacaagatgggtgtttccatcttgatattataaattaagaaacaaggctgggcgcggtggctcactcctgtaatcccagcactttgggaggctgaggagggcagatcacgaggtcaggagtttgagaccagcctgaccaacatggtgaaaccccgtctctactaaaaatacaaaacttagctgggcgtgttggtgcatgcctgtaatcccagctactcaggaggccgaggcaggagaatcgcttgaaaccgggaggcggaggttgcagtgagctgagatcgtgccactgcactctagcctgggtgacagagcaagactccatctcaaaaaaaaaaaaaaagaaaaaaaaagaaacaaaagcacaatatgatcgtgtgacctgccctagatgctaaacctaatgagcagagaagcaagcaaagattgattccaggatttcctggctccaaagcctaggttatctccattgtatcaggctccttccaccacatctggatgttgactacatccagaacatgaaacaaaagcttcagtgctaaaaacaaacaaacaaacaagcaaaccaaactatcacattaagaagcaagtcaccaactgatcattttctgattttgctgtttccatggatggttccaaaatcctacctaactcatcaagcttaaatcaaagttgactcatccttacttgtcatcccatgtaaaataagttgccaattcctatctgtttcactttcaaaatgtttttaatcctgctgcttctgtgtagttttgaactggatagttctaataattgttgccaaagttccatactagcatctctggcttggactccttacatgctgaatccaactctcttagtttgcatcccctcactggcagatcctgagacaaggctttaagtgctggtagtttatttggagcatgaccccccaaacacaacagtctgggaatgaagtgagatgggaaaaggaagctgaccaataaaaggtgtgttatcaagaaagttacaactgtacatagctggaacttagtcctaacagagaaccctaggaaacaggatagagcatctgacttggagttattctaactgaggatcaaaagagcatcatttatagactggttcccattggttattggtttaggctacccccaagaactttttggtgttgaactcttcctgcgtgtagtgcaagtgagaagagaatgcttctgcagccagggaaatccctcagatgaaaggacttagatatgaaagttggaagtcagagttcagagaaaagatactggccaggggagtttatctgggtcactgtatttgctctgccagcctatatattatttctaaattaatcttcttagtgtacatctgtattagtccattttcatgctgctatgaagaaatacccaagattggttaatttataaagaaaaagaggtttgatggactcacagttccacatggctggggaggcctcacaatcatggcggaaggcaaaagaggagcaaagtcacgtcttacatggtggcaggcaggagagcatgtgcaggggaactgccctttataaagccaccagatctcatgagacttattcactatcatgagaccaacatgggattaaacccatccccatgattcaactacctcccaccaggcccctcccatgcataacatgggattatggaaactacaattaaagatgagatttgagtggggacacagccaaaccatatcaacatctttgctggagaaagctactctagctattaggctactcagagtatgccttgtgactttcatccttcatgcctttctcatattgtctccttttcttgattattgttttcagtcttaccctactccccgtcccacatagtcaaatgttacctatttatgaagactcacactgtgggcatttgtgattacatattatttttaattacattataacttgatgtaatccactagcacagtgttctaaatataatagaggcctaatggatgtttttggactcattgtctgacaacataacaacttgtgattgtctgaaaatgtaacaacttgtgattgtctgaaaatgtaacagcctgtgaactcttcgttgttcaaagaaaacagaaaaattccaaatatgtaactctttgaaattatgtcaatgtagatttgtttcaaatgttaatatatagtaaccagggaataatagcaatgaatttgttcagttacgatatttggtacttccaaatagcttcccatgatgaggataagataactaataattcttacagtaaaatattctttgattgggttgtttcctattgctgctataataaattaacataaacttagtggcttaaacaacccaaatttattatcttacagttctggaagtcagaattccaaaatggattttactaagctaaagttaaggtgtcatcatggctgcattcttttctggagactctgggagagaatctgttttcttgccttctttggcttctagagactgtctacatttcttatctcttggccctcttccatcgtcaaagctagcagtagccagttgaatctcacagagcatccctttgacattaactcttctgcctccttttctcatatttaatacccttgcgattacactgggctcatctggataaccctggcttatctctgtatcataaagtcagctaactagtagtcctaattatatctgctacgttaactcccctttgccttataaggtaatatattcgcaggttcaggagattaggacacagatgtctttgggaggccattattctgcctaccacaattgatatgtcccactcttccctcctaatttaataagacaatcctatactggtttacccttatctcgtaaaatattcaagatgtagtacagatgttcttgatgctagatgttgaattatgattttaacaaatggaggcttgtgtctcataatgtatatttcgttttgaaatagaaaagttgacttagaaaattagacttccatgtgtacacataatagttctgctacttgagatccagcgattagcctacttctagcattttcaaaataaacttgtcatttgtgtcattatcatagctgattagaaagtaaattatttgtattgaccacattgagaaaattaccatttagcttatggaactctttgtcatagagtgtggatattatatttgtacttgattctaatagtggttagggacattagaaggatatggagctcatcattcaactaagtccttacaaaataattcaatctctgttttagaagtttatcataatattagtacataaactgaacacaagaaggaatttataccatagaaaaattagagagaaaacttagaaaccatctcctacgagctctttgcttttcttgcgaagtggctgctatcaacagaaagagccgttgttaggctttgcatgttctggagtgacatctattagagaaggtttatcatctttgaccactttgcacttcctctcccaacaaagccttacaagcatgtgtttcctagagtggccacttggatcttcatcttccagtaatgttcatgatttgggtattcctagttctctctatccaaaatggccagttggtatcttcttaacccagttgtgcattttaaaatattttgtgggccaggtgcggtggttcactcctgtaatcccagcactttgggaggccgaggcgggtggatcacctgagatcaggagttcgagaccagcctggccaacatggtgaaacctggtctctactaacaataaaaaaattagctgggcatggtggcgcatgcctgtaatcccagttactcaggaggctgaggcaagagaatcacctgaacccaggaggcggaggttgcagtgagccaagatcatgccattgcactccagcctgagtgacagagtgagactgtctcaaaaaaaaaaaaattgtggagtccaaactgttactagttaatctggaaaattaatctataaaaagttcctaataatttatactattttttcttcctgtcacaatataaaaaataaacattacctgttgtaatctgaatatgtgattgtaaaatgattaagcccgatttttcaaccaaagagattatgacttaaagtgtttattatgaagttcgtggtaaatgaagaaccagaatgtataaaggtgattcagctataaataaaatttaattttgtgttaataaaagtaaaattagggaattatgaaaagatattttcaaatacaaagatgcatttaatattcacacaatattgatacttagtacccccatttaactaattaagaaattaagactagtaatgattaagtaactttcccacaattacttagctggctagagtctaacatggtatctttttctttctttctgtcttttttttttttttcttgagacagagtttcgctcttgttgcccaggctggattgcaatggcatgatcttggctcactgcaacctccgcctcctgggctcaagtgattctcctgcctcagcctcccaagtagctgggattacaggcacacgccaccacatgccaccacgcctggctaatttttttagtggagacggggtttcatcatattggtcaggctggtctcaaactcatgacctcaggtaatccacccgcctcagcctcccaaagtgctgggattacgggcatgagccaccatgcctggtgaaacaaacgtggtatctttttcataagaggaactcaaacattctattgagttgaaatacattgaatgaggcatcctttgttttttgcactgaataagctctggtgagagctctattgttgtctttaaataagtctattcttctaggactggctaaaagcccacttaaatgggagccctcaggtacactcattgtcttcattaacttcctttgttagaaacaccattcattcaacaatatatccaccaaaaatattcagaagtggatgacctttcttatgctgatttttgaattgtagaaaattgcggagattcttactaagttttgggatagaactctctctcactggtctttcctttaaatataaaatagaaccttgaatatggtaatttcaaatatgcatgcttttaagtgaattgtaagtttcttgcaaacagggattttgttacagtctacctttattctaacaagataatagtagctaccatttcagggcgtgtatgtcattaactgcttcataacacatgatttgacttttgcttttatatttctaacatttataagcagtacaatgtaatagtcacacataaatactttataatatttatcaataattaaaaataaattaatacaggaatctaataatttatagtatatgaatttagaattcattatttatattataataaatatacatttgtaattcattattacattatttatttattgcatctaccctcttgacactatttcaaagtgtgcataagtattgcactttggctttgagaaatctaaactaagaaaagataagcaaattttccaagggctcttagctagcatttgacaaaggaaaaattctaaccctggtctgtctgactccaaagatggattttattcctttttagtgtgctacattgcttgcaattttccatgagcctagcaaagtgtatcctgttggattgaagcatattttcgagtggagatactgtggtaaatgagatggaaggagaagatggtaactgggacacctactgaggtgtgttcttagaaccaaagacttcgacttaaactctatcatagatcacagttggtattagattcacttagaagaatataaaacacaaatgaacattatgtgtccttcctccttgagaatagtcatcacacaaatctatgtagcagttcccacagccatctgggtagttatctttagcgattcctttcccccatgtctcacatcatggaatacgaatcacattgtgtaggtgtagaaatcacctgggcgtaaaaacctcattccccagtagccagtatctcttatatcaaatctgtagtcacagcccctgaaaacatgctcagttgcaagtcatcacactcagggaagtgcaaagatatgacatccagatcaggcatctatacttcatttatagtttcttctagttcatgtgaaacttaccaatcaggactcatttttatcatagccagtatgaccttgtaacacatttgacataccacgtttatctgtcttcaggggatcagaactaaaaagttaccaaagatccaattttaacacaggtcgaagggttttgatagccttttacccaaaataattacagaatggatttcttgaaaagtagttttgaggattttgttctatttttaaggatgggaggatttggatatgacctcaacagttggtggctgagaaagagtggagaaaaagatccttggagttaaagagataagagaacagagaggctagaatgttagacagagcccctttgtatatgttgaaataagcaaaatgtggacatgtgggtaggtgaatgggacagtgatccaggctctaaaactcttactaaatgagagaaaatgacagggagatctgtagataactatagctttgagggaagatgggtgatggtggctgatggcacaacctcaaatgagttccttttattgaaagaagacaattcatttggaagaagtaattgggagcaagggaaacacctactctatctctaggccctaatttttctcatgataattcattgaagtgctgtaaaatatccaaacaaagtaattcagtaataagggaaaaaacttaaaaatatacacacaaatttataaatgtcatgtgtatatatttgtcctcaatacaatttctcctgatcagttgtgtgtaactaggatgtgtaataaatgaacacaaggacaaacacactgcagatatttaccctaaatatctcagtgtattttaatacatggaatattattgtgctgctttgttagtggggtataatttaggggggatctttcttgatagcatagcagaaattgatctgaatcctaaatactccatttattagctgtatgactttgggcaaattagtttactcagcctcagattcatttctcaagaaattagcccaccagtatgacttacctcttaggattatagttaagattatatgagataaagcacatgaagattttagctcagtgactagtgtagtaaatgcttaataaagctattattgtcattgtaattacattaaatcacattaaaaaatttagttcccctattaaatcatatgaagagtttaaagaaagtcaacggggtaatgtgttcagtttcttttttaaataaaaagtatgcaatattataatgattagagtcccatgtagtagaaggaagagaataaaggactgaaattataagactatttgtgcccttgattttaatttcttaccttgagtccttttgttatttagaatgaccccaagggaatcattccttatttgattagcagtgctacactttaaagagcattacttcccccttatctcactcccattccaaagaccactagggtataaccgttgcaaacatttgtactttgtctaactacaggaaaacataggaaagggtaccttgcattccaaactcaattttaaatcactggtaatggttttgactggctaatgcaatgggaacacctccaatatatgttggccagtattaatcttagcatagaaaatattcacttttaatttgatggtcattttttttctttttttggaggcagagtctcgctctatcccccaggctggagtgcagtggcacgatctccctcactgcaacctctgcctaccgggttcaagtgatactcaagtcttagcctcccctgagtagctgagattgcaggcacctgccaccatgcctggctaaatttttatatttttagtagagatgagattttgccatgttgaacaggctggtctcgaactcctgacctcaggttatctgcccgactcggcctcccaaagtgctgggattacaggcgtgagccaccactgcacctgggctggtgctgatatttagcaatactgccatctgtggtgttcatagaaacaaaaaaaatcctccaaatactgcttaaaggagtctcatcacacttgacacacatcttttaaaaatttgtgtttttctattgctctttcatctcaaagaggcctatagcagagaatgagtagcacgttgcgctgtctttggggtcctggataaacaacctctttcttttcttttttcttttcttttctctctctctctctctctctccccccccctccctccctctccctctctctctctctctctctttcctttctttctttgtttctttccttcctcttctttttttttgagatggagtttccctcttgttgcccaggctggagtgcaatggcgtgatctcggctcactgcaacctctgcctcttcatttcttcatctgtaacaagagaataaaaatgacttcttcacagatttatataaataatattttaactaagtaattcattttgaaatgtttatagaatgccatttacagataaggtagaaatagagtccttcctaaaagtctgttttagataattaatcactaaaattataattggagttgtcataatcaattatgtagcattgtttcaatgatgttaacattgctctttttcactggataaattgttatgtggcatgtcatcattctaatattcagtttacatgacacttcttctttaactctcctctgcagatattcaatctagagtttgtggcacagtatacataatttttggcagatgatagctaagtgcattgtataaaagatacattatttaccagatcaaaggtcaatgtgttcataatttaatatgccgagggtcatacagtccagaaatgtctgtgaatttctgaagtgacacacatttttgatagaaaactgccattttgtaatggatagcacatcaattggatagcccagcattcttttcagatttacatgtcaagttcatcagtgaggccctacataaatctactctaggattaatttccagatttcatctttaactgtatcacaattctttttttttgagacaaagtttcgctcttgttgcccaggctggagtgcaatggcgcgatcctctgcctcccaggttcaagtgattctcctgccttagcctcccgagtagctgggattacaggcaagagccaccacatctggataattttgtatttttaggagagatggggtttctccatgttggtcaggctggtcttgaactcccgacctcaggtgatctgcctacctcagcctcccaaaatgctgggattataggtgtgagccacagcacccagcctcttttcttcttaaataagtctttctcaaggaaattttcacaatattgctcttgggactcaatgtccttatgtggtaggacactacgttttctgaaaaattgcttattaatctggtatatgtgaactatgcaaattatgttttctattttagtctttagatgcagtagttttactattttagttttctcagatatattcacagcaaaagtactatcattgtagagtagtttcacttagcagtgaaagtaactctgctatgatgtggacactgcttctcatttttcttaataaatattatgtttgttatttttataaaatttgttcattagatatggagttttattccaatttaatgatgatagatgggttttatttttatttaattttactgttgtgttctatgaaagtatcttctttaaaatattgtgtaaagatgtcttaattttactaaaacgatagtaataataatatagatgatactactactaataaaactactattttctgaatatgtacaattgccaagcatgatttatgatttacataggatgccaaatttccattatatatcttcaaatttatatgttcattggtttgttcatctatgccacaaatgttaatggagtacctactaagtgccaacaactatgccatcaaccatgaatcagtcacttaacaagatagatataatcccttccttcagaaagcttgtagtctgggagaaaatttaacagttaaacaagacattgaaaaaagtgtgggccgggttgggtggctcatgcctgtcatcccagcactttgggaggccaaggcgggtagatcgcctgaggtcaggagttcgagaccagcctggccaacatggtgaaaccctgtctctactaaaaatacagaaattagccaggcaggcgtggtggtgcatgcctgtaatcccaggtacttgggaggctgaggcaggagaatcgcttgagcccgggaggcggaggttgcagtgagcagagaagattgtaccactgccctccagcctgggtgcaaagcgagactctgtctcaaaaaaaaaaaaaagtgtgataactgttttgatacagcaagtggatggatggaagaagctctatgagtatacagcagggatacatggcctgggaggaaaaagggctgaccatccattgaaaggtttaattaggtcagtgaagttgctcaagtacagctataaaatgaggcaatcaattactggtgatgcaggagagaaagtgatgtatggagaactttctgaactatagtaagaaatgtaatctgtattctaagggcatacttaattactgaaatagtgtattcaaaataggtatcataatcaaggaaacaatcttaaatcatcatgttccaattgcttgatgattattgaagctaacgtattaggaatagatgtattagctaatgtattaggaatagatgtttcctactgctgagttgaaataacgaacccacttgaactttcgcagacacctctaggtttaccttttatttaataagtaaataaaaatgttcatgttttctataatactttgcatcagctttcccttaatcttggaaacatttatttgactgaagaaattaagcactctcacctgcataaaatattcttctgtatgctatagtggagccagttgtaaagatttagttcagttaataaatatctgttgagatgctggcaaggctgtggagaaataacaacgcttttacactgttggtgggagtgtaaattagttcaaccattgtggaagacagtgtggcgattccttaaggatctagaaccagaaataccatttgacacagcaatcccattactgggtatatacccaaaggattataaatcattctactataaagacacatgcacatgtatgtgtattgcagcactattcacaatagcaaagacttggaactaacccaaatatgcatcaatgatagactggataaagaaaatgtggcacatatacactatggaatactatgcagccataaaaaagaatgagttcatgtcctttgcagggaaatggatgaagctggaagccatcatccttagcaaactaacacaggagcagaaaaccaaacaccacatgttctcactcataagtgggagttgaacaatgagaacacatggacacagggaggggaacatcacacacgggggcctgtctggggttaggagacaaggggagggagagcattaggacaaatagctaatgcatgtgggcttaaaacctagatgatgggttgataggtgcagcataccaccatgtcacatgtatacctatgtaacaaacctgcacgttctgcacatgtatcccagaacttcaagtaaaataataaataaataaataaataaatatctgtttaatttctgcagaagaccataaatatacttggtgtgtcaggcagtgatctgtaagtatttttgttcatgcaatcacaccaatcaaaattttgagcaaataccccaatatgtgtatatttttctaataacaaataatacatatattactatattaatatatagtatacattaatacctaaataaaatagagaattgaaataatggaatacaaataaatttttaaacagctgtaaatatttttctcatggctcaatcgaggaaatcttaaatatcgcccagggagtaggagcttattttgcataccatcacaatggggaaaagaaaaatgaatacactgttatgtctaccttcaaggaggcagcaatatggtaatagaaaagttcacaggggccaggcatggtggctcacgcctgtaatcccagcactttgggaggccagggcaggtggatcatgaggtcaggatttcgagaccagcctgaccaacatggtaaaaccccatatctactaaaaatacaaaaaattagccaggcatggtggtgggcgcctgtaatcccagctactcgggaggctgaggcaggagaatcacttgaacctgggaggcggaggttgcagtgagccgagatcacgccactgtactgcagcctgggcgacagagcaagactccgtctcaaaaaaaaaaaaaagaaagaaagaagaaaagttcactaaagctaaatgctgtgccctgtggtattagaagttagagctgttgtggttcaaagtcaggaagatattttcagggcaaatttacttgtaagttggggccaaagaaaggaaggtaatagggaacaaaggctggaaatacagcatgatggttctttagagcaatgcttctcccagtgtaatgtgtctttgaatcagctagaaatctgagctgcggcctgggagtctgcatttctaacaagctcctaggtgctgctaatgttgctggtatacagaccacactttcagtgtcaaggctttaaaggactttctcatctaaaatgaggagtttgtgcttaaattgataggcagtaggcaatttggaaaggtgttccagctcagagcaacatgatcaagttgaactctaggcaaagtaatttagcagtaatttatagattggaggccaagactggaggcagagagataagtctagaggcaattacaggtgagaggtaataagacctctgaagtaggacatggcagtagacacagaaaagggacatggtagaagcagaatcaacctgagaagagagataacaaaggaacacaggtataatatatagaacaaattaaaacgaagactagagaaactaatgagaaatgtgtcctttactgttcatctagtaatttggaaatttgaattttcatatatttaaatacatatgcataaatgatattttcagctaaccaccagaaaatttctggtagaaaatatcacaaaataaaactggctttgaatatgtttgtctttttccttgatccttatttccagaaagaaatacatgtcctggaagtatatgtccatagaggtccaataaatctcaatgattgtaaatagagctttattcatattgagcaaatgtttcctgttcacttgcctctaggtgaaaaacataaatgtctttatacaaatctctgaaatgtttgaagcataaggaaggtgaaagtggcaaggagacatgtattttcattataggctctgaatatccatagctgttttctgctatttagccacttcttcctttgtgacctgactttggacggcacacattatcaatcaggaagaccattatgttccttttacttgtacttgtcaatgtctggctgctcctactgcaagataagctccttgagagccaagactgtgtactattcattttgtatccccagatcccagtgcagatgctgaataattgacttataaataaatgtgtaaatgatcccagaaccaagcacagatatgaacacaaaaaaaattcctttggagtgaacgaatgaattaataagtaggcaagtgaaagaatgaatgttgacttagcccttagaatggccattgacaggttctgtttttttattactagataagcaccaaccttattctactcaaagtatgtgatcaatatttcactcattcatgtccacatactataagaagccttcacattatatagtgactttgaaatcaaagtctaagtctaaattttattataggagaaaaatgtgtgtgttgtgcattgtggtttagtataaatataagtcagattccttgacatcaaatcagttcaccattttttcactcacagactttttcgtcatccttttaagcctcccattttttctttttttaaaaaatgatttcattatactccattattgtgtatgtgtgtgtgtgtatgtgtatctgtgtatgtgtgtctaagtcaaaaactaacctcttctatgggtattttgttactatcctctgtaatataatgtgggaatctttgtccgtgagcataaacagggtgagtgcaggaatctagccatcagttctttctgtactatgcatgcacagcgtctaacttgtgcttgtaatttgtgattacgtcttcaggatacatagttttaaactaggccgagtgcggtggctcacgcttgtaatcccagcactttagggggccgaggcgggtggatcacctgaggtcaggagtttgagaacagcctggccaatgaggtgaaacctcatctctactaaaaatacaaaaattagctgggcgtggtggtgggcacctgtaattccagctacttgggaggctgaggcaggagaatcgcttgaacctaggaggtagaggttgcagtcagcggagatcgcgccattacactccaacctgggcagcaagagcaaaacttcatctcaaaacagaataaagtaaaataaatgaaaaaaataaaattaaactaacagctaactcacagtcttctgctaaaaaagtgtcatacattcagattgtttactctatcaggttagttactcatgctgctatactgtttccaaactcttaggattctagcacattgttttagtttaattttcactgttcctttaaatgtttatttaattcattttctaaaatcacagatatgagcagagccttggagaccatctagtagaatccttccgtggaatagatattaaaataaaaactcatattggttaagttactttacaaaggacatatagctggttattgaaaaaagtggagtaaaaatgaaaatctcccaaatccctaggacagtgatttctcttacgctgtgctatatcactaaaagattttatagtttccctttggccatcagagaagctatgtttaatgtcaagcctgattcatagttaacatcatatcttttgggagcctagatatgataaaagcaaaagagctacaggcattttgaagaagcacttcctacacactactatataccttgaatttgtactggaattgtttgataccctctcagtttattgatactccaaaagaccgaatttctaggtttgttttctaagctttgtcaataagggtagtatttagtcatgcaacactttagctcaaaatattatcattacacattgtctatatgtaaaaataactttgcatatgcatatagattttccagttccattcagcatgaggcatcaactctttgtagtcttttttatataaacacacaaaaattagtttatgacttgtgctatcatgtgttcatgctggaagacggtcagatgtatgtagaatatagcttctgttagtgctcatagtctggtggttcacaggaaaatgaagaataacacaaggaagtgcatgtaattattttaataacttcattcttgcaaataacagaatgaatgaaacaatgttttgcacaacctattttatttgattttcaaaggaagtcatcatgcaatagtccattgactttaattctacctgcttactgtcataaagtaatcttcatggcttgaacaatccagagcctgtgaaatctcccttgaatctctgcatctctccatttccaacaccatcagcctactcgaagtgacaatcttctgaacaattgaaactgcattcactcttgcctggtttgtttactcatcattcaggcctattttttaatgtgtaaaattttaaattttttgtttaaaaatgcaagtatgatcaagctgctctctgacttaaaaccatttggtaacttcctgttggtcttaataacttcccattgctcccaaatccttaatgagaccaacatattttgcttacttttttctctttctcctcctatcttcaccccattcctctcatcttactctctcagcttctctcaccatgaaagtgcatgccttgactttttcatcccagggcctttgcacatgctgcttactccatttgcaaagtattgtctgtcaaatgacttgcaccacttcagccaattatctccttttcatgcgtgaatttccagattcaatgtcacttccttaggaaagctttttcttcaaagactgggttagaattccctgtcacataccttctaacacctaacaccgtgcagtcctgcttcacagcaataatcatagatataatgtggaatttattgattttgttgaatttattgttaaattttatgctaaataaggccgtatgttctttgttcacttcctccatgagaaccttgcatcttgttttgaacacggtgaattctcagtaagtatttcctatcatttcaaattttttgtgcctattttattttttacataatatattggtagaatattacaggtatataatttatatagtgataaatgtagagagagaatatgtactcccttcccattccgcttccccttccccttcccttcccttcttcctttccttccctccctcctttcctcacttcctcctttccttcttatttttttctgtaacctaataatattgtataatcaaaaagtctggagacttctgcttgttttttacttaatacgtattttccttctatttaataaaaggagactggcctgtcttttaaattgcattttatggcctaaatttctactatatgattcaaaaattgctctgccatagtttgtgagaagacactatgttattttacttcctaaagaaagggtagtgaacaaaataataaaagctttatattaaagacaataaagttgatagtgttgtgaaatcatgttactcttattttcggtctgttttctttccagatctctttcctgatctatggtatatatgccagaagccataaatacttaatacagggtgaataaaagacattttaaattaagcatgcccccccaccaacattatcaagagtaaaatgaaatagaccaataaatcggcttacttactggccaacacctaaattgattattagatgtaatggtacaaatttgtataaatatcacacttccctctaatctttttaaatgaaatatgcaggaaggattgtcaaatggaagtactatactaaaaagcgattatcaccatggtaatgttggcttgcttttctgttccttttaatttggttaccctctttattgttaaattttttaaaaagttttctacttttacattttttatttatacttaacacataataatttaaatattggggtacaatatgatgtttcagtgcatgtatacatagtatgaggataaaatcagggtaattatatacaccaatttagacatttatcatttctttttggtgacagcattcaaaatcttcacttctatctgtcttgaaatatatattacattgttatttgctatagtcaccctagtgtgtaatagaatagcaaaacttattctttcctgtctaactaattttgtaccaattgactaataacctttcccaagaaccccctcccacataccctcaccaatgtttgctaactactattctactctctacttatataaaatcaacttttttaggttccacataggagtgagatcatgcagtgtttttctttctgaacctggcttatttcatttaacataatatcctccaggttcatccatgttgttgaaataacaagatttcattctgttttatggctgaatagtattcaattgtatatatatatatatacacacacaattgtatatatatattcatatatacaattgtatatttatattcatatatatacatctattgtatatgtattgtatatgtattgtatatatattgtatatatattcatatgtacaattgtatatatatattcatatgtacaattgtatatatatattcatatgtacaattgtatatatatattcatatgtacaattgtatatatatattcatatgtacaattgtatatatatattcatatgtacaattgtatatgtatattcatatgtacaattgtatatgtatattcatatgtacaattgtatatatatattcatatgtacaattgtatatatattcatatgtacaattgtatatatatattcatatgtacaattgtatatatattcatatgtacaattgtatatatattttcatatatatgaatatatatgataaatgtgatatattaataaatgtgatatatatcacattttcttcatttgtaaatgggcatttatgttgattctatatcttggctactgtgaatagtgctgcaataaacatgggtgtgcatatgtctctttgacatactgatttcatttcctttggatatatatctagtaatgggattgctggatcatatggaagttctatttttatttttttgaggaaactccatactgttttccataatggctattctaatttacattcccaccaacaatatataaggtaaattctttaggcattgccttaacctatacagtcactgcctcactatagaagttattttactctgattttgtggcatcattgtgttttaaacaaaaagtgtcatctattatgataatattatggcagctgtatttattttcctgctttctgtaaattagggtctcaagacttccttaagtacaattatagccaaaatctcatatgaaaaaaatgacagaaacatgcatcagataaaaaaatataaaaatcttcagtgactccaaaaatatatggtcatttagttttaaaagcaatttcaaactacctggtaggatctaatttaatgattcttaccatgatttcttaaagagtattcatcgttgcctccccttaacttttaatgaaaataactaccaaatctctttgttatttggaaactaaataaataaactggatcattaacctgaaaatgttatcagtggtcccaaagtttcactaatggaattttacatatttaaattaagcaataaaggataagaaaatatgtaataaaataattagatttaatatctatatgtggttcatggaaaaatcaaatgttactttgaaactttgtccctataataatatttaattataaaatacacaatagaaattactcttgagaataatttttatgtacctgattgcatttcaatccacatttcccatggaacctgaagcaaataccttacaaaaaagtaaaaattctataaggaatgtactaaatttgtaccccagcattagtgatagaatagatgtctacacagattacaaataagtcaacaagttatttgataatgccaattcttagatgaaactaaaaccttttacattatctatattgttcccttttatatcaacaatgatctttttcctttacctagtcaagttgctagagaattcccctttcaattcatgtagaaatcactttctttataaatctgtgcccatctgaaaacagccaatacttcttggatttttctttattcattcttcacatgactttctttatctgaaggaaaaatagtagatataacctatgaatcttattattcatcaaaaagacagagaatgaacatgtctttagggattactatgaaaatttgacaaaaactatatatgaagatgaaggcgagtatttgagatgacttgcaacctgtttttctgtttctctttcttagtttagaaattcaatataactatgatttcagataatacaaaccttgtcagttttgttttatgaataggttggatgtctcctttactagaaaaatgggaaatatgtttagtgaatattcaacgtatatgtagaagtgattagtatattatttattgcaatttgagaaaccaaattgaaaagtcaccataaattatgaagaaaaatgcataacattccaacccctcgataaaatttctttgaagttaatatgaccatataataacttttggtgttagaaatatatattttatttttacttgaactccgataacttcagcaaaatgctgttaaaagtattctgtgcctccctccattattgtattagatgttttaagaacataacaatgtggtgattattaagagtgaataattatatttaatgaactatgaccatgatttgaattttatatggatggtggtttactttctgttactgaatgttgcacccagtgttgtgggattttgttttgttttgtttttgagatggagtctcactctgtcgcccaagctggagtacagtggcacgatctcggctcactgcaacctccacctcccaggttcaagcaattctcctgcctcagcctcccgagtagctgggattacagatgcccaccaccatgcccggctaatttttgtatctttagtagagacagggtttcaccatattggtcaggctggccttgaactcctgacctcaggtgattcagcctcccaaagtgctgggattacaggcgtgagccactgtgcccggtcataccaattgtttttaagtcatagggtaaaattgaaagggcacagacaccagaattaaaatgcaggtctgtgtgaatgacctgaactactctggtcctcaatttttttcacccataaaatcggtgttagatttcctactttcccaggaagtggtgaggatggtgttgtcattattgaataaattcaaacatgagtcatgtaccacagcatctaactaatataaaacgcttagttgatattaattctattgtctctatgtgagtatgattaaatgtaaaaaagtaacactttataaggcaaaagatatttctcaaaacaggctgaagataaagattatagctatagaattatcaagaattatgaaatatataaatagaagtaaagttagttaacatttgggagatacagtgttcaatcagtaatttattaggcatgcaaaattaaggctgtagacatagaaaaataattatctgagagcaaaactaaatatcatgtctatgtttctaaatgtcagtacaaatagcaaatggagggaaagaaaaaaaaaagggacattttgctttcagcataacactccatgcatttgaatgtttattgtggttttttaatgggtaaaatagggcttcttaactgagagaatgaatttgtgttcaaatagtggttttcaatttgttctaagcttcttaccaaattgaaaataatgacccattttgccaataataacctcaagatgtctttaataacccaaggtattttgaaccattaaactggcttgaccaaattctgcttagtagcacacatgcagtttctttcagcatcaagaaaattactacatttttcttttcaaaaggttaagttagctgtgaactgaagtttttctaatttaaaggttttttaatactctataggtatagctaaatctcagtaattgaatttgttcgtgaaagcaattgtatgatcctagaatacatatgtggttttcagttcattgcttatggcattggttctcaacgtgtggttccttgaacactagtagcatcacccaggaacctagagatgcaaatttctggtccctgttcaagacatagtgaatcagaaactcaggagttggagcccagcaacctatttttttaaatcaattttattgtatatatttgaggcttacaacgtaatgttttgggttacatatagacagttactctagtgaagcaaattaggaaagctattgtcttggtgtagcttgtttatatgtgacaagaaccacaaaaatctacttacttaacaaaaattgctaatacaatacaattaacatgccctccaggtgattctaatgcattctgaaaatctatcaagtccatatctggcatttaataccatacattagtgtttgcagcagggaagcaaaagttttgaggagagagccctcatcagataggtctaatgaagtttaatgagtcttgtgtgattaaacattgacaagccggaagactttggggaatcataataagaatcattcgagtcatgagagtctcattggataactttcttcagcaattcattaaacattggagaatcaggatgggaagaggaggcactgaaagaaaaactggtgaatttggcatgggatcatttatctgaccacaagctgagcagggagactgttgtcttttcatggatgtcatgtctcttacagaacagagaggtcttggacttgctgctaaacccacccaaggcaaccaaattatggttgtttttattccagtaaagtggtggttctcagatcccagtgtacttgataatcccctgcgtaattattttgaatacgtatgcctgagtcacttcctgagagattgtgatttaggaggtccaaggaacatacttacaaaacagtgctaatggattgtaggtaggcggatgattttattcagatgccttgtacaaaatcagtattatttttggattgaaaaacagctaataaaaaaataaacacttaaataaagtattatcaagaaagctgttttaggaatctccacatatgggaaatactttttggtgcaatttctagtatcactgatttaataaactaaaaataatatcagataattgtttatattgttaatgacaatgaatagatagctactctatggtttactagtgttctgcattatgaaaggaacagaaaattcatacctttgtggtccagcagctactctaagtaaagtctcattttgactgttctgtaagtactttccttatcattgctaatggtgattacagggccactctattattgtaagttagctcaagcaacctggaagctgaggctacttcaatgatcatttacaagttataagaggaaattggttgtgaagagatatcccgcaaattcagaattagcatggcatatgctacttccatagagtaagaggaaacctaaaaggtaaaatgtagaagacgcagatagggaaaagcaaaaataaagcataaaagaatatgaaactgtctggatgatatgtgtgaaactttgccaaaagatgactcaaaaatcttcaatataagccgcataatgcttccatatatgtattaaaaggtcaacataagcatatggatttataaaaatgaacaatcaacaagatgcttttttttttttgagacggagtttcactcttgttgcccaggctagagtgcaatggaacgatctcggctcactacaccctccacctcctgggttcaagggattctcctgcctcagcctcccgagtagctgggattacaggcatgagccagccaccatgccctgcgaattttgtatttctggtagagacggggtttctccatgttggtcaggctggtctcgaactcccaacctcaggtgatcagcctgcctcagcctcccaaagtgctgggattacaggtgtgagccaccacgcccgccacagtcaacaagtttaaagtagttgacagtgtattgatatgagatgatttgcatggaagtaggaagatgaatgtgcagaaaaattgctgattttcaagagacataatttcagacaaagatttactaaattgttctggcttggctgatggtaacccatcacttgtgccgtgactcggagccataaaggaaaatatatcaaatagaaaaatgaaatatattaaggtgttattgcaaaatgcatgtgatgtttaggttacattgtcttgcttatgaagacacagctaagtaatagtacatatcaaatgtaaacttcatggagagatgaccagtggttaatagttttatgtaatatttgttatcgcataaaacacagaaaattcagaagtagatttatagtaaaaaccaatggggtttaatgatataggaattgctattccagtaaagtacagaaaaaaaactctcattaaaaagcataaaggttgatttatttaaattgcggtgggtttgtttactaacttcagtggataaagttctatagtaagaaaaaggaggcacaaaaagatccaggagacctggcgtgctggctcacgcctgcaatcccagcaactttgggaggccaaggtgggtggatcacgaggtcaggggatcgacaccatactggctaacacagtgaaaccccgtctctactaaaaatacaaaaaattagccgggcgtggtggcgggcacctgtagtcccagctacttgggaggctgaggcaggggaatggcgtgaacccgggaggcggagcttgcagtgagctgagattgcggcactgcactccagcctgggcaacagtgtgagactccgtctcaaaaaaaaaaaaaaaaaaaaagagaaaaatagaaaaaaagaaaggatccaggagtcttaactttgtataccaagtaaaaacctcacgctcaaaatggatattggttgtcataatgtgtttaaaatactctagcataatctttaaagaaaaatgatggtcatccttttgttatagtgacaagtcactacttatttatgttttgaattgagatttgtttatttttttccactgccttattgcaaagcacttgtcacataaaatatatgctcaagggccttggaaagccaatgaagtgagttatacatgggctgagattaatcagtttattatttcttaagcttagtagctataagtaaaagtaaaatgcaattcagtatttgaaaatgccacatactgccctctggagttttccatgcagaagaagaaatagaaaaatgagaattgcgaggatttagaaacgacatggagtagcttttaaaaataagattccaagctgggtgtggtggctcacacttgtaatctcagcactttgggaggccgaggcgggaggatcatgaggtcaggaatttgagaccagcctggccaacatgacaaaaccccttctctaccaaaaatataaaaaattagccgagtgtggtggcactcacctgtaatcccagctactcgtgaggctgaggcaggagaattgcttgaacccaggaggtagaggttgcattgagccaagatcatgccactgcactccagcctgggcaacagagtgagactctgtctcaaaaaaaaaaaaaaaaaaaaaaaaagattccagtgtatattccatgtagaaatgggaaaatttacatttttcttgaaatagtatactgcccaatatgatgcttttatttactctagcttagtagtgctaaaactttagcctgcatcagaattagctagggagctggttatacacaacttgttaggcctcagccctggagtttctgataccgtaggtctggggtagagtttggtaatttgcttttttttttttttttttttctttttgatacggagtcttgctctgccgcccaggctgaagtgcagtggtgcgatctcggctcactacaagctccacctcccgggttcacgccattctcctgcctcagccgcctgagtagctgggaccacaggcgcccaccaccacgcctggctaatttttttttttttttgtatttttttagtagagacggggtttcaccgtgttagccaggatggtctcaatctcctgacctcatgatccatccacccatgtaggcctcccaaagtgggtacttcgcttttttgacaggtttctaggtgatgttgatgctgctggtctaggaaccacactttgagaacccttgtccgagtttctcataagcaaatttgaaacaaacaaaaaaagcaacttcaaaggaattcctcaactgttttataaatgcacttactatggatggttacctttagaaaatttacaaggaaaaatcttgaaattttatggggattgttgaaagaggaacatttgtttcattcgatttttttcctctctagcaacttaagggatccatacttacgtctgatggtcatttctggacttacaaagacaatacgatacaattctgtttgtggtgaatagactttctgtatgatgaatgggtattagtttgaaaatgtgtcccctttctgctgtattgtgcccccttccccactaaaatcctcaatgccatttaccaatcttttcctgaagatttcttgttattgacaagcagagggagattggaccgtgattcaaatgaggttgacaaaaaccagaaagcatttgatttcaagactctaaatttacccaacgttttgttctggggatttggatattttggttataatggtcgtgatacttcctgactcatcagtcttctcagcattctcatttcccttacaactcaattgaaggctggccccagaggaactggggatctgtcaagtagtgttcatctcccttctcctataaagggagatgactgtatagtcaactgagctgaattctgcttcagtggagaagaaacaaataagggagaagcagttctgcccattagaggacataccataatacattgttgatgatggagcaggggggatgcctttctttttctctgagaaagaacagaccagttttgctttaatcacttgttttattggctcattttgaagatgtattgaatcatctgatcattacattcacaattatactcttaatgaactattttttctcactgtagttacactgaacttctcccaaaaattcgattgctgtctccagctgaatagacctattttattttatgaaaaattggcacaaaatgcttctgttcttttctagggcagagtggttaatttcatttgaaatatacttggttttcttataagaatcactgtgtatacatataagtacatttgcataaaatacaacatttacaataaaagtattgtttaaggtactgtattgtttaaattaattttctattattatactttaagttctagggtacatgtgcacaacgtgcaggtttgttacataggtatacatgtgccatgttggtttgctgcacccatcaactcatcacttacattaggtatttctcctaatgctatccctcccccagcccccgaccccatgacaggcccggtgtgtgatgttcccctccctgtatccaagtgttctcattgttcagttcccacttatgagtgagaatatgtcgtgtttggttttctgtccttgtgatagtttgctcagaatgatggtttccagcttcatctatgtccctgcaaaggacatgaattcatccttttttatggctgcatagtattccatggtgtatatgtgccacattttcttaatccagtctatcattgatggacatttgagttggttccaagtctttgctattgtgaatagtgttgtaataaacgtacgtgtgcatgtgtctttatagtagcatgatttataatcctttgggtatatactcagtaatgggatggctgggtcaaatggtatttctagttctagatccctgaggaatcgccacactgtctttcacaatggttgaactaatttacacacccaccaacagtgtaaaagcattcctttttctccacatcctctccagcatctgttgttttctgacttttgaatgatcaccattctaactggtgtgaaatggtatctcattgtggttttgatttgcatttctgtgatgaccagtgatgatgagcattttgtcatgtgtctattggctgcataaatgtcttcttttgagaagtgtctgttcatatccttcgcccacttttggatggggttgtttgatttttttcttgaaaatttgttcaagttctttatagattctagatattagccctttgtcagataggtagattacaaaagttttctcccattctgtatgttgcctgttcactctgatggtagtttgttttgctgtgcagaagctctttagtttaattagatcccatttgtcaattttgccttttgttgccattgcttttggtgtttcagtcatgaagtccttgcccatgcctatgtcctgaatggtattgcctaggttttcttctagggtttttatggttttaggtctaacatttatgtctttaatccatcttgaattaatttttgtaaaaggtgtaaggaagggatccagtttcagctttctacatatggctagccagttttcccagcaccatttattaaatagggaatcctttccccattgcttgtttttgtcaggtttgtcaaagatcagatggttgtagatgtgtggaattatttctgagggctctgttctgttccattggtctatatctctgttttgataccagtaccatcctgttttggttactgtagccttgtagtatagtttgaagtcaggtagtgtgatgcctccagctttgttcttttggcttaggattgtcttggcaatgctggctcttttttggttccatatgaactttaaagtagttttttccaattctgtgaaggaagtcattggtagcttgatgggaatggcattgaatctataaattaccttgggcagtatggccattttcacgatattgattcttcctacccatgagcatggaatgttcttccatttgtttgtgtccccttttatttcattgagcagtggtttgtagttctccttgaagaggtccttcacatcccttgtaagttggattcctaggtattttattctctttgtagcaattgtgaatgggagttcactcatgatttggcaataaaaaatccttctcaaccagttcaagttttatatttgtgtattctaggatagctagtgtggtagttagaataatgactccccagagatgttcatgtgtttatagctggagctatgttacctagtatggcaaaaaaagaaaagactgtagatgtgattaaattaaatgttaggggatgggatatgatcctggattatctgggtgggcctggtgcagtcacaatggttcttataaagtctgactcagaaaaggaactctaagtaaagctttggtaatcaacattattactgaacgcatgctgagtttgaataggctctgctgtgacttttaatttttttgtacaaccccaaaacataagtgatattctcttattggttttgagtattgagtccttataagagtacatgaaaggacagttcctacctcactgctgactagaacagtggttctcaaattttagtttgcactggaattacctggagggcttgctaaaagacaaaagtatccgattcagaaagttgggtggggcacagaaatttgcatttctaagttttccaggtgtgggtttgtgaatgagtggaatgggtaatctactcgtgagcactactggcccagaagaaggtttcataatctttgaaggaaatgaaaaaaaaatctactttaggcttattgatcaaattaacaacaaatcaatctctctctctctctcaagatttcactaatccttgtatttcaggccctttgttgatcatctcattgaataagccatgttacattggatagcatcacatataaggatggttgtcagtgcaatgagaactactgtcaaaaaaaaaaattgaggaacaatgttttatataaagcacctctgaaaacctgcagatataacgaatatttattattaaatatttttaatcctttttcatccttttgagattagtaagactcaagtacttctctattttcaagaagaaactcattattattattattattattttttgagatggagttttgctgtcgttgcccaggctggagtgcaatggtgctgtcttggctaactgcaacctccacctcccgggttcaagcaattctcctgcctcaacctcccaagtagctgggattacaggcacccaccaccacacctggctgatttttgtatttttagtagagacggggtttcaccgtgttggccaggctggtctcaaactcctgacctcaggtgatctgcccaccttggcctcccgaaatggtgggattacagatgtgagccaccacatctggccagaaactcaattatttttgttttttgaaaaaatagtggaacctccattaggctattcccttaattccaaatcttgtgctctatcagttgatcctcatgacctaatccaaacataattcctttttcatactttgctacattgctaagaatgtaaacattacagtgacgttttagattcctgtatctttatctgtatgtacatgtgtgtgcaatacatgctcaagtatgtctgtgtatatatcaaattgtttctgtgaaacaaagaaacggaggggtggtgagagttgaattgattcttggaaaatgcatccatgcttttgtgtttccttcttttgataaatataattactttaaaataaaaccttctatattgtctttccactgtgtgaactatttaaaattcccaaagaaagagtttaaggaacatgtgatctgactgagttgctaacatgtgacctggaggagtttacctggcctcttttagtctcaattttctcatctgtagtgaaaacaataatagtctcatcctaggtttctgatgaggattatataatatagtacttggaaggtttttagcacaccatgtgttcattaataattacttattagtattctcagctatttaatactatattctcactactcctatttgcaaaatagcactgttaggtctccatggagctctgaataaatcttttgaccataagaacattatgattcagcatctaaacctataattttttacatgctaatagtctaggtattactgtttgaaatacattatgttaagcatctgacctcttccttgtactttgaataccttgatcatttcagctaaagttcactgatggggcaaactttagaaagaattaggtagaagcattcactgactaattcagtcaaggaacaattctagaattcctactatgtaccacatactcttttttagagatacagcagtgaaccaaacataccaaaaattatgcccctgtggtatttatattctagtggagtgattgctctcaaaattgcataaaataaaggatggcaattatatttatataactgctaattcaactttatccatgtttcagattttcaagaaatgctcctttttaaattatcataataaagcagatgcaactgaagaccatttacgttcatttttacaattcatctagactcataagcactaataataaataatctctaagtcattgaaatattgtcatttatagtaagtatgtatttggtctttttctccatttcttggcaaacaactgctaaagcccatggaatctccaaaatagtgtctttgtgtgtaataatgagatgactgatggctctggcctcttagatagctttaagatggagggcggttgccaggggaaccaaccatgttattagagagttggaacttttagccttgcccccccccaccccatgccttccctgacctctggtagaggagaagggctgaaggttgacttgatcactgatagccagtgatttaatcaatcatgcctatgtaatgaagccttcataaaaccccacaattcttatggaaacagaaaaactgaatctggcactctgctttactagactaactcctgggcttttccattctgtagcatccaaaggaaaaaataagttttgtgttggttgatttgcagacaggtgtgtagcactaatgactgcattccagaagtggcagagctaaggtgatttgattttctaaaatggtaaaaaagcctttgtaaaattgcaaagaaaacaaaccaaaatcttcctttggattgcacatagttgaattgctagagaaatcaattacattaaactttgaaaaaagattttacatgtttatattacgtggagttaaattacacgctcatgtacttagttttttttttttttcacctttgtcaatgtctaaagaggcatcccaaagtcacaaaaattgtgaaacattgttttgtcatttggtaacggccagcatatgacaaaacttgtaacatatgtgccctgtggtaggcacaataatggccttcccaaagacattcatatcctgatttttggaacctgtgaatatgttagcatacatggcaaaaggaactttgcagatatgattaaataaagatcttgagatggggagattgccctagattatccaggtggactcagtgtattcacagggtctttataagagggaggcaggagagttagagtcagagaggatgagatagaagcagaatttgaagtgatgcgggaccatgagacaaggaatataggcagcctttagaagctgaaaaaggcaaacagaagggattcttccttagagcctccagaaggaaagcattcctgcttacccattttagacttctcacttccagaaatataataaatttttgtagttttaaggcactaagttttggttacttgtttacagcagcaataggagattaattcatgtcccaagtacttaaggccagtattgtcttccaatgaatgtgacgtcaaaaaaagaaaccaaatatttctatactgtttcctgtggagatgtactactctgattttttccctcttctccatccctgcagatgctgactgagttcgctctgatcatctcccatctgaatcaatatagctttctagaattttcccattcttcaaacttgcatccctccaatccagccccccaccatttgattgttcaaacattttttgtcaaacctaaatcctgttatttctctgcctaagcatccttatggtctcctatgtttctgtggaataaagtgcaagcaggtgactttgactgacaaacccctccatgatctacatcttgattgccttttcagtcatctccctcatcacatactcatctctataccctgtggtacaaactgtcatccccagtacagatgagattattttcttgcctctggctctttgttcaaacttttcctactgaatgagatgccctcctctctcctcttcactcccattccctattttattttattttatttacttattttgaaacagaattttgctcatgttgcccaggccagagtgcaatggcacgatctcagctcactgcaacttctgcctcccgggttcaagcgattctcctgcctcagcctcccaagtagctgggattacaggcatgtgccaccaggcccagctgatttttgtatttttagtagaaatgggttttcaccatgttggtcaggccggtctcgaactcctgacctcagatgatctgcccttctcggccttccaaattggtgggattacaggagtgggccaccgtgtccagcccccctttttttaaaaacaaaacaaaactttttcttgtttttaggacgtttgctcaaagaagctttgtgttattcctctagttagaactgaccatgttcttctttaggaacccatttcaacgtgtatatacttctattataaaatatacacatatttctattataaaatatacaccgtcatcctgacttgtttgcgtttccatttctcatttctagcccatgagtgcctaggtggcaggaatgatgttttattagtctctgtgttcccagcaacgaatatagtatttcagagagtagtagggtgcctaataaaggcttgatgagtgaattaaattaaccagtgctcacctgaggacatatgacatttgatgaaaattatacattgatttcagctgtaagaaatgatatttaaattattatccagccaaggtttgttttcttcaacgcatcacttaacatgcccctgtagaatgccattgagccacttaaattatgtatttttgtatgtttgtttgttttcttttttgagacagagactatctctgtcgcccaggctggagcacagaggcttgatctgggctcactgcaacctctgcctcccggattcaagtgattctcctgcctcggactcctgagtagctgggcctacaggctcatgccaccacacatggctactttttgtatttttagtagagatggggtttcaccatgttggccaggctggtctcgaactcctgacctcaagtcatctgcctgcctcggcttcccaaagtgctaggattgcaagcatgagccaccgcacccacccacattatgtattcttcattgagactgtgttcctattcttttttccccggatttcttgatgagcattttgtgaaagcacaagtaaaataatgttctcaagtcaaaacaaattaaataaatcaattcctattagtacactggacttgtcatagaagacaattttgtgagtctatatgagatgtactgtgttgttcctaaagccatgatgatttctgttattccatagaagtctaataaagcattcacagagtaaattgtacagtgttaaaaacctgccatctttatcactttcagtaacaccttctaaatgatcgtgagtaatttgtgattttaaaaattatatttttaggtatcaaagcaataatgaaagctttttgtcaagtgaatcactaagtaaaagtttgcatttatcattcatgtaattacagaatattcaattgactggaaacattccttaacactttcttcttaaataagcatggtggtaaatttccaatgatgtctatattcttacgttttgttttttcacagaggatcttaatggcatgtattcctaacctgactttatattgctatatgactttggggaaattacttacccatgctaggcctctgcttctctaactctaaaatgagaataataatgttgataatttcaggaggttgttgtgaatatcaaatgaaaatgccagtaaagcacttaccgcaatgcctggctcaaagtaaacgcttgatcaagattagctataaatatcattactagttgtggatacctgtgctttatttgtttatgacataatgctcttcatttaggaggcactctatgagtgctgttgactccatgatactccaagtcataaaacataattaaactacaaacctggatgtcaaggtgatttacaatgtaacagagatatgataaatctacaactaattataaggaagtatatgattaattgcttgagaaggtcaaatgtgtaataggtttataaagaaagcagaaatgacatttttagctgggctcaggtatcatggtgtcacagcagcaaaaaaaaaaggctccatttaagcatttaagaatgggtctaattttgacaaaggaaataaagaggtattctaggcaaggggcagcaaatgactaagaagaaggaggagagtggaaatacttaaataaagcaaatagttttagttttacttcagtcaccctactattagtttgagaatttttattacctttatctctaaataaaactcactgttaataggtgtttacataacagcctgtaataagcttttaatatttgttttcatgttgatgtgtgaaggtttttttattcataaaaattatgacacatacaaaatatagtgttgctataaaaatgaatgatgatcataccaattttttaaacagctagatacatgcagcagagttgaaagcaaataacaaaaattctggtatgaaaaatgatgtaattggcctcataagtcttctttgtgaccaacttggacagttgctctggctgatacaattcgttttgctataatcaactattaggatgccagaaatgagtttgacaccttgagtacaatcctttagtccagttttgaaaaaggctaggaactctgcaatagtaaaaatattaaaaagtcagtttaggttgagaaacccttgatttaaaagacttttatttgcaacaatggcctagtagaaaggaaagaaagatagaatataagaaaaaggaggaggaaagacaagtatatttgtaatcttgttcccatagttgtggcattaagttaccacggttgcaggaaaaagaaaattcatctctaaactgatctaaggtaggactggagtgtcatatctttaatacatatttctgttattactaataattataatgataataataggtatttacttattgactagtatatgacagatattctatgtggtgtttgtgtacataatttataatgcaagagaaatttttaaaaaggtatgtacatttcataggtaaggaagtcaaggtttaatgaataagtgacaaaatcagcatttgaaattttttctgcagaaaagtaaataccacatattctcacttataagtgggagctgaattatgagaacacatgaacacatggaggggaacaccacacactcgagcctgttggagttgggggggagggagagcatcaggaagaatagctaatagatgttggtcttaatacctaggtgatgggatgatctgtgcagcaaaccaccatctacctatgtaacaaacctgcacatcctgcatatgtatccctgaacttaaaagttggaaatccaaaataaaaataaagaaacttgttctgtataacaacaaagtatttagccattcctctgttctagacttggtctagaagggtcttgcatgatgtttggcttataaattgaggagcaaatgaatattttatgaaaacatttactaatcctcagaatcttctgccaagaattatgacatgtgtaagacttgactctacttgaaagctaacaaggtagcttgccacaggttcatgaatactggcacaaaagacacagagtattgggacagaggcaaatggccttattactcatggcaataaaaactccccaaaccccaattctgagggtgtggcatgaaaaaggtcagatgacgcctgtttgtactgtgagttgcattataggataggaaccctgagtatagggaaggtaaatctttatactggacagtaagcatgcatgcccattgctctgaaaggagacactgtcttcatcttccaaggccgttcacaatgcaaacatcttttaaaacatcatctgcaccaaagtacctctacttgcaagacttaaaaaaatgtgagcaattcaagaagaattttctcctaacacctttcatttacacaaatgtattcttaggcacatggaaccaatctatcccgttttcaccccttactcccctatcctcatactcttctgctttaactgttatttagattccaccatgctgccataggagagactctagctgtaatacattcaaactgacattgaccagcctgaaactggaaggaaaccatatacttatttggcacaagggaacttggctaactctgaaaagctggtctaaactgccctctagagctctactctaccaattagtgccaaatctaaccaattacatgcagttcccatgcatattcctctctttgtaaatgaaaagtaagagctaagtaagcagtgggtcacccagcttctggctaaactagaatagcttgcttccccaggagcctgcaatacttacagcctcaaccatgtggttaaaatcattctccttccacagactactcctctgtgtctttacaatgaacttccatccctttaagcaatctctgcatgtctcttcctttgtgactctgagaaatttgactggcaggataggactatatttatcttcctaattttaaaagcatttaattaccaataattaccaccaatgtgattttttcccctagtgcacattaaaaattttgaatcccattttctgtaataatttaagttgatctggagggacagagagtaattaattatctataatttctcaaactgtaaatgccgaatttattgaagtgaaacaaatccagggtagaataaggctgaaataaataggattgcatgagaaagaaggatgcagcaaaattaaatattttttcaaaattgaaagagcttaaagctcttaagtactgtagttgggttaaaacatacactttttttttttttttttttgagatggagtcttgctctgttgcccagactagagtgcagtggcacaatctgggctcactgcaacctccgcctcctgggttcaagcgattctcctgcctcggcctcccaagtagctaggattgcaggtgcccgccaccatgcctggctaatttttttatttttagtagagatagggtttcactgtcttggccaggctggtctcgaactcctaacctcgtgatctaccagcttcggcctcaatgtgctgggattacaggtgtgagccaccacgcccgcccactattttaatcagtatgtcaggtcatgtctcctaaagccctttttaaacaaaaattgagtgtttattgcttgcaaaatgtttttactgtaatgagtttaatatacaactgtgagccataagaagggaacaattgagaattgtgttgtttttgttttttgtttttccactgtggttctttaataattggtatagtttagatagtacgtgttttttatttgccaaatatgtaaacgttcttatgagcttctttacagaacgtcttcagtgtgaataagaataaagcagaatataagatgtgtctgtgcattttgcaacgtattgccatttaaagggcatggattttggactcaatcacacttaagtgttataagctctgaatgtattaatgatatgattttggacaagatatttaacctctctgatactattttcattatctctaagctggtgataatatttatgttgcaaatctcttgtgagggcattatggaataaattataaagatatctaaatcagtgtctagaactctttaaatgttatcttcatttccccctctttttcctagtttttcttgttcccttatgttccctaattatcttaatatctaattcttcctgttatataagttctcagaagaattatatattcatataaagtaagtgttcacctgttttcagtaatttcattatctcccatttgagaaattagaattatttcattactgctggtaaatatgaaaagaacaagaagaagagggaaaatattatatattttcctacccaactttttcctaaagcttagcactaaaagctcaatttttatatatacgttcataaattacttgaatcattcaaaagttgtctgggataatgtgtgattcatattttatatctctactctggcactatcagatctgtatatcaggaaatgtactttgaaaactctagatctttataccacaaacacaaggcattactattgataataatataatccagttatgggccacacattgtatgaggcattagaagaagtatgacgtgaatggcatgttgggtcatggtttaagagataagtggtttagagcatggaccttgaagttaggcagatcttgtttcaatcctgactatcactcactgtttgaacttagacatatcatctaaactctccaagcctcagtttcctcatctctaagatgtgactaatacttactaccttacagtatcattgtaggatacgataatgtatgcaaagtgtgatgtatactgactagtacttaatgcaaatttaataaatggtaattattagtactattgctaataagacaagacatctgtccttatggactgtcagtgtagttgagaatagaggatcatacgctatttggtatcatatgaagccagatgtcctatttccaataatagaggttttttaaaaagtactaaatgggtataagaaagattaagtttcattggttgactctccaaatcgatttcagtagcaaccatattccttgcacggactatcaaactgtggtacctgctgcagagggattctactgatattaacttatgttggtgttaaggattagtcaaagttgttgtgaacatgacaaaatactaaaagcacttagcacagttgatgggatacaccagtaattttatagatgttgcccatttgtatattcttgtcaagaaccaattttgtaaggcagagcttacaaaagactgttccttgctgagaaggctgacagattcctggtaattgatgccgatgtgtgttgaaccataattatgaactataattagtactatcctccatagattagaatggtctttatggaaatccttttttcaattaagtactgtttatggcttatgccaatacattcagtattaagtcagaactcttccctgatgaaagcatgatgaatcttgcaatgacctttataaacttaataaaataacattaattttaaaatcttgtatccaactcaattatatactggtgtattgaggatctgttctctataactgaggtgaataatacgagaaaatcaaataatattgaccagttgacatgaaaaaatacttattttggaattggctgtattgatattatattctctgaaatgcgcatatatttcaccatgtctcaaataatagattgtatatagttaagaaacatttgtcattcaagcaaaaaatgagtttcatgtatttgcaatctaatatatataggtatatgtatatatttgtgtttgcactgatcaaacaaggttaaatgtggctttcttgcctatttatataactaattgtgatgtacattaattgaggtaatgatttaataattataaaaattaaataaataagcactacgtatataatgtaataaacagaaatcaaccttatcacttacttttcttttaagtgtattgggctattgttcctcatgttccatgaaacctagtccgcattttataaccctcggagtcactttcaggagaaaaaagaaaagccctcctctcagtgattaatgtggcctgtaataatcaaaactctgtacttattttaaagcagtggtttccttcttcatttccccccacctccccatcagtctggcccagcagcaagctaaaagcccagtcagaaaaggagatattatttgatttcttctttctttccctgccatgtactttgacaccttttgctgtatctttcaaaccaggttttggattccttatgattagagtgtggggagggaaaagaaataaagggggcagcagagtgttaacttaactggcattgtggtaatagtccacagggcgcttcagaggtagcaccgacctcccccatggagaaaccttctgcctgtggtttctttcactggataaaagtacctccatttcagcttactacagtctccgccctcatccccaggcatttagaagctcttttcacatccttctgctgaggcatgtggcccttacagagatttatcttggtcagggtctaagatgcgactaccccagctccttgtcgcacgtggcccacctctgttccattcatgctccaacaaaatttgagaccaactccaatgcaagagcaaactctcctttgctatggaactccccagctagccagtctactcagctatgtatcaggcagcagtctattctttcgttctccacaaaccgaagggtgaaggttttctcttgactcagagtgaaggggaaagtattccccacccctccaaaggggacacgactcgcaggcatatggacagttgactccaaaagctgtttcaacttcttacccctttatgcccttgtgtgtgggtagtcaagagccatggcagatagaaggtgtcttgttcttcaactgaaacttaaattttaaattgcattacataatttttcagtatttctctattatctttacaaaagaacatatacttactgaaaacaaggtatctggcatccctagtgtgcattttggtggccccaaaatttctttgcagtgaacacatttaatagatggagtgattatttaacagggaagcatttatttgaactcttaactgtttaatataaccaactagtttatttcttttacattgtaatgcactaaaagtaactataaactagaaaaccaaatctatatcattgaggaacaattctattctcaacattgaatgccattttaagattaatggttttggcttataataagaactaaatataattttaaaaagctattttcctatttatccatttatgatatcttccaaataaaatgtgattccactaaaattattgatgatattaccataaattcctaatataaaacagacaaaaaatatatgtagcaatctattttctttgactgttgtcataaaaactattggatatgtggcgtgtgtgaatatattatggttatgttcagaacttattatctaactttttctcatgaggaaaaatgattaggaagtatgttagtactaaccattaactagaacagttaatatgttaaatgttcataatattaacaatagcgttttaagcacataccttaaagaacagtttagatattagccaaagaatagtattattattattattggttgagtgttctatatttacattataggatttttattagatagcatgcttataaacattcttcatataaaatatagctaaaagttgagtgattgaagataactttattgttttttagtttataatttactttgctataataatctttcccatatgaatatcatattgattatcagattttccactttgaattttgtatttgttttttcaaattgtcagtgttgttaatattgacaagtagaaataggtaaattgaacaaccaagctacattagtatttcctactaattttttaaattgctagtgattaaattaaatgtcttatataacacaaattctcagaattcccatattaccatcttctaaaataaagttttctgttttttaatttataatattcatcaatagaaactgcatcagaaaatagcccatatattaactcttgcatttaagattttggcagaataaaagataaatagccttttaggaaaaaatgtaccctatttctcccccaatacatcgtagatctagggtaaaactactcttttatagaaaggcaaatcaattgaaatatagaattattctatagatatagtgtagtaaaagattagggcaggttggaggcgggtgtcatgataaaaatgtagaacaagggagtaattttatgatgatgaaatgaaacagcctatatcttggttgtcatagtggttccacaaaatgatacatataataaaattgtaaagaattaatacacacataggcaaataaattccaataaaaactggcaaaatctaaaatactatatgtagattgtaccaatgtcaatttcctagttttgatattgtactagggttacatgttacttatggagtaaactggataaagaggacaggagacttctctgtattatttttgcaacttcttgatctatatttatttcaagttaaacgttgaggaaagataacctcttgaatgttttagagtttcttccatttaaccaaagttgtgaattgtttttcctcaagagacctgtttttcacagtaaggttgcttaaaattagagaatggcctaggaaattaggtatatcattaatatcaaatatacttaagtaaattaaaagagcatttaaaaatcattggactgaaatactttgaatcaaattctgaaagagaaacattaccatatataaattaggcaaagattattatgattatttaacaaataaatttagccatgtaaatgctttgtttttttctcatgaacatcatttatattcatggcattgttagtaaaagctagtacctctgtttttatagattttcatttttttaaaacattaacacaaaaatgatttatacagtgtattaaaagatcagtcctctattgcactgttagcaagggctatctaaagcaaataggaccttgagatctaaatgtattgctgcattcatgtgtagatatctaatgtgtacccaccatgtgctagacactattacagaagctgtggtgtagcatttggggagaaaaagaaaacaaaccccttttcctcaaagacttttctttctgttctggggagatggaaaaacaaatacatgtgtttcaggtaaaaatatttaaaacgagatttggtctataaaaagttgtttaaaagacactggtatttaataaagacgaaggaattacttgggtatgaaatggtaattatatttattaatagagcccacaaatgtagtattagcatcatactcagcatttagagaattctcaggagtggagtcgatgcatatcttttttctcacatgccccacagttcctttaccagaggaaatgttccctatatataatttgaatgcattgtcattactttttttttttaacactgctccccttgaagtgggtcttccagtattggagatcaagttccacagtcacctcagtttataggtgagaaaacctatttgaagttaactcgccccaacccatttaatcagcaaatggcaaagatgaatttcagttctggtcctctgactccaagtccagaacactttcagggtaggaagaattatctcagaatatcttttcaaatagatctagcacaacactctcaacttcattttcccagagtcttatatattgatatgcttttcacagatatttactgagtactctgtatgtacatggtttctaggtgctgggggtgagaagagatatagtgaagaatgagacctaggttctgacgtcagtcctaaactgtgaagtagaaattctgtgtgtgcacaaatgattacagtattaatacaagggagaaagtggatcatgccatgagggaggcatagataaagtgctatggaagaccacagaaagatcaactgcttctatttccagacacccaggaaggtttcccaaaggaagtggcttttgttttaggctttgaattgggaggattgtggcaatggaactgaggctgtacttgggataagtacttttatctctccaatatagtaaattcaccaatatcgtccaaaagtttgttcatttatctaactaattactttttttttttttttttttggagacagagtctcactctgtcacccaggctggagtgcagtggcgccatctgggctcactgcaacctccgcctcccgggttcaagcgattctcctccctcagcctcccaagtagctgggattacagacatgcgctaccacgactggctaatttttgtatttttctgtagagacggggttttgccatgttggccaggctggtctcgagctcctgacctcaggtgatccacccgcctcggccttccaaagtgctgggattacaggcatgagccactgcacccggcctatctaacttcttaacctaaatccctgaaccttccaatttctgtagaaatttacactctgaagcagttaggtggattcctaaatttcctagatagtaatatgtctaaacaaattttcttcggtaatacttgacaatactaccccattatcaaaataacttgaagttagctgccaaaaagtccagatttatgccaggctgtcaccatgatgattttaaatttctgcattagtagatattaaacatttccaaaagtgcttaaatttccatccactaatttttttgtcataaaatagagattgcagatgtattttgtactttgaagaatattaagggctgaataaggtggaagcacttacaactaatgagcctgcacatcttgagtgagctacctagagaatgtttctccttagcaataaagaacgacaactgctttgttctagctcagtaataacaataatatcgtagtatgtcctttgggaaactaactgaaatataagttcagataagttcacatccttgtaaagcaatgatattttgctatgttgctttcctacttaaagctgccatggataatgcacaattaagtcaacacatctaggcttaccaaaaataaattcctagattgtatttggtcttatccatacaaatgcttttggtttatgggcctgacaatggaggagattggaggtcagaataatctcataacagttactggttgaaggcctcttgttaacccatcattattgctttgttcctatgacctggcatcagacttacccttctaatcagcagtgcagacctcccccaccacccctcctcccattttaactagaactctgcagggaacctcacacttgcttgactgagccataactcattgtttaggtctggccagttttttctcttgggggcagtaagttcctatatcttaactgccaactcctgtaaagggtaattctccatgatgctgcatggtattacactatactatataatataatactatactattatattaatataatgggaagcaataatattgcatcctgccttaccttctatctagtgtatattttcctaatcataggagctggcttttggatagcgatgccagtcctgctcaaacccaacttcatctttttcttttagatacgattttaggattcttagaggttagagccacatactttccttattctgtgtcccttcagtcttgttggccctttaggttacatctataaagcctaaatatatgcgttttaagttttaattattcactgtgagtttttgtttaactgaattatttaatttacttatatacaagttgaacaaaaaattaagtagaatctgaaagttatcattcttgctttctacttagaaatatagaaatcatttccaaagaaacaactgctttattgtaaccaaggcttgatttagaaaaaaacaatccatgatttttaaatgtctgatgtctgtttggagaattatctcaggctctctggggggaaaaaagaattagtgtatttgattcatactgcccatctctaaacccaattgacagccccactttaatgaaaatgcagcctgactttcctgagtgaatcactatctgattatacaaatggcccacaaatttctctgcattctctatgcctatacttccttcattcttggcagtaaattttagaaaggttgctgattttttatatacatcctatattatagggcatgtgagtgacattctaattttttaaagtaggcaatttagactgttatttaaattataagtttactgggtatcagcattatattttcttagttctttaaggaggtatttcagtgagaattttttttttttttttttgagatggagttttgctcatgttgcctaggctggagtgcagtggtgcaatctcgcctcaccgcaacctccgcctccctggttcaagcgattctcctgcctcagcctcccgagtagctgggaatacaggcatgcaccaccacaccaagctaatttttgtatttttagtagagacagggtttctctgtgttggttaggctggtcttgaactcctgacctcaggtgatccaccggtctcggcctcccaaagtgctgagattacaggcgtgagccaccgtgcccggcctcttctacccattttattttggccatcattgtacaatattttgatccttgagttggataaaaatagaagacatgcttttcaaatatatggattatgcaaattaaagtaacagaatagagatttatgaaccactctcaggctagaaggaagtgacaatttaataagagaacatttaataaggatacacacagaatcctgttcttggtcacagtagtgcactgcagaaataaagaacaaggaagatgccgctagatttggcaaaaaagattttaggttttttttttctttttttctttttctttttttgagatggagtcttactctgtcacccagactggaatgcagtggcatgatctcggctcactgcagtcaccgcctcccaggttcaagcaattctctgcctcaggctcccgagtagctgggattacaggtgtccgccacgacacccacctaatgtttgtatttttagtagacacggagtttcaccatgttggccaggctggtctcgaactcctgacctcatgatccacccacctctgcctcccaaagtgctgggattacagatgtaagccactgcgcccagccagattttagagttttcatgcattggtaagctcagcataagttgacagtttgatgtgactattaagcaggcaatggcaattgttggccactttaatataaatatattccctgggtcagtatttctcagagtggcttattgcatcaaaattacctggagaaattgtaaagtatagaatgcaagacccaacaagttatccactgaaacgaaatctcttggtgtgggatctgtatttttaaaaaaactttcaggcagtttttatgcaaattaaactttaataaccattaaaatggactaagggcaattttgatgctattctgttttatcctgttttatcactgcaggatagttgcgttttactctcttgcttatactttaagaagggtgtgaaattttggctgcattcgggaaaaaagcaactttacaaaaatggggaactaattcatgtccatgagtaatgcatggagaaaatggaacttttacatatttaggatataattgaacaattaaataaattatggtggttaatttgactgttattcatgaatatctgataaatatccactaccataaagagattgttgtgaatatcagatagtaacatgagaaaatgtttgtataaataacgttacacaaatattttgattacaagtgtctaaaaagaagatgcacattaaataacaccagaaaaaatacacccaaatgataagtggttttctttgaatgatactataatcacttttttttttgcaaaatagtctctgtttatgaatatgctcttatatacttaaattaattttcaaagttaataaaaactatgatattgttaattacctcaaataataaagtatactgtagatgagcagttcccagtctttttggcaccggggactggtttcatggaagacagtttttgcgcagattagggggcggtgcagctgatttcggggtgaaactgttccacctcagatcatcaggcattactaagattctcataaggagcacataacctagatccctcgcatgcgcagttcacaataggtttgctctcctatgagaatctaatgctgctgctgatgtgacaggaggcggagctcaggtggtaattcttgctagcctcctgctgtgcggcctggttactaacaggccacggactggccctggtctgcggccttggggttggggacctctgttctagatgataaaacattatttttttctaatacaggcaaatataaagaataatggtatgaaacgaatggaagtaaattctgactggatttaggaaaaaattttttctgggtctcaataggatgtgataaaattcacttatttaatcatatgtaccaagttctactttttaaattttgttgaagcaaatgcaatttatactttttttacaccatattcattaagtacctactgtttgttcaggatatacccatggctgttttgctatactgatggaagtttataaggctatgtattaaataaataatgttctggtttttaagttgtgtatttagaacataggcctgaaagcaaatgcttgtgtaaaaagaaaaaaaaaatccaacagtcaaaaagtcaggtctatgttataagaaatacagcattcctggaaaattgcagtgctttacattgcccagatgttatcatcgctgttgggttccttggcagagtcattcagaggctctgcatagctaatactatcatggttctctgtggcacagcccccccttgattgcatttagtatcttcttcctccagcttggggcttagcagtttctactcaaaaaagtgacacagcaataaaatttgaaaccatagaatgatcactcatcctagtgatgtgttatttggcatctttgaatatatgactattgcaaatagttcatttcaaattttagcagattgttttttctcaattcaaaatcacattgaaagggggagagaaaactgccacagtggaacgtttgcaggtactccattttttcccaataaaataatgttttatcataaattcagcatgtgttaagattgacatatttatagcatatctgggcaggatatagcaactagagctgtaatgattgctttctctactataaaaactatgacgctcatattaatacttaagacatatttatattattaagctcacattaatattaccataaaatatgacagtttacaggccatgtattactacacgggatttttcttttcttttttttcttaacttttattttaagttcaggggtatatgtacaggtttgttacatgggtaaacttgtgtcatgggggtgtgttgtacagattatttcattacccaggtattaagcccagtacccagtagttatttttcctgatcctctctctcctgccaccctccaccctctgataggctccagtgtgtgttgttcccctccatgtgttacatgggaatttttcattcactcttttactcacttcatgatttttggtatttgattaggagcaagaaaaacaaggaaaaatagatacagtgtctctttccatctgacattttccaatgcctagagtctataattctatctttcatcctattagatatcataatccagaatattatttaccaattttatgtcttattaactacaagtatatttagccaaatatttgcatagttatttcaagtacatttatatttattattttatatttttcattgcctattttgaaattatattttttaaatttctaaaataaaattaattttgataactgtaatttttacattggtaacttttgtgcattttgtcagtttttatagtcattgtaacacatttaaaaaaaaatatgacgttgtctctgttttttaactaaaggcaatttacattaccattaacaaggatttgtatatttttaagtcataatataaagagtcccttccagagagtcctccattccagtaacatacttaggaaataaataatgcatatgcaaaagacatagaaccattgtcaagatagcactttccgttttctttctttattgggcagacctatacacagttcaatttgcattaaactattttgactttagtataatcattattgatttttttttttttttgagatggagtttcactcttgttgcctgggctagagtgcaatggcacgctctcggctcgcggcaacctccgcctcgcaggttcaagcgattctcctgcctcagcctcccgagtagctgggattaacaggcatgcgccaccacgcctggctaatttttttgtatttttagtagagacgggatttctccatgttggtcaggctggttgcgaactcctgacctcaggtgatccaccagcctcggcctcccaaagtgctgggattacaggcgtgagccaccaagcccgacctattgatttctttttaatgaagtttctaggtttaaatatgattaagtttccctaccactgtaaaagaaaagttttgcatcagacacttgatacaattggcaagacatatgcaaactatgcaaccgacaaaggtctaatatccagcatctatagggaactaaaacaagtttacaagaattgaacaatcctataaaaaagtgggcaaaggacatgaacagaaacttttcaatagaagacagacatacagccaacaatcatgaaaaaaagctcaacatcactgatcattaggggaatgcaaatcaaaatcacaatgagataccatctcacatcagtcagaatggctattatcaaaaatttaaaaataacagattctggcaaggttatggaggaaagggaatgcttatccactgctactgggaatgtaaattacttaagccattctggaaagtagtttggctgtttctcaaagaactcaaagcagaattatcatttacctagcagtcccattactgagtatatacccagaggaatataaatcattctatcataaagaaacacacatgcgtatgttcaccacagcattattcataatagcaaagtcatggaatcaacctacatgcccatcaatggtagactggataaagaaactgtggtacatatacaccatggaatattatgctgccataaaaaagaatgaaatcatgtcctttccagcaacatggatggagctggaggccattatcctaagtgaactaacacaggaacagaaaaccaaatactatgtgttctgacctataagtgggaaccaaacattcagtacatgtggaaagaaagaaggggacaacggatgccaaggcctacttgaaggtggagggtgggagtaggatgaaggttgaaaaactaccttattgggtattgtgcctatctgggtggtgaaataatctgtacatcaaacccccatgacatgcaatttacctatataacaaacctgcacatccacccctgaagctagaataaaagataaaacaaaaaattgtcaagacagactactacaacaggggagaaagattttagtacagaactgagatctgtactaggtgagaggatttttaaatgctgaagtatagtaacagaaaagtaccgaatggcactggggaaggagggaaatttgtccaatgtgattggaccatctatatgtggtcattgccccatttcaaagttaggctactaccatctcacagagactggaagatagggcccctatctttatttgtttttattgatacacaatagttgtacacatatgtggggtacatgtgatattttgatacatgtttacaatgtgtaataaccaaatcagggcagttgggataaccatcacctcaaatgtttatcttttttttgtgttgtgaacacttcaattctttcaagctgttttgaaatatacaaaaaaattatttttggcagggcccagtgcctcatgcctgaggccaaggctggtggatcacctgatgttgggagttcgagaccagcctgaccaacatggagaaaccccgtctctactaaaaatacaaattagttgggcgtagtggcgcatgcctgtaataccagctactcaggaggctgaggcaggagaatcgcttgaacccgggaggcagaggttgcagtgagctgagatcgtaccattgcactccggcctgggcaacaagagcaaaactccgtctcaaaatatatatatatatatatatatatatatatatatatatagttaactatagtcagtccactgtactgtcaaacactggaatttattttttaactgtatttttgtacccattagtcaacttcatttcctccccctctctctaccaccctcccaagtctctggcagcaaacattctactctacctccatgagatccaaatttaagctcccacatatgagtaagaacatgtgaaattgtttgtcattttgcatcttcctgtttcatttaacataatgacctccaaatatccatgttgatgcaaatgacaatattttatgacttttatgactgaatagcattccattgtgtatatacaccacattttcttcacccattcacacatcatttagtcaactgcccgttgatagacacttaggtagattccatatcttggctattgggaatagtgctgcaagaaacaggagtgagaatatctcttcaatatactaatcgcctttcttttggatacattctcagcagtggaattgctggatcatatggtagttctatttttagtttttctgaataaatttcttacagttctccacagtggctgtactactttacattcccaccaacagtgtacaagagttcccctttccgcacatccttgccaccatccactgtttttgtctttttgatgatagccattttaactgggctgagatgacatctcatgtgcttttgatttgcatttccctgataattagtgatgctgagcattttttccatatacctgttggccatttgtatgtcttcttttaagaaatgtctattcatctattcaggtcttttgcttatttttaataggattatgtgttcctatacgctctttgtcaagtgatgttatgtattcatttaatactcaactataatgattaataatagttgtagtaattatatttttcctataagtaaaataaaattagacggatatattgtattcctatacataatcctgttatgagttccctatacattgtgcttattaatccctttgtcttttgcaaatatttactcccattttgcagcctttctcttcactttgttgattgtttccttcttgatgattacacttcaaagggatggttcctaggcccttgagaaattcattcttgggttgtagaagattcatctcaaacagtcagaggatttataattgcaaggttcctaaactaaatgctctaagaaacggaggtttgggttggaacaaagattaaaattttttggtagcattgaactttttcaggaagaaatttaagggaactggtgtcagcatcctagggacttggccctgagttgttagaaactatgctattatttgttcaagtctcttattatggggggtagacaaaattgtttgtactgaaaattgcagttcccatagaccaaggttgaggcctagccgaggagagagttcagaggagactgacaaaagttggtcaaggaaagagtctttttcactgacccttcaccttaggaaaattgcctgcaagtaatggcttatattagtgaatgtaaattttgtaaatattttacttttctatacttatagttgcaattcaaacattcgaattaaagaaacaagttgtgaatttaggccataatatttgattttatacattctgtgagattctcccaaaacgcatgccatcccagtgtaagcctggtcatatatatattgatgttatatagcatgttatcagctacattttgcataatcagtgtggtagattctggattcagagttcatgacctcaaaaattgactccacctcttatcaactgtataacattatcaaattgattaaactgtccaagcttcagtttcctcatctgcaaaatgggcattatagtaataggtattgcataaagtaactgtgaggattaaatgatccaagtgctttgcagaattcctggccagcagtaatgactcaatagatattagtttctttttattttattttattttttttattattattattttttttgagatggagtctcactctgtcgcccaggctggagtgcagtggtgtgacgtcggctcactgcaacctctgccacccgggttcaagcgattctcctgcctcagcctcctgagtagctgggactacaggagcatgccacaacacccagctaatttttttttttgtatttttagtagagacagagtttcaccatcttggccaggctggtcttgaattcctgacctcgtgatctacccacctcagcctcccaaaatgcatgctgggattataggcgtgagccactgcgcctggccgatattagtttctataatttgtattagatattattagtactgaataagtactagtggagaaagtaattacctgatctatatcattaacttatttgaaaactcttgaaaataagagatttcagtttttatttgaattttcttctgtcatttgctctgtatacttgctgttcttagcccattttcctttatttattttgtgtatgtataggataattaatttaaaatgtgtcatatttaaaagaaaataattttatcagttaaatgttaattctgttttttttcaagaacaaagacatcttttcttctgattcataactcgcctgagagggagtagacctttgagtatgtataacctatatatagtctggcttatttattaatagaggtttattttaaattataattgaacacagagtttaggaagacaattacatttgagattgctaatcttggggtcagagaaacttgattgcatacaattccaaactctttgtcaagtgatgttacgtattcatttaatactcaactataatgattaataatagttgtagtaattatacttttcctataagtaaaataaaattagacggatgtttacatggattatctcattgcatttttacataaattacataaaacacattttccccctgaaggaaacagtaatatatacatatgtatacaagtatttgtaccattttaataccaaatagatctagtttttaaaagatatatgtactgaaaagataaaaaaatgtaaaaattggaagggataattattgaaaaataaggtgaagatagtggtaagttaatacacaaaatacatgccatacagttctggaaactttgctgtagttggcctataagtgtttaacctaatagtcacatacattttattgatggatcagagactattttatttaaaacgctttcccaaattcagatgtcatgaattcacatgccttccagtcctcaccccaagggctagaaatgtgcttttatgaagtctttcttgcctttttttgtggagtgggggcaggggggaggattgaaagagggaatggtactgcacggctaaatttcaaaattttgttctgtaagtggaattttaatgtattcttcattttctaaaatccaagaaacaagagaggccataaactatttcctcaaataaacttagaaacacagagacagttttgaagtcatcaaagataaagtaaaataacataaatgattgaggttgaattatctgcgaaaagaacaaacatactttacattttgccatatcctgggtcatgaagtcaaaatgaaatagtcattcaagatctaaactctttgaaaactctgtcagccaaaatttcgaattttgaccatgtttgctaagcatattgccttctaactcaaaaagcagaaagagcaatgcttatttttaattttcttgcactatgtagtatttcattacatttggccagtgttgtgttgagaatgctcctgaacagttcaatggataactatatcaccttaatttctttcttacgagttttagtgtggtttctcaagagaaccattatacccatgctgacctagcatgggatatactagaggagtatgtgtgcttggttatctgagacagtattcttttatcatatttgcctgtatttcactgctttgacttcattatagatatcttatatagactgaaaaatcatggacttatgaaggcaacaattcataccaaaaataaagagtgaactactaaattatgttacaaatgaaggaagacgttaatatcaaagcaaaacttcctgtcaacacgtgagcagtataattctaataagcagttaaaatagcttaagaacgtaaaacttgggttttataaatacatatatatttgtaaatattgatctggatagttattttaagctgctttgaaatcacatttgttccctttggaaatatgcaagagagacaattacttgcctctcagtggactattaaggtttgcctttgcttatacctggtacaaaataactatatatctgatgtaagcaacagagatatgttatgcaagagtagatacggtatgagcagaatcatgcaaataagattcatattagaaatcttgtgtcccaactctggtttgtcagtggtgaaaacagagttaacaggtaatgcataggttcccaaattcctgatgaagtaacatctctctaaactacagatcaaacctccaacagactcagtcaacaaaagccataagtctaaaaacccaaaatgaatttggcaatgagaaatagagcagcgagaaacagtactgggcctaaagagccagaatccattgacttagaatcatttttagttggttggatttaaaagtcttaggtaggggccgggcacggtggctcacgcctgtaatcccagcactttgggaggccgaggtgggcggatcacgaggtcaggagatcgagaccatcctggctaacacggtgaaactccatctctactaaaactacaaaaaattagccgggcgtggtggtgggcgcctgtagtcccagctactctggaggctgagccaggagaatggcgtgaacccaggaggtggagattgcagtgatccgagatcccaccactgcactccagcctgggtgacagagcaagattccaaaaataataataataataataataataataaataaataaataaataaaagtcttagctaatctttcttcattagtacttctcagagtataggaagaatacattaaaaactccaagcaaggggtgggaggtctaagatggagagtaaagtgttggcagtagacatcacacagtatacagccaagcatttttggccaacttcctgctttaggataaagaaggcatcatttttcccatttgacaattgagaatgttgagacccagaaatgatagataacttacaaaggttatacagcaagaaagaaatgaaaatagtagtagagcctgattctcttaccttctatttagcactctttcccagatgccatgttgatagcactgcctaaaatgtgtctagtttcgtacttttgtcattgttttgatataaggtgcagtgggtcaagagaaccatgatattcaattcgtgacatttaatctatttttattttgtttctatgtgtgactgcatgtgtatgttcttttttctgcatactgcatttcatttccactctcctccccagtacaaacattgtgttttaagtataaatttttttatttgaatggtgtcctttcaaagtatgaattgctttctgtttgtgaattataatttatgtaaaatacattctgttagatatttcatttttcatcttgttttctcactaaggtttattatttgttaggatccttccacattgctatacacctactctatgacttctcacttcatggtgtgtatatattgaatctccatgaaaattgggaatagcgaattccaagctatttatttccttgccaggcagccccttggctaggtgcgcttatacaggcacaagctatgcatctgtacatatctgcaatgaagcccatggttgtgtatccagcaaattttgcctctttggccttgatggaaactcaggttacttctagctctcaccattaccaatagcactgtaatgaatagccttgtatatgtgtcttatgcacctgcgtgaaaattttcctgggataaatgccaattgtagaattgctatgtcaaagggtatgtatatacttaatttgactaagtagtaacagatggataggcagattgctgctgctgtctaccctaccaccagtagagcaccaaggctcctatgtcaccatatacatgtggttggttccttttgtatttcatatattcttgccttgtttctctagctgcagtgaaggaagggaccattttaaatggctcagattataaatcctaggaattattaaactaccagtgaatatacttggcaggtgaaagtcaaccaactttcaaagtggttcaaattaatcatgtgttttgtgaggtataactgttgtttaatttgtgtttttagagctaaacaatgttctcaatcagacccaacttagagttgttttgcttttatctctgatttgtttctttctttcacccaattaaatatgatttaattttacccattatttgctttttaaactaagacagaatgaaaatgtcaaaaataatatgacgcttctaaacctgtcaagtatgaatgtcatggatcacgaggatttactgttatattttgggaagttggcataatataaatcgtgacgctcttctgatagaatgtgtcatcactttaaacccagatgtctgaattttacagcaaaggactctgaataaggaaattcttcccattgatctgataatgttcaaatatatcttaaggaagggatagtcaaatgtgcatcatttaaatgtgatcttagatattttaatctattcatttaatttattctttactcatttgcttctctaataaaatgaatgacaataatctaacttcagccagcttcagaaatgtattcagtcatattatcatgaaatatgtaattctcatgagtgacactgcctggcccactcactgtgtcattgggattgccctttctctaagctcgcatgataaaatgtcattccaggtgcaacttaagagtcacgctccccttgtcctttacaataatgctaggtaaatagcaggaactcagtaaatatgcaccaactaactgataggtaacttttaaaatatgaaatcttctattctttgactctgtagagaaagtgtttttcttcagctctatatgaataccagatatttactgaatgttttgccacgtctcagtcttgcatttgcacgtccgcacactacttttatgccatctgttgtctttcgtcattcaactgcttatataggtgaagaataaaaacggagagtgacagattagctgtattctatcttctaacagtttattataacagtttagttagctttcatcccttcttaaacacacacacacagagtgagagagagagagggaaagagaaagggagagagagagagagagagagaaccgaaacaaagtattctctcactttcttctcttttaaatataattaattttagtaaccattgtgggatagaggtggggccggtctgagatgaaaacaaaaattgagcaaaacagccataaattgtttgtatagagtgagcatctcattcccaattatttgttcaatgctattgacataaagtttcctgtgttctaaagaattaatggcatcacatcctcttgactgtgctgttgcttacttggccatgggtgtcctgaagtaggtgaccataaaatgtattattgaaattggggcaggcttttagctttgttaataattctgttgacaacaggggtgaaacaagacatatgcttatcctgccctcaggaagcatcagaatgagtagcttttaaattcgctgccaccatgatgacttgaaggatcagaaagcctcttatacttgacgcagaaacattgtagaacacctgtaaagtggccaaggtagtggaaaaaacattcaattgggagtagttaaacctgtatgatactgaaccaaggagcaaaatgatgagtctaaggcaaggagaagtcagacgtagaattcctaatccgtacgagactgtacctcgtcaagcaaaacttgggagttttaaaatgaaattttggaagaaatgaattattacaatagcaataaccatttttgttaccatcctggttttcctgatctctacatattggcatgccctggattcagtccttggtgtcttggatcttccctttctatacttacagtcttatagtctcagaaaatcaccttatatatcaatgccctcaaatttacatctgtggctcaaagccttctactcatatccaaacttggatatacaacttgctactcaacatctctaacagtaagtcagtggacatcttcacatgtcctaacctgaactcctgtccccccgcaaagcctgtgactttcaatttttaattgataacaacttcatctgtgtttgctcaggctaaatggtttggtgttgccccgacttctctcctcatttcacatcccatccctaataaatcagctttaacactaaaatacagctgaccctcgaataacatggaggttcaggggtctggcagctccccacgaccatgcagttgaaaattcatgtaaaacttaggagtccccccaatttttttttcaaaatggagtctcaccctgtcacccaagctggagtgcagtggcacgatctcagctcactgcaacctctgcctcccaggttcaagcaattctcgtgcctcagcctcctgagtagccagaattacaggcgcccaccaccatgcccagctaatttttgtattttaagtagagacggggtttctgcatgttggcaaggctggtctcaaactcctgacctcaggtgatccacccacctcggcctcccaaagtgctgggattacaggcgtgagccaccacgcccagcctgagtcccccagaatttaactactaatagcctactcttgaccagaagccttactgataacataaacagtctattaacacatattttgtgtattatatgtatcgcatactgtattcttgcaataaagtatgttagagaaaaaaatgttaagaaaatcataaggaagtacaaatatatttactgttcattaactgaaagaggatcatgatataagtcttcattatcttcattgtcatcttcaagttgagtaggctgaggagaaggaacaggaggagttggccttactgtttcacagatggcagaggcagaagaaaattcatgtgtaaatggacccgtgcagttcaaacctgtgttgtccgagagtcaactgtatattcagaattagacaacttttttttttctttttttgacatggagttttgctgttgtcttccaggctggagtgcgatggcacaatctcggctcaccgcaacctctgcctcccaggttcaaatgattctcctgcctcagcctcccgagtagctgggattacaggcatccaccaccacgcctggctaattttgtatttttagtagagacggagtttctccatgttggtcaggctagtctcaaacttccgacctcaggtgatctgcccgcctcagcctcccaaagtgctgggattacaggcgtgagccaccgcgcctggccagaattagacaacttctaatctctattcccgatcttcatcactgttatgatctcttgtctcaattactgctagagtttctcaagtggtctgaaaatcagcactttctacccatgcctcaaactgcctagtctttgtatagtaaccggaatgttcctctttaagcaaagagcagaatgtgtaattgctctgtgcccactcttgcaattgcttccattgcattccaaagaaaagctagagtttttacaagagctagtaaggctttttataatgtggcctcctgtgtcctctctaaccttattcattattctcatctgcagtcaattcacttgagccacagatgcttcccacatacatgtctgtgcatgccttggggcatggacactgcttgttctttctcctttcttctggaggctgtccttccagatatgccagaattaactttttcatcttagtctttacttcgatatattcttctcaatgaggccaatttaaaattcaagcgtaacttcccccacctccagcacctacctatttcccctacaattttctttgatccataacatttatcatcctcaaatatactctgtacttgatttatttttaatgtttatattacgttcctccaacaggaatagaagctccataagggcagagatctttgtcaattttgctcatagataattcccaagtacctaggacagtatctactagatgcttataaatatttgcagaatgaatagataaagtaagaagcccagtgatgtcaagaaaatgaattaccctctgtgcacctcaagttgtgcaaactaaaaagattaaataaaatggtttctatatgtcaaccaagcgcacatgtgtacattttgtgtcttgtggggatcctgattcagaaatcaaatgcaaaaaaaaagaaaaaagagagtgagatactaagaggtatttgaccatggcttgttattccattattttaaaaaattattcttatgtcaatacatgtgataatcataagccctttggttaagggcttatgtgtttgggatgcaaaatgaagtatttagaaataaactgatatgaaattgaggatgtggttttaaatattccaggaaaaaaaataagtgaaaggaataaatcaaacaaaattggcaaatactgctaattgttgatgaggggtgataggtgcataggagtatattgtagtgttctcattacttttgtgcatgtttgaaatatcccataataaaagaattaaaattggtaacctctgaagtccctcactactcaaaaaatcttttattagagccatcattttataagtagatcatttgtatcagatattaagaggatcattgggatccccgagataattccacagtataacgaaaacataaaggaagataaagagagaaaatccaatagaatgtcatttataaactaaaccttcaactgtaaatgatagttgttctaaactgtggctctgtctaaagaattttacccaaatttccattcattgtgaataactaatgcaagtaaatgggtaaattatgtctgtatatttaatcattgtacaaattatatcccataattccattagcagaatggagtacaaacttttttctaaataagtccttactaaatagatttaacagcaataactatgcaatttgactaagcaacaaactgccatttaaactatatattactatataatataatatgtcattaaaatataaatactaaaggctgtcaagatttttttttaaaggattgggccaggtgcggtggctcatgcctgtaatcccagcacttcgggaggccgaggtgggtggatcacctgaggtcaggagtttgagaccagcctggccaacatggcgaaaccccgtctctactaaaaatacaaaaaaaattagctgggtgtggtggtgtaatcccagctacttgggaggctgaggcaggagaattgcttgaacctgggaggcggaggttgcagtgagccgagatggcaccgttgcattccagcctgggccacagagcaagactctgtctcaaaaaaaaaaaaaaagattgtttatcttctatgtgtatgcatattcatagattggtatagatataaattgtgtaatgtggatatacaagtaatgagacactgttacatgaataagttctgaatcgtgagtcattttgatgataaaacatagaggagaaacagatgagatcatggatataacttgtttgaaaatggtctcatcccataaagtatagagaggcagaacattataaataggacagttaggtgaagaaaaaaatatatatgggatttgacacaagggcaaaatattcttattaattgttgaaaatctaggaaaaataataatgaaaaactttaataattgagtaatttaaccatgatttcttgaggctatgtctttttttatgacaaaacatgctgatatagaggatcaaaattagatcatagaaatcatagagacagcaaacagcatttttgttttctttgctgtcattttgttatcttggcttcagacttttttatcattgttttgtttattacttatatgttataaactgtctcccctggcccccaatctcctgaaagttttagaagcttgatctggtccattctctgcttgaaccacagtaacaagtatctcctggcccctccttccatccgcaaagttggattaaatcctacattctcaattgaactcaaatgaaaatgatcacttcttccttaaacattaactctctcaacaaatagcttcagatttatggtcttaatgagcctttcaagcatgttttgttagtcaacgaaattggactttaggcttatttgtttctttgtttttttgttgttattgttgttgttgttttgttttttgttttttgtttttgttgagacagggtctcactctgtctcccaggctggagtgcagtggtgcgatcacaattcgctgtagcctcaacctaccaggctcaagtgatcctcccacctcagcctccttagtagctgggactacaggcacgtgccaccacgcctggctaatttttttaatttttgttttgtagacatggagttttgccatgttgcctaggctggtctcaaattcctggactcgagcgatccatttgccttggcctccaaaagtgctggaattacaggcatgagacactctgcctggcctgtttcttgtattttctacagcagtgattttcaaacttttttgatgtattgacacatatacaatactgtaacactcgtgacacctcctggagttttgcagcactttgcctacaaacacctgcaactcaaacaaaagttcgctgagctaacacttattttcactatattctcaggtaagaatccaaccttatggagggtggcaaaggttaagatttcaaaggagatggctaagcaagcaaaatgttggcctgtcacaactccataggtgctcaaagtagacaatgagattcaatgggttagagcatgagtctttaatattcacaatatagcaaatagcaggaacagtagcatggtagtaccagttcctctgcctcaagtattacgaggtgacacaagaggccaaaacggtgactatgcacacagtgggttgtgctgcagctggggaatacagggccaaggtctcaccatgtagtaaacaactaacaagacagtctcctttccctggagagaaaagccttatggtagtcatgctgtggtcacttttacctaattaattgcctacgtgactagctacagaaactgctcagtaccatggtatcaagggatgataaagccttagaatttgtcacacttaaaaaggacaggcagggttgtttatcgcccatgatggactgcccttttcaacaaacctgtgatacatgattgaattgtttattttactccactttgataaaatgctagtctagaccaaatcaattgacttcatgacccaataatagatacaactcacagtttgaaaatcactgccttagattcctagtaaatgccttgcagattctaattcaaaaagccattgttaaacaccaaatatttgccaggtagtgtgttccatgctcagaagacaatgttatagctgttacagcagaagaatcatggtctttgtaacaactgtagtttaacttcccattttgctatttatttagtcattgtttagtattttggtctttattatcttattttgttcttgcgaagttaaaacatgataatcttggtgaggcaccttgtgcattgccaggtagctgccaggtatttatcttaaataatctgccttccatggatttctttgcagtgaaatattacacataagttaaagaaaaaatattgaagtggcactttaagaaactgcatgaaaattgaaattactgattgaactcttgaacttagaaaacacaaatcatctatattaaaatttatacattttttctctctctctctctctctctcacacacacacacacacacacacacacacacacacacacacttacttgtattatacaaaagccagttaatgagatgtaaaataaacttgaagcccgatgtggcaaagaccaaaggaaacagaagaaagaaaaatctgagattaaaaaaataaatttgtttttccttatatcctataggtagctttgaaactttgtgtaattgatattacttactattcattaattttctggttataattctttaaagacaaagtcaatcaaaatgttatgtttgctgttttttgtacagaaaaaaatctcatttgtttcctctaccaataaaatgccatgacaatgtagaataaatatataatttacttcatagtgcaggattatgctgaagtatacatgaaactattgtccaatgaaactgctttggtatgataagtttttatataaatatcaacctggacacatccggtataatttttattttgtaatgtttggcttaaccagtgcactctctttgttaccatttacaaatgaccatgctagctatttcttcagtctatggagaaacatggaagcctaaaatatttttttaaatagctatttcctcatatctcctaggtaagacatatccaaagcacgacaaaagaaagctaccctgtctttatattaaatcttgttgaggaatatttatagcatcccagagttataactattttagggtgacaatgcaactgatgttgagcaattatgttctgctgctatatcctatgtctatggtcttaattattaaaaaccaagaaatataaacctaaaattgttgactgctacctaaagataaagatcattattaaaatactgatgacaagaagtttcattattaaaacaataatgtacaactatggattcactttaaaaacttggtttattcatctgtattcaagaaacagagttaatatcaaagaaggcaaagaatattgaagcatattaaggaatgctgtgatttagcatttgtagtcatgttaatggcatcagactataaaattataatattccctcaatttagccacgtaaaaataaatcacttaatgacaaaagtacatattttagcaatctgggatttcatgtggaagaaatattgatttgccactgcatctgcatgtcaactcacatacttgagtaaaaactagtatttctgagaagacacgaaatcactttgaacctattaaaatggacaaaagtgacaatcagttgatgatatgaaatgcggtcttttgagccaaactttgacaatttataattttctgttgtgtgataaattttaaatggaaacagttgcataactcactagagtcagaacatacattataaataatttagtccataccctttgattaatcgataattgggaaataagtgaaatgtcagaagtctgccaagtagttattgggtgagccaagactcaaatctagataaagtatttattctactatacaaattaatgtcattaaaattattgctttatttatgtattcacgtgaatattctctaagtgtttttaaacacttacaatgtaccaggccctgtgctaggacctggggataaaaatggaaaagatatgggtctgtcatctagagatactgtggtttagcaagggagtgagctactaatatgaagaaggagaaggagaaggataaattattatagtacagtatgataattgtgctaaaagtcatcacagagttctaggattgtgcccagtaccctttgactagtagagaggggagaggtctcacttgaattacatcccttcttatctggactgttgcatcttgaaagatctcgccacttccagtttgaccttcctccaaatatttcctccaaattgctgctggggtggtctttctaaaatctgaaatttaatcagagcactcacctgtataagaaccatcagagtttctccatttcttcaaaatgaagttcaaattcattatcttatcatgagacctttcatgatctggctttagtcaatcactccagccttacttcctgctactctttcagaaacattctccaattcaaaagcatagatctacttatagtcacctctaggtctgggtcaaagagcttgagagcattgtagctcgaaggccaccattaactcaatgaaatcagcagtaatctttaaagaaaaaaaaaaaagaaaaattggcaataggagtcctgtgggagaagttaaagtttgtaatagtgactaagatgatagggagagaggaattctgggccgttaataaatcaatgataaggtacagttagggctaagcgtgcttttgtttccctaataatttatgtgtaatttaacaactaaattaattgaaaaccatgtttgaatctcaccttaccaactgcccacctggttgaaaattaaatactattgaatcttaaagacaggtattttttagaccaatttatatattttgctgttcatgttatagatttcaatttgacataataattcaccacaattaaaaatgttcttgaagtaaaagatatttacatgtctaacatatctaaatagcttgaaaaattacatgaaacattagtacatttttggagactcttatcttgcccttattttccaaaggataagttcttgaaattgagtaaacgacagaaatagcatagctagattataattttgaataatgctgaatactttctgatctggaacctgtaaaacgtggctgtagtgagggagctactcttggttgcacaagggaattgggaactgattgtggttacgtgaaaatcgtaaatgtcggatctcagtttaattgtggtagaaatatgtggtagatgattctgagtattaaacagctgtgtaaatattggaagagcagaaaatctaacataatacaacaaatacatagatcttctgatgttcttctttttaaaaagctgtaaattaaaatcctgtgtaggaaaaataaaggtaagatgcagtgtacaaatcagggtttctcaactctggctacacattgcagtcactcagggagatttcaaaataaactcatatctgggtcccactgctagacattctgcatcagttggtctgaggtaatggctaggcattagtattgcttttcttttccttttttctttttaagatgtagtctcactttgtcacccaggctagagtgcagtggtgcaatcttggctccctggctcaatgcaacctccacctaccgggttcaagcgattctactgcctcggcctcctgagtagctgggactacaggcacccgccaccacgcccagctaatatttgtatttttagtagagatggggccaccacacccggccttagtgtatatctgtttctgctgtgcaacctgagttgagaactactggttaacatagatgaaaataaggttcatatatttcagttataaaaaataaggcagaaaacttatccaatgttattagaatttttccttgcatagctatcatgcaatgatgtagttaacaaaaattaaattgcttacctgcaattttatgatgaaactgaccaaacacaccttccaaagatcaatggaatgaaggcaaaatcagatagaagtgtatttcactgtcttttgtgatttcacctctacctgactaaaactactaatgctcaggagaacgaatcaactgacagtgcatttttatataccccgtgaaggtctcataaataagacatggctgaaattaggtaggaggaacatttatcttgaaaatccaaaattcctaaagcaagggatcatatactgcatatgttaccgtcattatgccaaaggagcaatgtatacacacacatacacacacacacacacacacacacacacacacacacacacacacacacacacatatgacagacttctccagctctctgaactacaagatgctttataaaaccttcacatgggccaggcgcagtggctcacgcccgtaatgccagcactttgggaggccgaggcgggcggatcacgaggtcaggagtttgaaaccaacctgaccaacatggtgaaatcccatctctactaaaagtacaaaaataagccaggcgtggtggcatgcgcctgtaatcccagctactcaggaggctgaggcaggagaatcgcttgacccaggaggcggaggttgcagtgagccaagatcttgccattgcactccaacctgggcgacagagtgagagagcgagattccgtcaaaaaaaaaaaaaaaaaaacctgcacatgtatatatttcaccaaacaaatataagcacaaacaaaggaatgcagctgtcttaaatagtccccatctatttggtgtagatgtattgcaccatttttccccggtgcaagaagactagacatgtttccaatagaggattcacctcaaagcgttcagctttgccaccatcaagaatatttgaaagaatgtgccacacaaacacaaaaattaacacttattgtgaggccacaaacgttagctgaaacctcatttctgcctaacttctataaatattggcaatttcattgataaaattttgatacttttccagcttcctaggattcttgttaggattaaaaactaagctccctgaagggagagggttttgattattttattacctgctcccaagcctctggaacaatgtttagaacttaatgctaggtcaatatttgttcaatgaattattggaacataaggacatatgactgactaccttgcacttaggagttgttcagaaaattgtagttagtattatttctcttttattttattcatttcaagagatgcttgcctaacttgagttgccaaaaaaatgagatgggatactaagacagcggaaatgggtccttcaaaaagattgtctgtttctatattgcaatgatatctgaaatctgatgctgtgataagaaccaaaaacttatcaggggtggaaggattttgccctgaatgagaggaggccccggtgaagatggtgtcttataatatttggtcatcatatgcagggctggcatcttttaaagtgtagcagttttagacctagactgaaaatccattatatgtgtcgtattccaacctcttcccaaacaagactcggattgtctcctatggtttctggtcacaaaacagataaaataaaaccatccctcctgttaccctattcagaaactctgatagcattcttcatatctctcattctcaatataaatcactctccaccaaaatttgtttattctccttgtctctactcagacacctgcccaaccctactcaatgtaatattttctatatgttatagccagaatgatctttcataaaggtaaagttgataagtatcctgaagttttaaaaaaaaatggtacattctctttgcccttgaggtaatgtcagcatactttaaaagacttacaaggtttttcatcattttgcccctttggactctataggaaaaatacgtgtatgcacacacatacacatatgtgtgtctattttcatttatgtctaactgaaatttagtatttgcttcatttggaaatactagccacactaattagtggctattgaaagaaactgttactttatcacttgaagttacaaatattttcttattatattatggtttttgtaggtttctcagatattatttgcattcattgtcactccaaaattaggcctgccactatctcctgtcatgtaagtgtcaataaagaattacatgttactatattgcaaattcattttattactttttttttttttttgagatggagtctcactctgtcacccaggctggagtgcaatggtgcgatctcggctcactgcaacttccgcctccccggttcaagagattttcctgccttagcctcctgagtaggtggggttacaggtgcatgccaccgcacccggctaatttttgtatttttagtagagatggggtttcatcatgttggtcaggctggtctcgatctcctgacctcatgatccacccgcctcgtcctcccaaagcgctgggattacaagtgtgagccactgcacccagcctattatgttttgattattgcctttcaatataactggttttcatcataattcaatgaagttttattttgtgcatatataaacattccagaaaggcatccataatcaccaaatgccaaaggagtccatctctctctcctgtacgcacacacaatgttaagatcctcaggactatattgtaataccttgcatattattgttcacttgttttccatgtaaaatgtttacaccattagaacaggttttgtttcagaatgataacctcccagactgattcagtagggactaaattaatatgcatctaattaaattgaaatgaaacaaagccccgagatacggacagaatttcagatggtaattttgagaacacctttagcatttagtaaggtggtactctttaaactcatgctatgttgtcagtattaacatttccaaagtcactaggtttaaattttagagacttactttctgactaccggctccaagcatttattttagcctatgtgtacaaacattcagactggctatgtgatggaaaagtaaaaaaaaaaagatgacttttgtcctggccctcaaaatcttatagcttaagatctaattctccaaaagtagacaaaagttgcttgagtattgggttgcacttgtttgtatagtttttattcagataagaataatgaagactcttgttctctctttctatctattcctttataataatagtaatcatcatcatcatctcaggcaacagcatcctcaatgcggtaaattttgcctatcatataaaaaatacatttgaatatatagttgtatcatgtttactttcacttttttgtaacatttcaaaaagtattattctgctatgacattttttgggcttagtcatagaacaaatgtgagctgttagggaactttaaatgtcttagttttattgtttatttataactaaagagcatttttagtctactgtaaaggcaagttatcatatgctaaacaacataaaaatgactgaatattaaagttaaaacttttttatgagaaaatgagagacccctatgtgatttattttaaaataatcattgcatatgccctcacacagaaaatcagaatggtgtgattgttgcctgcatgaccaaaatcgattctgcctcctttgtggttagccaacacagtgacttcagcacctagtagacacaggttgtgtagttgtagtggtgcatccttagtgttatgctctccattgctggcaggacagattctttcatgcttgtcttctttaaagcattgacttaatttttcaactgaaaacagtaagtgacaaatggagcacagagtattttagaacatacccagaaagagcacttaaagacaataagaaatactcaaataattgaaataggaatatttttattattatgtcattaaactagctggtgcttatctgacatttccatgttagacatccgtgcttatctaacattgtaatgttccacgttccaagtctgttttatcttgacctgtgcactattaagtaccagcagagagtgatcaatattattgtccaaagcagtgcatcacaacctttactgggcactggaaacacctgaggatcttgttaaactgcaaattcggattcagacatgaggctgagagtcttgtaaaagaaaaattgaacagatcggttaaacaggtaaagtagactttattgaggactgttgtaataggagagagtttcatctcaactcttccactgaagcaaaaggtgaaaggatttttaaatgctggggtgagctaatggaaaagtactggaggacataggcaggatggagaatgtgattgggctggttaatatgattaggccacctgtgtttgctaatggtaccttatcaaagttaggctcctacactcctatagagactgggaagtagggccctatctttcttgatgattacatttcaaaggattggcgcccaggtccttgagaaagaatttcctaggttgtagaaggtttacatctgaaaggggcagagaaggaatttacaattgcaaattttccaaagtaatcgctctacaaaaaaggaggtaataggcctatctatagtcagaaagaagcttgtctaaagttgggagggggggaccattaaggccattgtggtcagtcagtatttctacaaactcccaggtggtgtcaatgccattggtctgcaaaccacaggtctgcactgttacactgataggaaagattccatattgatgattcatgttaacgcattttctagcttatacagtgtactgtatatagaagtgtgtatttgaaatggtcaataccattgtctgtctagatggataataaaagttgttgtgtacaatatttatagaatgatatcttttcatacttctagaggcctactcagaacatctgagtctctcctgatgagatgaaatttggaataagttatgtcccagaattcaggacacatttgatgtttaacttatttcactatgagaaaagtagtgttataatgatgttccacagttgtattttgttttaattattctcattaagcccctagcaaacaggttgcttcatcatttttttctttctttctttttttttttttttttgaaatggtgttttgctcttggaatgcagtggcacaatctcggctcactgcaacctccgcctcctgggttcaagcaattttccttccttagcctcccgagtagctgggattacagtgcccgccaccacatctggctaattttttttgtatttttagtagagacggggtttcatcacgttggccaggctggtcttgaactcctgacctcagacgatccacatgcctcggcctcccaaagtgcagggattacaggcgtgagccactgtactggctgattcgtccatttttaacagatgaaaaaaaaactgtaatcaattttggtcagtgacagtgcaaaaaatgcaatttaatactacaaatacttattacctgataaagttctcaaataatgagctaaaatagaatggatatgccaaaactgtagcaaatcattaaagacaaaataataacattccagggacttaaaacaaattgaattctccaaagaacattattataaactaatattcctaattgcataggaatggaagatttttttttttttaatgttagtcataggagtttcaagacatttgaatcacctgcgtggacactggcttttatcctattaaatttaatgtggtaatttagagtgtttttattagaataatcaacattctaaaatgcaatcattagcatatttggcatagaaaatagatctgaaatgaacccaaaaaatgagctttaaaaattgctaaaactagcagtgtataatggtaacacaatccaaaggtcaaaaaacacaatgattaattaaaactaaagaataataattaattagtagtattaagaaagctttgcctccttttcaaaaaaaaaaagctaaaaaggaaagttgttgaatgttattgtttttaaagaccagcttttcatgaatgaagtttttaatcctttcaaagcctaatctaaatttaagaattcaaacaaaaaatccctaatattttaatttgcaatcaggagaggttcaatcagactaagactttttaatttgacagtctcctttttaacacatagagctacttctttgatctgccttggttaatgaaatggatgagttccaataaatttggatgcaaagtaataatcaacagaattccatttcccattgattttcattgtaaacttgtatcacttttttgacataaaataagcactctctggaatgaataatttaatttgaaatatgaataaaaaataaattatggtgcagaatattgctaagtccttcatacatttgcagcactttgcatctaccactgcttacttcctagacagagaaccatttcctataataatagctaaaacccatgaaggatttcctatctggaaatagtttctataacctttacatctattcatcttcatgattacattgtttaatgggtactatagagatcgtcagcatccccattttacataaattgtaagtgccagagttttggtttaaaccaggttgtctgactccaaactcttcacttaaaaaatatattttatttttatagataataatacaaatactgaaaatatttacaaaacaaatttacaggtaatgaacactcttattactaatgaaggcaaatgcctttattactatccttgatgtcagaagctagaaccttgcgagccattccagaaactttccacgtgccttcttataaccatctccggacacacgcgtgcacacacacacacacacacacacacacacacacacacacacacacaactgtgaccattatgatgattttattttttggaatggcatccttacttttcttcatagttttgtcactcaaatatgcatccctaaacactgtagtttagttttgcctagtgtgtgtgtgtgtgtgtgtgtgtgtgtgtgtgtgtgtgtgagacagagtctcaccctgttacccaggctggagtgcagtgatgcgatctctgctcactgcaacctccgccttctgggttcaaacgattctcctccctcagcctcccgagtagctgggattacagatgcgtgccaccacacctggctaatttttgtatttttagtagagatgcggtttcaccatgttagccaggctggtctcaaactcctgacctcctgatccacccgcctcgtcctcccaaagtgctgggattacaggcgtgagccaccgcacctggccagttttgcctaatttttaaaatctattaagtttcttttaatctataggtttcttcctttatctttttcttttatttaaacagtatatgtgttgaggaagctaaatagtttgttctgtagtcttccgtggactggcttttgctgcctgtgtttttgtgatgcaatttgttttgtttcactatcatccgtattccctatctgccttgttgccttgcctgaagatcaccaaatttcaaggacttctttcctgctctgctccaaggcacttctcagcccactctggatgtgcgtgggtggtggccagtagaggtgggctgcaattactggcttctttagtaagagctgtgaggttacatatattcaactctgggtttctaaaggcccatccaaggacaagttccagggaagatagggcatgcatgagtttgaggcagaatgagaaaaataagcaacatacaatacattttttcataaaattaaatttctccttttaaagaagtgttctttattatatttcagttagcctactgtttcattggcatcgtttccctttcattgtttgtatttttgttttggtgaaacaaaaaattagaaacccaatgtcagtctttgttctcttcttatgatgctaatttccaaaattgaaaagtgttggaaactctgctttagccttaaattttctgcagaaaattacattttgaattttcataaaagaaattattggtcttaacccattctgtatgataatttttaaaaaaaaaaaactctctaaagtgtaccttgaaaaatagtacctgtgatttgtctaagcttttgaataattcattctatctcaaatgtatttctaccactaaagttgctataccactttatggaaagaagaaaagcaactttccttttttgtacaggaaacttgaaagttcatctcatggaaggtgtggagagaaaggtggctatgtaattctcctttggatatttctggatctgtttctcaatcagattggttccgttcacactgcctgctgtcatgaaagtttatgcctcgcatgcaatgccagcataaatttctcagcacaaaacagctctgcttgttaaggaagatgttctgaattatcaaatatatattttttaattagccaccctttcttatgctttcagaatatatattaaagtgatctggggtatttcatgttaatgtaagaaaaacaatccaaactccctttgtttcttgacttagcttattatatcttcagtacttgcaaactgtgtgatacatgatcagtcacagcacactgctatttactgagcatccatggccactggctgacgtggcattgaatataacattgtattgttgctctaagccttttagccttcgtgctaaatgactcaacccatcacaagaaatttataatggacatataactcacctagttagtctgcatgagattgatttgttgtgaagttattggctataatgtctttgagaggataggccttcatttcaaataaagacagcctcatttatggatttcaaagcatgtctatacactgtaagtctgtattaaagaaatgggatgaagccagctgttaaaaacaagaaaatatgtgcaaaaggatttggagttgactgtattatatagaagtattaaattaggagctttagggcatactgaagcttcatattgtttgaaagtttattttgaattctgtagaaaaatgagtactgttaattaggtgatgtggtttcagcattctcaggcgtctgctccccacagtatcaaaacctttgcccaagtccactcactttattgtgacccctgtagatgctctatcattatggtccctttaccaaaaaaaaaaaaaaaaaaaaaaaaaaaaaaaccttgttgtctctcaggcaaccagcgctttttgtcagcctatttcatctccccatcccttcctacaatcgtttatactactgaaaacttgaaagcccacatcccattctctcctggatctctaggcctaccaaagtttctttctaaaaccatgaaatgaccacaagttaatttgatgaagtgattcataataaattgttaataagaagtgacctacaactaggtcaggtcattcttcaaccacctattttattagtgatcccccacaggcaatacatgtgactgaagctggaatttgaactttctgtgatgagggccctgtagcgtatatgtgagacctctggtagcaggagtctctgagagcctctaactcatggtagtctgaaatagacataggcaaagccccagggacatttttaagagagctgttgtaagtaatccagtattataagttaagtctgtcctgtattcatcagaaaaaaacagaatctgctgctacaagatattaggatttctggtcttaagcaacagacttgaatttcactacctggattcttctctttggcttcatgtttgcagataggatggttgaggaggatggagctattgagagggtggctgctctgtgcagttgcttttgtttatattcttactgacctggcacagtgtaggtggaggtgatgcatgttttctgacattgggccagtgatgtatggcctgaccttcaaaatgagaaacatcatctctgtgggtgagactatagccgtgcaaatgcttttatcccatattgctcagcagtttgcaaccggttctgataaaaagcacccaccccgctgagttcgctgaagcttgtatattggttttaggttgaacattttggcaaattaacgactgagtgaaaccataaaattggttttatttacaacaaagccttgtggtgtctgttggttgttcttacatctctttcctttaatctttgaggttgtttctgtaggtggcttatctaactttacattgaaatttgcattcatttcaggataatacttcccctgggtttcttcttaattgacattggacatggtctgcattctcaaactttgtgcataaagttggtaactatacagagtcctagtttacgcctaccccaggtgattctgattcgggagatgtgagatggaaacccaaactacacattgttagtcagtaggtgactcccccagtgtgaatctactgatctcatgtttagaaatactgctgtataccatgcaaagctgtcattttctaactctgctaaacaataaaggttcacaagccatacttctgatttgccataaagttcgagtttttctccatttggttcaatggtgttgctatggatggcattcatagcaaatgataagattgggcatagtatactttgagtgaattcttagttttccttagaacaacaagataatgagttagaattataagagagccatctagtggataaggatataggcctgttgcatcttgtcttaatgtcggctttatggttttatcagattacagatttaaatataaatgaaattaagtgtagatatatactctgaatatattacattaaatatatattaaatgttagtgaattttgtttttgttctttttgttttaaaaaaataatttcttattttataaatgagtctgtacttttaagtagttctactcctttaaatgaaacatggatacagagatgataagacatgattttaccgtaaaataaaacacacattatatttttagggacataaatataggctagtaactaaaacatattttttaatgcctactatatgttccttggatttgaatgtaaaagagatttcaggacttaaatagtagtttatgcaattagagaatgcagaaatagcgtgaaagaattatagtctagatacattactattttttatatactctggaagtttttaacagttcgtaacaaatgccttgggcagattagggcattgccaaaaatcaacatcatgctacttacatttacaatcatctgacagtcatctctcagacgagcatcctcctgattgcctaacatgtttcttttataatgtaataaaggtgagttacacatttgagcaacagtgtttgtctgttatacctagagagaagaaaaaagattgtaggagagcaagatacccaagatactaacttttccaggcccacattttaagtgtattgtcaaaagaagcattttatttttatttttttttacttttttattttttttgaggcaagtgtcttgctctgtcgcccaggctggaatgcagtggcccaatcttggctcactgcaacctccacctcctgggttcaagtgattctcctgtctcggcctcccttggagctggggttacaggcacccgccaccgcacccagctaatttttatatttttaacagagacagggtttcaccatgttggccaggctggtcttgaactcctgacctcaagtgatccactggccttggcctcccaaagtgctgaaattacaggtgtgagccaccgtgcctggccgaaagaagcattttaaaagtttgatattttaaattaaattgaagatactctatcacaacttaacattcttatgctgggtcatccctccttcccctgtactcaagctcctagaaatctcatctatttatacctgactctgctattcaagtaacttccaggttttcttcccccagcgctacatcttttcttctcttctccaggatcctgctggacatcacttcctgatattcttctggcacctcaacatggcccaaatcaaattagttatctttgcactgtttttgtattgtgtatttcagttaaaggggcttacctttaattttcttaagaataaaagattatagtcttatttaatctttctttttttcttatctccttcccccagtttcctgttggttctacctctaaaacctatctggcatcattcatcaggatactttgcaaaatgaggattatgaggtcaggtcctgtggtaagcagggagccaaaaataagaccctcagagtttcttgcctccctgttgtacacacccagtaaaatccccttcccttgagtgtgtatgagactatgaataggatggataccacacccccgactaggttacgttatacagcaaaatggaagataattttgtgtatataatttaggctgcaaatcagttgattttgagctaatcaaaggaagattattctgggtgggcctgactttatcaggtgaaagcccctaaactaggaactgggctcttcctgaagagataaattctcctgctaggaatgaagtactccttgacaaagtaagcagccatgttgtaagcgggcccatgagagggccatgtggccatgaatttcaagtggcctctaggagcaaagagtggctcttgtctgacaactagcaggaacagagatctataaccacaaggaaatgaatgctgccaacaaccacatgagcttggaagagcacccaagctccataaataaatgcagcgtggctggcacctcaatactgcttcgtgagactcggagcaggggacccagttaaaccgcacttggactcctgacccacaaaaactgtgaaataataaattcaggttgttttaagcactattttttaatttttaatttttatggatatataatggttgcacatatttataaagtaagccactaaatttgtggttatttgttatgcagcaataaataacaataaatgtcctcattatcttttgctttggatcagtgcagtaaccttcaaatgaagctctcttagctcatccgtctccatgaaatcctacataacacagccaaagtcatcttccttatcctacataagacagccaaagtaatctcccttataaacagactataatgtaacctccatgagatagggttatagatagagttttgttcaaagctgtatctctagaagaacgctaacatttatgcatgctataaatattgactgatggactcaatgaataaatatcatctgtcctcctacacatacatcaaaacctttgctggtcccttgcctacagagacatcctccagatacaagaagagggaaggtatataataaaatgcttcagcatacaggttctagagtaaaaccttgggtttagatttcagctctaatatttcctagctttgtgatctcttggaagatgtatgactttactaagcttcggttttccaatttataaaacatgaataacttttaccactcaagactgtattgaatattaaataagacaatgcatttaacatattttcacagtgcctggcctatgcaatagatcaacaagtattatttatgattataacatttaaggccctttactatatacctttccttcctgtcctccagccttatgaagctggcacccttgtgtttcctgcctttgcagcatgatggagagtgagatgcatggatacttttaaagtgtccacttctacgcatcccctgctaaatgaccttgagcaagtttcttcccggtctcagtttggttatctgagtaatggggctaatttgaatacatagttctcgagtttgtattgagtcgatccctgcattagtcagtcacattgaacaataaccaaatattggccactgaggtcacttactgcaggaacaatataatggacgtctttcataacattatgaagacccatggaaaacttttcttaatattagaaatagttgtgttggtactgaacaatcaacggttgttattgtttttatctgaccaggcttttctctttgaattagcttctagttgagacaatctgtactgactctagttcagaccttgttccctgtctctgtgtatttccttttttctcgttacaaatttctaatttatgttttcctgctatatttaggtaagttaccttaaattcattctttaaaaaaaaggtagaagtaagtatataaaaaccttccatggttgttacatatgtaacaagcactattcctgtgtcatttgtgtgagggtatgtgtgtgttttaatggtgagagttaacaaattatgtaagaaacactgacattggaaaactgattttaaaaaaacaacttgcaaaatttcatcaaatgagtcttgtttcttgcattgaacagatcataaaagcaattcataaaaaggcaaatatagtgattcttacatcacccatttagttaaagtatcccaaatgctatagcataaggaagtacatgtgctaggcagcctttgagttaatgaactgatgttgatgttaaaactggtgcactcttttctcccggaggtatggctgaatctgtgccacagccagccactttttcatcagattccatttgaaagtcaattgatgaatcagccctgatgcctcattgaacataatgtcgagaagcaagatttctgtactctattgatgtgtttaagcagcatcaaacaagcacacacatcaatggaaatatcggtcaaatcatttgtcaacaattttatagagaatacagttgacttcctaatttctccactgtttgggttgctatagtctaataaatcatgcttctgcatggagacatactaatacttcgtggaaaagtaatcagaagtcttaattgaaataaaattatatttgtccctgtttaaagatattcaaacactacttcagttcacagacttaaaagtgaataacttctttatgaccttattgaatgaggatgtgattaatgttactaaagtcacacttacgttggattgggggactgaccgaccatgctgtgagatctttagcgagaaaattgagctctcttctggttagcgttgactggctatactttgtgctagccatcactgacttccacctaaaaagataaactgtaggtgtaagcagcaaatatcaagccgtcttaggctgtattcttctattccttctctttttttttttttcctttctttttctttttttttctttttttttttttttttttttttttgagatggagtcttgctctgtcacccaggctggagtacagtggtgcgatctctgctcactgcaagctccgcctcctgggttcacaccattctcctgcattctcctgcctcagcctccccagtagctgggactacaggcgcccaccacgcctggctaatttttttttttttttgtatttttagtagagacgggggtttcaccgtgttagccaggatggtctcgatctcctgacctcatgatctgcccaccttggcctcccaaagtgctgggattacaggcatgagccaccgcacctggccccattccttcttcttcttaatatttttccatttcaaggtcacaactgcaataccttatatatcccatattagtaatgaggacatctgtgttgcactggtattgttaaattggccttcagtaaaatcaaaccattccttgcagtaatgggtgagaacttgcctttcacctagagccaagttcattacaaattcatgctcacagcccagagaaaaacagggtttttatgaggtttcaacaagtaatatatctgcatgatgggttgttccaagaaactaagcaaatggaaatgtcagtttgcagaaactgtcaaaacgaacataacctaattagaattgctgcttatttaataagccatcagtagccctaccagatagagtcctgccaatcttgcaagtactcattcatcttgcatttaagtttgtagatactctaggctctgctaatgggaaaacaacgttaattagataccgcacccaatcattaaacagctgcaagcatagttagtgcccttagctatgaaatgctgtaagccttcatgtgaatataccttgatatgtcaacatgggaccccagtgtgtattgcagttataaaacagtgtgcatcactgtatgctttgcacatggcagatcctcgcaatgtacacatcgataagtagtttttattaatgtatattccatgtgtttgaattgcatgtcacccacttaaggtaggttcttatttgatgcccgtagtgtttgcatattaagggccctgaatactactactttgcttagtaacgtgtctttacagacattacctctgacttcatgttttatggttgttagtaattgtgaaacaaatgtgtctgactgccactgggcaatgctgcttcaatagagtacacacattaagtgtatgacattcaaaactagcagaggaggaactctgaaggaggtagggcaggggatgacaagagtgtgggaggaggagaggtgtaaggagaggtattatgaaagaaaaaataatcatgcttttttaattgcataaaataatttgattgcaagtttcaaagacaaactaaaaaagaatgtaatcaattatctgcgtgttggcacaatagaaatttatggggagactgtggaggaaacgaaatgagaacagctgaatgaagtcaatcgctgtgatgtggcgccttccctattgttgagaatggaaaagagtgcaaatgcacagtgcaccggatttgtcagcaagctgtgttttctcggtatggtagatctctattgctcatgactattgagaaagacctacacacctgcttctgttattctcaagctgaatgatgaggacagagtttataaatagcctttctttcctctctgttaagtgtttcctcatatgtgggagaaggtagattatctggctatctaaatatcacctggaattgttacaccatgcagtgaatgtttaagaaatgagagtggacgattttggttgatggttttagttagctacaatgttttcaacatctttaatcatattatccagacttcttatttgttcttcctgtattacctattgattattataattctggctccatatacctgttacctagagtcacattgatacatttttgtcatcatgtgacattgctttccctcaatctcatatgccatttctaatctcattcttgctttactgtttactcgattacatctgaatctgggaatcactctctcatccaacataacagcagcccctcacatggctcctttgcttctaacttgcctcaatttctttctagccagtagagatcaccaagacccaatttggtcatccattatgtttgggaggacagaaatattattttagttatatattcagtgacttacaattgtttatcacaaacctaaagttacctgtagtaagcactggatctgtttcaggtacactgtcaattgtagaaggtagttgtggacatgaataaaatgttagagatgtcagaggccgatgtggctgtctttagaggtagagttttattggaatatggcctagaactttattttcaaaacaaaacaaagaaatggataatcacctcttttccttatcaatgatctcttaatctctactgaattagttttgcaaattatcactgaaagaggatttcaagaaatatgattttaaattatctttttcatatttctctagattttaaaaagctttctttaaaaagatgacaacctttaaaaataacttttagataccatatatgccttccaatctaaaaaaaatgaaaatattgataataaaacatttttctccatggtctgtgttaaaatttatagtctgactcactcaatactaatctatgtggaatttatcttgggtagtctaatctttgttgcaaaaagtgcaatacatgtcttccttgctttaagtactgctttcttatgtgatagaaaactgttacaactaaattacattatttttaaaaatatgatattttttaaatggagatctttttgaatatcataccacattcaatttccagttaatcaaatggcaagttaaaaataagtagtgtgcattagatttttattgctgcagttgtaaattaccaaaggcttagtggcttaaaacaacataatgttattatcatactgacacaggtcatactgatcaaggtctcagcaggactgtatttcattctggaggctctaggagagaatcagtttcctttgccttttccaacttctagagcaagtttgtccaacacgtggcctgcgggctgcatgcagcccaggatggctttgaatgaggctcaacacaaatttgtaaactttcttaaaacattgtgagatttttttttttttgcaattttttttagctcatcagctatcattagtgttagtgtattttatgtgtggcccaagacaattcttcttcttctaatgtggccaggggaagccaaaagattggacacccatgttctagaggcttaccacattcccatgacttatggcacctttcttcaatctttaaagtcagtaacattgcatttttctcatccttcttcagtagccatatctacctctctgactcttctgcttccttcttccacttaaggatggttattattaaattggatccacctggataatctaggctagtcttcctttaaggtcagttgattaacaacagtaattccatctgcaagcttattgccccctttactatgtagcctaaaatattcacaggttctggggattaggacatggatctttttgttgggggaggcattcttctgcctaccacatagtagtatataggtacacacacacacatatatatatatatatatatatatatatattttttttttttttttttttttttttttgaggcagagtctcactcagtcgtccaggctggagtgcagcggcatgatctccgctcactgcaacctctgtctcccaggttcaagcgattttcctgcctcagcctccctagtagctgggattataggcgcacgccacctcacccggctaatttttgtatttttagtagagacggggtttcatcatgttggccaggctggtcttgaactcctggcctcaggtgatccgcccttctcggcctcccaaagtgctgggattacaggcgtgagccacctcgcccggccttataaatatatttatacctaggtttgcacatggaagcaagcatcactattttagattatggacatcttaattttcaactttggcagtaggtttttacctgtaaaatgaaaggaaatcaacctgattatatactgtgtactttgaatccatttgaggcctacaaattgtttgtaaaaacaattgtttttgtccaactgctttttttccaactgcatatatgatttatggaatttgatgataagatcatggaatttttctcaaccaaaagtaatggtttgtgacactaatacatgaagcacattccagaatgatactccagattttaaaaagagtaaaggcaaaaaattgctaacgtctccaaacattttcctgtgagccactaaccattgctaatgtttccttgacaagtgaagaaaacaattattttttaaatattctgtcaaatggtactattttcttcaggtcaattctaaattccaaaatttcagggattatgagcaagctctcgatcgctctcatccagaatttatagtgtccgtgaaactttatgtgcagtacaggaacattttacattttggggttaagagttgcaatagtttggatgattcctctgcaaactgaaactaatagagtcatacaatacaggaccatgttcttaaggcaaatatactatatagtgaatgaaagaaatggattttggtaactccctttcgggctgaactgagtaagcagttcttcacacaaaggcaccatgatacagtgataaaaatggtgagttgggataccagaaacttggtttctggtcctggctctgtctctaattattgcatccttttaaacaagttaaaggatagctttttgcctcatttctctcatttaaaaatgagtttaagaggaattatcgctgaagtcctggatcatgcacagcttctgtgatgttataatcccagttttacatggccaccacatgcctaacatcatctgtggtggctcctggaaaaaagaggggatgtgagcaaaaaaaaggaaatacagcagggagatgtgatatgacaaaaatcttgctaccacaattgttggaaacagaaagcttactcaatcgctgagagctaaaaagggcttttatgcacatctccttgctactttactgttttctgagttcaattccaatggaaatggtaaatatgaaggggccttaaaaagaaatagcatcaggatgttttactatagttctgccttattgtatatggaatagacttgatactagaaaattgacagcaaagtgtagttctctatataacattttttttccccaactgcttttgtagaactgaaactgcactcccaggggaagataaacgatcccacaaggtgcagtaaaagtcagagaatgctattgcagtagggacaagatggcccagagacacagtctacccaacacccacatttaactgatgcagacctgcaaacagagagtcttcatgattcactcaaggtcaagaagccggttagttacagagtcagagctgaggctgtatttactctttcccacaagcaaggttcaactgttcctacttgaattgcatatgattacatacagtatgaaaaaggatttttttctgttaactgttgacaatattaacatcagtcactaattttaataatagtacttaattgatgctttgtatgtgctaaacagtcttgtaggtgttttactcaatatagttttattaactcatctaatcatcccaagaattctgtgaaataattctacgtacactcctactttacaggaggggcgcccatgccccatttaaagatgacatttgaacttagacactttggctgtaaatccagtgttcccaattgtgctataatgcctctgaacttaaatgctacaagaaaaatcaaactaccaggttggacctcaattatgattacagtcatatgagatgagccacttaattgtatggatctttagatatataacattttataacttgaggctcattcattcaacatgtagtgattaagcatctattatatgtacagggatttaccaggtgttataaaggctaccaaggataatgtaattgataatgctagtatgcgtgataaaatggtataattcaaagtataacgaatagcattaataacaacagttcttagatagtacgtatttaatatgggccagcctttttgctaggcaccttgcatatattatctcataattttcaccccagtcattaagccaagtcatatttttccattttagaaatgatgaaacagacgtgaataggtaagcaacttacccatacttacaaaggaagtgacagagttggtattcaaatctaggtctgtgtgaataacaacctcattttatttcaactactctgctttaaattagaaaacccaatcctatcaaaagaacacgtgaggcccctctccaggcccagctgggaggcttattgctgaatgcatggccagaatccattgtggcttctttttgcacagatcttacatgttccccggggggtttattatctccccatatatggtaaagaggagaaatcctggagttcatctccagtctttctgtttaggctttgcccaccagtgaaatttaagagcagagtattgcaaagcgtatttggaatatgttaagaacccttcattttgcgttcatgctttgatgcttcaacatccttctcattgtcctaattttgagtccacattcaaaaccagctgaaaccccttgaaaataaacccaaccgctggcatctggctccgcagccacccaccttgcttggtttgctttcaaattgcccggtgaaattcactggcaccaatcacaagtcctcatgctctctctgctcatcacctattaggtcaagcactcatgggttgtgccgtgttgtggccctgcatggcatactgtcaccctctctctgggacctgtgagaataagaaatgtcatcctctcaaatcactttctcttgttctcctgtggcgggaccaactttcccataccttaaccaacacctacattcttagaacagatggaatgaatggaaacgaagctacacaactttctaaacttgtgattctaacttcaaaagtaatgattactttttctctttcctgctgcttttctattttatctctcatttttctaacatcttttctctcatctacctctgaagatccactctacctaggatctggagccttccttaattcagtcactcatttagggactgtactgagtttcaccaggggtttcaccaaataatgatataatttcagctctttatgccttttgagtgacactcataggaagagaaggattgcatctctacctctaaagggtcttgaattgtgaaagagtttccctcccctcttctcttgtgctctacttcctctgctttcctcccctccttttccctctcccccacacatgtaaacattgtgtaattccatgtgtgtccctgttatctatttgtttctagtgttaaggtgacttacagcttaggggtacaactgtatatgtattatattcagatgcagacttgtcaagacaaatacagtcttcctgacactgatgcatgcagtcaacactggaacagaaagttgatagctgcattaaaatttttgcaatggctgccatagaaacccacgcaagagtgactttgcgctgaaatatgacatctcagggatctgtctggtgaatctttgacacagaaagagaaataaattagaaaacagttttccacagagccttttagatccttaaaacttgagtctcaaagcacttgaacaaagtaactatttggaaaaagaaaaggtattcgttcttggcatttttaaattcattgaatagattctccttaaatgttaatagcattttgatgggagaattactctattcagagcattcggctcacctcagaaatgatttaaaaattttatgttatgccttttaaatattaagcttctcattttccatcccatatcaaaactggcataacatttcagaagtcaaggtttaacagtcagcaaataaacatatttgcaaaactgttaaatgatgattatttttgcatttgatacgcaattgtatctacaatatatgtcttgaggaatatgtgttttattcactgcatgtatgcaagcaataaaatttcactaagcagactccatggcaaattagttacctgagtattccaattactgaggttcctcaaaccactagaactttcatcttttttttcagtcctttttttttaatcatactctaagtctgggatacatgtgcagaacgtgcaggtttgctgcacccatccacccgtcatctatgttaggtatttctcttaatgctatctctcccctagccccccaccccccgacaggccctggtgtgtgatgttcccctccctgtgtccatgtgttcttatacttcacctcccacttatgagtgagaacatgcggtgtttggttttctgttcctgtgttagtttgctgaaaatgatggtttccagtttcatccatgtccctgcgaaggacatgatctcatcctttcttatggctgcatagtattccatggtgtatgtgtgccacattttctttatctggtctatcattgatgggcatttgggctggttccaagtctttgctattgtgtacagtgctgcaataaacatacatgtgcatgtgtctttatagtagaatgatttataatcctctgggtatatacccagtaatgggattactgggtcaaatgatatttctggttctagatccttgaggaatcaccacactgtcttccacaatggttgaactaatttacactcccaccaacagtgtaaaagcattcctatttctccacatcctctccagcatctgttgtttcctgactttttaatgatcaccattctaactggcatgagatggtatctcattgtggttttgatttgcatttgtctaatgaccagtgatgatgagctttttttcatatgtttgttggctacataaatgtcttcttttgagaagtatctgttcatatcctttgcccactttttgatggggttgtttgtttttctcttgtaaatttgtttaagttctttgtagattgtggatattagccatttgtcagatggatagattgcaaaaattttctcccattctgtaggttgcctttcacttcgatgattgtttcttttgctgtgcagaagctttttagtttaattagctcccgtttgccacttttggcttttgttgccatcgcttttggtgttttaatcatgaagtctttgcccatgcctatgtcctgaatggtattgcctaggttagggaactttcatctttactagatgaatcaaacctggcaatcctcagataccaaaacaaaaacaccttcatatacatgttagccctcatagaattcttcaaaggcatactttctgtcttaaagtataaaataattcaaatataaattttcttttctcttgatgattctgcaccgtagtacttttgggtgttagtgtaatctactggtgcttttgtgtagatacaagatgcaagtcaagaatcagatttgttgtcatctctcatcgctctttttttttttttttttttttttttacaaatgtaaccttgtgcaagatgcctttagcaatcaatgcctcaagaaaaaaagagatgattgccaagtggttaattagccttctgccaggtcttccccacctcagcaacctatttaccaacatgcaaacttgatgcccactaacagtggaaaagtcttaggcctttaggggtcacagtgatgaggtacaggtgactctttacccaccccacccctgatagctgatctacctctcatcatccttctagtcatgacttcaaattaccaccatgctgcctggacagctgatgaggggattttcataacagccagtatggctgctttgaatgattgccatggaattttttccctcttctttcggtttccctcccttttactttcttctatctcctgttgctactacaaattttctgtgaaaagctggtttatatatagattaccaacccatcagagaatacttttgctttcaagtaggaaatcaaataatcatagcatactgggtactattttttatgggttctctcttctatgttgtttattacttggattcatggggatgcttcattcttcccaatgaggtaaggtttccagccctctttttgtaaccataattgttttgaagtctagagctgttcccaaagattgagagttctgaaagtttggcctcaggagtgggtggggtgggggagagtagtaggtaagctgttgtgtgtatatttatgcttattgtttgctcagcaagcagtagacatatacttgaattaatctggcaaagtgtttagttttaatgtaaggtgaaacacaggaaaatactcctatcccaaagatgtgaaaaaatagtttgttaggggaaacaggaaagagcagctctacaaccaatgatatattcatatctaagttgaagtcatatattctgttttatgtggagcacacaaattagctttgcaagttggtcggctatgcctagatatttactgtaacatatatttttctaaaagcatatatgggtgccttaaaattaaaatctgtaccacaaggaatattggatattagaaattatgaaacaatagggcttatacaaaagaggtatgtttattcatttacttactgttttttattggatacatgtgattaaaagaaaaatttttatataatcctattgtctcaaggacaaatgattctgtgctcatctgggcatgggacatgtcacacagatattaaagacactacagagccatactgaaataacacggacagagaaataaaaaaaaaaaattaaaaacagggtcaatagtggcaaaaagtgagcttgttaaaaaacagaattggccaggtgcggtggctcatgcttgtaatcccagcactttgggaggctgaagcaggcagatcatgaggtcaggagttcaagaccagcctggccaacagtgaaaccctgtctctactaaaattacaaaaattagctgggtgtggtggcgggcgcctataatcccagctactcaggaggctgaggcaggagaatcgcttgaacccagaaggcagaggttgcagtgagccaagatcatgccactgcaatccagcctggttgacagagctagactctgtctcaaaaataaataattaataaattaattaaagtgaaggcatgcaaaatatcctctttggagtctaatttagacatcatggaaggataattatttggtggtggggatgacatggagattaaaaacaggagaaggaaagccctgtgtgttttggcattttagacatttagtggaacacactagggttcttgacactttctctgtaacttggagaggatacttttatattgtagataaccttgtggagaggtagaagaactatggtggagtctgaagaagtaatacagttcaaggtgtttccaatttgctctaagttagcaaaagaaaaagacaaacacaaacaaatagaaagtattggctgggcatggtggctcacactagtaatcccagcactttgggaggctgaagcagacgggtcgcttgaggtcagtagtttgagaccagcctggccaacatagcgaaaccccctccctactaaaaatataaaaaattagctgagtgtggtggcacacgcctgtagtcccagctacttgggaggctgaggcacgagaattgcttgaacgtgggaggcggaggcagaggctgcagtgaaccgagatcatgccactgcactacagcctgggcgacagagcgagacaccatttcaaaaacaagaaaaaagaaagtgttatacaagttatatcacgaacaagataatataaaaagctattgcacatcaataagaaaagttcaactcaatgcaaaaatgcacatatgatatgaatagacaactcataggaaaggaaattcaattgactttgaaatatatgaaaatatattcaacctcatttgtaataaaataaacataaattaacattaaacattttacccatcggattaacaaagttaaaaaatggtatagagaattaggtgttcgtacactgctgatgggagtttaattgttacagcctaaattcaggcaagtcagcaatacctatcaagaacaaaatgatgcatattctttaggcaattctcaaatgtatcttgcaaatatggtcattcatgccatctcatgctcattcatacacattcatgccgttgtgtgtctgtgtgtttgcagccattgtgtgttgaattgcataagattggaaattactgacatatacatcaatggaggactagtcaagaaagttataggtcattcacaaaaagagactattctatatctattagtatggaaagaagttgaaaaggtatcattaaatgaaaaagtaggggattcgaaacaacggttatagtacggtatttcttgggggaaagaatacacatattgtgataatggaatatctctggcctgtttatacttgggtttggctaagggattgtctctagggaggggaactcggctggggagattggagtgggacaaaaatttacttttcaatttacacagttttatagcttttacattttatatcttattgtatggtcaactcagaaagaatagttaaaactaaagggattagaggaaattatgaattctaagaacttactttgtctgggaatttaactgtgcattgagctagaattatttttgttgtattaggaatctggtaatagtgaacatgaaacaggagagaaaaatttttcacagatattttgacatcaaactgagatcatttgatagtttttgcctgattaatattcttaaatgattatggagaaggtgttgtgacccagaaatgcaataacccattatagtatcttgtttacaccccattaacactgatagcactctatgttactttattttcaatttttttccttcagagtctcagttatttaaccattttccaattactaagcgatatatgaatctgactcacattctatattcagaacaatgaagatcaaaatatgtatttcttatagcagttatagattacaatagtggaaaatgggcttcagagtatgaaaaagtggagagcaagtcaaaatcttatatgaatatgagagaacattttagttataattacaaagccccaatggcctaattttcctcattaatgctgagtgatatttttgaaaagtatgtagaatttaaggtaccaattgccaaaacagtgaaataaaggaaaggcgtgagaaagaaagataaatgaaattcccaggtattacacaatttacatcaaagtattttctaattggtaatgtaaaatgttatataggaaattttacacatcattttatatatctctttacttgaagtgttaaagtgatttcccatataataattcagaaaattatgtataagctaacaaaacttagacctgtagactctagttgtatgtagaaactgccaatagctgctaattcaattctctcttcaatgtaccccaactgatatcttgtttactgggaatatcacattcttctctctcattggactttatttcactggaaaaataagtcctaaagggaataacaaagaaaactacaattgagaaatagaaacaacaacaacaaaaagtttagctaaataattaaagatatttgatgagcatcctggggatatccaagttaatgaacttgagtgagtaggatgggcattcatctctgattcccacctttcagaagagtgaagaaagcattaaaccatgaaactatggcttgtgaagatttccgagggccagtttactgagtgctgagaatgccagttttttaaggcttctcattaccttttagcatttggaacccaaagtggagaatgattgcttctgaaataacaagaggtcatttcctcttccttcaggtctcttcctaaatgttctcttgttccttatgctgcatgatatgtaagataaaatttatttttttcattgtatcattaaaaataagaatctttctgcaaggaaaaagaagggtatttagataaaaccaggagtttactttgatacttccatgtaaactcctgtttgtatcagcagtggtaccttggctgttgtccagcggtttaattggctcttgtttgcctaatctcctgtaacagataatgttattacagaatcgtaggactccaaaatttcccatcagacaaaacaagccttttaatgagaatcactttgttttacctggcatttggcttggtttgagccacctcaatcccatctcacttgtgagaaatgcattatttttcctaacaaccatgctaattctaagccaggaaacatttttttggatcacttcttttctggaatgattcaaagttcaggaaagtaaaagtgggaaggaatttaaattaagctgagatgggaaggagacataattaaattggactttattacccctgttttgcaactaggttgatgttaattggtatctcaaaagacatagcactataacatttgctgtttttgaatttacattaatttcttctataatagtacgtcagtgtatataatttgtctaaattctgtatcttttatttatccatttagtaattcttacattcaaccaatatttggtgagtgtatttcgtgtttaaggcactgttctagggaccactaatagagtaaagcaaaacaaaccgacaaacacaaaataaagtcctaactgtaatggagctttttgttcaggtagtgaaaattgttttaagaaaaataatatatggggataacagtagaccgtgtatgcaggagtaggacagttatatttatacatctatacacacacacaaatacatgtatgtattcacatccatatacatctgtctacatagatatagattataatgttatattataggatgtcaaaaagaatctctttttgataggctggcttttgagagaattaaaaggaagtgaaggggcaagacatgtagccatatggacaaaaggaaattacagacaggacacagaaagttgcaaaaacctgaagtaaaagaatgttttgtgtttaaggggcaacaaacagtgatgtgagttgggggaatatgctagaagaggagatgagagagacaaggtgggaatggaaaaagtccagtaggacttccgtgacaaatatttaggaatggattttgttaaacaacatgtatacgatattgtggttaaagtagaaaatcaatgatagactggattaagaaaatgtggcacatatacaccatggaatactatgcagccataaaaactgatgagttcatgtcctttgtagggacatggatgaaattggaaatcatcattctcagtaaactatcgcaagaacaaaaaaccaaacaccgcgtgttctcactcataagtgggaattgaacaatgagaacacgtggacacaggaaggggaacatcacactctggggactgttgtggggtaaggggaggggggagggatagctttaggagatatacctaatgctagatgacgagttagtgggtgcagcacaccagcatggcacatgtatacatatgtaactaacctgcacattgtgcacatgtaccctaaaacttaaagtacaataatagtaaaagaaaaaagaaaaaaaaaaagaaaatcagggccatagagaaaagatggaagcaaatatagtgtagagaaagctaatatgtttctgtagttgatcactagatttctctatcagtttcctagtggccagggcatacagggaaataaaaatgttgtatgtctggttaaatacatttttttaaagcaagcaagtataccaattatttagggaaattgaaacaaaattacaaaacaattgttgctcttgtttgtcttctttgttagccaaaaaatgcctcccctttatttttatttgttgttgttttggttcttcagtttctattaaataaatttccacacttgagacgctgtgtaatttcatctagttttgtacaaggttgtgggtgatacaatcttatgtcatttttaaattgtccactaccatactgaaattttcatgacttgccttcatatatgagtatgtttttatttcaatcccaagattcaagtatacaaacgcagtgcttttttaataggaagaacatattaaaagtcttcatataccaagagaaaacttacttctcttagaatactgattgtctctttataaccactcttttataagtaattgtataaactcttacattgggattatggtagtttcttattgatctggtaaatgttttctcgtgtctataacaattcaaggtaaaatacactacaatcaccagaaataaactatgttttctggtactaaaatcattattttagtaatttttaaaaataatgttcattattatccattatctgagagatacctctcattacctctctcaaaaatgacaagaaagtgaaataacatgtctaagattattgttacctaatgtttataaaaatagataaacccaagaaaaatatcgaaaagtattaattgtatgaaaagatggagaagaggaaaatatcccttataatgaaaatcagtcatgctagatgataaagtggtgagatttaaacaattttctgggcattgtattctcaaatggatagtgagttgagcaaatagattaaaaatagtgtaaagtaatgcaatagtaaaataaacatgctgagtaggaagagttaagtcttagataacaaaaggcagaagacaaattaaatcaaaataatgtagaggcatgacaatgaaagctaagtagtctatggaaaactgttaagagacctgaattaattaatgatgataatggtcgtaactaacatatatatgtagtgacaggaatcaatccaagtattttacacaaactcctcatttaattggccccacaactcctttaggttggtattattatcatttccatttacacatgacgaaactgagagcacctagaggattaactggatcctaacactcaaaggctttgtgatatgaagtgttcagtgattaatgtgtttgataaggttgaagatttggggtgcatcatttcatatcaactatagtaggtggaccctgtcaggagaccagggaagagatgattagaaaacccagatgaaagaaactaggacctttatcaggaactaaaggtgaaactatacatttagatggtgtaaatgccttaggggacctgaaaaatggcaagcatttaaggtgaaaggtaaataggtgagtagccccaattgaatgtataatattaatgaaagtcacatttaaagatgtttagacataaagcaaatggtcttgttatttagcgggacttaaaaggtaaatcagtaagtggagaaaatctcatctacaatgggaaaatataattgagcttagactggatataaaagggcagaagtggagagctagatctatgtgtatttatccagggtttgttatgagcccagagaaaatgtaggaaaagaaattcaacaactgaaaaagcaaaaaattaaatgaatctgaacaaagaaagctgcttatattagatatattttctggaaaaagatataggtgtcctgtcttagcaaaataggaactagaacaaatgccaccatctttcaaaatttaatattttcttgctacaatttatgtttatgatttatacttatggatatgatactctattaagaggcatcttgtgtgaaacaattatcatatacattgcaaaatagaatatgtataaatgtttccgtgtatatgtgtagatgggtttgtgtgtatgtgagagagagcaaagagggggagggagagagagggaggagaggagaagggagagagagaggcagcaatttctaagtatttctaaacataggagggttataagattatattcatggaaaaaagacatgttccagttcaagctgtatgcatttatacagtggactactagtatgatgaagctggagaacaagtcaaaacactggagtggaagcagaataatcacacacaagacaggtgaaatattccagagtcaccttgaaataaatataaaattgatgttggcagcctgacagtgacaggagtcaagaaatgatgctgctgtgaaatcacaaaagatgcaattgatattttaatctcaaataccacgtctgaggagaaagcctgaaactaggaattgtttgtaaaagtgtatctgttgatagatttctgattttgctgcttttcatttttatcctcttatggagaataataataaaagtagtcacatttttagtttatattgctctttaatttttttcttaaaatgaatttgaatttttttaagacaagaacataatatgctctgaaatcgtgtcattagatttaaaaaacattattggagatatttttcttgttagaccactgcttttcttaagtgaagttgaccttttgagtttttagtaactaaggtatttgtgtgtgtgtgtgtgtgcgtgtgtgtgtgtgtgtgtgtgtgaaattcattatatttgttcttctaaaactattttcttcagttctaggtttcctagtttggagcagaattctatatttttcttgttttatgccctaggaagggcataaaattattttgaatatttttttccctcttcttcctgacccatgtaatcgcctagctgaatcaggcctccccagaaactgattcatggtcgttgaagtatctcatatgacccccatcccacctagtccgatattaaccctataaaatgtctcaaataaactcttattttcgtggcctctaatctccttaattttttaattttagattcagggtgtacatgtacaggtttgttacatgggcatattgcatgatactgaagtttgggcttctaatgatcctgttgccgaagtcctgaacatagtacacaaataggcagttttctaacttttgcttcactcctgtctttcccccttttggaatccccagtgcttattgttcccctctttgtattcatgcgtacccagtgcttagctcccacttttaagtgagaacatgtggtaattggttttctattcctgcattaattcgcttaggtgatggcccccagctgcatccgtgttgctgcaaaggacatgattttgttatttttttatggcaatgtagtattccatggtgtatatgtaccacagtttctttatccagtccactgttgatgggcacctgggttgattccatatctgctatcacgaacagtgctgcaataaacatatgagtgcaggtgtatttttgctagaagaatttattttcctttgggtatatacccagtaatgagattgctgggttgaatagtagttttgtttttggttaactgagaaatctccaaaatgttttcacatcagctaaactaatttccattcccaccaacagcgtataagcattcccttttctctgaaacctcgccaacatttgttattttttgactttttaataatagacattctgactggtgtgagatggtatcttgttgtggttttgatttgcatctgtctgattatctaatctcctttaaaagcttcctacatcttcctgaaaatatatattgcttgattaattaatttatttatttttcccttccctttttcacaaaggattgctggctgcttatactaaaaccacatattattaaataaacaacaacaatgtaaaggacacaaatgatgcaaattaatcatataaaagggacaacaattttgctgtgactatttttcttactgtcatttgagcttcctagcagggaatataaaaggcaagacacagtctccaatgcaggactcaacataagataggaagatatgttaattgctgatttcattaaattttatccagccggttcattctaatgcctctgttttttcaactgtgcaatgaagatcatgcctaccttgtagagctactataagtagtctgatagttcagtgacacatatttcagtgtgctcatcacatttatccaagggtagcttccgagatcaccgtcagtttcacaggaccttatctatataaatgatgatgatgatggtggtgatgataattatggtgattacagttagcacttattggtaacttgtaactgggaagtatggtaagtattttcttggcttacctcatttaatcctgaaaacagctctatacagtgggtacttttaaaatgtgcattttgcattgaggagaccttaggctgagtgacttgatgtccacacatataatatgaatctgctatatgtttatatatatagcatttgaatttgtgtatttgaatttgtaatgataaatatgggagaattaccctgttttcttacctcctctcactactgcaacttattaattggacgaaatatgaaagtaataaattcagaagagacagagagcatttttcaatgttcattatttcagtaaaatataaacagctcacagagatatttgaaaaatagtgagccaaacacattcatttcatttttccttgttcttcttttagaataacaagcctagtatgtctctgaaactttttgcaatctatccggttataatgttagcaccaatgtagccataagtaatttttttttgccaagtttgccctaatgcattatatcatttgagtgcatgggaagatattagcgccattaaaaatattagtaaaactgatttcagttcaacaacctgtacattgaagttgttgcatttatctatttacatctctctgttctgtacaaaagcagcaacttaaacgatgtagataaataatagtgacattttatctccctttctaaagttgaattccagaaggtaggaaagatcctttcatgcttacattaccatgacaaactgaaagagataaatccctaacggatgggatgagatgtgggagttagaggattaatgcttagatgcttcctccaatttatttctcctattatatgtgttaaaaatatataccatatgtcatgcagcatgttttaatcccatcaaaatgtctcacacaattccttaggggatatgctttttgctgccaagttttcaccgctggaatgctgacttactattcctttgcagagagcttcatggtttattttatgataacatgttgttataacttctctggctgtaatttttataaggagaattagtcccgggggaatttattttgagagtcatatgcttaatggtgacagaaaaggagagaaatatttccaaaaagcaatgtatccttcagttgttttaatagaacagaaattcctttgacaacatttgtgaaagcctttattatacccagcatttaaattcagtccttgaaatggggttttcccggatcatttgaaggtcaattttggaatagttcttgtgtcctatgacacctttcaatgatagcactttacagagaggaacaaatttaaggcaaaaagtctcttttagtgatactaagtatacatgacttatagcaggtgacaaaaaagctgcatataattgccctagggagaattttctttgtgccacgttgtcgctttaaaaaaaaatgcatgtagcaaaatttcacatgtaccccataaatatatacaaatataacatatcgaacaatttaaaaaatattgaataacaatgtgagcgattaggtaaagaggacaacttgaactaattttcacgtcacaaaaaaacaaggttaaaactttacaccaggaattaacaacatgttaccttcgggttcctctgtgtgatgttttagtttgaaatctcagtatccttaaagttaccatttgttttatacgacattgttcagctaactcatgtaggctagggcccactctggcccccaggtatatgattttcaccaatcagggatcactacaagatttacttaagtactcaaatataataaagccaaagttattatttagttttttttttttagaaattaagttgctccgaaatgtatgcaccctgtttccaatcaagccttctaattgtaataacattcccccacagaggctctgttagcatttatgggctatattaagaagaaaaaatacacacacatgagcacaattccagagatgccctttgggttttgctttccttattggaagatataacctaaatggatgtcaggtgtgcaaatagactatattttttttgttccataaaatctgctgggcatggttcaaatgctgtcttttaagccctttgatggtacttaataaatgcagggatgcaaactgaggagttacttgacacatcatcatgccattggcagtatattgatggtaaatatgaaataatttgtttctcccctccccaactctaacctcataagtttcacacatatcagaccttagcttctctttgtcagactcaaattggatttccttttctatcatctctaggctcagacttcgatgaccctaatttggcagctcttcaaggggtttatggtgtaagccttttctatttctaacaaaaaacacagctcaaatcctcttcacattagtgaatactgtttgaagtttcattttccaaaagataccatactttcttaactcaatttttaaaattatttttactttttctgtactgaatagttagtacattttaattttgagtgaaaaaaagttggtttgaatagaaagtatgcattaaaattctccataactggatttcgtagtcaaatctaggacagaaataatataaactattttatatactattaaataaatgggatatttatttaagcaactgttatttataatttaggtgctacttctacatttagggatttagtatatactcctgttggccagattttaacagagttcaaatttcttaaatggtgttctctttagcttaaataactatatgtcacaaaaatctgaaaaaaacatataagattaatcatgattttaaaatttaattgatgctggataaatgtaattagaaacaaaatttcaaagttgtattactactagaaattctcatctgatctatatattaaaatatagtcaaatatttaaggttgcctacattacagtgggaaaaggtaaattgaagttgcagcttcttatgacatataacctatacatggtatcatgggtcattttgcttgtttcatttcccattagaggaattttaatgaaggaggccagtaaaatgttgattaataagtgttgatgtgaaatacacttactgggccatataaaagtggcaagcttatgtagactaccccccaccattattatattttttaattctatgagtatggaactccagaagactggaaaccatagcttttatctttttcccatgagagttatttatccagcattttcttcaataattctacaagatataactagagacatagatcctattagtttggtaaacagttataattattacagtagccttccttatttttcacctctttgtcccaattcattcttattaagatttaaatgttggggataatttattttaccaaatgttatagaagacagagaaattaaaagcaaatggctaaagccgacataaggtttcaagagctaactgaggataaaactctaatcgtgcagactttagttgctgtattagtctgttctcatggtgctaataaagacatacccaagacagagtaatttataaaggaaagaagtttaacggactcgcagttccacatggctagggaggcctcacaatcatggcagaaggcaaatgaggagcaaagtcatgtcttacatggcagcacacaaaacagcttgtgctgggaaacgcccatttataaaaccatcagatctcctgagacttattcactaccatgaaaacagtatgagggaaaccgcccctatgattcaattatctccacctggccccgcccttgacacatggggattattacaattcaaggtgagatttgagtggggacacagtcaaaccacaccaatcacgtcggtaagggtgagtcaaatggctagtgttccctcaaaagtgagtgtgctgcaagagggtatatgtgatatatgtatgtgtgcataagcacaatcacaagattaatggattttaataaaagatgaaaaagtattacccagaatactctatcaccccagtttgcttgattgatcaattggcttccggtatcataacttgcattctcatcccacttatatagttaatttttatatttgtaataaaatgtatagacagtaaaaataatatagtaaatatatatattatatataataaatatagtataactgaacgaataaaataataaaatgtatagacagtaaaaataatatagtcaatatatattatatataataaatatagtataactgaataaataaaataatatttttatttccttgcttttatagatattatctccaagaaaatcataggggaaaactttaaactgttattgttggtcagtcacttaatcattaaagtaccctaaactttttttccaacttgaagtcgactttcctaggtatgattttaatggctgcaacacatgccactgcatgattctccattgttgcctttcagattgctgtgattttttttaaaactacaaccaggtacatgcagataatgtcttcaatgttatctgataaataagataatttgtaggcaaaaaataataataacccttcaggctctttataaatgtttttaatctaagtttccaagagacctggaatcaattccatgccttaggctaaattcttaatcttccttggagacatgttcttcctccagacctcctcaatttagtgagtggtaccaaaacccaccctcttgctcaactcaaaaacctggctgcctctttctccctctcccttacccctgctttttgccgttatacgctatcatgtttctttccttctacttccttgcagtggtttccatcacatttagaataaaatccacctttttaaaaaaatataatctacatgctgcccacccctctaacagatcactaactcccaggcacacggagcagacagactctcctgtacatgctgttcatctgtttggaatgttcttctcgcacttgccatgtctggtttctttttgttcttcaggggtcaattttaatgttccatttgcacagaggccttcctagatgacctcaatctgaagtggctatccttcgcttgcataatacctttcctttctttggtgcctttttgcaatgtataatattatttaatatgtttgttggcttacttgtttaaatatctctctttacaactagatatactcatgaaggttgctaccatgtctgttttgtttaccagcatatatgccatgctaatcatgttgcctgacacattgggttatagtggattggactgcttgggtttttgtcctggctctgaaatgtattaactgctgtccttgagtacaaatgtaagatgggcataatgataatacctaccgtgaataaaccaaattattcatatacagttattagcatagtgcttggcacaatatacattctcaatacattgtagttactattattttgttctagtaggcattcttgaaatattttttgaaagagtgaaataatgagtttattttgtgatataaataagtaagtaattacctctttggtatatgagtatgccatttttatcccaatctttattgctttgagtatcatcctttaagttactaataggtagctgggcatggtgactcaccatggtgacccagcattttgggaggccgaggtcggcagatgacctgaggtcgggagtttgagaccagcctgaccaacatggagaaaccaagtctctactaaaaatacaaaattagccaggcatagtggtgcatgccagtaatcctagctactcgggaggctgaagcaggagaatctcttgaacccaagagacggaggttgcagtgagctgagatcgcgccactgaactccagccttggcaacaagagcgaaactccatctcaaaaaaaaaaaaaaagttgctaatatgctaaaaataagaataatgctcatgtttttacttccatacaattgattgttagaggtgaaaccttttcccatctgcacaaatttctggaagacaataaatgtttcttcttctttcattaatattttaactgtggaggtatctgtttcaaaatgtaaaatccaataggtaatcagtgaggaatataacctagattaacttttttttttcaaaataaccaaagcacactcagtttaagtttcatgttaaagtgagccaaatgccagttaccaaaatattggatggctatgtatataatcctttgctgatgagtaatttagcatcaatttagagatgttattttttttctaccagatgctcgaaagcattaaggcaagattagaagtcattgtcccttcttctgttatcagtggtcccacaatatttgtttatatcaccattagaaacaaattgtactgtattatagttatttttttgtttgtccctcctattagagagtgagttcactaagggcagacattatgttttatactttattgatgtggaaagcaggcagtaaagaaagaatgaaggactgattattggacatttgttattaatgatcttagcttattattttcctccaaatgaaaatgttttagtgaacataaactgggaaaacagcaggagcaattcagttaatactcagttaccttgaagaggttgaagcagaaagtgtttgtgtcagttgttttaacataattgccagtaaagatactgaaagtattccctcatgataatgagaaaaatccagaacacaaggcttgattactcctacaatatttgcctgctttgactctgactgtgcttaagtatatccaggcatgctgtgcaaagtacagaactgaaataaaataatccctagtccaatcataggcttacgttactaggataagtcaagtttgtggtttcacctgaagtaagaaagcattaagtcttcttatcacacccaatcatccatattaggcttgggatagaaaaggcactagagacagtagggataagatttagtccagggagtaagtacttggtttcattaaaactaccctagaattggctcaccagtattaattaagtcctttttatttgtaatctcattcatcattctctctctctctctttctctctctctctcccccccccccgctctcatagagcaatgttaaacaatgtacacttctttttttaaagttatagatttctaaatttaaaatgttctgatatagtctagctctccaattagggagaagtagaaacatatgctgctcagcttttctaaaatcttttaaagtaatcaattagcatatgggctaagttcactttagatggatacacacatgcactatatatatatattttctttagacatgttaaggcagtggataaaatttccttttgcaatcctttgctcatggtatattaatgctgatagtattttatgctattttgtgttgatgctctcagcacaaattggccccaaaatattctgtattcaaaagcatgtatttttttcctaagcgtactatgattttaatagaagcagaaatgagtgtttccttcttttgtgaatttttgggagggcatgcttccctgcagtctctggagtgtgtgttgacattttttgtgccatgatttcccataagtaacacactcttttgatagtgaagcagtgagggaaagttgctaagttccatctgtaagaaagcattatcagaagtggaagaagggaaatttactaagttccatctgtaagaaagcattatcagaagtggaagaagggaagtgacaagaaaagattcaaagttgttttgttttagctccagtagatgctttataacacactcctaaaaagagtgtgaatataatatagttaatataaaatttattttatataaataatttataatcttcaaatataaatttgtttttactatataagcaatgtaacattgacctaaaaattgaattgaaaaaatataaactttcttctcagaaactgggttctcaattactctctatgtacctgtttataaaatacaaaccatctagataatcattgcaccacaatttgtatcaaactctgtttcttagccatcctagagtacaatcaatatcattgatcttttcgaaaaaccagcttttggtttcattaattttctttattgtagagttctgtttctttaatttttttattattatttttgagaccgagttttcctcttattgcccaggctggagtgcagtggcgctatctgggctcactgcaacctccgcctcccgggttcaagcgattctcgtgccccagcttcccgagtagctgggattgcaggcatacgccacgacacccagctaattttttgtattttagaagagtcggaatttcaccatgttggtcaggctggtctcgaactcctggcctcaggtgatccgcccacctcggcctcccaaagtgctgggattacaggcatgagccaccacgcctggccctgtttctttaatttttagataaggatctacctttaacttatgaatataatatataatatgaattatgaatattatgaatataatatgaattatgaatattatgaatataatatgaatggcattgttgtagggtgataactattttaattcaccttcttgaaatagataacatttggcttttggttagattttagatttatctgttaatgttcagaaaaagataaaagataaatcatggaatctttttttttatttttttattttattattattatactttaagttttatggtacatgtgcacaatgtgcaggttagttacatatgtatacatgtgccatgctggtgtgctgcacccattaacttgtcatttagcattaggtatatctcctaatgctatccctcccccctccccccaccccacaacagtccccagagtgtgatgttccccttcctgtgtccacgtgttctcattgttcaattcccacctatgagtgagaatatgcggtgtttggttttttgttcttgcgatagtttactgagaatgatgatttccagtttcatccatgtccccacaaaggacatgaactcatcattttttatggctgcacagtattccatggtgtatatgtgccaccatccatggtgtaaaaatgctcaccatcactggccatcagagaaatgcaaatcaaaaccacaatgagatactatctcacaccagttagaatggcagtcattaaaaagtcaggaaacaacaggtgctggagaggatgtggagaaataggaacacttttacactgttggtgggactgtaaactagttcaacccttgtggaggtcagtgtggcgattcctcagggatctagaactagaaataccatttgacccagccatcccattactgggtatatacccaaaggactataaatcatgctgctataaagacacatgcacacgtatatttattgcggcactattcacaatagcaaagacttggaaccaacccaaatgtccaacaatgatagactggattaagaaaatatggtgcaaatcatggaatctttaaaaaagaaattttattcctgtgttaatgtgtagttttaaagatttgtttaacagtgtgtactaatgaagcataatagataccaaaatgttttcattaggaacaaaggtcaattgtgcgagaaggagtcaccatttatgacctgacaggttgaggtaatgcaggcagggtaagacaatacatgagtaagcaagcccccctcccaacagtagtcatcattaataggaactcactgcatttagggttaacagatatatgatgggtttgaaaattaccaaagtggaacccagatggatatgtagatttcagtatcattatatacttggaaattgaggaaatagtgtagaaaaatacataaactggaaaaaatcttatcagtcaagaattaagttctagggacttgctttgacctctcattcattcctttatggcctcttaatttctctactttttctaagcttctctctgcatatatcttcactcttatctccctaagactagctttctctacttattcataggttcctccttatcactttagattacatgtggtcatcacaacttctttggccctaagtctaccttaagccttttgtttatactcagaaaggaggactctgattgggctagctcatcttttctaatgaaaccaagagataggttacttgcctgcataggacttggctgcccttggttaaggggccatcatagcaccaatcagtcatgtctggtctggccatggggatgcataaataaacaaatggtcttacctttccaacctcttcctcaatcactacctaccctaggaccacaaactctatgttctatccaaaccactcttttccacagatacctaatcatttcactattcacagtgttaacctgccttttctcacttcttgaaatttccatcacagaatgcatgattaatctcaaagcctcatcccttgcatgtccccatgaagtactcttttactttcctaggaaaagttaacactctgatagtgctttgtttatgattgaataaggtcacttctggtattgtatttccactatgagagtgatgtacatgaactattgaatataaaaacatacctttgataccattttgttgtatagtttataaaagaaagctatgacaccatagggttattaacattatattacttaaagtagtggtaaaaacaacacacatatacacacacaaacacatacacatacatagcacagccagacttggcattctaacatccccacacatgagaactatcaaagtatcatttctgagctgcgttgtttttctacttgtgccctatttctaatagtggaagaatttttttttaaagcaaagctgttatcttttaaacactggaataaaaaaaaaattccattttctgcatgagtcagttttttcagtgaatattttcagcaaatgaacaagctctgcattaaatccatgctttgttttagtagtttccttgggtggactagtttcaccgaatgccatgtgtaaattggtcacatagaacaagaatttatatttccacaattttatttggaactttgaaacttccattatctcacagaacccagaaattgaattgaggctttgttactaagccaggttgtagcaacagacttaggagtcagtagctcaattttctacttctttgcatcaaattttctcctgagaatgatgcatgcaatacagaggaatggcagggaggagcctctgtgaagtgttaaatgtttggttcactgggtcctatcagcaggtagggcctgtggggagcttgtttatccagcagaacaatctcattatgaggacagtgatgtacaatagtttgcttcataccccaaaaccattcaaggaaacgactgagtgaatgatatttttccgggccctgtattatgctattatgacttgcaataactggcagcatattaaaacagaagtcagggactacagttactctgttgaatgaagttctgaaatttcaaaggtgttgattattcagtattttccaatttacagaataaaagagtatgtgattgactatttcatggcgcagtaatggaaataaagaaagagaatgaacaggcttgattaatttcagagtaaatgcttatttttcataattgcataattctcaagtgggtctctgtgtagaccggggtggccttttctgtcaaatacaaagataagaacttggcattgaaaattaaggaacaataaaaaataaatatgtgtgcatgtgtatatatgtgtgcgtgcacatacccttgtcatcactaagggcaagccaccacacagccttggttagctttgaaaatatctatgaatactacattgaaaaaataaagtaagatttgggacaaacatccatcttcctcatgacaatatgctgggaacagctgtaagcttagaataaagtggggaaccctgcttaatgcgctatgcagtaagcttatcaaatctcagcccagctagaacagtgccctaggatacaacaggcaccttgtaaatatctgttgaaataaaggatgaatcagtgaacgaatcaatgaatgcttctgtccagaagtgacacagactaaatgctgtaaaatcattcatcctctaaaatttcaaatattgttggttgtctgaaacatattaaaggaaagggacatggtatgaccactaagtgtctgaagtcttaacttttgaaggatgcatcaagaaacccagctacatcttttcggtagaaagtagctaaagaaaggattctgaattggatgaaccatgaagtcctaagttcctctttaaagctatttattaaccatacaaaaacatactttcactcactgagaatttaaacttttatttaaatattagtgatttactgcattaagtgttatcatgagatagcatctgctaggccagaaaattcatctagttttgagtttaatcgttgttaatatgcagactgtaaagataatctcactggtaaaccagtgataaaccagcacttgatgatcttttaattgctaagtagcactgaggcagcttacatttggctttggatttagtagatatttatattaacaactggccagtacagcttttcacgtaagtacttcacctcaaatttatcaatcctttaaaatatacatgaatttaccccacacccataagctgcactctcaaagataggggaaaataaaaccaaaagcaacaaagattgaatcaatgtaattttctgctgtttaaacataggtttctacttaccttgattatttaaagaatgcctgaaatcatgccaatgaaaactctggaaagtagagtttaaggttcaaggcaaccttctttttttttttttttctgtgctgccatcatctctcacctgaactattgcagtgatcttctaataggtcttctttttgatgtctgtcacctacattctattgtcaaccaagcaggcagagagcctattcttaacagctttattgaggtataattgatatacaattaatcacatatatttaaagtgagcgatttggtatgttttgacatatatataaactcatgaaactatcatcaccacaatcaagactgtgaacatacccatcacactaaaagtttcctcatggccttttgtaatgctctctccctttcgtcactatcccagacaatcactgactcgctttctgccactatagtttgcattttctagagttttatataaatggaatcaaaacagtatgtactctgttttgtctgacttttttcacttggtgtaattattttgagattcatccatgacatgtataaataattcattcatttttaactagtatttaattatatgactacattcatcatttgcttattcacctgttggtaaaatttacattgtttacaatttggagctactctgaataaggcttctatgaacagttgtgtgcacgtgtatagacgtagagttttcttgtcttagtcaaatacctaggaatggagcagctagatgacgtgaagttagtccatttgttcttttatgagttatgcttttggtgtcttatctaagaaacctttgcctaatccaaagtcacaaagattctctcctgtcttttctaaaagttttatggttttatgctttacatttggatccatgatcctttttaggaaaatttttgtttacagtagaatgtatgaatcaaagtttagattttgtcatatgggtacccaaatactccagcaccatttgtctaaaagagtatcttgtctgcactgaattgcctttttgctttgttgaaaatcagtggcaaatatatgtgtggatctatttctggactctaattttgttacatttatctatttttctatcttgatgacaagactttgattatgtttgattagtttgattatggtaactgtgataaatcttgaaatcaggtagcataagacttcacgctttgttctttgaaaaagttattttgaatatagcaggtacttaacattttcatgtgaattttagaattagtatgcccatttgattgtcattgtattaaatctatataacattttggagataattgactaattttttttaaacttctgttttacattcagggttacatgtgcagctttgttatataggtaaattgcgtgtcatgggagtttgctatacaggttatttcatcaccaaagtaataagcatagtagctgataggtagtttttcaatgttcacactcctcccaccctccaccctcaagtagaccttgttatctgttgttctattctttgtatccatgtatacttcatgtttagctcccactttataagtgagaacaggcagtatttggttttctgttcctgcattagtttgcttaggatgatgacctccagcttcattgatgttgctgcaaaggacatgatctcactcttctttacggctgtgtagtattccatgatgtatatgtaccacattttctttatccagtctaccattggtgggcatgtaggttgattctatgtctttgttattgtgaatagtgctgcgatgaacatatgcatacatgtgtctttatgacagaacgatttatattcctttggatatatacccgataatgggattgctggatcaaatgatagttctgctttaaattctttgagaaatcaccacactgctttccacagtagctgaactaatttaccttcccaccagatgtgtataagcattcccttttctccacaactttgccagcatcttttgttttttaacttttaaataataaccattctgactggtgtgaaataatatctcattgtggttttgatttgtatttctctaaggattagtaatgttgagcattttttcatgtgcttgttggctgtgtgtatgtcttcttttgaagagtgtctgttcatgtcctttgcccagttttgaatgctgttgtttgttttttgcttgttaatttgtttaggttctatatagattctggatattacacctttgttggatgcacagtttgcaaatactttctcccattctgtgtgttgtatgtttactctcttgatagtttggtttttgctttttgttttttatttttatttatttatatatttttgccgtgcagaagctctttagtttaattaggtcccatttgtttacttttgcttttgttgcatttgcttttggtgtccttattatgtaatctttgctagggcctatttccagaatggaatgtcctagattatcttccagagtttttatacttttaggcgttacatttaagtctttaattcagcttgagttaatttttgtacatggtgtaaggaaggggtccggttcaatattctgcatattgaaaccagttatttcagtaccatttattgaatagggagtcttttccccattgcttggttttgtcaactttctcaaagatcggatggttgtaggtgtgtggcattatttctagactctattctgttccattggtctgtgtgtctgtttttgtaccagtgccatgctgttttggttactgtagccttgtagtcaggctttattactggttcaatttcagaactcactatggttctgttctgttattgttctgttcaaaaatatggtttctccctggttcaatcacttataaaggcttggtttggctggatatgagattctttgttagaattttttttttaacaattctgaatataggcccccaatctcttctggcttgtagggtttttgctgaaaggtctactgttagcctcacggggttcctttgtaggtgacctgccccttctctctagctgcctttaacattctttcttttatttcaaccttggagaatctgataactatgtgttttggggatggtcgttttgtacagtattgttgcagaggttctctgcatttcctgagcttgaatgctggcctattagcaaggttagggaaactttcatggatgatgtcctcaaatatgatttttctttctgtctttcggggatgccagtgagtcatagatttggtctctttacataattccatatttcttggaggttttgttcattcttctttattcttttttctttatttttgtctgattgacttaattcagataaccagtcttcaagctctttgctcagcttggtctattctgctgttaatacttgtgattgtattatgaaattcttgaagtgaattttttcagctctatctgatcagtttggttctttcttaacatgtctattttgccttccagctcctgtgtctttttattgtattccttagatcccttggtttgggtttcaactttctcctgaatctccataattttcattcctatttatattctgaattacatgtctgtcatttcagccatttcagcctagttaaaaaccattgctggggaactagcacagttgtttggaggtaagaaaacagtctggctctttcagttgccagagatcttgccctggttctttctcatctgtgtgggttgacgttccttcagtctttgaagttgcgtcctttgaatggcactttttgcttttatcttctgtgatgccagtgggggtttgtttgtggtataaggtgggtttcaactggcctcttttctggaagattttagggggccacggctcaacacagcactcctggactgtgtgttctaactctgagggacttttaccgggcccctgcctttgctctcgagccccttgaagttaagatcttgctgtactggagggacctaagtgttcttggtccactggccacaacacgctgttggagagtgccagccaaagcgctttgtccagtggtagcagtgggatctgtgctcactcgggtgtgccagcagccacagcatgtgtggtagggtgcacatttttcagctgaggaggggcaccagtgggggcagggttgctgtcatctgtgctagcatttgcacctgcagtggtgggagtagggcacttgcagaggcagggtttcctgtgcccatacacagattcacaccggtggtggcagaagcagggttggtagcatccatgcgtgtattcgcactggcaggagtgggggcatggtgggggtggggttgccagtgcccatcaaggcaatcttctatacttgaatttgttaatcatttcacaatacatatatatgtatcttaaaacaaaacatcacattgtatgccttaaacatatacaatttttatttgtaaattatgcctcaatacagctggaaaaaaaacacatgcaaagttacataaatatccccatgattttttcctcaagttatcaccccttttttcttacttgagtctgagagtgtttatgaaaatgctatgaaaatgaagaagtactaaaccgataacatggatggatattattatatgtatgacaaaaatgagaaggaaaggtcctgaaggaggtacacagatacatttttgtaataccctgaacaaaatgcagtatgtcaacagataccaatcataatagatatatgattacacatatgaatgtagattaatgcccaaaacagttgtatgtgaagctaatctgtttacaatatattatatatttcatgagacttctctgataaaaatagacttggcatcacttaaaaaatggttctaacctttttaaaagttctcacttagaaattcacttggcggagcagtacacaagctgtgtgtgtctaattttcctctacaatctctgtaagaagttaatcaaataggcaattaatctgtatgatattattcatgtgaaagcatatgcatattaaaatacacaacagacttcattcttattttccttaaatttttctctaatgccaggggcttgaatgtccagcagagctcacaatatgaaaaggatacatggcagtgcttttgttgcacataccagaaagtacaagcaataacgttctgctgtataaacacctgtaatgaaggcagaaaatgtgtagtaagctaacaaacaagactttgaccccaacaacacttatctctcgccttgaatctgcttttgctcctcatttccattaatagtgccacaatcttctctggaatcctgatttgaaatctcagagtcatcctagactccttctcctccttcatctcgcccttctgatcaatttcagcatcctgttgattctgactacaattcttcccacatttccttgtcatatcctttgctacttcttttttttttttgtaacctctattttaagaactttctgagttgtctccttactcctagctatccccttccaatccatccttgatattgtcctgaaagtgatatttctaaaatgtgaatcagataataacacttcgtttgcagacatttaccactgtcaacattggttttagcagtgggtttcaaagtgtcatccctggaccagcagcatcacctgctttgtagtaactactttgtagtaacgcagatccttaggtcccaatccagaccttctgaatctgaaactctgagaggggagcacaaaactctgtgttttaaaaagtcctccaggtgattctgatgcacacgaaaacttgaaaactacggggctacagaattaagttcaagttttttggcatggtgtcttgccaaacctgtcttttctgcacttattttcacctccttacactcttctgtactcctcaccactccactatttcagaaccttaccatatactgtcctattaactgggataaaccattggcttgcaattttctcttccaaattatcaggttttgaacgaagcacatttttaatttcatctctttcttaaatcctttttgatcttcctagacatatttcctgctccattatttcatctgtgaaatggaaaacagttctgggttgagaggtaaaacaaacttcttgctttgtgtttcctcagtaatgttatctttgctctcagaatttattcgtttttcttgtgctatacatggtttttgacaagtctgttcccacttatagatgatatcttcaagggtgatgcaagtctcagtaatctttgtcatagaagagtgagttgcacatcatatgcggtctataacatgttgtctcacaccaatatatgacttgaactttaatgcatgattattttatatgttcattgctgaaaacaatccattagtccatttgggattgttataaaatttaaagaccttttgtaacttactatcttgaaaagtgtaattctgttcttttgtctgctctaaaacaaaaacaaaataaaagtaaatctgtgccttgaaccctgttactttctctttaaaggatcaatttgctggctgggtgtcctgccatctaacaggccttccctgtgaggctcctctaaattgggaaaaggattaaattttatcagtgtttgtttggtctgttgctcatcatgttgatatttaatccagtgtccaacaagtgtcccaaaggaataaaatgcctgaagctggcaatactttttgacctatctgtctgaacatattcctatcagtttttacccaaatagagggttttccaggagacatacatgagctaaataaacaatataatagtaagcttaattcagtaaactatgtttaatatatcaacaaggatttattgagttctgaagtacactcaattttgtgaaatcaaattattctgagttagaaaattgtatcactttgcaatattataaaggaaaaatgcatactgctattttttaattatcagggttaaaaatatctacaaacaatagttataagcgattgtgttaacaccaaagatatacattttcaatactcatttaagtgaacagttatttagttaatcactaatttattcaacacacatttattgattgcctattgtgccccaaatatatatagatatggaaatagctctaaatttataattagagctaaatgaggtttttttttcttttttaaagatagggtcttgctatgttgcccagacgagactagaactcctgggcttaaagaatcctcccacatcagccttttgagtagctgggactacaggcacatgctgctgggtccagtttgagatttagatatgtagatgatagatacatagatagataaacagatagctaggcagatatagaaatagagataaagatagagaaagatagagatagatatagagatggcgatagagatacggtaaagtcccacttctcagagtacaccacacttcagtgatcaatgaaatacatgtaagcaaataatgatttaatatgatacatgctaatgaaagtatgtattaactaaagaacatagggtaactaaatagtcaaaagaatgaaaaaagtcttcaaagtcaaagatggaccatatgtaccaagattttacctatctgcatcagtttcttatgcgaaggctaataaaagaaaataagaatccagattttcttgtaggatgacgtgcatctgtttgtgtttgctgaaatagcagggctttttctgctcctgttcagtgtgggaatggaaagcagaacatcccctgtgttccatgtactgtgttaggtactttctcatgtcacttctaaacactaagagaagtaaaaaaagaagattcaaaaacaagtcttaagctgaatttacttaatgcaaggcaggaataacatgatcccacacagatgcatgggaccttcagattaacagttaaagaattgttcagagaaaattaacctaaaacattgaggatttgttcacatatagacacatacaaggaagagcaacccttatgaagactttttctcaggccgaagtcaagtgtagagctttaaaaaggcaaacttagaagtttgggtttgtttgtttgtttctccaacaacaagagttgctgctgcaaagtgagagtcgctctccctactttttagttattattccaagatatctatccaagtagacacaggttgagtatcctttttttctgaaatgcttgggaccagaagtgttttggatatcagatctttttcaaattttagaatacttgcatatacagtatataatgagatatcttggaaatgggacccaagtctgaacataaaattgatttatgtttcatatatagcttatacacatagcctgaaggtaattttatattttccttggggatgctaaataaattgtgttctgtgaatctacattttgactgtaacccatcacctgaggtcaggtgtagaattttccatttgtggcatcatgttggctggcactcaaaaagttttgaattttggagcattttgggtttcggattttctgattagggatgctcaactttactttaaagtaacataatttatccttctataaatatagtattttgttttcatattagtatgcaacatgtataaattatatcattagacttttttgaaagaattcaaacttcaagtttgttaccatgaacatatttttagcttttacataggtagtaacagtgacttaattaaaaatactttttctactcttatttgaatatattgataatagccaatatatgtagttttcttcatagtacatcagtagtgaaggaattacttctgaatcttaattccattactgtcttcatatatgctcccagaactttatgagaggtaacaaaaatgaatgaatatggtacttcttactcccactccccaatgtaacttcatggcttccttcataaactcccattggctgtgaaagaacgtgtactgcagagatatgttgaactggagtatttccatagaatcctcccatcagggaaggagagtaccaatagcaaattttctgagagagacttacagaagggtattttattccgaaagggagaaaaacagattaagtactaccagcatccacaattacctgatgataattttaaaaaacaataacaataaaagttatatgaattacatacaattaatgtgtactgaaatcaacagtgtctagaaatatgcttttggaatgattgttcccaagccaacaaagcttgtgtgctgaagtaagaaaaaactgaatggatcaacagcaattctgttcatcaagagttagattttaagttatcacatatccttttaagatttgaaaagtctcactacacaaggttaaaaaatatactttgtggctatatttttaaagtctttattcacaaggggatacatactgacgtatttggggatgaaatatcattatgtctctaatttcttttcagctggtttagaaacaataatacaatatagaaggtgtgagagagaacatgtgtgcagatgaggcaaaccgttaacaaaggaaaaaaatatatctccttcatcacttctttcatttagtaaaatgttttattgtaactattgaagagagacataggtccatcatttgtttaaatgattttatgcaggccgggcttggtggctcactcctgtaatcccagcactttgggagaccaaggtgggcagatccgagatcaggagtttgatgccagtctgaccaacatggtgaaaccacgtctctactaaaaatacaaaaattagctgggcatggtggcgtgcgcctgtagtcccagctagtcaggaggctgaggcaggagaatcgcttgaacctgggaggcggaggttgcagtgagccaagatcgtgcctctgcactccagcctgggcgacagagcaagactccatctcaaaaaaaaaaaaaagattttattcaaataatttgaatatgccttgaactgttctttatagtgtttaccatcttttcccaggaattattgaaccattttaagtttattttttaacaggatgcatttagtttaatggtagtaaaacctcctaagccatagatcctccctctgtttccatattgaaatgaacaccaagtgtctctaatgtcgtccaaagtgccatttcttcattttgcctctaacttttctttggcacatgacgttgaactgtatgaaacttttttcctgactgatatttaggtatggaataagagtaattttcaggaatatttgtgattttcttccaacattttctcagaaagcatattctgaaagtgtgtagtaatatctatatgcattcccaacacaactctctctctattctcttgatctaatttgttactaactttttaaaactttctagactaaatctttttgcttaccttcaagcattttgttttatactacaaatcttctgagactcgaataattttatcttactgtttatatactgctaacttgaaggtatttcagcctttttcactagcagcgataccctccatgacagatagtcagttatattaacttgattctattgtaatttacatagtggtaaaacaaaataattttacacttataatcaaaattataactgtttaaaaaattaccacctaggattcattttatgtaatgggaaaatatacaaaactgttttgataaatattatatgcaattatataacttggacatctctgtgtagttttttcctcctgtttaacgtggtatgccagctctacagtagtcatgacaggaattatgacaatgactcagacattgatggtgcccaccaagcttccagcatatttactctagatagtacctcaatacagcccttttgtaaaaattttaaacccaaatttggtaattgaaatgaactaaatcaaagaatgctgtgaaattgacacctttattaaaaaacaatatgtgacagtagggagaattaattctaggttcagataaagctgggtgagaaccccagcactcacccttattagctggcatggagtttcttcaactgtataatttggtaattcagttgtttattttgcttatttattcatgcattcattcatttattcatttagtaaatgtatgctgagctggttagcaggcacaattctaggcactgtggctaaaaagggaagtgagaaggacaaagtccctgctctcaaggggtttacattcaaccggggagacagaaagcaaagtggatgcataatataacatcaaatagcaataggtcttgtgaaaaaaataccaaggcatactctggatcaagtgaccaggatgggaaggcaaaaggcctctctgaggaggtgatatttggcaagaaagaaagagaaagccatgcagatggttggcgaaaaatgttccaggcagagggaagagcaagttcaaatgcctcagtttatatttctgtgaatagtaaatgaaagtttatagactcctggcacatcgttaagtgcttattagatgttagatataattttaagataataaatgtggataattaattccacgttattatgtgtcttctttgctgtaatgtacatcctccttttcatctagaccatttttcttctcttgaatattatattatttatcctgttctcagagctgttagattgccctcttattaatttgtagtgactttaaccctgcttgcaatattcaaatgttattactgtcagaggtcctgttttctcagtctttgcccttttgctcaacatttgtatactctgagtaatgccaaattgattttcttgctaagtgttgggcaactgccctctctaaacagtaaaattcacaacttctctgtgatgatgataatgttgatgtacctgccctatggggacctgttgttttgtatgcatgtgcagggagaggggtgatcaaaaaatggtgtcaagatgtcatttggaagatggtacctgcagaaaacacagaaaacccaatcataccccacccccatcctccgcatttcccaccatggtttcttgtttacacttctccgattctcccagaagtcagagcaaagtgactgtttacctctgtctctggctgggaaaaaaccactcccagagctcaactcacttttattgatttctatattgtttggctgtaaaacatttattctcagttgtatcagtttgggtccagttagagaaaaaaacacagtcatttgaacagtgaaagtttttacaaataattattaaatgtaacaggggattatagtaatgaagggattggctagcataaaagaaagatgtattagtttgctcaggctgccgtaacaaaatactatagactgagtggcttaaacaaaagatatttctttctcacagttctagtgactgggaagtccaagatcaaggtaccagccaatttggtttctggcttttggatggctaccttcttgctctgtgctcacatgatctcttttttgtaatcacgatggagagaaagagcaagctctctggtgtctcttcttataagggcactaatcccatcaagagcctcgttctcatgaccctcctcatctaaccctaattacctcccaaagaaaggcctcatctccacgtactgtcatattgagggttaaggcgtcaacatatggattttcaggggagggcacaaacattcagtctatagcaaaagagaaccataaataatagaggaatggctaccattagccctagggctgagatagcacacctgagaaaaagtccctatgttttcatccccaaagcagagatccgcactttattgggaaggtacaaccatagcttaccgaatggcagaaatcgctaagttgctataccagcagaacttgtcagaaatctgtcttcttcaagttaacagagaccctccctctaaggtacctgggaaacatcgccaagctgctggttgccaagcactgtaggagccaggtgctgaagaaggcttgcacgctgtaagagcctgccaagtgagcacattgaaaataggaagcaaatccctttcttcctgaaatgtctcaccagtgccctctccccacaaagcttcagtgccagctagttaagaaaaacatatctcaaaggcccagatctatttttaccgagcaggcagaaaggtacatttagaactaagaggcaataaatcaataaccagcacactgatataaacaaataataaataacagcagaagcagactcagtgaagaatatattgtttgttagcagagtccactactttgcagggccattctcagtttgattcattgctatgtgctctgtgcctagaataaaatctgacccaatatggatgctcagtaaatatttgttggatgaatgaataatctaattgcttattttttttgcctctaatgtttttcctctctttctctgtctctttttttacgatagccgatggatgcactgactggtctatcgatatcaagaaatatcaagttttggtgggagagcctgttcgaatcaaatgtgcactcttttatggttatatcagaacaaattactcccttgcccaaagtgctggactcagtttgatgtggtacaaaagttctggtcctggagactttgaagagccaatagcctttgacggaagtagaatgagcaaagaagaagactccatttggttccggccaacattgctacaggacagtggtctctacgcctgtgtcatcaggtatccctttaattctattactgctgaatcaaagaaagcacaggctgctttctcgtacttaaatgttgctgctatctcttttgcctaaagccgttgtctcaatatttgcatgtgttgctgctttctaaaatttagaatcaaaatcataaaaagatgggattggaatttatattagacattatttctagcttatggagaaaagcgataccatctgggtagctacttatgttaccaagaattactaaaaactatgaaataaaatttatacaggaagtaaaatggtgcaaataaaatgtaagcaaagacttgcagaaaggatgcatagtttcttgctaaatgagttgtaacattttgctattgcccttcgcagacagatagagcatggatacttctggttcacacacatttgcaaagatgatttaggtaatgtgtgtatgtgcacagggagaggaagagagaattaccatgttagagaatatgaaggttgtgttccagattgctttgctaaccaaaacttctgggtcaatacaaaaatcttcccaagtctttcagggccaataccaaagttaataacaaattcagttcctgtatccccaaggatacccaccatacatctacacatctttgtcagcttctggaagaggtatatgcagtttgtttaaagataatgcattgaagcaatgcccatgtaacacattcgcagttaaaaacctcagtttaagcatttagcccctcatagattgtgaatcacatccttcatgaatgatcatgtatgtcattggactattagaacattagcgaagctgggtatagtcatatagagggtgtgtttaaatctatttatttggctttctgtatttgggcttattcagagaaataaagaagaatctaaagtaatggattcccataactcagagaaagtctcagaatcacctagtgtctttttcaaataaaaatttaccgctcctgaaatcctgatcagcagctaacactcctctgtcataaatatcatgcctccctctcaccgtcatctctaataattacctgtaagctgagccatggctacgggtgtgctaggacattgaaataggtcaagttgcataaaagttaaacagaaaggtatctttctaacactagcaacatatattatgttagagttaatgttggaaaatataaatgaatataagtaaagagttgtgcttgggaaaaatgcctaagggattttcaaagaacaaatgcatctggccgggcatggtggctcacgcctgtaatcccagaactttgggaggccgaggcaggcagatcactttaggcgaggagttcgagaccggcctggccaacatggcaaaaccccatctctactaaaaatacaaaaaaattagccgaggatggtggcacgtgcctgtgatcccagctacttgggaggctgaggcaaaagaatcgcttgaacccaggaggcggaggttgcagtgagccaagatcacaccactgtactccagcctgggcaacagagcgagactctgtctcaaaaataaataaataagcaaacaaatgcatcattcctttggcaactcttcttctttctcttagggtttactaatccttttatgattaaacataactcttaataaaagtagaggttttgtaggggtacagatcaataactgtcacactagtacagttaaagaatactgtttggactagctgttcccatttgaccaatagtaattagattttaatttcatatctgctgtgtttctttttaaaaatcattatttctgattgttcatgcatgtcgtaaggtgattcttcaagataggcaaatgtgtgtcctcatttatctgacattagaattgagttggatgtccatagtataatactacatttcgtcacttattattgatggaaaaataatgatgtgttcacattagtaatctgaattttgaaaacactgaggttgcaattctctgatgtatttaaatatacactgtgatccaatactctgagaaactgcattaaaatgcctctggaagggctgggcaccgtggctcatgcctgtaatcccagcactttgggaggccgaggtgggcagatcacctgaggttgggagttcgagaccagcctgaccaacatggagacaccccatctctcctaaaaatacaaaattagccgggcatgatggtgcatgcctgtaatcccagctactcgggaggctgaggcaggagaatcacttgaacccatgaggcagaggttgcagtgagccgagatcgcgccattgcactggcaacaagagccaaactccgtctcaaaaaaaaaaaaaaaaaaaaaaaaaaaaaaaagcctctgaattaccagttgcaataatgaatgaaagattgaaaagtttccaaaatgatgacacttgccatatgttcatatgtctacattttaataaaaggtgaaactaaaagacaaatactttaaagtttatgtgtgtcaagtggcaatctagagaaagggataaactgcaggaagagatacttttgtcactgaaattcaaatatgccaatcaatttgaagggagtgttgttacagctttcttttccaatttggaaaggggtactcaaaagtctttacaaacagcatttgaaatagcacggcttggtgttgacgtgagaggagctcaagggctgtcagttgagtcactgacattttggcatattgttagctatcaggccactaaactgtcaccattagtttttaaataatccacttgcaaagaattttagaggcttgaaaatgttagcatccattctaaggttctagtctttctgataaatattctgagtattaacttgtcaatgaaattgtttatcaagcttttcatatacaactaatttccatttacacttaaatatatgcaattaaatggcatacataatggaaacacctaagactcctatcattataatgaacaagaactttcttatttccttctttaatatctattttggacagaataataccacacaattctttgctccatacttactggctctttactcagtttactcattcttaaatttatattttattttttacatgaaaaagtgaatgaaggaaagctatgtaacaatttcttttgtcttattttatggccatatataaaaacaagtttactcttaaaaaaataaaaatttggtggccaggtgtggtggctcacacctgtaatcccagcactttgggaggcagaggcaggtggattgcttgaggccaggagtccaagaccagcctgcgtaacacagtgagaccccgtgtctacaaaaatgaaactgtttaaaaattagcctggtgtggtggtgtgcacctatagtcctagctactcaggaggataaggtgggaggatttcttgaggccaggagtttgaggctgcagtgagctatgatcacaccactgcacttctgcctgggcaacagagcaagaccttgtctcttaaaaatgaaatgaaataaaataaaataatagttccgtattcttgacctccaactttttaattccccttttcatagttatgccctattagcagtttcatatgcaaagctagctggtatatgtggaagcattccagtgccccccaaatggtagcatgctaagttatttggcaccctatttttaattaaaattttatttttgagataattgcaggttcatattcagttgcaagacataacgtagagagatgccatacccagatttgctcggtggtagcattttgtaaaactgtggtacaatatcataatcgggatattgacattgatacagtcaagatacaaaacaatgccatcacgtctcaagggcccctcctattgttcttttatagctacatccatctctacccaaccccaatcccaaacccctgtcaaccactaatctattctttatatttatagttttgttaatttattaatgcaatattaatgaaatcatacagtatagaaccttatggaattggatttttcactcagcataattcctttgaaatccatccaagttgttgtacatatccatagttcattcctttttattgctgtgtagtattccatggtatggactaccaccatatttattcacttgttgaagggtgtctctattatttccagtttggggatattaaaaaggaaacttctatgaacattcatattcaatttttggtgaacataagtttatttttctggaataaatgcgcaagagtgaacatggattgaatggtagttgtgtgcttagttttatgagaaagaaccaaactatttttcaaagtagctatagcatctgatgttcccaccagcaatgtatgatttctccacatccttgcagcatttgcgattgtcactacttttaattgtagccattctggtaggcatattgtgataactcattatgattttcatttgcattttcctaatggctaatgattaaaattttcatgtgttgatttgccatctctcttcttgtcagtaaaatgtccatatttttgtacattttataattgaattatttatgtcctcctcattgaattttgagaattctttgtatgttctaaatattaattctttttggagatgtagtttgccaatattttctgactgcctgtaggttatctttttgtccttctaacagggtcttttgcaaagcagaagtttttaattatgataagtttcaatttgtgaatttttccagttatggaccatgcttttggtgtgaagtctaaaaattctgccaagtgctaagtcctgaagatttttccttgttttattttttatttttaagatttaaaaaattgttaaaaattcagttgctttacattttacatttaagtctgtaattaattttgaattaatctattttttgaagaaatgcttattttattttttattttttatttttatgtatttatttatttattttaagtcctggggcacatgtgcaggatgtgcagatttgttacataggtaaacgtgtgccatggtggtttgctgcacctatcaacccatcacctaggtattaagtccagcatgcatcagctatttttcctgatgctctccctcccccagcccacctgcccagccccagcaggccccagtgtgtgttgttcccctccctatgttcatgtgttctcatcgttcagttcctacttataagcgagaatatgtggagtttggtttcctgttcctgcattagtttactgaggatactggcttccagctccatccatgtccctgcaaaggacctaagctcattcttctttatggcagcatagtattccatggtgtatatgtaccacattttctttatcccgtctatcattgatgggcatttgggttgattgcatgtttttgctattgtgagtagtgctgcaatgaacatattcatgcatttatctttataatagaatgatttatattcatttgggaatatgcccagtaatgggattgctgcatcaaatggtatttctgtttctatatctttgaggaatcgccacactgtcttccacaatggttgaactaatttacgttcctacccacagtgtaaaagcattccttttttttctgtaacctcgccagcatctgttgtttcttgactttttaataatcgccattctgactggcgtgagatggtacctcattgtggttttgatttgcatttctctaatgataagtaatgttgaacgttttttcatatgtttgttggccgcttaaatgtcttcttttgagaagtatctgttcatatcctttgcccactttttaatggagttgtttgtttttttctcataagtttttttaagttccttgtagactctggatattagacctttgtcaagtggacagattgcaaaaattttctcctattccttaggttgtctgttcactctgatgatagtttcttttgctgtgcaaaactctttagtttaattagatcccatttgtcaatttttgcttttgtcgcaattacttttggcattttcatcatgaaatcttaattttgaattaatatttatttcaggactgatgtttgtttaggttaagtcttagttttatggggttggatgtccagttgtcccagcaccatttgttgaaaaggctatgcttcctccattgaattgcttttgcatctttattcagaatccattgagcatatttttgtaggttaatttctgtgttttttattccatacctttgtctatccctctgccaataccaaactgtattgattagtatagctatatggtggtgaaaatatcaactagagtgattcctcctactttatatgtctttttaaagattgtgtttagctattatagggcctattatttttcatgtaaattatagcataagtttgtctatgtctacaaaaatccttactagaattttgatagcagtttcattaagcctatggatcaatttgaggagaattgatatctttaccatattgagtctcactatctgtgagtacagtatgtgcctccacgtatttaggacttccttctttggtttctttcatcagcatacaaatcctataaacattttgttaaaattttaactaagtatttcattttctttggaatgtttgtaaatgatatcttctgtttaattttggtttcgacatgtacattgttactatgtgaaaatgtgattgatttttgtgttaacattttaaaaacatatttttttcaaatgacatatctataatgtgttatatctagcatgtagttcatttgctcaagtcttgatttttccttttgggactatgtaactcttttttctcattgaaagaacacagtaagtaagcatctatcaaaaagtacttaaagaacatccatttattcactcatgctatgctaatggtaggatttaaaagatttaaagagaagcttttactttcaagtagtttacctaagagaaaataagtgtgtaataaattgctgcagatactatgaaaatagtttagaattcagtggaattctgccgagatagagtagccccgttcctcttaagtcttccttcttacaactaaaaagtctgcatgtaacggcaaacaagcataagaagtctctgaaagatggaagaaatacctctgagaaagacctcagaacttgaagaatgacatggcaacatgtcatgttctcactatcctgtctgctcctcacagattaaggcatgaattcttatcattttttcactttgttccttcatttgaaattcaatattttcattgcctacctgaacaatacatatttatttctggatgaaaatccagtttatgtttactttctttctatctttcctataattacttcaaaaacaattgtttcttctacctattctggggagaaaacacactaaaacttagtgccttaaaacaataaccattttatttgcacgtgactctgcaatgtgggctggactcagctaggtggttcttccagtgatcttgcctgtggtcacctgtggctggagtccactgcaatacagggttggctgagcctgtttctctattatttctgagggcctctccatgtgctttttccatttatctatcaggtgagccagactttttatgtggcaactcagaaagtataactgcttatcaagcatctccttgagtcatgcttactgatgtctcatgagccgagttttgagataataaaggagaagactttacaagggctttgaggtgtggttcattggtaggaccaccaaagtaacagtctaagagtcaacctttgacccttaatactgtcattcatgtccttataaatgcaaagtatagtgaccccattcctaaaacctccaaagtcttatctttctgtggcatcaggattaggttagaagttgatgatcttattatccaagtcagctctgagtgtgaatgaggttcttcctgcttagttccctgaatacaactgctcaggagtggctgctcttcatccaaaactctgtgaactaaaaaggtatataatttggccctcacatagccaacataaatagtgagatagggataacatagctaaaccaaatatccccatttgaaatgggggctgcggataggagatacagagcagtcactggcccatggcaattctaaaattcagctggatacatggcaccagtttattttattcttttcccaaggagagtaaatatactttattttttattttttttattatactttaagttctgggatacacttgtagaacgtgcaggtttgttacataggtatacatgtgccatggtggtttgctgcacccaccaacctgtcatctacattaggtatttctcctaatgctatcactcccctagccccacaccccccgacagaccccggtatgtgatgttcccctccatgtgtccaggtgttcttattgttcaactcccacttcttaattagggctcagttctggttactggaagtggttctctgatattcttgggtccatgctcttcctttctatataaaattaatggcccaggcctctttgcaatttgaactttatcccttttggtataaggtagtatcgttccttaaaatgttgtgaagcttccatgtattaagttgtaatccacttcatgaagcagaagccacacccataaatatcttcaggaaagatgcccctctactttgctgttcaagtcaggatgctggaggacaatgtaccaaagattcttaaatgagttttgcctagctagtcttagggcatgcctcatagaccctcctagctaagaatcttagagtctgccccatagactttcttagctactttctctggatgatggagtatgcattgtataccaaacatattaccacagacatttttccccctcagaatcaatatgaggtgtttgtcaatgagaaagcactcaatacatatttattgaacaaaataatgagtgattgaggttagtgttccttagaataccttgtggaaaacactgctatagacaaaattaaacaattttctgattcctatcattttccataagaaaataaaataattctttttcttatgacatctcttgtctgaaaccaacacaaattatgaatggcttgtcctaaatcatgatttttggtatttcagatgacaattttctgtcttttgacagaatatacctttactgtcacctggtggaaataaaaactaataaagtgttagatctgatagacccaaacaagtaactgctataactgtagtataaacaatttaagtaatttttaaaaatctgtatgatacagtatacttttaatatttatgaatttttatgtaagttatttaaaaaatcaagtcattcttgaatcaaaggatatataatgtcagcattattttagaaagccttaaacatttatgccataaggagtcttcataatttgttcagggcaatcaaagtccgtataaatgttttatatcctacccagtaattttaatgattgtgtgcatatgtgttccaaggatctagtgtagtttcacaatcttggtttcctaatttttaaactatctctcttaattgaaaccatagtatacccttgagaatatcagctataatttataggttataaaaatgcaattaaacctacataagccagtccctttaaaaaaaaaaagtcatatacaagtgaaagtctttaaaataagatttcaagtttggatgtagagtctcttatagataatatatttattttgtaaaactgcacatcaggcactttctgtagttttttggtagagacatctttcttgccatagtaggtttcaatgagatttttcagctggataactctgatgattcttggagatggtgttgaagtttaagccatatttccatgtctgagacacgaagacattttctaatggatcaaactacttttaacagagcaataattagccaaattgctatatttctgggttgtgctcttttcaaaaacaacaaattcaattgatggaagtaaaagccaagagctgtgtgaaatgtctatttgatttactgattttttttaaccatctaggaaatacatgtcttcaacaaaacagcctattttttttttttttttactaagaagatgaaataaattctgctggagtgatcatggggtagtttcttagatcactggattaagaaaagctttgtctaatcttaccaagtcctataggagagacagctttgagaactctttgaaatcaattgtgtcatgttcaaggcagagacttataaattttcttcaaaaagtatcaaattaatatggagtagatagagtactggaaaagatacatttgtaaaataattaggtgcataaagtccaatttgagattttatgtagtcttttttgttttccattttaggtcaaatgaatcaccataggcccttttcaaccatggatataacatgtgtatttatcgtatttcacaaacattactgaaaatctaggacatgacataattggtaattataatgagggaattttaaaaattacaaacaacatatgccaggcaaacaaatcacttacaacccaacaggactttattggtggctatacagggttatactgtgattattactatttgttctttatttgtaaaaaactattctccaaaaaaaataaaatgttaactgctaatattgatgcactaagtgaagagaaattgattaggcttaataaagtagtagctgctgatcagcaaaatttgggataagtgataaggtaatcacttatttgagatcagtgaaaaagaataggaagttaagattattccaggctctttctaaatctaattttgtgtgtggtcctaaagtaaaaaaaaaaaaataaatgaataaaaatctcatggaatgtagagaagacaaaaaggggctgattaaagagcgtatgaaggacttgtgatttgagcagtagtttcaagactaaactcatggctagggaaagtgtaactgggaaagatttctgttaaaaggtttcaggaagactactacaagaaaaattaaataatgaatgaaaacaggggttggcaaactttttctataaagagtaaaattgtgcactttgggaggctgaggtgggcagatcacgaggtcgggagatcgagaccatcctggctaacacggtgaaaccccgtttctactagaaatacaaaaaatgagccgggcgtggtggtgggtgcctgtagtcccagctactcgggaggctgaggcagaagaatggcgtgaacccgggaggcagagcttgcactaagccactgcactccagcctgggtgacagagcgagactccatctcagaaaaaaaaaaaaaaagtaaaattgtaaaaaattttagatttttcaagccatatagtctctattacaactactcaactatgttgtaatagctagacaatatccatacacaagatataaatgagtggacatggctgtgtttcaataaaactttacttacacagacaggtggtgggacggatttgggctgtgggtcacagtttgctgacccctgatctagaaaatgccttgcagctgtcaaatagcaaagccaacagtagcaactgttgttattaacaaagaaaaagctacaatatattcctgataaagcaagtagatcagtgttgttagaaaatgggctttctgtaggtgatagttagaaggatgactgtaaataatggtaaaaaaatgctaagacttcaatgccaagaaatatcaagcagggaatggaaaacagaaagcagttttcctggaagtaccttacaggaattctatgaaaccagagaaattagaaaatggaaaacagacaaggagtgtttacaataaatgaggcataaggcaatggggggcctatgtttagagtattaatggtagaagtgccaaagaaaataaaacagattcaaggtcatttttggaagaaaaaaatccatgagagatgatacttgattggatatattctgagcttcattggatgttgctatgggaaataagtaaaagagacagcaagaggcctatcttaatgcttttcaatacaaacctaaacatttttaccaaaacaactcaagctctgagaaataaaatcgcctacactttaagctattagacagggaaacatgtaaataaagttcccccatcgctggtttgccatagagcatttgaataaataaaggaaggagtttgggggtactttctaggttctctgatggtctgcttattagtctttcccttagatcatcttaaaggcaaaggtgtaactttgcatctttgcatctttgcatctcttattacacatatatgatcactgagatctgaacagagtaaaatcttttgattagttgtcacagtttgggggtggctttgtgtataacaagaatcttagaaataacggtggcttaaacaggagagaactttgtcagggaaaagtccaatatatccaaatttcagagcggatgtattggctgcctaattgtctaggcctcaggattctgccctctatagggtatggtcttcatccttattttcccaagatgaaactctgtccatcatatctacgctattacaagctcgaaggtgtagactgaaaggaacaaaggacatgatccttcccacctttaagaacaagtcccagaggttacttatatcacttttacttacattcataggccagaacttgttcacataactacaccaagctgtagtgatggcttgggtatgtagtttttgttagtaaaacccatgtgcctgataaaaatactactaatttaaggatttcaaattgatttccctaagagaaaagcctaagatagggattcctgtgcaagtgagctatgaagagagtgctctcagaaaaaaacctgcagggaagaagtcaggcagagatgtgttttcaagtctagcttcagcctgatcccacagggagctgtggtgcataaattgcatcacagagtttaatctcacattgaagcaagcctggacatcgcaagtatctctatctgagtggttcttgtcataccaaggtgattatcaagaaaagggtacagctatgggccttgaccagctagtacccacagcagctagagaatgagtacaacagctggtgaagaaattctgggtgggatgtcaaaagcatctgctacactgaagaaggaggacagattttgagggaaaattagtagccatttttgtaagagccaaaagtatcccttcacacatactgagatgactcaatatcctatttctgttttgtacatggttagtactctatcagtatttgtagaatgagtaatgcatattcttggacaaccttctttttttttttttaatttccacagccatcctttaccatttttgaaagtattaagaaatgttaatactttcagtaccaccatacctacccccagtacatacacaagcatcctgccctcaatagctatttcctctactcagattctaagtcacactcacaaccaattgtagaattacctcactggcattctgaagaattagctggcaaatttcctgcattttcaaatattttaagttccggtttccagaaaaattctccttgccctggaaataatagccagacaactatgattagaatatatataacctgcttatattcaccttctttaaatctttggtgaagaataggtatggcttttctcatcggtttgctctggcctagatttatgttggttttacagtgacatttctgactttcaggcaagtatccattgagtaactgttttattatacaaaatctgaggttataaaataaagacttaaatgagcatttcactgatttcattatatctcacaattatagatctggatctatcaattttttctcatgaaggtcccaaaagactgttctataagagccgtgattatggagtgaatgagtcaaatttgaagtctggtccaatggtttcaggaaaatgttttatattgttctaaagccaaaaaataaagaaagaataaagcatcatttcaaagcactatcacaccaggttggattagttaggcttcatattacagaaaagcagcttaagtaagatagtttagtttctcacgtaaagtagttataaggtaggcattcctggacttttatgataatttcaacgttttgcatgacttaggctctaaagctttatgctttgccattctcagcatgtggcttccattcccaatgtcactacgtgctcctaatacaactgaagaactgaatttttaatgttatttaattttaaatagccacatgtggatcttagtctttgttttcaaatagtcattacaagctgtttgtggctactgttttagaatagaaactcttctggatagctcttatttagcctggaatcatgtaatgtaaacatggaaaagattttagatttcactgtaggggttgcttagttttacagataaacaatggaggaagtccaaagaagtattggctttctagaaattcaaaactaatgtttagaaatactgaaaatcgagctggatcttttgatttcttaatcagtgcactcataaaaaataatttattaaaaatattttgtaattgaatttgttgattattcaggtagatcttcctttatttacttaaaaaagtaagattttaatacaattatttttttcaatccattcatttccaatggctaatttatttgaagaatgattgcagcaatctgacaacaaagttttaccccatctactctagatattgaggcttaggctgtgtttctattcttgactctataagccaatccattaaatgataagctaacaattaatttacattaaaacaagactactatttctgttactgtagaagttttagaattagttgcatgtaagttaatgtgattaaattggctaggaatatttgatactgtatctatttaatttattcttttagattattaagtatctattctatgcaagccattaggccagctgttgggagcacagcagtgaattaaaccacagtagaattaagctagaatagaacatgtctcttctggaagtttattctagaaaagagcctttgaaacagtaattacttggatcctaacttttatgaagagaaagaacaaggtgccttaagatcaggcaacaggctggcttagcccacttggtaaatagtctctccctcaaaggctcaacctcttcaaactgaaatctgactacttctgaggttgcacaaaagttccacagactgttccgaaaaaaataatttgaaggaaattcatctccagaacctcaactttcacatgtactcttgtctaaaattgcctgaaatctcagaatagcatttcctccaccttacaaaagaaaggcacacctttcttccttcccaaattgtagcatgatgcattgccccagaacttagggtgccaaacaaagggatagtctaaaatattactttgaaaactcaaggccccttaaactcagagatcttctcctgcctgtgtttcaggaatttttgataacttcagtgcttaatcaaagttggtatattcctaattcagaacagccaaagccttatatagtagtgatactgaattgtgtcagtgtaattggaatgttttataggactatcattttttcaagatgcatttgataaaactcaggaacacactttacttgtgatggttaatactgagtgtcaacttgattggattgaaggatgcaaagtattgatcctgggtgtatctgtgagggtgttgccaaaggagattaacatttgagtcagtgagctaggaaaggcagacccacccttaatctgggtgggcaccatctattcagctgccagcacagctagaatataaagcaggcagaaaaaaaaaaacacgtgaaaggactagactggcctagcctcccagcctacatctttctcccatgctggacccttcctgccctcaaatattggactccaagctcttcagttttgggactcgggctggctctccttgctcctcagcttgcagacagcctattaagggaccttgtgatcatgtgaattaatacttaataaattcccatatatatgtcctattagttctgtccctctagagaaccctgaccaatacatttgttttctttcatatttgatgtgcattgtccaaaaataacacatggaaagcctatttcattaaatcatgtactatgtattccacttagttaattctcatcatattccatttatacaatatatagtattttctctctcctattaacaaataactaaaattatttaaacatacaaaaatagatgtcacctttaaataataggtttttataagtcatttaaggtaaatgtgacacaaaaaagcttggaaaccccttttcagggtttctcaaattataatcgtatgtctaattagattaaaaaaggtcaccaaggtgctagtgaataaaacaaacaaacagattcctagatcctaccacttactgttgaatcagaatttctggggaaacaaggatcagaaatctgatggatcagcatgcatacagatgattcttatccacattaagtttgtgaatttatattcaagtgataacggttactatggtttggatgtttgtttccccaaacctcatgttgaaatttgatcccagagttggaggtcaggtgttactaatgggagtttgagtaatgcgggtgtgtccttcatgaaaagattaatagcctacttcagcagtgaatgagttcttgcttagtttccaggagagctggtgctttaaaagagcctggcacatccaccttttttctcttatttctgctctcatcatgtgatctctgctctcttttgccttccactataagtggaagcagcctgagttcctcaacaaaagcagatactggtgccatgcttttcgtacagccttcaaaactgtaaactaaataagcatcgcttctttacaaactagctaacctcaagtagttctttatagcgacacaaaaaatggactaagacaatgatccttttaagagagttctatcccatactaattcaaagtcaacatggtgtttcatataatcttgttgtaatagtctcttggtggtggacatccggcacctaacacagtgcccagcacatgttggagtgtcaagaattaatgattgaaagtgaatggaaaaaaggtatatatctcctcccaaaacatcaggagattgaatataaaggacacatcttccttctataatgtgacagatgcactctatagttactgtttgagagtttttttagtgcaaactatttacctcttaggctaaatttaatttacaaatggaatcattagtagtgaagatatagcagggtgccttccagattcctctgctgtgatcttcaaatgaataagcactgcagattagtcaaccttctgaaaagttcttaattaaggaaaccaatactgtgcagaataacagcctgtgtgttaaccttgttgacacagtgtagaaatctcatgtagatagctagtacaaaagaataaaaatgttgttctagtttctaaagtggcgtttccaaggaattatacttctaatgaaaattgctgctgtggatgtctgttcaaaggctttggcttacaaagtaaagatttgaaaatatcaaacttgcttaatctctgaatgttgttttcattcattaggtgaatatgacagctctctctttaccctaatcgccccccctggaggaaataacatttttgtttgtctaaacagtacttaatgactactctaaaattagagtttaagatctttaactctagagtgcaaagctctacgtccttgactctgacgtttatcatgaatattaatttctgatcttaaagtcaagccatgaaatttttatatattatcatacatttcccttgacagtttttgtaattgccgtaatttcctcatcagcaagagttgtttgtggctctcctggtctgaggaggctataaatttggcagctttgaattccctcttttgtttgaatgtggaaccatcgacttgtttactctgaacattaactagatctcagatcttaaaagaactatagtttttattggtgcctttacatgacaaaagactcaatatatttgttgccattacatgttttcattgttacctttggattgactttcttgttaggggagatttatgtccatcttcagatacttttcctgctactcacataaaaatgttattttctgccacatagctaccattttctttaaaattgatttattagtagtgtttgattatcgaataccagactgtatatattcacattgtgtataagtatccaacatgaaaattatttagacaatattcatggacatgtatacataaacacacatactttttaatatatgtaattcaactgaaatgttatcttccgtttgtactttcaacaaagatttatcgaacatctactacacatcaggcctggatttttttctgcacacaggaataaaaatagacaagacacaaattggcctgaagatgccacagtcaaccaggcaaacagacagactcataaaaaattatctgtatcactgtacggcaaatgctgttaaaaatatggtgacaaagagctgttgcaaccagagagactcagggatggatacacagaagacaggtctctgaggctacacgagatagatctttcttcccagagaaattgaaagggcatgttattttacacagtaggagtggccagacatggtgatttagtaaaagagcttcagaagggaaaagcaacagatacacgtggctggagtgaaaagtgcaaagtggtgcgtgggaaagaaacagaagctagaaagttaacttttggatagatttgggaagtacccaagaatagaatctcaggttcaggtgtttgactttttttttcttaggacctgaagacagtgatccaggatggcctaaatgtcgcagagaaaattattctatatattcagtcattcagacaattatctaatgaattctttatgagagttgtttttggccaggtgatgaacaagagtcaaagtctctgttcttaggaatcttatagtctttcaagagagaaagttaagtcactcaacgtttaatgtctgatatgacagaggttacaacagagaaaagaacagagtgtaatgggcacatagatgtgatgtgtaattcagaataaaaatcaggtaaggcttcttggagatttaaatattgagttctgatacagaagtaaaacttacctggatgaaataaggagatgaaaaaggagatttggaggagatcctaggtggtaagatagtatatggctacagtcattatatattcttctaattgtccacgactatagtaaagttcccatgacttgggtcatttttagagaagttggaaaggatcagttcatggtcttggggtacaaaacgggagagctgaaactttacacaaaaaggttcagggagacaatgaaaaactttaatcagatggatgacaaaaattggatttgagttttggggcggtcatttagcagcagtgtgtggggatgttgaatggagggcttggagagtagcatctaactacagggttgtcttagattggactcctctagaaacaaaccgcaaggaaacatcactagaggaatggggaagtaagatgtagcagagaagggaagccagtaaagtatgcattataaagctgttttatcccttttggcaactggaaattaggtttactggaaaactctgtgagacaatgtagacatactctcagagttatacccgaagggagaggaaactgggttgtttttctaccagctccctacctgttcctgattgagggtttcttctactaggaatcttagttctctagcatttctggcttgcccttcatgaagaccaaggttggtctcagggccagacaaaagccatcagactgagggtgtcacgtatttgtaagaagcagccttcatacggtagacgtttgggtggggcactgacataatcagctaaagaactaacaagatgggaggtgttgagggtctggacttaggccatgatagtggtaatccggggaagtttgggagtgctactaggccattgttttaataagatttggccatgcattaaatgttaggggtaaattatgaatgatgactttccagagagtagacagatgttgatgatgtaaaatgtgtgtgtttaacaacgtaaaggttttagtataaatatgaaacctatattaaagtctctttataattgtatctattttagaaaagtattataatacagcagtataaaaactctctaaccagaagacctagagtacttcctagatccagatttctaacagcatgaatcttggatgatactcttaatctctcagagcgtctcatgaaaaaaatggaagtaaacatgaaagaagctttgcatatgttacgtaaaccaaagtgtcagtaagccttgtacaaaattttaacttttaaatagaaattacataaagtatttgggccctaggacctaccaagtcgattattattaatgaatgagtaaatctagtcaatcaaagacctttcatttttcccacacctatatttgaacagatgccagttagtgagcatctttgtttgttaatatctgtacttcatacttaatggactaattttttctctatcaaaaaagctgcctttgttaaaacatttcaatcaactaaattacttaactctaatgcctattttgagggaaaaatatacttagagggagaattaaatgtgtaattttatttctgcctcattaaacctcctctgtgtctaggccaacaagagtttcctcctcctccaccggcacacacttattggacgcttcattgtgagaaaatcctcaggtcgctggaacttggtagtgagttacatacctgcccgtcccctccagtatatgtactaattatcttatggaaaataactattttcttgcttttttttttcctcaagaaagccttgagtctcatccagaagtcagatgagtgttagatttcttccttctcttggcttcaatggcaactcttttttttctgattctaaataaatagattgttatacccacatgaatatccacaggaccaacactgcccctttattactcaggaagtatttatttttcagctttctctttcctttctggccctttgaaattcaagcttatttaataatgaattttagtgaaattattttaaaatatcttttaatcacattagcaaacttctagcagagcattgagtttcttcctcagataattcaagttgtcttttctaaaatatgtacttaaaatgactttgaaaaaagagatgtatgatgtcagaaatttctttcaaaagaatctgggtgtggttggggtgatgggtagggatatagatgaaattaaataagcgctatgttgataaatgttgaagttggatgatggtatatgggagttgtgtagtgttttctacttttgtatatgtttgaaattttttctacacttgaaaagataagagaaatttaaaaattaaattggttctcacaattttatttttgtagctgttttttatttgagacgaagtttcactcttcttgcccaggctggagtgcagtggcacgacctcggctcactgaaacctctgcctcctgggttcaggtgattctcctgcctcagggcatgcatgtgtacaagcaatgcccttaccatttatgcattcaactattcttccctctacccattatttaatataagaagtacttatgatgtctgtgctgctgactgtgctaatcattgaagaacctagggtgagcaaaaacacacacagccattgccttcataggactcatagagaaatgagcaagaaacccaatgagaaatcacacaaataaatgtaaaattgcaaaaataacagctgttaaagaggaaagatacatgattttatgtgaaattataaccgggtggtattgacttgatgatttgagaaatcaggggaggcttatctgagtttgtgctgatttaactgagatcaaactttgatcttggtgtgtggagacatagaacataaacctcaattcacccatggtagacatgtagcttgagtgagaaaatgtaactttgttattgaaaaagtcatgacaattttgtaatctggcctatcctgatgaacattcatagggttatgatgggttatccttatatatcttgagaacaccaaggacagtggcagagcttggagtgagaaggaaatccataaaccagatgccaaaccttcctggagtcagcatagacatgaaaatgcacaagagggcaaaagagttatagaaccaactggtatgcatttcaaaagagcaggattgtggagaagagagtggatgaattattatttaggagctggaataggaaggaaggatatcaagcccagtccctatctctgaaatgcaaaaagtatgaggaagtaaataagcaccacctgagatagctgtaggagaagtgataatcacagaggagagctaggtttgattgggtgaataccaagaagagaaggggatactaaggatttagagcggttatatgagtatggaaatattgcatcaaagggtacagtgaaacaatttgagccatgagatgtgtgtgtgggcacagaatatgaataaatgaatgaatgaatgaataatagcattatagaaatgctaatgcagtagaagtgtatgtatatgagtgtgttggagaggggatgcttacaattttggcattgatttgttaaactaaggatgacagacatcctgaattcaaccttaatatctctttgaggaagatgactcacttggttgggggtgatgggaaacccagaggcaatagaatccatatacttttgatggtgggttgatagtaaaccagatcttcagatccccagtgtccattactacctacgttgtagtctaatctctcattaattctcacatgtttaattccctccaatccagctgtcagacatttttattcctctctgcttagaaattgatatttatggggggccgggcgcggtggctcacgcctgtaatcccagcactttgggaggccgaggcaggcggatcacgaggtcaggagatcaagactatcctggccaacatggtgaaaccccatctctactaaaaatacaaacattagctgggcatggtggtgggtgcctgtaatcccagctactcgggaggctgaggcaggagaatggcttgaatctgggaggcagaggttgcagcaagccaagatcgtgccactgcactccagcctggtgacagagcaagactctgtcaaaagaaaaaaaaaaaaaaaaaaaaaaacgaaaaaaccagaaatagtttatttatggccaggcgcagtggctcatgcctataatcccagcattttgggaggccgaggtgggtggatcacaaggtcaggcgttcacgaccagcctggccaatatggtaaaaccccatctctactaaaaatacaaaaattagctgggcgttgtggtgcacgcctatagtcccagctacttgggaggctgaggcaggagaatggcatgaacccgggaggcagaggttgtagtgagctgagatcatgccactgcactccagcctgggtgacagagtgagactctgtctcaaaaaaaaaaaaaaaaaaaaaagaaattgatatttataaaatataaatgtgaacttgttatctcctgtttaaaaatccttcaatgatttttcaagctttccagataatatttaaactgtgttaaaacacaaaagccctttaccgtctctcctgtagctactactttagtgtcccttcaaagcactttcccctactcatctttcatgtcagcaacagaactattttaattttttaaagctttcttgtttcatgctgctgtactggtgtctgtgctattcaatctatctggaacctccatcctaacctctttgtctggttaactcctccccaaagggattaatgactgaattaatgatgccgcatatgtttttctaatgttcttttgaagtaactcaattgactctgaaagtttcagaaaccccttgtcaagtactgatcaagcagcttatttcactgcatattttttaaaattattttttcctgaagtttcagaagtcatgactttatttcctttggaagtgttcaatatttatgaataaaattatgaagataatcatgtaaaaacagcttaataaatttaaataaattttaataaaataaagagatgatgaaaaaaaggagttatgaaaagccataacagcagagaaaaaagaagctacaggaagtgtgaattggaactaagatagaactatacatagcataaatgggaaatgtaagaatgtaaaatttgtgcacttgaagaaactgaacacaattgcaaaagtttattttgataagtggaaaacattgtcatcatttgtacatttttttcccttaatagaaagcttcttaaattatatctaagcacttatcttattgcactgaatgtaagatgccaaatatagtaagagacacaatcaacaatgctttcttatagcaatcataaaagatatacccaattttggagatgataaaatacaagcaaaatgcacatcttagaactgatgaaatctggaaattgatgaaaaaagtcaagtaactaggttattgcatacatggtattagaaaactgccaaaggaaatttttaaaatctttagaaagaaaattatcaatactgcttgatcacatttgatatgaatttttaggaggacacaaatattcagtccataacactctctgagcttgtcttcttcaagattctttcagttgcaagtgacagaaaaccgagatcaaagactgattaagcatagaaagggatttttttgattcacgaactgaaaagtccaaggatagcctggctttttaggcatgtctggatttagattagaggctcacatgataacagctgaaacattctctctttttcccacttctttccttggtgttggctttattcttaggtaggcaaagatgacccctatctcctctagtcttagattctactgtcttagccaccagagccagagaaagacatcatgcattcctaaatctccaacaaaaatccaaagtgtggctctcattggcctcatatgtccatccctgaaccaatcacggtggccagtggaatagaatattcagattgaccagttctcaggcataagaaccagagagaatcagtccaacttgaactacatgctaataacaaaagaagggagaaaatgttggataaggaaaaacagtagaggagccccagtactcactaaataggattaatttcttaaatctgcaaactgggagaagataccaaacctttaggactgctgtgaaacagaattaaacaatatgtgttattatactgaattgcactcatgtgactaaattattacacaccacatacccgtatattgcaaaattctaatttcttaaggatctgtccttgacttcattgtggcgattatacatcccccttgtagcccacgatagaaatgatcaatagaaaacattgtccaagcgtcctggctttcctcaggcaagatgttagttaatgagacctcaacaaggatgagtaactctttccaagggacatcttcagggtctccctaaaggagaaatcaatgccccctaactgatttggatgaggaagccactagggtctcaggaagtcccccattgaaatgcaaattggtctagctagggctttatcttaaacaccagcaaatagctcagttattacttagcacagctgcagggattatcaaaacttgcagttttgttgtcctataggacataagtcaatattgtatctaactttgcaatcttattctatctcttttagtcaaagcgatactgcaccaggcatttgttaaaaaaatggcaaggaaaactttattcaaagctattgtaatatcagttaagactattgcaataggggcaagaaagtatactcaactttattgaaatgaaaggcaggagaggttttaagccttagggtgagctagaggaaaagcactggaagacactagggggaaggtcggtcagggtgattgggcttatcaaaattaggctcctaccctcccacagagactgagaaatgaggatgttatctttcttgatgattggatttcaaaagaatggcttccaggtgcttgagaaagacattccagggatgtagaagatttacatctcaaagggacagagaatacatttacaatggaaagttttctaaaataactgctccaaaaaaagggcggggctgggctcagtggctcacgcctgtaatcccagcactttgggaggccaagtcgactagatcacctgaggtcaggagtttgagaccagcctggccaatatggtgaaaacccatctctattaaaaatacaaaaattagccggacgtggtgacgggcgcctgtaaccccggccactcgggaggcttaggcaggagaatcacttgaacacaggggcggaggttgcaatgagctgagatcacaccactgcactccagcctggggagacactgtctaaaaaaaaaactggccaggcgcggtggctcacgcctgtaatcccagcactttgggtggccgaggtgggtggatcacgaggtcaggagatggagaccatcctggctaacacggtgaaaccctgtctctactaaaaatacaaaaattagccgagcatggtggcgggcgcctgtagtcccagctactcgggaggctgaggcaggagaatggcgtgaaaccgggaggcagagcttgcagtgagccgagattgcaccactgcactccagcttgggcgacagagcgagactccgtctcaaaaaaaaaaaaaaaaaaaaaaaaaaaaaaaaaaaagaaaggaaaaaaaaaaaaacaaaaaaagggtaagtcgggagcttattaaggaaagaatcctagtctctggcattctatttgggccaactttgtcatccttgtaattccctctaaagctttggcatgtgctcacactatatccgtatgaagttcatggctttatatttataaaaattatattttgacttcttttctcttatattagttggtagaataagcagaaatcaaagaagctgaaactagaaaacagaacatagcaaaatagcaacaaaaagacattaaaacacaaattttgaaagggcaaaaaatcatttttggaatctgactaatgagacagcatggggaaggctaatggggtaaggagaagaacaaatagaaataattgtctttggaatgtgaacattaacataatggagagcaatgaataagaagtatgacaatgttaagtattttatgtcattgtcccaagaggtgctcaattgagaaatcacacacacacacacaactttaattataagaaaaatatgtggtaacaaaataacaggaaaactcagaagtcagagaataaattgcttattaccacctcctaagtagcttttaatgctctttctaaattttctttgtaaattcaaaagttaaattgaattttgattcagacataaaatgaaactgggagcatttatttctgtattgccaggagaaatatttaccttgatttatttaaattcttctaggcattcctatttattcaattttataaacatcctcttctttgatgttactctaagtttattgtttcattgtctgagaaaaatcttattgccatttcctaaattggtgtttttttccccatgaaatttccagaagcatccaaatgactggattaaaatgaagtatggcaaattgccttttagaatgactcttcccaattagaaattgccaaaagtagagatcaaagcagtatacagtggttttaaactagctcatataacatcttccatgagctagttatataaagatttttgttttgattacttttatcttataattattcttaccaaattccaaccataaaagatattttgtacataataggtactcaataaatgaacattacatttgaaaagcaatgacctgctttatatttcagtctaaatgtaatcgatatgaatcaagcagtaaagaatatggcagagttgcattacaatttgcagtccaaaaattcttgagtaatctcaggaaaaatgtactctaccagggctttccaaagatcgttttcaggaatactagcctgtctatgtgctgccaaagcgagcacaggaatactagcctgtctagatcaatgcagttaacacaacccagtagatctctgtgcttgatgatgaaaatattctatgtctctgctgttcaatacaatagtcaatagctatctgtggctgttaagcacctaagatgtgactaatgcaactgaataacaatttttttcatagaaattaatgtaaatagccatatgttgctagtggctacggtactggacaacatagctccaaagttctcaagaacaaagaaaaaaatttatttatttttctttaaagaacaaaattttgtctaacctagcatttcccaaatttagttcatcacgaaattcctctttctactttgagaagaacattagggtacacttttcaaaaattttatattattaataaaaaggaataagatgtttaaggccatttacacatgattccttattttatttgctgattcatttatgtatccactcaactaacatctaatgagctaggggcttggcaatattgagatacagttttgttcattattgagttatatctaatgggacaggcagattaatcaagagataattacacacagtctggtaagttctaagaaacacagaggactgtgggaatacacaggtgggtgcagaatcaaaatttgtcatggggaaagtttccagagggagaatggaggacaagtaggacattgtctggttaaaaagaggtccccggccaggcgtggtggctcacgcctgtaatccctgtgctttgggaggccgaggagggtggatcgcctgaggtcaggagttggagaccagcctggccaacatgatgaaaccccatctgtactaaaagtacaaaaaaagaaaaaaattagctgggcgtggtggtgtgggctgaggcaggagaatcacttgaacctgggaggcagagattgcagtcagccgagatcgtaccactgcactccagcctgggcaacaagagcaaaactccatctaaaaaaacaaaaagggtgcctttgcatttttatttctcttattcccctccccagggtttgacacttagtctgtcttattcaagctaagtccttgaatcacaactatgcctagatccttatgggttgcttatttatacctttaaacaaagagaaattcatctgatttttacagattgatttgagaattagaggctgttaatactatttcctttttgccaccccaaccactttttcctgttctaacttcttcatactccagtatacaccacagaaacagaggctgatatggtttggctctgtgtcccacctagatctcatcttgaactgtactcccataattcccatgtgttgtgggagggagcggtggaagataattgaatcatgggggtggtttctcccatactgttctggtggtagtgaataagtctcacgagatctcatggtttcataaggggtttcggctttcgctcctgtcttattctctcttgccaccatgtaagaaatgcctttcaccttctgccataattgtgaggcctccccagccaggtggaactgtgagtccattaaacctatttttcttcccagtctcaggtatgtatttatcagcagcatgaagaaggactaatacagaggccattcgtactttaaatgtattacggctaattatagtcaagagattagaagtcataatacaaatattaaccacagagaggtttaaatttctctatataatctacagtcttctcaaaatagccttcaaaattttgacctgagagcaggaacaggcctttcatgttttaatcctcaataaaacacagacatacaagcctgtgtgtgtgtgtgtgtgtgtgtgtgtgtgtgtgcgcgcgcacatgcattctcacgctcatagtctgtcttttcccaacttcgacaattgtcccactgatttctctgtaccttcctttctattttaatcaaatctccgcaaaataaataagggatattctaaaatgtaaatctcattaagccctcccccagataatactcttcaagagtttcctcagtttccttcaaaatatgttctatggccattagagtagtttaaaattccctgtataatctagtccaagtttatttctccaacctcagagcaaacaattctagaacagtgtctagcatataataaacacccaataagtgttggctattgttttaggaaatggttgtctgtccaggaagcctaaaaaggtgtcaaaccacaatattagggaggcaatgcatagtgcagccaattcacaaaagagaaacaagtcctagaaatgttactaagagctcaccattcatgacaacactaatctcctcccgcaactctgccctcacccttcattctttgaggcttcaaaggatgaagtttatccattcatatcaaaaccttcctttttcacatatcaatgcacatttaaaataatcttgtagacactgttttctccttaagagtctgagagttaggaaacaattctgtaaatattaaaaacacaggtattgtaagactgattggaatcttacaaactaattttgttttactaaccaagacagtgtaggatagttacacgaacccaggtctagtaaataattcattcgcgattgtgggattgagtgcaaataattagtgtaaattgtcactttctcaaaacaaccgccataatagcctgttgattaagcaacgctgagtttattacttagtgcagtaataaagatcaacacttgacacagggtcttagttctctgaagacagtggttgaaggtagatattttttatagagttttgagggggtctaggttcaagtggtttaaagaagttctttgaatgcagagatttgattgaaattgggcaaaatccaagatataatagacaagaattggtggacccagtgagtccaggttcttagaataagtcttgatgagtaaatagctgttgaataagtaagggagttcatcatgttaacaatccattgtcccatgaaagggagctttttctccaaataaacaacttattgtcttaagacagagctacttgatcactgtgtagttcagataaatgcagtttcaggaatttcctgacgctgtatattagtttacaacattatttcctgggaaaatgttttgtggaacaaaatgcaaagttatattgacgtaggggccttgataattaagttgagcgacaacctctctgagtttcctcaattgtaaaatggggataccagtggcacctttttcttttggttgttttgaggatttagtgaaataatgtgcataaagtcctcagcaggatacctggcacttagtaaaagtacaatggctgttaaatatatttttcaactactttcacagtagttactcttaaagtatcaactcattttttcatccactcttctaaaacattcaccaaaatattatatgccatgttctttgctgtgtgttaggagcacagggatgaaagaaccatgtactcaataacttgtacttatagacatgttaccctattactggagactgttttggtaaaaataggaataacatgccaaggcagctcaggggatgtaggaaagtctaaaaacctgtcctagtgaaactgatgcttgacctgggccttaaaggatgagtaataatccattagtcagccaagggtccgatcattccaagctaaaggaaaactatgtacaaaggctaggaactattaatttccatgctgggttccagatataaaggagaaatccatgtgatttcacctaaagggtcagatggatcagcagaagatgagttcggataacaaaaataatagttaatagaattcaatatatgataagaatattcggtgtttataacaaacgggataattccaaccagaggatggaaggatcaaaggttttttttctatcaaggtgtggagctggggtcctatcttacacagtttagtcattctcaaatatttttatacaccagaaaaacatggaaagacttaaaattgcctccgtcttgctcaaaccttccgaagattccaatttaattgatctgggatggagcctgggaatctatattttttatttttgtgtgtgttttatttgtttagtgctctcctagtaatactaatatataagtaggacagaaagctgcctgcagtaagcagtcacaacccaataccagtagttagaagcccaaaatgagtcatttaaacaatattcttaaggtccacgtgcaaaattctggaaacaaggagtcagtagaggttacagaaggtaattttagcagcagtgagaggttgaattaggacagtgagttttcagtcatttctgcttatctggcacttgctttctatgaagaaaaggaaagagcatattcagatactcccagtgatactggagtcatagtctcaggctaagatagtgggcatgagatgagatggactcaaaagacagaagtagatgttgggataaattagagtattgggataaagaagaaagagagagctcaaagaacaatccaaaggttgtaactataggggcaggagcagtaggtctaggatgtagataaagaactaatttgaaagtgttgactataggcagcttcccaataaaccatggctaatacctgagccattatttctttcacagccccaggcacaactgtgtggtgcctcactttctgaaacattttaacagtctcctcctttgtatatgaccccagtgccctcaggccattcccggactgctttcttggtttcaaaatatttcctctacttaagtattggttttagaggagactgaattgagaattgtgctatagggagcatcccagaaccacgaaaatgacagtggttatgaactatcactgatgaacattttaggcaaaagtggccgattttgaagatgacctcgaggtcatccaaacttccctctttcctcattgccaaaggtcctgaggaacattatgaaaaataaaaattaaaggcaggtggaaagcccaaacatacgtctttttatttgtgatattgaattataaagtgagaattactaggctttgttgatggcaaaaccagactctgtaaaatattttaggcagtcagattacagtttggttttatacattttatgaaggcaggagttttaggcaaagacataaatcaatatatggaaggtacacattggtgaggcctaaaagggtgagatatcttgaagcaggggcttacaggtcataggtggattcggagattctttaatttgtgattggttaaaggagtaaaggtttgtctaaaaatttggagtaagcaggaaggaatgttttaagttaagataaggaagtctgttaatcaatacactgggtcagagtgacctgtaggggtgtgcgatttaacccttgtctgacatggccttaggtcctgtttataatttggtatcttaatgttgcagagtccattttgttagtctttgctctctattttacaataacattaatgctagtcagttgtgcctaaactccaaaagggagggggtataaaaaagcgtgtctgacctcctttcttgtcattgccaggaattcagtttttaaggtttctctggggtctcagtggctaagagagggtctggtccatttgtgacgggctaaggattttatttttagtttacagcaggatcaatgattatgtttcctaagggacctaattctagaagtccttcagttctccccaaatattttgggcccttgtgtcacaattgctgaaaccctgactccaaatttgggaggataacattgctgccagctttttactggtatcaagaaaaatgccagaaaatatgcaacatatgttgccattttgtcaaaagcagcaatgttaacatgacaatgaaagcaagttccttttggatttctttttaatccctggaaggtcagagggccaaagttttctagtaattcatctaggaaattaaccacctttggcttttcttactattttaatttacaattatgatttatagatgaacgttggttggaaaatatttttacacataatggcttttttagaatagcatctacagatacatgacagaaggataaaaattgtaactgtgacagcaatttcaatcagaaataaaaaccttaaggagcatcatgaaatttaccaaaatttatgcttctgatttcatggtatgtatttgttgatttgtttcttccccaagggattagtagtgaatatgtaagtaaaaaaggacatgattacacatgaaatacaatatgtcttctgggaaggtggagaaatctttcagccttagtggcattcacgtttgtgtggctgtgtatgtggatgtgtgaatttattcaacaaaaatgataccacttccatttgcatgatattgtaaagatttttttctttcccatatattctctctttttggtctcctgataatcctgcgaggtaacattaatatatgtgatacatttaatgaaagtctttgacaggcagcaacatatttgagaaaacaagcttgggaagtaagcaatattatcttcatttaaataatgagaaaaatgagtctcaaatagggtaagtgatctaccaaccagcacccagctctccaagatagaactgatactcaaaactaagtcttgttaacccagtactgtgcttgattcatagaaaatgttccacaaatatctgaaatttaattcatagtttgtgtaggtacagcatgcaaccaccacaaggaattttggctttctctttaaaatgtggacttttatgtgccaagataaattttctttgtggctgaatgtttttcaggaagagattactcaactaatttgaaccacattgacctatctgtaatttatggaaaagtgcaacataatacaggattatagaggctagagtcacgcttgctgaatacatatgctgtacattattttgaaagaaagaaaacattttaatacaaactatgtgaatttgatgacgcattttccctttatttctgttagtataaacctgcctatatctgataattgttggtgggcatgaagtaaaaggaaattatccccctttctgtaggttgtctgtaaagaaataaagcaaaagggaattagtacaaaataataacggtaatctaagcagacatagagttcagtgtttgttttatttcacagaaagatgcctatgcaacttgtgtaacaaattggtaggctgaaagaataacctcatgtaaatgaagaatgtaattaccatcttcacagttttggtacatgttggaaatgtcatttcaatcagggctaatcataatatgacaggaataactgtgataccataagtgataatgttatgctgctcactttttctaaatttggtggcaaaatatgcaaagataaaactttcaaagagccagtaaaacatgttcaagaattttctcactttaaaaaatattttcagggaagtactcatcattatagatcaacaattattttgataactccattgtttttaaattaaccctgttttagtattttggtcatcttttatggtcaattataaaagaaaaggatccattttaagtgacaataagtatttgatattttactttttccacatatatattcctatattccatatggcacatatgtatattttgtatatattccacatataatccatatatatatattagacacacagatacacacatacgtatgatatctgtctatctgtctgtctatctatctatctatctatctatctatctatctatctatctatagttgagacaaggtcttactctaacagccaggctggagcgcagtggggtgatcacggctcacagcagactccatctcccaggctcaaatgatcctctcacctcagcctcccgagtagctagaactacaagtgcaccccactgcatgtagataaatttaattttttttttttttttttttgtagagacagggtctcactgtgttgcccaagctgtcccctaactcctgggcttaagcaatcctcctacctcagcctcccaaagtgctgggattatagacataagtcaccatgcctggacacatgtgatattttgtatgtatgtatgtatgtatgtatgtatgtatgtatgtatgtatctatctatctatctatccatccatcgatctaaaaatttaaatatagttttcgaaatgttgtctctcattttttttttccgtacatgggcttcttattaacaataaataaagtagctaaaaacaacgaactaagaacttcagcataaagctcaatgggtgttcccattcattgcattgtgaagttgatatgaatgccattttgatgctacctcattttctggctcctgatgaagaaacagattaatgacaaattcctttcattactaatttctgtggttctcatgaagtttatgacattttaatttaattttattttgttacttttctaatccactactttatggacaagtcaacaaatggtttcttaaaagtacctctctactaggaagttggcaataaatacaaataactaactgttgctgtgtggatacagcctcccaacgggagacaacaggggagtcaggggagtgaagaagaaaggaagaagtatgatttgtattttgtttttgttcataatttttggtgttgagtacaaagtttgacccaagacataaataaatgcgttgatttttgaaaactttaaataaaggtatcttattctgtggttcaagaaccactggaaatgtagaggtcatccaaatgtcctgaaattggatgcaaatttttatttctatgtgcatatgtacatttttatggggaaaggatacacgacattattcagattttcctcaacatataagactagcaaataggttcaggaccactgccttatctattaattatattcaggtccaaatgggaaaaagacgtttctaagaaacaagaatataaatgccttaatccatgaatttacttttatttatacaagatattacataaaataatctgaaacaaagcatcttccaaaatagtgttataagaatgaatattatgccgggcacggtggctcatgcctgtaatcccagcgatttgggaggctgaggcaggtagatcacctgaggtcaggagttcgagaccagcctggccaacatggcaaaaccccgtttttactgaaaatacaaaaaaattacccgggcgtggtggcgtgtgcctcaaaaaaattactgaggcaggagagtagcttgaaaccgggaggctgaggttgcagtgagtcgagatcatgccgctgcactccagcctggacaacagagtgagactccatctcaaaaaaaaaaggaatgaatattataatactatgttatttacttaattataagaattaaaaatatatttgagcatatttagggcctcataatcatgcatagaggaaattgatatgatccattttatgttgagtaactcattatcattattattattaataatattgcttactacaaaaaattaggcaaattccttttcttataaaaattaagagttgaatatgttgttatgcctaaactacataacgtctgcaaaggttatggtcttatggatgatgatttttctcaaatattagtgtgaaaataacaagtttctaagttttccaaataacttaatgtgaaggcaaaggatttttaagaggttttgattatactcagagagtggaggactaagtgatgaaagaccaagatgagtggtgatctgtgttcctttaactattatgtgcagttgctgacacaaaatggttttgttctttctaaaaggtagagagagaattttgcccacagacagaaagaaaatgtctttcaagaagtggtttgagaggctggagagaagcagattggttacttgattactgagagggccattaataggagctcatttctagctaaagtgctgacatcactttgaagccatttacaattgttaaaaggaagcaaccctttagtataaataatgagcctgttacagtgaagtgcattggcagatattcataaacacagatacaggaggagctgttattcattacaattactgtttttcgtatgtttgaaaaatgcaaatatatgtgtgtgtgtatgtgtgtagtcgcacagtgatattttgttttagtacgtataatttagaattatcaaaaggaggtttgctccttatatgtaggttatattatgtcatgtgtctacttttggagagagtgataaattgagacaaatattccctaagtttggatttaacaacccaaaatcctctaggatgtcactctacactttatttggcaacttttctatgtgcatattttagggacgcttgcagaaaaggtatgtatggacaagacaagatccttgcctagaaacagaaagaacaaatatgagcagaggcataaatcaaaacataagcaatacaaatcagtgctaatttttttaattaaataaggctttctgattcatgatctaacctttaaaagtagtttctgaagtatattctctgttatgaaacttcgttcttataataaaaatcatattttgcaaaaaaaaaaccctaattttcaattacactatgaaaaaataaactaatgagttttcactattaaaaaaataacagaagccaagttcatggagttgctttttctatgtatgtttattgcttgtagtctttcacaaggatacatatattccaagttcaacatctttctttctcttttctttctctttttttctttctttttctttctttctttctgtctttctttctgtctttctgtctttctctttctctctctctctctttctttcttttttttttgatggagtttctttcttgtcgcccaggctggagtgcaatggcaccagctcggcccactgcaacctctgcctcctgggttcaagtgattctcctgcctcagcctcctgtgtagctgggattacaggcatgcaccaccatgccggctaattttgtatttttagtagagatgaggtttctccatattggtcaggctggtcttgaactcccgagctcaggtgttctgtctgcctcagcctcccaaagtgctgggattacaggcatgagccaccacgcccggctaagttcaacatatttcatattcaaaatatctgtgtcagttagctttggctacataataaactactctaaaactgaatggcttaagacaatttagttcactgttctggtaggtgtttcttctggtctgggcttggctctctcatgcatctttggctcaagtatggctttccacagtgtcttaacccttcaaagactcaggttttacatctaaaaccagagttcgagaacaggaacctcataactgacaaaaaaataaaagttactcctcagtgttgtctgaactcatctctcctgctaaactcccaaaggagaattcaaaactggcctattttcctcaagctccctattcaacccttctcaaccttcccctctccttagccaatatcctacctgatatgtttttaaatattttagaccctcagatatgaatgctcttgccttccctatatcctaatgataaatgtattcatgatcacagccaacctcacgttcttttcctggctttctcagaggagagtctcatcgtccacttaagagatacctatttcacttgcatccttgattttatcaattcttattctctttcaactgtatggtcatcttcatcttttcctctctactgtagaactgccattttatttttcttcttttctgagccaatcttctcgagggagtaatctcaattctctatctccatggcttaatttcccacttcatgctaatctactgtaattcagtctttatttgtcatggtgcaaaaactattatttttataatcaatggtgacttttatattggtaaatctagtgaacatgtgctagttttttttttaactaggtctctcttctgcacttgacactgttcattactctgtcttagtctctacacacttgcctcttattatagtattctctgttttctttcctttgtgaacactgtcaacatccttcacaagtttctcttcctgcagtcaccttttggatagaggtgccaccatgcttccgtcccagttcctttactcttcttatcctgcacatcctcttgctgtcttcattccatctccaacccttgcatttccatcagatacttctctggagtggttccatagggatgccagatgcactacctaccaactcatactgaattttttatatatatatatatatatatatatatatatatatatatatatatatatatatatatatatatatatatatccccttcttctttagcacaatatcctggagaatcacgtagattagaaacaaacgggtcactcttgttcccctacttcctcactttcctattcaattagtcatcaagacttgcacattttgacaactaagatttttcttttgttccatcccctttcagcccatcacagtcccctaagaccacctcttagttcaaatattttgtacctcttgtttactaccacagcacacaacagtttcacataacttcacattacatatacactttcactcaaaaaaggatagcatttttggattttgaagcacggcataccttttaacgtgtgtataagatgtgttttctcatgacttcttatacaatcacatgtactattctgcattgctgctttatacgcttgtgacttatctcatgtaggaatggaaagagggtgatccctttccttcccatcataagggtcacagttgacacctctataaaaagagagaagccatacaaatttattttatcatagtttcttgtggcttgggagggagccttcagaatgaagaccccaagatacagggaagactacctttttatgcttaggttccatgaaggatggacagctgtgtagaactgtgattggacaaaaagggtatgatctaatactaatagactgagtgggaaaaatcagcaaggcctgtctgtccagattcttcttgacctctctgtgcagcgttccttcctcccaggtgtggtgcaggaactctctctggtatgggggatctttgacctatagtcaacaggtaagttagagaatttctttatggccagttcttacacataaaggtagggggtaagttatgatgatatttttaggttttatggctggccttgaggagaaacatttctgatttctatgaccagttttagggaagagggattttaatttcgatggctatcctcagggaagaacaaggggtgagagacaaaagggcaggagggcagaattttgtttctgaaattgcctctgaggacttcactttggggtactgcttcctgtgcctcaatataatcaatgtgatcaattttacattgttggtattattcaatgatactttagatttgtgaaattcactagttagaaccaagctatttattctacattaaaacatttcaatagatagaatatcttacaatagctattgtcaaaaaatcattattattgggtttaacatttttatatttagctctgtgtggaatatcttaattattttttgacttctctctcatgtagcatcagaaattattcacttgaacagattttagattaatttattgatattatgattaccatgcatatccattaaatattttgatattgacaattaaaaagaatgaagtatgcatatatgtctcaatcatccagctgatcctaggaaagggatgtgcatttattaatcatgtttttaacccacagcacttactgtgacatttgtcacatagtaagcactatatatgtttttaaattaatgaagctatcaaagttcaccaaccaatataatttcagaggacagatgaaggctttcacgtcttcatttgttcacaccctatattcttccttatgcagctatttaaaattaattggcaagaattaccactctccttttctcatacttgttttggattctaaactttgttattttatttttgccatctctattctttctacttacttgacaattttaaaatcacacattatctaaaatcaggcagtgttttaattggttgatatattttacaagaaaccattccaccattatgttcttggtgatttaaatgcctatttggctacttacttgcacattatttgcaagaatactgatatctctttgaaatccttatctgtgagtgtgttagtccatttgtgttgctctaaaggaacacctgaggctggataatttataagaaaaaaagtttgttttggctcacagttctgcaggctgtgcaagaagcacggtgctggcatctgctactagtgagggcctcaggaagtttctgatcatggcagaaggtgaagggggagccagtgcatcacgtggttaagagaggaagaatgagggagaaagagtggggaggtgccacagttttaaacaaccagatctcacatgaactgagagtgaggactcattcattattctgagtacagcaccaagccattcatgagggatctgtttccatgacacaaacacctaccactaggccccatctccaacattgaagactatatttcaccataagatttggaggggacaaacatccgaactatcagcaattatgtagctacatagaaacaccaaagctgttctttctattttatttggtagaggttaagataagagaatatgacagtttatttcactcaaggcattttattaattcattgacatttgtctttgaacaaagagggtcatgtacgttcctgccttattcatggtgaattggtttggatgtaatggtacttgtacaacctgaggtcttaccaaggatactatctctccagttcatttgtatgtctttccaaggactctgaaacattttgtccaaggaaaaagtttcttattgaatttgaacttacatcaaatgaggcaaagtacttagcagccactccactttcagcataggaaaattctataatttgtcttgtgcattgtatgcattgttctatttagaatctgtgtttaccttgtaaatgtacttttaataatacctgaaaaagtaatattgagaatgcattgttctatgtcatagccctcattatttcattaaatgaagagctgaaaaagagataatcatttaatttatgttttaaatatctatactgacttgtttgaagaataatatagccaccatttattaaaccttggaagtagtgattttacaaacatttttttctcattcgcacaatgactctgcacataagtggcctattattattttcattgtccagttgacgattcaagggttatacaatttatgtgacttcccattgtcatattggggctggaatctataccaattttgcagaacttgagaatttatgtcctttcctgtataaccgtggttttccatgttttccttctgcttccatatttccacatgggcaacacattcccactcttttacataatatttcttcagaaaaaggcaagaagaaggttgtatgtaatctgaattggctgtcttttacattcccctctcaaaccctagaggttgcaatacccatgatcctcttgagaattgccacactatatagcagtggttggatgctggctccaaattagaatctctaatagtctgatttaattattctgggtactaagatgctggtattttaagagctctctaggtgatttaatatgcagccagagttgaaaaccaaggtttcccttctattgtatttcatgaaatgaaaaagacaaaataaaaaaagaaattcaatttatattgtttgctgtcaatgaaacatatcacataacctcccaattcttaaattacaccagtacttcatatttgaaatatatattcttaataaatcttttaactttcagggctctttccccctaattcttttcagttactttattagctctttgaccttgggcaactttctcttagagtcgattttcttttcttcattctaatttataaattaaactcttagctaggtaatattatttattacttttttgaataggtgactcttataaaatttcatttattttgtttctggtatttacatattggcctagtgaccatactagatacttaatatgctgtatatattttatacacataaataaaaatgtaaatacacactatatatatactatatttatttttagagtaaataaactttttaaacttcaggttatttagcactaacatactctctgatggtcccagtattaacatggtttttaggagtgcacaaacccttttctgcaagagaccagagagtaaatattttaggctttgtaaaacttatggtctcttttgcaacaattcagtatctgtcacaactattcgactccaccattggaatgctaaagcatctgtagacaatatgtaaacaaataggtatgattatgttgcaataaaactatatttatgaatgctagctgtaggctaggtttgacctgcagtctgtcgtttgttgaaccctgctttttatgatgattgtgaccttgattttgttttcctttttcatagcaggtgcttcataagtattgatttatattagtatgtttcctactttcttcctgccacaacacagcagttgttcacaggaattttgttgcttctcctagccttttccataattttttggtattaaccaaagtaatctactatatatggagaaatttgctatggtattacttttgtataggttatgtggtcagctgctctaggttgattattttagctctattgaaatcactttggtagatctaggctgcagcaacaaggtgaaataaagttagaacaatggaaagagtggtaaataaaaggatcaaggccaatgaaaaggcttatataagaagatatcccaaaatattagagttttttagtggctctccctattatacacactgtaccaattaaaataaatttaagagacttcagaagaataacacagttttcagatgggtggatatggacatattctccaatcctcaggtgactacaagtaagaaatccactaattggaaagaaaagaaagtagactgtaatataacaggtaacaacttcatgaaatgagtaatctcaatgagtagtttagactaaaaatacaaataaattatatatgtatatatatatagagagagagagagagagagagagacagagagagagagggagagagagagttcataaatgaataattgtagaaagttggtttgagatttcagtaataacgtcatggagggcagctctgttcatttttcagaatgctctattcaaagtagttatgtctgtgattttatttatactgtgattttttcttaaatgttttgatttctcttaaagtcgtatgcttttcctctcattatttaaatttagatcacggtagtatgatttactattaaaaggttaataaaatgggctgatatttctcattatatatgagatagcttcaaattatgatatagaaaagccattacattgatatagagcattttctgttttatctaacacagaaatttcccaatcacttaatctgcttaatatttatagatcttacattatccatgattactgtttcagcttatttttactttattcatgttgtgaatagatagtacatgctcatggtacaagattctaaacacacacacatacacacactcaaacacacacacacacacaaatgatacagagaaacagtagtctcttttttcttctgtccgtctatatcctgaattcaattactactatgagtctcatctagaaatagttcatatacttacaaacatatttaaattcttatgtaatcccatttgacccagcaattccactcttaggtatatacccaagagaaatgaaaatacatgttcacataaaatcttgtgcacaaacgttcatagcattattcataatagtcaaaagtggaaacaacccaaatattcatcagctgatgaatggataaaacaaaacgtggcctatctttacaatggagtataattaggcaataaaaaatgaactactggcttggcgcagtggctcactcctgtaatcccagcacttcgggaggctgaggcgggcagattatttgaggtcaggagtttgagaccagcctggccaacagggagaaactccatctctactaaaaatacaaaaattagccggtcgtggtggcacacgcctgtagacccagatactcgggaggctgaggcaggagaatcgcttgaacccaggaggcgaaggttgcagtgagccaagattgcaccattgcactccagcctgggcaacaagtatgaaactccgtcttaaaaaaaaaaaaaaaaacaactactgatacatgttacaacattgctgacccttgaaaacattatgctgagctaaagaaggcagctattattaaaagaccacatattattcaatttatgtgaaatgttcagaacaagcaactctatatagagaaaaattactgttacagggctgctgctggtggtggtggagggtgatgcaggaaaggggaaaatgggagtgactggtaataggtaagaggtttcttttggggagggtgaaatgctctgcaattacatggtagtggtggttggacaaccctgtaaatatactaaaaacactgaattatacactttaaatggatgaatgatatggtatatgaattatatctcattaaagctgttttaaaaaatgtatatttgttcaagattttgaaccagcaacatctgtaacatattcaaatgcaatttcattttagcttccaagcatggtcactctacctcataggtgttaattcagtattagaatgactagtccaaggtagcatctaaaactctgaacttaatttagtgttaaattgtgccccttccccggtttagggctactgcagacaggagtattacaacagaaaagacaggcgtggcaggcggcgtctttaaatctgttccttggacttctctcctgcttacaccttgctattctgactgttccaaggtcagagcagaataaagacagaatgaggtgatataaagtgttttctaggcctaatggctggttaagtgttctttctctttgtctctcccctcccagccctacctacctctcctacagtttccttgacccagacaggctcaatctctatctgtgtggagacttgttactctttccttctcttctgaagatctaggcttcacctcaggttcttgttgctgaggttcttatactcccataggtggctactggtcagaacccaagtcaacccagtgttgactctattttctgtgtactttgctgttagggtgcccgtgtaagttatcatccaaactgaaatacatttgtgagtgaaagggggtattactaataattttgatgaggccgggagtggtggctcacgtctgtaatcccagcactttgggaggccaaggcgggcagatcacctgaggtcaggagtttgagaccagcctggccaacatggtgaaaccccatctctactaaaaatgcaaaaattagctgggtgtggtggcacacgcttgtaatcccagctactcgggaggttgaggcgggagaatcgcttcaacccaggaggcggaggttgcagtgagctgagattgcaccattgcactccagcctgggtgtgacagagcgaaactccgtctaaaaaataaaaaaataataattttgatgagacaggcataaaatgggactgttctgagcaaatgggtcttatagatacccactgtatagaaaatactcacatatcctttgcccccaaaggtttggaacactgcctcatctattctgcttgtggccattgctctgcctctctcaggtgtgaggtgagctccattcctccacatcacccaactgcaaagaacacattcagtagatttcaaaggaatctcatagaagacccctttacttggctggagataatagatgagaattctcagctctttcccaaggagatagacaaaatatcttgtcagagaaatatctgcacaaaatccttcctctgcactttcctaaaccatttaaaatctgaaagtcaccaaggagttcaagagtaaggaacagatgcttacccatttcctttaaaaatctctatttagtgatttgtaactcacactagtatttcgcatctgttgtaacatggtgcctagttccaacttcaattttaacatcttattctgtatatattctttttttgtccacacaaatgtgagagttatttttgaaatataatgtcaaaagagatgatttgtcttagtggttcagtgtggcacaggctttgaaatcagaaaaccagtgttattagatttttgactttaggaaagtaacttgacttcttgcagccttaacttcatccccagtaaaatgaggataataatagtacctacctcatgggactattatcataattataagaaatcacatatgtaaagaaattaacataatactcaacttgtggtttgatgtgcaataagttaactattattattactatgattgttatttttaatatctataggaaaccaaataatatgaaatgtcacaaattatttttgaaaatactattctaaggtcttttttttttttttttttttttttttagattctatatcaatttttattccttcattgttacgaaacagatgaataatccttggcagatatacttgagagaagactcttctctcttcctgactggggtccaagtagtcctaatcccatttatccgcatctgtatattccacattggatttgtctcacacatgtccttcttgagatgttacttctgtgtttgagccagattctctgtctagaaaattgtccttggttatacctgctcaatgtttgctattaataatgatatacatcataatcatttaaaaagcccaaaactataacaaccctttagattaaagatacatgctccattggcagccctcaagccatttattttcacaatgtgctgagtttaactcactcattcatttataaattgacttggttgccaatatttggaatcagaagatgtttatcccaaatccagctttccatgggaaatcaggtaacatgggagaacttggcccatattttatttatttatttatttatttatttatttatttatttattttatttttttttttttattgatcattcttgggtgtttctcgcagagggggatttggcagggtcataggacaatagtggagggaaggtcagcagataaacaagtgagcaaaggtctctggttttcctaggcagaggaccctgcggccttccgcagtgtttgtgtccctgggtacttaagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctatccacacagacccggcaaccatccgatttctcaatttttttccccacccttcccgcctttctattccacaaaaccgccattgtcatcatggcccatccccaatgagccgctgggcacacctcccagacggggtcgtggccgggcagaggggctcctcacttcccagtaggggcggccgggcagaagcgcccctcacctcccggatggggcagctggccgggcggggggctgaccccccccaccatcctcccggacggggcggttggccaggcagaggggctcctcacttcccagtaggggcggccgggcagaggcgcccctcacctcctggatagggcggctggccgggcggggggctgacccccccacctccctcccggacggggcggctggccgggcagaggggctcctcacttcccagtaggggcggccgggcagaggcgcccctcacctcccggacggggcggctggccaggcggggggctgatccccccacctccctccaggatggggcggctggccaggcggggggctgacccccccacctccctcccagacggggcggctggccgggcagaggggctcctcacttcccagtaggggcggccgggcagaggcgcccctcacctcccggactgggtggctggccgggcggggggctgacccccccacctccctcccggacggggcggctggccgggtgggggctgaccccccccacctccctcccggacagggcggctggccgacccccccccccgcctccctcccggacggggcggctggccgggcagaggggctcctcacttcccagtaggggcggccgggcagaggcgcccctcacctcccggacggggcggctggccaggcggggggctgatccccccacctccctcccggacggggcggctggccgggcggggggctgacccccccacctccctcccggacggggcggctggccgggcggggggctgatccccccacctccctcccggactgggcggctggccgggcggggggctgaccgccccacctccctcccggacggggcggctggccgggcagaggggtcctcacttcctagtaggggcggccgggcagaggcgcccctcacctcccggacggggcggccggccgggcggggggctgacccccccacctccctcccggacggggcggctggccgggcagaggggctcctcacttcccagtaggggaggccgggcagaggcgcccctcacctcccggactgggtggctggccgggcggggggctgacccccccacctccctcctggacggggcgactggccgggcagaggggctcctcacttcccagtaggggcggccgggcagaggagcccctcacctcccggacggggcggctggccgggcggggggctgaccccccccacctccctcccggacggggtggctgccgggcggagacgctcctcacttcccagacggggtggctgccggacggaggggctcctcacttctcagacggggcggttgccaggcagagggtttcctcacttctcagacggggcggccgggcagagacgctcctcacctcccagacagggttgcggcccagcagaggcgctcctcacatcccagacagggcggcggggcagaggtgctccccacatctcagacgatgggcggccgggcagagacgctcctcacttcctagatgggatggcggccgggcagagacgctcctcactttccagactgtgcagccaggcagagaggctcctcatatcccagacgatggggggccaggcagagacgctcctcacttcccagacgggttggcggctgggcagaggctgcaatctcggcactttggggggccaatgcaggcggctgggaggtggaggttgtagcgagccgagatcacgccactgcactccagcctgggcaccattgagcactgagtgaacgagactccgtctgcaatcccggcacctcgggaggccgaggctggcggatcactcgcggttaggagctggagaccagcccggccaacacagcaaaaccccgtctccaccaaaaaaaaaacgaaaaccagtcaggcgtggcgtcgcaggcactcggcaggctgaggcaggagaatcaggcagggaggttgcagtgagccgagatggcagcagtaccgtccagctttggctcggcatcagagggagaccgtggagggagacggagacggagacggagaggggagaggggagaggggagaggggagaggggagaggggagaggggagaggggagaggggagagggagagctattctaaggtctttagaagcaaacagtgccattgagaattcctcaaagcactaaattacaaaaatattcacatagatttaaaggttaaacctggcttatagcaggtactcaactaatattgaatgaattaaatgaaacaactctttatctatcaggtacctttacaaagtgtacactaccattatgttataatgtattagtctcctgagtctgttgtaaaaagttaccacaaacttggtgacttaaaacaacagaaatgtattctgtcatggatctggaggccacaattccaatatatgttagaaccgcagcttattagaggaaataagcaagtcagaatgcttgactgtacatatcattctaaactgatagacttgacctgaggcctttgacctcttacggaacaaaggacaagtactttgtgacagctatttttctattttattatttgcctatatttgaaagcacatttaaatgatagatgttgaatttgttagaaaagtgtcagtctttaacttttgaaaaaatgccagttaataaaaaggatatataggtatcaagtatccttgattgtgttgtatttaaaaacagtcgtgcgtatgtaaatagttccaaaaatatgtgatagctacagactttttggttgtttatggaaatatatctcaattatagctgttttttataagcctgaccatcatagccaatcactggtattaaaaaaatatatatgtatattatacgtatatattttatatacataaatatacatatatacatatatatctataccttatatacctatattattattctgctttttggtagaaaaggtgtgtgtgtatatatatatatatgtacacacatacacctttaatatatcatatgtatatatacctttaatatattacatatatatgccatatatatatatatatatatatgcaccgttttggggtgtgtgtgtgtgtgtgtgtgtgtgtgtgtgtgtgtgtgtgtgtatatctatgtatatatatacctgatatacctgtatcattctgctttttgaccttatctttgaaaaactttgtcttcttttgtttttaaggatattcacaagaatatgaatagttcgaaatgtaaaatacaaactgctgtagggtagaaaaaactgtagtgccttttcctcagggattccaagcgttgtggccaacactcctatgccaaaagacgttaataagataaaagcataacagaattaatcaaggtattttgtgacatggaaggcttcagaaatgaagacccgaagacccagggaaaactgtatttctgtgcttaagttcgatgaagcatagacaggtgtggagaaatgtgattagacaaaagggtatgatctagtgttaccagattgaggggggaaatccagtgaggcatgtttgttcagattcttctggcctctttgtgcagcattctttcctccaggtacagggcaagacacctgtcacatgtgggttttcaggggagaacagagaaggtcagagagtgacatttcttggttttatggcttgctttgggggagaggagttctagtttctatgacttacctgagagtgtgggtggagaggaattctggtttctatgtcacactttggaggagaaaggggagccggagactggagggtgggagaaggtctgatagacctgcttctaaggtccccccagtctcctccaagtcaaagtactcagcatacaaaggtgccatactttggggtattgtgttctgagttccaacatggcaaacatgcccttttattataaaatggctttggacattttactgcattgccttaaaaaataaccaaggaaatgtgccaacatttataaaatatatgtgtaaataattatatgcattttaatgtttctatcaaaatatagactagtatagataggttttgagtttatcagttgaacactgtcaatcttaaattttaagctgactgtggactattttatcttaaagcattgtctaagagataaaagagtatacatttacaagattactttctaatttaaagggaaaaaagattagtattctcaactttaaatgaaaatcagtagcagtgaggaaatatagtactagctaaaataggcgtcttgcagctcatgacccttgagtttatgcttattatatatgtgaccttagagaagtacctttacctcagttaacttcaatgtccccatctgaaaaataggagttgtgataatgatatatgaattacaagattttttttctgtattaaataagatactatacacaaagggcttaaaacaatatctgacaaatttatttatttattttttttgagatggagtctcactctgtcacccaggctggagtgcagtggcttgatcttggctcactgaaacctctgcctcctgggtttaagtgattctcctgcttcagcttcctgagtagcttggattacaggtgcccgtcaccacgcccggctaatttttgtatttttaggagagacagagtttcaccatgttggccaggctggtctcgaactcctgacctcaagtgatctgcccgccttggcctcccaaagtgatggtattacaggcgtgagccactgcacctggccgacaaatttattcttattattatgcatcatattaaaaattaggctttttaaattttttggtatgcgtcattctctggactgagcatcttaaggacatagaaaccatatcttaatcattttttattgtggcttcatcaattaacactattttatccttaaatgcttgaataaatgattcactgattgagtgaattgtcggctgagttaactataaagtgtgtgagaggcatataaatttaatcactttaggaaatttttagtttcagtattatatgggaaatggcacacacacacatacacacacacacacgcacattgctgagccaaatacatttgaacatagaatgctctatttataatgaatctaaaagtgttaaattatacgtttgattcttttcatttctaagaaggttttgtagatattattaaatctttgtttacgtagttgttaaatatttgcttttaattttagacaacaattggctgaaagaaaagctcatgttatttttaaaaatgttgctttttaacacacatttcctatattacaactctctgagggacaagtgacagaaatctaactgaaaatagttcaaagaaaaatactgactcagtcagtgagcactccagtggtaggactgtcattgtcctcagataaagttgaatccgggagctcagttgatattattagtactttgtttctctctctctgtgtcactctccctcatccccttcttctcttcctgtctctgtctgtctctccatttcttaactgttcatttctctgagtccctgtggtaactttattatctgtgaggccctatctttctggtgattaaaatggcctctggctacctcagacttacatgattcttggtgccccccattttagaaagctccacatttttgtttggtctgattttgatgacatgctttgatcacacgcccacgctggaatcaaccctagtggctaaggggatatgttaccctgattggccagtcttgggtcatatgcccagcactaagataaataatatgttcggcccacccgagccgcaggtactgagaactgtgatctgttctccaagcttatgctgggtaaatacacacacacacacacacacacacacacacacacacacgcacacactcaaatatcacatgttactatgttgatgacactgtgataaaaattggacaagtcttttataagaaaggcaacttgacatattggaaaaatgtaggaggcagatcattttcactcctgtacattttggctatttgctgtcatcagccaagttatataacctttctgagcatcaattacttcactgtaaacataggatagattgtgatgaaaattaaatgatacattatgtaaagaacctaacctagtacttagcacatagtagataatcaatgtatattaaatgtgtaatcactctttgataaaaataccttaggattcagaaaagggaattgaaaagtggggaaggggtatgaaatttaaagaaatactatctgttccctttataaaaaataaactttttaaagaactattctagatatgcagtattattatagttagttctttttaaagaactattctagatatgcagtattatacagttagtttctgtataccctacgcttagttttccctgttactaataacttgcaaaagtatggtacagttgtcataattaatgagccaatatatgttactaactaaagtccacattttattcagctttcctcagttttccttaacattcttcttctgttccaggatctcatccagataatcacattacatttaatcatcatatatcaataggctaaccttggctgtgacagtttttcagattttccttgtttttgaggaccctgacagttttgaagagtactcactaggtattttgtaggatgtccctcaactgggatttgtctttatatgtatattttttcatcagatgtttctgggcaaaatataaggtcagagacttgtcagtcaccttcatccctatagcttagctcattatctgttgcatagtaggtgctgaatacatgtttttctgccaactgaaagaatagatacagtggtagagattactgtttatctagtcaatattctttgtttccttctgccttactgacaagaacatactttaaaaatatatactcaattgtttgttgattgaggtgaaatttgtataacataaaatcagtcattttaaagtgaaacattcagtggcatttagaacattcacagcgctgggcaactaccatctctatctagttccagaatattttcatctacccaggagaagttgctgtacccattaagcaggtgtgttccccatctctcccacttcccctacccccagctcttggcaattaccaatctacattctgtttctacagatttacctattctttatatttaatataaatgaattcacacaatatgtgactttttgtgtctggcttctttcacttagcataatctttttgatgttcatccgcattctgtcgtgtatcaacatttcatttctttttataataaaagcctaattttttttggaatagcaatgaccaagtttaaaactacattccctttcctttggtcgtgtggcactgatgccaccaatgatgtctaggaatcccgataaggcctctaggcaattttcttacagacagctggttcagcctgcaagtaccctgtttgctcttttcccttttccttcttcctttctgaaatacaggtattatggtgagagctatagatctaagcaacataacacaaggatgatggagtgaaaaggtgaaggagctggagtctccgaggacaccatgtagctgccataccagccctgtaatgactactttagccttcattcatgtgaaagagaaatgaacatctagtgcccttaaaaatattagtatagcaattcagattttactatgcattagaaatccagtgaaagctagagacatttcctggccaatgggtttatcataattctgaattaacctatgtaagagaatattcaaatgtccactgaaatcaatgttctaattattattgcccttgtcacccttagcttactattcctgtgttcctagtatggcagaatgaaaaaggctaaaacgttatatctgaaattggaggttgctgacctgtaaaatgagttagttagacaacaatataccattataactccatcttaacacatgttaccacccccttctggaaaataaatccaagatgtctgtagcacctttgtagccctgacggaagagtcaggccctttgtgttgcctgcacattcacttaggagagaatgaagcgtgctaatttgtggagcatataatctattcttttattaaaagtgtatgacaaatggatacagagatacctacctggcatactcatttgcatactaaaaatataatctttatagaagacaaaatagaatacgtccttgagcaaaacagagggaacaatttagtgttggaatggctaagaggttggaataatgatgactaaacttgaaagtgaagatgaaaaagttgagtctgaagggcaatgaaaagccagtgaggatttttaaaaataatagtgtagttggagcaaaggaggaaaaagttattttggtagaaggaacattttctattacgtgaggaaggtaaactaatgaggagactggagcatggagtatgctaatatgtgaatgaaaatagtgagtacattgagagcaaccttaggattgaaaataagcttaaaaatgaaaaaatgaattaatatactgatgtaccgtgattgctttgctttgattctttttttaatttttgagacagagtctcactctctcacccaggctggagtgcagtgggatgatctcggctcacggcaacctctgcctcccgggttcaagagattctcctacctcagcctcctgattagctgggactacaggtgcacctgctaccacgtacggctaatttttatatttttactagagacggggtttcaccatgttggccaggctggtcttgaactcctgacctcgtgatccacccacctcggcctcccaaagtgctgggattacaggcgtgagccactgcacacggccttgttttgtgtgtgtgtgtgtgtgtgtgtgtgtgtgtgtgtgtgtgtgtttgttttgttttgtttgtttgtttttgtaattttagcttcaggaaaaactttctgaggcaaaaaagttaattgggacttaaaaccaaagaccagaataagtcattcatttgaatacatttattgagaatttactatattccaggactctgctaggcattggagattaaattgtgaattaaaaaataaggcttttacccccattgatcttaggttttagtgaaggaaagacagtaaacagataacaagtaaatacttaaagagacagttaatagtgtcacagtttttccaattttagttccatttagcagtaaaaacagaataaaatgaagccacatgtaattggaagagagaggtcaagcatgtaacttttcttgaagatgaatcattcaacaagcatgtttgcatctggtcattagtgatgcgtttgggcagctttgccctcactgtcctcagtcacaagaaaggatggacatgagcagaggaccctgtagaaaaaggcagacatacatgacaatatgaagtatcacttggttgcttttctaattatttatcagtttttaaattgtaaatatgacttagactgcaggctagtatcacctgaattgtctaattatgctaacacgctactaaaaattacgatgttgataatgtgtttctctttaagttcaagtaaacatcattaaaagaagcacaaagcaagtgaaatatgcatggcagagaagcagtataataagggaccattgctaggtcacaggttccaatgttaacagcgaatgaagccgttttcttttttttctggaatagaatttcaagtagatgatgactgaaaagtcgttcttggacagttcagcctcattacttctggaggtctctctcatcagtgcctagtggagatgacaattcctaaactgtctgcaacaagtattaattacttgggtaatcaaaacaatataattgttgatttcttccctgtatttattttataaaatgaaaacagctttaactgtttttctggctgttaaaatacaagctccttggaaaaacctgtaaatgaatagtcaaattatcaataatggttttctcccatggtgagattgtaggtacttttgctttcttgtatttattttccatatttttgttcccagtgagtcccacagggagaagctgagatgccataaaggaaaaattggggctcatgagcaaatagggtaaggacccagaagtggtacaggcctaatggttccctgctttttgttttagcccaggtatccccctttccttgggctaatgtagatgagtcttttcctttgcccccaaagaaccctgctaaaaccgggtggggctacattctacacttgtatttattggtcatcattccacagaaccaagcacacagtagaaactcaagaaataaaatacttgattttattaagtgtcttatttcctgaaagtatgaaataacattacgtggtggagatatggttaaaaacaatatgatcaatttcaggagaaggaaacactccataaagtgcgagtcaacttgatgatattctatgagaaaagattgatttgtagtttttttttacattagaaatctcatatatgtgtctttgtgtgcaatatttatttaaataaaggctaaagattcccaaaaacattagtgagaaactcttcttaattagctttcacttcttggcccacattagtctttctctctctcactttctcacacacatacacacacaccacacacaaatgtaggtaggagagcaagggaggaattccgcattaggacatatcgaaagtagattaatgcaaatgaacaagatgccaagtacagtatgaaaattgacatttatcagcacactctgtatgaagatattttcaaagctttgccatacatatgaaaatattccatttttatgcttatgttttcgttattcaatagcatgcattactttctgttgtttccaaatgcaagttgtaaatctcctcagaaaatttcaccgatgtgagatttcacttagtcttttatggttgggtggatcatttcctttcaaccagaacagtaattccatgtaaaagagtaagaataaattgaaatagaaagccatgttgctttgaaattgaaaaagaaataaattattaattttagtggctttttggccatacttaagttcctattttcatctatggaattatattttaacatcataaacatgaactatgttttatgttcacagaaaagggaaattttcatctagctattcattttacatagctatttgccttgattcactttccttttttaaagtatttataaatttcatacatttttaattagacaaatgatacacacatccattcctattatttaagaaaagtaaaaaaataaaacacacacagggaacatcttaatctcccttggccattactcactctactctccaacttctccagaggtaaccatgttttttttgtttttgtttttgtttttttgaaacagagtctcgctctgtcacccaggctgaagtgcaatggtgcgatcttggctcactgcaacctccacctccctggttcaagcgattctcctgtctcagcctccccagtagctgggactacaggcacatgccaccacgcccagctaatttttgtatttttaatagaggcagggtttcaccatatcggccaggatggtctcgaactcctgacctcgtgatctgcccgccttggcctcccaaagtgttgggattacaggcgtgagccaccacgcctggccaaccatgttttaagaccaggacacgaccaatcagacatttttaatggaaacttgatggattgtttcgtagatcatctttttaactgacagagtatttcacgcttaaactacacaaaagttacatttaatcgtttccttattggtagatatttagaattatccaaatgtttcaccattacaaataatgcttcagttataatccatgaatatgcctcattgtacacataagcaagtatttctctgggataggcactaagaagagaaactgagagtcaaagggtacaggcatcatgaattttaatagatactgccaaattgccctccaaatgtcagtatcgatttattttctcaccagtaggatatgagaattcacagcccctctatcttttggaagcactgagaagagaaaatgctattgacatgttgttgtaatatgcatttctctgatttctcacaagctctggttttcatattcttagtgtctattttgtcttccttctctctgaaatgcccattgataacatttctccatttttgtattggtttgttttatttttcattgatttatagataatattttgtaaattgttcattttaattttgttggattttatatcttgcagatatagtatcttatttatcttctttttactttgcttaggttgttgaaaattcttaaatgtttacaggttaaatgtatcaatctttgtctcatgttttttccccttgctgtgttatttaagaaagccagtatcagactctaaactctggtacatttataggtttttaataaaagcaacttgatttataatccatctagcatttattttgtgaatagtctatgatagaaattgatatatatatatatgtttgtacaaacatgaataatatatgacagtttttcttttaattattaaatcaccttacaaatcaaacaactatggaatattattagcttaactacctgggtgattagcaaaagttttatatttcctttccctatactttttaatatctactctaaaataggaaagttactttctctggctttgagttgtcactaaaatatattcctttttgtttgttaaggccagtcagttcttcgatttgaagcccaaaaggctccaatgaggaaaagattcatttcttctctctttggtgctgttgttaatatcctcactcagatgcagtcaggaatatagtaatgcctgtctcccttataaggaccattatgattacattgggctgatctggctaaacctggataatcttctcatctaaagatccctaatgtaatcacatcaacaatctcccatttgccatgtaaggtaaaacactcacaaatactggggtttagcatgtggacatctttgggaggccattattcttccctccacattgtcaacctctggtccaactcacttgtcatcagtgtaggagtgcctgtggaggcaggtagagtggtaggagttgggaggattcttgattgccttcagctgagcttgaacctgtgctcttagtggagcagtttcatttaaaaggggatgtggctaagcaggcaccataaaatgtacttctagtagcatccctgaattgaaagagtttacatataagactgcatgataaaattaaatgagttacattttgtaaagcaggtagaacaatgcctgagcagagtaggcatcatatacgtatttgtgcttgttaaataaaacccaaaaataatttccacgaggaaaggagtttcaagcagataattaatttgcgaatgtgatatatcctcttgatccagggagctaattgattttgtgaattacatttctcagggtacactaaatcctcactgttggctatcaagaggaaatacaccttgacaggtttctccagtggtggtgaagattgtgtatggattatacacttaattgtcacatttttaatgagaataacagcttaaaatcaagagtgaaacatatacgctgaaaaatggcagtattaattagctcattccatatttattgaacaactacactgtaccagattttacagagcatcagtgataaataacagtccttgtgctcaagccttttgaagtataatagggtgaattcttttgggtttgcaaatacagtctcccccaccccttatttgtaggagataggttctaagacctaccttacccgaccctgtggatgcctgaaaccatggatagtactgaacctgattttgtcaaatggaacatgttttttatcatgtcttccacccacaaatttaatgccttttccatcttaactaagaacttatatactgtggctgtaacttttgcagttagaggtgcaactgcaaaactagcatgcatttctttttctttcttcacaatttctcagatagaaaatttcttcttactgtagatcttagcaaacagtatatggtgattttttttctttcttttcttttctttttttttttttggagagagagggtctctctctatcacccaggctggagtgcagtagcatgatgatggctcactacagcctcaacctccccagctcaagcaatcctcccacatcagcctcccaagtagctgggaccacaggcacatgtcaccacacccagctatttttaaaatttttttgtagttacggggtttccctgtgttgtcctggctggtctcaaactcctgggctcaaccagtcctcccaccttagcttcccaaagtgttgggattacagatgtgagctaccatgtccagccgtttacttattaagttgagaatttttactttttcacttaaaggaagcactttatggcttctctttggcatatccaaattgccagcataactattcttgcattttgggaccctgattaagtaaaatagaggttacttgagcactagcactgtaataccaagacagttaatctgatcaccatgagggctactaagtggctaatgggcaggtagcatgtacagtgaggacacactggacaaaggcatggttcatgttttgggcagaccagagctggacagcatgagatttcatcacaatactcagagcagtgtgcaattgaaaacttaagaattgcttatttcttgaatttcccatttaatattgttggacctctgttgactgtgggcaactaaaaccacagaaagcaaaactgcacgtaagggggactactatacttataatacaaaatgaattacactgtggcccgaagaaaatattaaaacaaagtggtataaagtattataaattagagtaatcactcttgtaaagatgtcttagagtaacaaggtagtatttgaaatgagctttgaccataaaggtgaaaatgagatgggacaccccaggtaaggggttaatattacctaagatagagagagagaaaatccaaacctttaaaataaaacagcttggcagaaatagaggatgttgcacctataattgtagtgagaaagaaaatggaagagttcaatgtaacttttggatcatatctgggtgtaaggagttaacaactcattaacaagtggcctaagtgacaaatagtgaaagctttgactaagatagtaagaatgaactagaaaggaggggctgggtatgagagacattgtgttaaagcagaatccacatgatttagcaactgatttaggaggggagagaggggcccataatgactgctttcctgcttggatgactagaataatgtagtttcagaatagaaacaggaaattggacagatgatgtattcttgtctttaaatgaatggatttaagatgctggaagaattttgagggtgactctttcaaacaagtatttgaaaatgaggttggacattcctgagggagatagagaaagatatttgggagctttagtctaaaataatctcaaaatgggagaggggagactttgtagctcattttgtcctatggactcatcttacttgagttccagccctttccttgtaactgccaaatgtttttctatcctgatttgaactttgagtctatggaggccaaacccgtggccccctggaggttacctcaaaatcactgacatgaggcaaattgatgagtgggataaatggcatacaaatttatttaacttgtatatacgggagccttcagaatgaagacccaaagacacaggggaaattgtccatttttctgcttagattcaacaaagtatagacagccacgcagaaatatgactggacaaaaatgatatgatctaatgctgatagattgagtggggaaacccagcaaggcccatctgtctagattcttcttggcctctctgttcatgtatttcttccttgtgggtatggatcaggaccctctctggaatggaggtcttctgacctatagtcaaacaaggtaagtgagatcatttctttatggccagtttgtacacagataggacagagagaaagttagagtaatatctttaagtttatgagtggctttgggacaaaaggagttctggcttctatgacctgccttggggaagagggattctagtttctatggccagcctccgtggagaatgggatagagagacaggagggtgggaagaggtcaaagaaaaacttttgcttctgaagctgtttttgaggctttcattttggggcattgttttctgagccccaacgagtctatgacatcctgaggcaggcaattctgtttgtaccattcagtttgaaatttcttctttattctgagttgtctaaagttctttccctttgaacctagttctacatcttgggaccctaccctagagcatttgcggttctgtctcacaaaagctcctctgatgttttaagaaagctataaagtccctctttagcctcctcttccagtaacgcagggagtgtaaatggtgctcagcggcagtataatatcttcatgccctcttttgcttgctccctgctagagttttcccagatataaataaattaatagaaaactaaaaacaacttgcataggttctaggctcaattaatctaacatgtgaaattgaaataaaaatccttcacagaaattaatagggtttcaccatagataaatgcctgagggcatatgtccacctctgtcacctctcccgcttccaatgctcctttattcttttataggctaaacatctctacttggcacaatggttcatgtgacagtttccagtcatatcactgtctttggtctaagtagcatggagaagaacaagaccagcccctcccttggtctacatactgttattttatatatatatatatatatatatatatatatatgctaaaatcagttgtgtgtttggatacacccccccccccacctggctcatagacacactgccaccaatgcctgttaatcatctgcagctcgctatgtaaccaagtggaggttcacccttcactgctattatatttcaccttactatccatcaggtcctcagataacatcgttttgttcaatgttgtttcattataacactgatgagaaaaaaaatcaatccccagccaggaccactgtctatgtggaatttgcatttctctgaatgtccgaatgagttttctctgggtactctgttttcctcccacatccaagatctgtgcatgttcaattcattggtgtgtctgagtggttccagtctgagtgagtgtgtgtgtgtgcgtgtgcatgcgtgcacaccacacacacacccagcgatgggctggcatcctggccacagtagatttctacatggcgccctgagctgctgggataggctcccaccacttgtgactcggaactggaataagcaggtaaatcgtgatttacttattttatgaatctttcttaaatgatgtatagctcatatgtatttcaatgtttaatattagaagtacgttggtctttagaagttttgtgatattttatgacaagaaatatgttacaagaacttaaatcttgtttatatcaattagcctatgagaaaattggttgtgtatgaggttgttgcacctaaagtcgcagtttccaagaacctatagatgacattaagtgaggacttactgtagttgaaccttactctaatctgcacgatcatttagatctcaaattgatcatgtttatcagcttgccttttttctctcttgctaagacattgttgatgatgtagaattttaagaaacttacatttaggatagtgtgcttgacaaaacagtatttttccagtttgacattaagttgtcaaaggtctgataaggaattttgggggaactttattgaagtggtatagatgttaaaagtgctttttaaaatgagatgacacttggtttattctgaatttatttatataaaataacactgtcttacgtgttgagaacttagacttttgattcaaaacacccagcatcaagtcctggtctaccatttatagtttatttatgctccctgaatctatttccttaagtgttatatgaggctattaatgccttcttcctaggctattgtgagggtttgaggagacgatgtgaataaaacacttagtaccttgtttggtatataataagtggctgttatttttctatgaaagtctgattacagtataaaatataactttattccctttgcgttcattttcatgccgaaaggttttctttcaatatgaaattggtatttaattgtataatgaatacttaggaagaaatatcgaatgtacatggtaagccttctaatgttttttgtaagaatggattttgatttgccgtacattcttttcattctttgcgtaagcagcaatacttactgattttgaaggtgataaaggccaaggatgtagtctagaaatccatgggcttggtgttcttaacttttgtgcttttatccaagctgccctaccatcatgatctgtaaccttcaaaatccatccctttttataaacagtattccattacccatttgtcatagcttgcctggagtaaagaaggatactgggaagatagtgggcactcttacttcaatgactgaccccttccccaccatttgttctcatcagctgtttttaatgttccattaaatctctcccttgaagttttgatattatttattatatttttcatttctggaagttcaaataattttgttcaaatcaggtaatctttgtagacagacatagaaatatctgcataagctttatgcttatcttttatttctttaacctacttgttttaaaattgctggctgataactccaatattcatagtttcaccacagagagcaatagctgctctctgctctttcatatgattcttgctgtaggtactgtatttctttttgtgtttagttgttttgttttgtttctatttcaatgagctgatcagtttccctggaatgttatttgtggggattctctgaggcctaggttgaagggaattcttgtagagaggatttccattagccttggcaggtgcctaaggtataaccactctgggatcactataaattaaatgaaattcatagcttgaggttttgggggaccatccaagtaataagaatttgtgctgtaaatctatcttaaggatatataaggggtggagatggtcaagtttagttatgtttcattatttttcctgaggatgtagcccttagctttactgggtagaggttctctccaatttgagatttaaccaagcccccaccccccatccccatctctttagcctcctgctaccattaaacctaggctcagactactggaatgtccaggatcagtgtcctcaggaaaaatgtcttcagtgggccacttaaccctttgagctctgattttacttagattttgggcataggaattcctatcttgtgaactatttgataactttagaaaaaaaaaataacccagtgttgttccttattttcagtggaaaggttgctccaattaaccttgcttgccatattaatagaaatagaacttccctgttatttctcacttaggagttttctcaaccagattttatatttaacatttcaaatttcttggcacaattctcattctctgaccctacttacttgctactggcagctttatttttaaactctgctttagcttttcttttctcctttgtataacttatccttcaacaccttgaaatagttaactcctgtgagtgtaataggaaatttacaaaaaataatctttaaaaaccaccagattatttgattgtgtgatccaggaatgaatgcatgtcttagaagaaagagggcaaattgggtgaaataaaagatgttaagcaagaaactcatgggtggaaagagagtattattgagatgattggcaagaccacttaggctgtcagataattaaatgaagccaagaaggggttatgggaaataagctgattacggcaggtaagacaggaaggaatgatggaagaactggaggaaaaggagcacctattaatcttggggaattttatcatgtattcagatttttaaaaaatcaattaatgaacatttgactatagaccatataaatcagggctgattcatagttttcccttttcttaaaactaattagcagatattagctataacaaaggatcttttgacctcaaaagaatacccttggtacattttctcatcaaactaatacttagaaacaatagggaaacaggaaattaatgagacatctgaaactttatgatttcttttcatctggaaatattagggggaaatcaaataaaatatacattttatcatgctgtttttacatcagacttttcccctagtattctttctcatttggaacatgttaatgtactacaaatgaaagaggatgaaacacttgaaaaatttctggattgtaatatgtttaaaaatatatatagttctccatctctcattttctacatttttccagtgttttttttttttttttaaatttgcttagccacgattcattactcattgaggtcctcctctgtccctggcactatggtaagtgttttgtgttttgcatatagtttctcattgaatcctcagaaaacctatgaggttctaattattattgccattttactggcaaaattgagactcataaaaaataagcaaacaaataaccttattgtttataaagtttacctatatttattttgatgtgcgttttaattgttatcttcatatcaagcctatgattttgtcagatactgttattattttttttaatacatgaggacaaagaagctcagagaagtgaagtgacttgtcaaagcttccagtataccgatacagatggtgctttatctcaaagcttctaagtcacactactaattttctacaatgctacacttatttggaagataaacataggatgatgatgatgttgatgacaatgactacttttaaagtggtacaaagcttgagatttagaaaaccattagtatccaacactagttgtatttggtaatacagattctcctctgctcctcatagtttagtgtagcctaccttaaacatgttcagcacacttatgttagcctacagttgggcaaaatcgcttgacacaaaacctattttatgatctcatgtaatttattgaatatgctacactgtagagtacattatccattgtttatccttgtgatcgtgatggtgtggctgactgggaactatgtctcacttctgctgttcagcattctgacagaagatcacacaaatatcactagcccaggaaaagatcaaaatccaaagttcagaatagtatttctactgaatgtgtattgttttacccatcctaaagttgaagaatcacaagtcaaaccatcataagtccaggattatttgtttatatatcttgtagggaagggaaaagtgaaaggaaataatgttctttctacccttctacattattggctggagcccctgtaacaaaagacaaattaacaagagaaaacaaacaggagtttactaacatgtatatctcatatatacatgggtgatacccaaggaaatgagtaaatctcaaagaggtggcttaagaatcagtcttaaatacgatcttcacctaaaaacaaagaaagaagggtatgggggaaaccacttatgggggtgaccaggaaaagtacagtaaacaagagtaaggttttttatgcagatttaagccatttccttcttcattaataagactccagtcttcttggtacagacagaaagagacacccttacaaatgaaaatttacgttataagtgtgaatttgccttacaaaagggtaacttctactttgtttgcagagcttcacatgtgtctgctatttctcaaaataactagttcaaaataatccttatactgaagaggcatattttggggtatcatattctggtctcctacaatcttaatatcaaatgccatagaaataacccaaaggatgggcacagtgtgtgaaaagttctaggaagaatataacaagtagactatataactactaatggcaatctgtgtcccaaccatttatttagctttatcagatatatttttctgaagatacttttctttctcatgtgctccactggttaaaacccagaaatacttgtagcataaagatataacccacaaacagcaatcatttcttttttcttgggtgtcagaaatagctcctttgtaaattcaggtgtgatgattaaagtaaaaacgagcgtgagataaactgttacgctaattatctggaattctttttgagatttttatgttagattgatttaggtgaggaagtatggcatagggccataaaatcagaggaaaaagaccgtatctgtgagttataaataatttttgtattaaaagggaatattcagtatagtacatctcttcaatttctaaaatgtctatagtaatattttaaaatattcacagaagaagttgaagtattattgataaggcttttgaagactattttgttcattaagtaaacagtaaaaaaaaacattttttgttaggtaaattttcaggattactcagaataagaatacttacagatataagggaaaactacctcaaaaggagtttaaagagattatattaaaatatatagtttgtacctaacgattaaaattttgtcctgagctcatcttaaattatctttgaaatcattaactatgtgttctgaaattttattttgggtacaaattgtttgagatggttgtttattttatgtatatatgtattcatgcattaattcatttgttcattcatattttttgtaatcttcagttccttatcatcattggcccaggctagtgctgtttcttcattatatgtgcatatatatgtgtgtacacgtgtgtatccatatatgcccttatacctacgacactaatccctttattctcctacagtgaggcaatcgttttaatgtactcaacgtgtatctttttatttgcacgtgtttttgtaaaatttgtgttgttggtttgtgtgtgtatctttttatgtaaattatgttatatatcatatactgttttctacatctttactaagcactatgttttaaagatccatttatactatatacatacatatatgtatatagacatgcatatatacacacacatatgtatattttgtgcatatatacacacacgtgcgtatgtatgtgtgacacatacacacacacacacacgcacacactcacattctaatttctaaatgcttcgtggttctccatagtgggcatctactacatttgaccctattccctctcccaatatggataaccagttgcctctacatctatacgaccgcaaataatgctacagtgaacatcctctcatgtgtccccttatagatccctgtgagaatttctctgagatatacatgtgggagtggaatggccgtgttataggtaaatatctatttctgtgctttccagaattttgcaccagtctgcactcccactagaagtgcttgaagattcccacgattgctcatttccatcagtatttggcaatgagtagtgttctagttttcgcctcagagaaatgtttaaactattttaaacacaaggttttcaagagtattctagtcactattactctgctgataaacctttattattattcatccaccaaaccaatctcaagaaaacctgtactacatgataatttgctagttatggtgtatgtattgtaaaataataaacttatttccttagaaaaattctttcagatattttattaatactgctaggatttagaattggtgatagtttatcttacattttatttctaatttgctcatagcaaattatattcatgatcaaagaatattttctgtcataattattgtccaaacagtgtttaggttgcacatggaatttaaaagtactcttcagtgagtaaatgacaaaatcctgtttttttacttagaacacttttaatactgtggttcacttttctataagttatactagtgggataggtcacatgcagactaaatgtagaaatataactaggctgtggaattaattagctttgattttgcatttatttgaaaaacaaaaaagaatatgaagaccactgacatatatttccactatttttctttttcaaatcatacaattgagataaagattcagtacttcctccaaataaacagccccgtaatagcagaaatgtaaattacaacacttctaaatctgtttttatcaactattgacctaactttattaaatgtacctaaaaatgtagggctactaagcagctggaaaataatgtattcagtttgtagaggggaaagacacgatacctttcctccgtgtcataaggttcttggctgacactcctataacaaaagacagattaacaagtgaaaagcataacacatttgtttaatcaaaattgtatgtgacacaggggacttcagaaatgaaaactcccaaacccggggaaaacgatgtcattttgtgcttatggttgttgaagagtgaatagctgtgaagaaatgtgactgaacaaaagggtatgatctagtgataatagaccgtggagggaaaccgagcaaggcctgtctgttcagattcttgtgacctctttgtgtagcattccttcttctcaggtaagggcaggaaccccctctgaaatgagggtattcaaggtataaaggaggagagggtgacttttctgggttttatccttgctttgggcaagaggggttctagtttctatgacttaccttggagaaggattctgtttttttataaattgcttcagagacagaaggagggataggagacaagagggcaggaggtcagaaagagaatttgcctctgaggctgcttctgcagccttccaatctcctttggttcaaagtaatcagcatgccaaagcactgttctctggggtgtcattttttgagccccagtaagtaaaagaagaagaaatcatgggcaagaaaatttcattgtctgtgtctctatctctgtctctgtctctctctacgcacccaccccccgccacacacacagagtaacaaattcacataaagaattgtaaagttattgtcaagatattttacttcagtacttaaatattaattgggtacttaccaaaaagcatgaacataaatacatatgtgttattttatatatatattatttataattgacaaataattgtatatagatatggggcacaatatgatgttttaatatatgtatacattatgacatgattaaatcaagctaattaacatatccatcaactctgctacttatcattttgtcacggtgagaacatttaagatttactttttaagcaattttgtaatatacatcaggccgggcacggtggctcacgcctgtaatctcagcactttgggaggccgaggcaggtggatcatttgaggtcaggagttcgagaccagcctggccaacatattgaaaccatccccctgtactaaaaatacaaaaattagccaggcatggtggcacatgcctgtaatcccagccactcgggaggctgaggtgggaggatcgtttgaggctgggaggcagaggttgcagtgagccgagatcacgcatcactgcactccagcttgggcaacagagtgagactccatctcaaaaaaaaaaacaacaatgtaatatacatcgaagaccttcagtctaattaggcaaacatactccaaaagtttattttagcaaaacgtggtttatatactacaataggctagtataaagaaaatatgttcattcagattttttcctcttaaacttatcaatatatctgatgtttttagaacaaattccttactttcattattttagccactactgagaagtcaatcatcaagtcactcatagtttgtctacttagggcctttcaccaatactcagtccctttaactggctacaccaaccaccatcacccttcccaaaaatacaacagaaaataaaataaaacaataattatagctcagtgacttcagagtactatcagtctatcactgtcagtgatttcttaccacttgtgaaatttcaaaagcctgccatgtactatttgtcctgtcaactcataccaggatcgtctgccaaatatctcaacatgaaggctctgtacaattacagacatctccatttgattcctcctctgaaatgtgttatttacatggttttttgtgtgtattttgcccatcattcactaatagtggcttactccaatgatatatagctatcctcccttctttacctagttaaatttcccagatgctcttcataggatccctctcaactattcaaggtctctttctatggtttaagggcttctcataaatgcagcctatcctcattgggtaaactatgggactagttagaggatagcagtaaggtgcatactccagcttttccccccacacggattcagactcatacttgggtaccttctgcctgaaggtgatggtggcagatactttgtaacccctgggttactaaatccttctcaatatttctaggtagccatgttattaccattccatttccacaaagatccctcaagtaccagagccaatattcaaacccagatctgtgggaactccaaatgctattctcatctctatatatgagggggtggggagctcaccaattctcttgacatgccaggagccatcttaccctttattttggtcaattttgttttgttcttcttttctcttgagctaatatttatacgctgattatgtgctaggcattgtgctaaatagtttaattattgcatttcattcccataattttactgaggtgtggctttatgaatgagcaaactgggacttaatgagtttaaataactgacccaaagtcaggcagctaataaatggtggagcttggatttaaacccagtctgctttaccttagcagccatacactaaacctgtaagcattcccaacaggacacatgggtttccatgattcagggtttcgtaaattggttaactgtgtttcttaggatcatgaaaaacctgcaggctttcagatttatttgaattatttttgaccattgagtcacacatggagtggattagttaggaaataattataggagtcagagttaaaataaaattaaatccagattggttataactcacacatttcactcttttatattttagcttccttttttttacataaataccacacatttaatagttttaacttgttattttggtcaaaataaattttgtaacgctgattcttctgttgtgtttagactatttggttgaatcaaggattttaaaatttgagtttaccaagttaagcactaaatcgaagtccaaaaccatatctgctttttatcccagtactttagacaataactagcacatagcagttgctcaataaatatttatttagtgaatatgtggaattactatacatttattattaatttgtacatcaaatgatctttcatcttttccttgaaaagtatttcctcattgaagaaatgctcaaattctgatacatctttcttcctaaaagagtatctttctaaagtccctaagcttttaagggtgctattaaatatatgtaaataatgattaatgaaaaatcaatctaattttaagatagtgatgcataccatctcacacaatgtgttttttcccagcttatgataataaaaaaatgtctctgagatgagaaagcatactgtatctgaaacctagccaaccacagctgacatcctcactgaaggttagctggtgttgactgatgcagggagggtacagatggaacaactgtagagtatagaatctagctctatgcgattttcatcttcctcagactaccttagatatgttagcaggtcaattggagacgggcaccaaaaaatggaagaaatgtgtaagtattaattgaagcctctgctttatgacttcgcattggctcaaacaggtcatttagtgggctcataaccagagtaaagtttccttaggcaaaaggtgcggatacagtcacagatggagtcattaacacaatcaacctatcatataagctaaactaattgtatttatttccataaattacatctggccttcctactacagtcttttgattttctactgagaagtgcatgctaaaaactaccttaaacacacacacacacacacacacacacacacaactttaactttctgcttactttcatttctgctaatattgtactttgtgctaatataattcattagctaaaatattcatttttgtagagactgagcaaaaggatagcagtcttttaaatagaaatatcatacagtatggcctttgtggtcagtatacaagacaaatatccacatggcatttatcaaataaaatttatgtatgtggacattttatttacatgcatatgttggaagaaagccatgtattttaaaaataaaaatgagctgatcattctacaaacgttgcagttgcctattataatgaaattgtgtgttaagtgtcactcttaaatcaatggagatgacatttgcatatcagtttaattgctttggattaaacattgaaagatgagagccaagagagcttattaagctgaaatgagggcaagtgataaaaaagtgatattatgtcaacactacatctggaggtctgttgttgtttccattttaaattctaaattgcagtgtttctaaaaaaattatcatcaaatgccatagttttgaaatatagtacaaaaattaaaacagttaatgcatcaattgtgcttgataaatacaatttgatttgaaagccaagctagggttttctctactttgttgaaatgtatttcttcttaatgtactagattgtaagattttgaaagcttttgaaaaacattatgtcttatttactgctgtatcttcaggactttgacatagtgtgtcctgtaataggtgctcaataaatatttgtgaataaatgagtcaatgcaaagtatggcaacaccttcatagttactgtaaaacactctaagtgagttcctgggtaccgctgattttggttgatgccagaaactgtatccacagctccctaccattcagaagcactgtgtgctcattggccttcttctttgcttgggggaatcatcagtcattattaaatatataaattcctgcaatgatctactttgaagtaggctatgtggactgtggcatgtgtgaagcaatttgattcccaattctgagggtctcctgtaggggtgtttgatttgagactccgcttagaaaccaccatttgtttgctgtgaccacagcatcagaaaactgatgacccatcattatccaacgataatgcagacctctttcatttgcattagagaatttgcatcacttccaggtattccctattgctcatcggagtgatttcatgtttgccagatagactatattgtgttagatcatctaaaacatagccttcaaatttgtttaaattaatccctccattgcagttatattgggggatttattttatggaatatctaagcatcttacaagcattatcttctcaatccttataacaagtgtgtggaaaaagttctatgaaatatcttcattttacagacgagaaaactgaggcacgggaaggttaagtggcatacctacagtatgtggaagagccaggttttgaaattagacagtctggttccagagggtgtgttcttaaccaccgtgctgtgagtaaataggtgcctgaggttcccctaaggtccctgaaaatgaagtattttgtatgccacatctatttcattgttgtttttagcttttaatcatagtacaaaaaaggtaacataaaatttaccatcttaactttttaagtatagagtttcagtagtgttaagtacattcacattattttgcaacagatctttagaactttgagttttaaaaattctatacccattgtacaactcctcatatcccctgtcatatctatttttaagtactatcatcccaaacatagcacctcaatctgatgagaagctatcatactattatcacttcaaatattaataaacagagaaaggagaatttttgtatttgcatagattagtatatgcccagaattcaaaatttagaaaaaatacgaatgcagaagaaatggagttgtattaatccgttctcacatcgctataaggaaatgcctgagactgagtcatttataaagaaagggggtttaattggctcacgattttgcaggctggacaggaagcatagtagcttctgcatctcgggaggcctcaggaaacttataatcatggcagaaggtgaagagaaagcagtcaagtctcacatgcagagcaggagctagcaggggagtgccgcacacttttaaatgaccagatctcgtgagaactctatcactagaacagcaccaaggggatggtgctaaccattcatgatggaccaagcccatgatccaatcacctctcaccaggctccacctccaacactggggattataatgtgacataagatttgggtggggacaaagatccaaaccataccaggagtgatttgaaataaaaagaaatgtcttagtgatttgtcttcctcttgtttctcagtttgaccttggatatttgcagaagaaaacttttctgatgtagtttatctgaatgacctgttcctaaatcatgacttcagaaatatatttttagttaaaagccaagaaaacaaaaagttatatttaatttacttgtttcttaaacacataagtattatgttaacttctgcataaaaataaattctattcaaacattgataaaaacaaaaagtacagttggccctctgcctttatgggttttgcatccatggattcagtcaaccacggattgaaaatatttgggaccaggcatggtggctcacacctgtaatcccagcactttgggaggtcgagatgagcagatcacttgaggccaggatttcgagaccagcctgtccaagatggtgaaaccccatctctactaaaaatacaaaagacaattagccaggcatggtggtgggcacctgtaatcccagctactcgggaggcttaggcaggagagttgcttgaacccgggaggtggaggttgcagtgagccaagattgtgccactgtactccatcctgggctaccgagtgggactctatctcaaaaaaaaaaaaaaaaaaaaagaaaaaatatttggaaaaaaattgtatatgtactgaacatgtacagatatttttcttgtcattattccctaaacaaaacagtgtaacaactatttacacagttggattaggtattgtaagtacatacattggattaggtattgtaagtaatccagaaattacttaaagtatacaggaggatgtgcataagttatatgcaaatactacaccattttataacagggacttgaacatctgtgggtttcagtgtccacaggaggtcctagaaccaattccccacagataacagggatgactgtatagacttttatatatgtatacatatttaaaattctatgtaaactgtagatagaattttaatcagtaaggtaaaaaacacgaatttcatataaatgcatgcaaaattatacaatctacgttgaagaaaataaaaaggactgaaaaagatatttatattaatacatattttcaattcttaattttctttatgtttgccatcatatttaattctcaaaaataaccctatataatagtttgaaatgtgatgtagtaaaggatgctaggaaaatagacttagatgggtggtgctcaggcagagaaggtgaaaggagttcctgggtgagggtcttcatcaacacatagaagtgagggagagcatggcacgtagatagcaccaatcgttacaaatggtcagagccctagatttgtgaatatggaagtggtaggagacagggaggagagataggccaaatccggatcaagaaagatttcctatagccaaataaattaattttaacgtgatttcacatattatagaaatgaaaggaaggggccaggcacattggctcacgcctgtaatcctagcactttgggaagccaaggcgggtggatcacttgaggccaggagtttgagaccagcctggccaacatggtgaaaccccgtctctactaaaaacacaaaaaaattagctgggcatggtgatacatgctattcggggggctgaagtaagaggatcgcttgagcccgggaggtcgaggctgcagtgagccaagatcgtgccactgctgtccagcctgggtgaccaagtgagaccctgtctcaaaaaacaaagaaagaaagaaaataaaggaagaaactaacaggaaaaatacttttttaaaaaagaaagaaatggtccggcgcagtttctcacgcctgtaatcccggcactttgggaggccgaggcgggtggatcacttgaggtcaggagttcaagaccagcctggccagcatggtgaaaccccccatctctactaaaaatacaaaaattagctgggtgtggtggtgcacacctgtaatcccagctactcgggaggctgaggcaggagaattgcttaaacccgggaggtggaggctgcagtgagccaagactgagccactgcactacacactccagcctggatgatagagtgagactgtgtctcaaaaaaaaaaaaaaatagaaatgcaaggaaggatattaattaatcaaaggattgtgtcgtagttagaaatgacacagataaaaatattttatcataaatccctttgctagtgtcaggacccattctgcttccaacttcataatattatattaccttaagttgggggttgatcaaatattaagaagaaagtctgagaatttttctaaggaccccttctaggtccacaagtcagagtagaagtagtttgggataactgtatgctgatagattttgtgtttttaaaaactacttggtaattattttgtcagttattctagcatcaaatattaaaggttctgacagtcgcaaggaagtgatcaatgatatttgcaaatgctaaagagaagatgattaccagccatccacagggatgattcaaatagcaaatatcattatggtaaaaacaaaattttcaacaaaaataactgtttaagaagcacagttttctgatatttttgataggtcaatttttttttttttttttttttttttttttttttgagacagagtctcgctctgtcgcccaggctggagtgcagtggcgcgatctcggctcactgcaagctctgcctcccgggttcatgccattctcctgcctcagcctcctgagtagctgggactacaggtacccggcaccacgcccggctaattttcatatttttagtagagacggggtttcaccatgttagtcaggatggtctcgatttcctggcctcgtgatccgcccgcctcggcctcccaaagtgctgggattgcaggcgtgagccactgcgcccggcctgataggtcattttttaaagtcaccttcaattcgagaaaatcaggaagataacatttttgagtaattttatctttacacttacatataaaatatttttaaagcatatatgcacatatatgaatttattcaagttttttttagggggaaaagagcttgatctagtgatatagtttattaactcactctgttatcttaacatatattgtttagaagctgtggaaatcatgtgtaattagcaaatataatcaaagttattttatatcataattatttattcttcccctgcaattccctgttgtaatttgtttgtttaatcagttcatctaaacttatcatttttcattcatttgtccattataagccatgaaacttttaccttttctctctcttaattataatcttgtctgatgaggacaaaataactgagacagaacagaggagcaagatgaatggcagacagcaggtgcatttgtatattatgaagtgtttgcaaaataataagcaccacatgaataatgcatttgaagaatattgtctggcaaatattattaagagtcatatatccaaatcatcccacaattactgaagaatgaaaaacaaagtgtctaatgcctctggttttgtcagacacagagagaatcaccatatagagcttctaggtagagcaaaagggcttctatttatttttatttatttatttatttatttatttatttatttatttatttattgagatgaagtttcgctctgtcacccatgctggagtgcagtggtgcaatattggctcagtgcaacctctgcctcccgggtttaagcaattctcctgcctcagcctcccaagtagctgggactacaggcgcacgccaccacgccaggcaaatttttgtatttttaggagacaggttttcaccttgttggccaggctggtctcgaactcctgatctcaggtaatccgcccaccttggccacccaaagtgctgggattacaggcgtgaaccaccatgcccagcaccacttattaatagaggactaaaaatttatatatatatctttatacaaatgtatatatctatattttatcatatttatatgtattatttatatatttgtatttactacatatatatgtgtatatataatacagttggccctccatatctgtgggttctgcaattgcagattcaaccaactacatatggcaaatattaataaaaaggatgattatgtttgcactgaacatgtacagtctttattcttgttatacttcatgaaacaatacagtgtaacaactatttacataggatttatattgtgttaggtattgtaagtaatctagagatgatttaaagtacactagaggatgtgtataggttatatgcaaagactgtgctatttttttatatattttatgtatgtatacctagcaaggtaaaatactgacacaattcaaaaaatgaaggaaaacctcagaaacgctttgattcaatgcttgtgtgtatgtgtttctgtttttgtttgtttttgtttgttttgagacaaggtcttgctttgcccaccaggctggagtgcagtggcgcaaccatggctccctgcagcctccacctcgcgggctcaagcaatcctcccacctaaggctgtggagtagctgggatcacaggtatgtgccaccatgctcagctaagtttttttgtttggggtgtttgtttgtttttctttttctttctttttttttttttttttttgtagagacagggtctccctaggttgcccaggctggttttgaactcctgggctcaagttatcctcccacattggtcttccaacatgctggaattacatgtgtgagccaacatgcccagcctctgtgtatgtgtgtgtgtgtgtgtgtgtgttgaaagagagaaaacataaagtaggactcaggattttagagtggttgatatgccactcctcattttgcctcttgactgtcttgctctatgaccactccttggaggtagctgagctgtttgtgttgctagtgttgctgcagccactggctgctgcaagaatctcaactgttctatcttctgttgctgctgctgctgctgctgctgctattgaaaagcagaagacagctgggacctctgctgagggaggctttaccaaatcttttctgggcaaaaccaacctgagatatcatagctgcctgaagctacagaaaacttctgactctggtgagattaatgagaacagctttatgagtccttcaggcctgttcttgattgcttgaaccttgtgcagaaccctgtggccttggctgtggagcatgagaagttgtgtgttgctgaaagtattgttgcagaatcaactgatggagcggcagaagcagcagcagctgctgctggatgttcaaaatgagggaaccaagtggaagctggagtagagttaatggcctgagacctgaggtacttaaaaaaaaatgctaaacacacctgattgaaaaggtgcctgcattctattggactgggccatgcatttggtagcatacctcctgaggaccgagggccactccctttgattctcgaaggaaatggggcattaacagtacagcccagcatggggtttgaaccactccccaaagcccaggctccgcagactgggcccactacattgatgactatttggacagttgagtttgccattacctaggaggctgggattgtttttgaggagttggaggagaccaggcagtgtgggggaaactgaccccatgattcaagtatctccacctggccccacccttgacacttggggattattacaactcaaggggattattacaattcaagatttgggtggggatacggcaaaatcatatcacttagctcaggagaaggtggacaatgagacagctccagatcctaattcagagaagatgtagaatatctcttgcagcattatttcactgagcctgtattcaccttttgctttttataggctgatcatttcagaaattctccctacctcggactccttgtcatgtggtccttatttattcgctgtctctcctgagtttggctagctcatgtcgtatatgttgttgtttgtccttttttatttagagttttaaaaatttatgattcatggtgtctttccaactttgcaatggcttatttaagtataaaatttatttaaaaacaaaacattaaaagttatgagtgaataagaaccagaaaaaattttttcgtaaatttccttttagagtgtcaaaatacaatttttctctgttttaccttgtgtgtggatgtttatctgtgtattgtttttgcaatgtttttatctgcttaattaatattcggctattggctttttttttctcagaacagtaatagaagatacgtttttgaagtggtaggatatgaagatgacatagcttacttaatttcatagttcaagaccagcttcttttgttgccattatgacatgaagtattttttttattgttaactgttgttattggtggtggtggtattttaaataaatagtacacttttccacaagccttgcgtctcctgattctttgacactcttgggtcattaggatccttcaactttagtctgttcttttttttttcccttagccataagtcttcaaagaatacatttcttctcaaaagtgcttccctgttcctaaaaggagatgtttacttctggtcctaaattctttttatgctcctttcttttgattgcccacaaccagtgctctaatctacctagtttcaaatattatctcagtatttcccaatccagcattgggcctcaatcacctcctacaaattattaagaataagaaaaatacctccggaggaaaattaggtcaaaataaatattcattaaaatatataaataatatttacatatatgaaaagatgctcaacctcacaataatagagttgcaagttaagactaaaataaaaggctatatttttgtattttctttttctctttttccttgtattattatttttatttgacacatattaattttacatatttttggggtagagtgtgatatttcaagacatgtatataatgtgcaatgatcaaatcatggtaattagcatatccatcacctcaaacatttatcatttcctgtgttgggaacattcaaaatctgctcttctagctatttgaaaatatacaataaattatttttaattatagtcaccctatagtgcaatagatcactagaacttatttctcctatctaaatgtactttttttttttttttttttttttgagacagagtcttactctgtcgcccaggctggagtgcagtggcacgatcttggctcactgcaacctcctcctaccaggttcaagcgattctcctgtctcagcctcccaagtagctggaattacaggcacctgacactatgcccggctaatttttgtgtctttagtagagacgggatttcacaatgatggccaggctgttctcaaactcctgatttcaggtgatccacctgcctcggcctcccagagtgctgggattacaggcatgagccaccgtgcctggccctaaatgtactttttaaaaaactaaacttagatacagggggtacgtgtgcatatttattacatgggtatattgtgtgatgataagattggggtatggatcccatcacccaggtaagtgagcatagtacccgataggtagtttttcaaagcacactctgtccttccctttccctctagtaatccacagtgtctattgttcccatgtttatgtccatgagtgctcaatatttagctcccacttataaatgagaacatttggtatttgattttctgtttcttcattagttcgctgaggatattggcctctagctgcatccatgttgctacaaaagacatgatttcattctttttaatggctgcatagtattctgtggtgcatatgtacccattttctttatccaatccaccattgatgggcacctaagttgattccatgtctttgctattgtgaatagcatggtgatgaacatataagtgcatgtgtctttttggtagaatgatttattttcctctgggtatataccaaataatgggattgctggattgaatgttctttgagaagtctccaagctgttttccacagcagctgaactaatttacattcccaccaaaagtgcacaagagttctcttttctccagagcctcatcaacatctgttattttttggcattttaataacaaccattctgactggtatgaggtggtatttcattgtggctttgatttgcatttctctgataattagtgatgatgagcatttgttcatatgtttgttggttgcttgtatgtcttcctttgagaagtgtctgttcatatcctttgcccatgtttaattgagttatttgttttttgcctgttgatttaagtttcttatagattctgaatattagactttcgccaaatgcatagttgtgaatattttctcattctgtaggttgcctgttcactctgttgatagtttatgttgctgtgcagaagctctttaattaggtcccacttgtcaatttttggtttcgttgcaattgcttttcaagactttgccagaaattatttgtcagtgcccatgttgagaaggctgtttcctaggttttcttctagaattttcatagtttgaggccttacatttaagtctttaatccatctggggttaatttttgcatatggtgaaaggtaggggtccagtttcattattctgcatatggctagccagttatcccagcaccatttattgaataggaagtccgttccccattgcttttgttagccccatcaaagatcagattgttgtaggtgtgcagctttatttctgagttttctgttctattccattggtctatgtgtctttttttttttttttttttttttgtaccaatacatgctgctttggttactgtagccttatggtatagttcaaagtcaggtagtgtgatgactctggctttgttctttttgcttaggattgctttagctattcaggctctgttttggctccacatggattttagaatcgtttttctaattctgtgaaaaatgacacttgtagtttgatagaaatagcattgagtatgtaaattgctttgggcagtatggctactttaacaatattgattcttccaatccattagcatggaatgttttgcatttatttgtgtaatctcttagttctttcagcaatgttttttagttctccttgtagagatctttcactactctggttaaatatattcctaggtatttttttgttactactgtaaatgggattatgttgtgatctgattcccagcttggatgttattgatgtatagaaatgctactgatttttgtaaattgattttgtatcctgaaactttactgaagttgtttatcagttccaggaggcttttggctgagtctttcggattttctaggtatagaattatatcatcagaaaagagagagagtttgaattcttattttcctgtttggatgccttttgtgtctttctcttgcctgattactctggctaggacttctagtactacattgaataggagtggtcagaatgggtatccttgtcttgttacagtttcgtgggggatggtcccagcttttgtccattcattgtgatgttggctatgggtttgtcatagatggttctcagtactttgaggtatgttccttcaatgcttagttctttgatgttgttgttgttgttttaatcaggaatagattttggattttatcaaaagctttttccagttcaatgaggtgatcatatggtttttgtttttaattatctttatgtggtaaattgcatttattgatttttgtattttgaaccaccttgcatcccaggaacaaagccaacttgattatggtgagttaagtttttaatttttcatttgtttttattttttttaatttttaatgttttgttgtgatgacctctctttttaattttttttttttttttttttttttttgtgacgaggtctctttgttgctgaggctggtctcaaactcctggcctcaggcagtcctccctcctcagcttcccaaagtcccgtgataaaggtttgagccacaatgcctggctgtttttaacgtgctgctggatacagtttggtagtattttgttgagaatttttgtatctattttcatcagtgatataggcctgaagttttctttttttgtcgtgcctctgcttggttttggtagcaggctgatgctaccttcgtataatgagttagggaggggaccttcctccttgattttttgaaatagttccagtaagattggtaccagttcttctttctacatctggtaaaatttgactgtgaatccatctgatccagggctttttctggttggttgctttttttttttttttttttttttttttaacattgaggaggttattttattttattatttattttttgagacaggttctctctgctgctcaggctggagtgcagtggcacaatgggctcaagcaattgaggagttcattttaaatgtatagtgtaatccacatctaagctctgtttgcagaatgagaggttgatgaaagaaagctcaatgaagctgcagagtcttaatcttgcttttggccgcaccagccctggcaggacctcgttcacaaagacagagaattaacatttgtcgaatgaatgaaggagatgccgtacaaagattgtatggttcctttcagagcctaaatatttaataggtgggtcactgagggtctgaactagaatatttgataagcagacatccagggttgagtgttagatgttctgcagggagatggatggaggggtacctacagggttctgcaagctcagtaatagatgttgttgaagaagaaatataagttagagacaggacaggacacacagagaatgcacctctttggggtcaataaaaaaagggaatgagcccagaggaagcactcaagatcagttgcaaattgatatcccaaatgttttggaatacttctaggaaaaaactctcctacatttcaaagtccagataatactgactccaccctctggcacagaggacttctatggcaacatagcacaggagtggtacatgaaggcaaagtccatttgtcttagctcatatcaaatggtaaagcagagcttcttttattttaatttagctattcaagctgctgaagctatacccaaaatccctagccctttctctgatatgagtctctgtgtttccatattgggagcaatttttttttttttttttttgagatggagtctcactcttgttgtccagactggagtgcagtggcatgatcttggctaactgcaacctccgcctcccaggttcaagccattctcgtgccttagcctcctgagtagctgggattacaggcacccgccgccatgcctggctaggttttttttgtatttttagtagagacggggtttcaccatgttggccaggctggtctcaaactcctgacctcaggtgatctgcctgccttggcctcccaaattgctgggattacaggcatgtcccactaggcccagcgcaattgttttttataactagaaatgtgtttggctttcctccaacaaaccaggaaggtcaagagatatgttctagatacctctttgtggttgcttaatgcagagctcatgcagacacatctgcaaacctaaggaaacgaccctctaaggactggttagccacttaaaatgtgggccaagataggctattaaattcgaatcctcactgcttcattacagcttcctcacattgttagcctacaaactaagttaaggacacacttaaattccagaagttgatattagtctattcagagttttaatctcttcttgattcagtcttgggagattgtgtgttttcaggaatttatccatttcccctagattttctaatttgtttgcatagagttgttcatagtagtctctgaggatcttttatatttctgtggaattagttgtaatgtcatctttgtcatttctgattgtacttatttggatcttctgtttttttctttgttaattaagctagtggtctatcgatcttgtttattctttcaaagaaccaactctcagttttattgatctgttgaatggatttttccatcttagtttcatacagttttctctagttttagttatttattttcttttcttctcctagttttagggtttgtttgttcttttatttcctagttcatttaggtacaaagttagatgattgttaatttgagatctttctaacttcttgatgaaggtgtttatcactataaactttcctctaaacaccactttagctgcattccagagattttgataagatatatcccgattttcattaatttcaaagtatattttggtttctgccttcatttcagtgttcacccaggagttattcaggggtaagttgtctaatttttgtgtatttgtatagttttatttttttttttagaaagtgtctcactctgttaaccaggctggagtgcagtggcatgatcatgggtcactgcagcctcaatctccccaggctcaggtgatcctcactagccacccagatagctggagaactataggtgcacatcaccattcctggctactttttttgcatttttttgtagagatggggtttcaccatgtcacccaggctgttcttgaactcctgggctcaaacaatccacccactttggcctcccaaaatgctaggattataagtgtcagccactgtgccctgcttatttgtgtcgttttgagagaccttcttgatagtgatttctatttttattgtactgtggtctgagagtgtgcttgacatgattttgattgttttgaatttactgagacttgctttatgactaagcatgtggtttatcttagaatatgcttcatgtatagatgagaagaatgtatagtctatggttgttggatggagtgttctgtagatgtctgttaggttcaattggttgagtgtcaagtataagccttgatgatctgtttatcaccctgctgtcagtgggtattgacatctcccattattgttgtgtagctgtctcagtctttttgtaggtcaagaagaacttgttttatgaatctgggtgctccaatgttgggtgcatatatattaaggatagttaaggcttcttgttggagtgtaactgttatcattatgtaatgcccttctttgtccttctttattgttattggtttaaaatctgttttatctaatacaagaatgatgactcccactgtcttttgttttctgtttgcatggtaactctttctgcatccctttactttgagtctgtgggggtgtcattagatgtaaagatgggtctcttaaaaacagaagatgattgagtcttttatttgtatccagcttgccactctatgtcttttaagtgggacatgtagcctatttacattcggggttagtattgatagatgagattttgatcctttcatcatgtagttagctggttgttatgtagacttgattgcatagttgctttttagtgtctgtgggctatgtgcttaagtgtgtttttgtggtagcaagtgttgttctttcaatttcatgtttagcattcccttaaggacctcttatgaggctggtctagttaaaactaattccctcagcatttgctcatctaagaaagatcttttttctccttcacttatgaagcttaatttggtaagatataaaattattggttgaaatttattttctctaagagtgctgaaaataggctgccaattttttctggcttgtgagtttctgcatcaaggtctgctgctatcctaatggagttccctctgtacatgacctgagccctctctctagctgcctttacatttttttcttttggattgacctttgtgaatctgatgactatgtgccttggggatggtcatcttgtgtagtatctagctggagttccttgtatttcctgaatttgtacgtcaacttctctagtgagattaagaaaatttttgtgaactatatcctcaaacatattttttaagttgcttattctctcttcttctctctcaggaatgccatattggtcatagatttggccactgcacataattccctatttctttgaggttttttttttttttcattttaaaaattattattttttctttatttttgtctgattgagttgattcaaagaacaagtctttgagctatgagattcttttctcagtttggtctattctgctattaatacttttgattttattataaaattcttctagtaatttttcagctctagaaattcagtttgattctttcttgaaatggttatttatctttcagttcttgcatgattttacttgattcattggattccttggattgggtttcaactgtctcctgaatctcaatgagcttccttgccagccaggttctgaattttatgtctgtcattttagtcgtgtcaggctgtttaagaagcattgctggggagctggtttgcttatttggaagtaagaggatactctggctttttaagttgctacagttattgcactgattctttctcctctgggaggactagtgttcttctatctgtggtgtaagttgggtatagttggttgtctttgtttctgcgtgttttctgagggtcaaggttctgtataatgtctttatttatggcttaattcttgcccatggtttcacaggaggatatattagcaaaatgtttttggtgctgtagtttgggctgcaatcctgtagatggtacataggaataacggtcagtagataggctcttactcagctgtgcagctcctgtgtatttccttgcatttgcagccatgctctgtggtataggggggagaagagatgacctcctcaccaggcctgctcctgggtcttaggaaacccctctgattacttccaccatgcccacatttattttgttaggtattctgggccatgggcctcccttgggcagaggctataacatggagatagactactccctttctggactggccttgcagagggaggcatgcctcactcccatgccagtccatgaacccatgtgtttcacccatttcagtgctgtgagagtgggctcctcccccactagagtgttgcatacagatctcagcttagcattcccgaactgtgcaccacagccttggggcaccaggactggctcgcagctctatcctctagacgttcagggttggtttctgggtgcactgggaaatccaaagtgctcccaggctgctgtgaatgtactcaggtgaagcaaagcatccaggctgggcagcataggctgtgccatgtatacattcctgtgtgggggaatggggggtatccaggtagaggctctgggaagggcttttgggcaggagagcctgcgaagtagacataccctagtcctgcaggaaagccagccccactttctcctggcctggcagtcagttgggcctagagattctcagaggaaaatggggatccctgtgggatgggcacctacctaaggccatgccctactggagctctcccacacagaaaggctcctggctttgcaccagctgaagcgttgtctctacctactctctgggtagattcccctgccagctcaaatgtctgtgggggacatggaatcccctgtagctaggatcccagaggttcacagtgagagtgggcagtcccacagcttctttactcacccctttcccaggagccatttggagccgaaaactagccataacgttcaggtaccttatacacggttcccagattcctctctcttcagcctcagtgcctgcgtcacatttccatccactcttggcatttttctctccaaagatgtattcaaattatgttgctttacttaacattttggtccctcttggcgggaacagtgctttctagctgtgtctagtaagccatcttgtcccacttcctagctgtatttttttttatctgttaaccatcctttggctatccctctcccttccctacccttccctgcctctgataaccactattctactctttacttcatgagatgtattttttagcttccacatacatgtgagacaaatataagcggtatttgtctttctgtacctgacctatttcacttaatgtactccaggctcattcatgttaccatgaaagacagaattttgttctaaaagaccattcttttttttttttttcctactagattactgaagatcggaacatttcatagcttatcatgttagctaatggtgtggggaaacagacacactcaaatgttgttgagggtttattttgtgtttttttgtttgtttttgagatggagttttactcttgttgcccaggctggagtgcaatggcacgatctcagatcactgcaacctccgcctctcgggttcaagtgattctcctgcctcagcctcccaagtagctgggattacaggcatgcgtcaccacgccctgctaattttgtatttttaatagagatggggtttctccatgttggtcaggctggtctcgaactcctgacctcaggtgatccacccgccttggcctcccaaagtgctgggattacaggtgtgagccactgtacctggccattgttgaaggcttgtattggtccaattcctatggataacaaagaaactaggaataggatttaccttcaaggtttttgggaatttctcaccactggcctatagtctcattaaaaatctactactttttaaaccttttaaaaataaatgcaatatttaccttgttgctttgtataccacctgcacaccagtgttactggtcagtggggcagcactactacattccgagtatcacttggtaacatgagagaattcaagaggaaatgtatagcaaggacaaaatcctaggaaaagtctagcatttatgaagaaagaagagaatgaatagaggcatattacaatcaggaatagacttactaataaaatttcaagaagaatgggagtaaatagtattaaatgccatggagtgctcaagccagttaagtattgagccagtgaaactattgaaaccatgtaattgttgaaaagtaggtttttgatagccttagtaacaacattttctgagaaatagtggagaaaaatcagaacatagtagaaaaacagatgagtctgtgttgagaaagtaaagagagtagcttagactgtcctgaaaagtttttgttagtgttgagaaagaagtgagttacaggttaaaatagaggacacacacatgcatacaaaaaaattaatagctttgtgtaaaatctctcaataatgcaataatagaccaggtaaatacaacataaataatgatgttaccaataatgtaattttggaatttttggaattgacataagctttcatggagatttttatatgataaatgaaaaagtaacatacgcaaaagcctctattcaaattaatgacttggctgggtgaggtagcacatccctataaccccagcactttgggaggccgaggtgggaggattgctggatccctggaattagagaccagcctgagtaacatagggagacctcatctctacaaaaaaaaaaaaaaaaaaaaaaaaaaaaaaaaaaaaaacttagctggacatgctggcatgcacctgtagtcccagctactcaggacactgaggcaggaggatctcttgagcccaggagttcaagaacagtctgggcgacatggagagataccgcctctacagaaagtaaaaaaacttatccagatgtggtggcacattcctgcagtctcagctactcaggaggctgagatagaaggatcgcttgaacccagaaggttgaggctgcagcgagccatgattgtgccactgcactctggcctgggtgacagagcaagactgttgccaaaaaaaaaaaaaaaaaaaatatatatatatatatatatatatatatatacatatacttatgtgctttgtacattatagacataataaatggtagataatgacatcagtaaccacaaagtcaaattatacagcaatacttcatgtaattttgattccaaataaatccatattagtaaaagaaagccaggagcattgtaatagcttttgtaaattagccaccaaggtagtcaatttacagttgtatttaatagactagtgaacagaagggttttgagagtgggaatgattacaatgctgttgcataaattggagctttaggaaagcactgaaggaaatggtgtccagttaatcattaagatattcttcacgtgcatatgaagaataatttgggaaaacttgacattcagataagactgaatataattgggttaaactgcaataatacatacatgttctctattttcttgctattatcataatgtacttttaaggaagaggcagatattgtaactgaaaatcatggatacagtaaagccatttcagttctttgttacagttgtttcctatgagaagaacatgagaaatgatcttatagtattgacagaaaaggagtgttgacagctgactgttgcaaagcctccagtgtaattattccacctcccctacggccagggatcagtgtttttcatatgacccatacttctgaaaataatgaatttcaaaatgtctgttccatgtacacagttgttgacatacacaaatatttagctatctagttctagaatccccttggtgtttcatccatctgaaactgagaaaagagagcagagtcagtaacagataagccctcgttgctgttttatttatgtatttgtttatttatttatttatttatttctgtactgctgcatctagggatgccttccactggatgcctctgtgtcaactgcagctctttcaggcaatactatgagacaagattaactgaatttcaaatgtatgagactccactcacagaaagggtgttctattcatactgaatctttctataaaaatgcaaaagttggatctggagaacagaaaaaggaagagagctgcattcacagtaggataaggagattaaataggaagagttatgtgatttatctcttttatgaggtgctgctggaaagcagattaagctttttaaaaagtggtgaccttgatataaatttcatatttagccagtgctgatggattttgaataatgaagggtatgtgcaacaacactgagcctgagaagatgcaagaaatgtagtgaagttgaccataatctgagtgctaatacatcactgcaaacaacagtaacaggaataatacctattgtgtagcagtttgcccattacaaaatacattcacaccaggatgctatttacttctcacaataactctatgagattaagtatccttagaatttgatgatctggtgctgaagttcaagaaagatgttacttgttcatagtcacacaacttgcaaataaattcctctccctgtgaaaatattctcttcttatattcattgtcacattcggataaagattggacccacttgtattttatttctaacacttttaatcatacctctaacataactctatggtattacattctgacaactgaaatgtaaagtgttttatttctgcattgtctctgttgacatgaatccttaatataatgtcatattctgagcatgtttatgtttataaaaaaatacaaatcattaggccattttctttttccaaaaatgaccggttattgccgagtaaagttactaggttgctggtattcaagccattcgttattttaatgaataataggtaattcagattaatggatttccattctagcaagaaatctctaaaaattacatggacttgaactgatattaaaattgtatataaaggaatggaaaggaaaccaactgtgaaatgtgtccaaatcatatagaataaaaaagttcccttccccaaaaacctaactctgcttttaaattctactaattcacagtgtaattctgctctttccttttttcctgtttttggctttagatacataaataagaggctttaatcatagaaaggaagctggaaaagtaccttaacttattacatttaccatgtttgaacactgttatttgtaatatttgcaaatgtacaactatataatttgtttatctttttcttttacctcatgggagacttctaggaatttatatataatgtggattaaacacttagactatttgttccctaagctactgtattggccaggacctagtcagttaaagcaaattcattccagatagttcagtagaagaaacttaacatgggaaacaggatatcaatatgctagaagagctgaaatgacccagaggttagcaacattaggaaaccactaccacccctatatatgaagggacaaagagaagaaggaagtcatgttaccagaacccagaaactgaaaggatagatcccctcttgtaaaaattcatcaccaatgccatttgtgaggagaaactgggaaattgagaaactacgtatgggataaagtggtaaacaaggcagataagactccctcatgcatgactcttacaatgttatggaggagaaaatatataccaatataaagaaagaagacaaagaaaagatcagttagtgataactgagaggataactataaatataaaactgagtgtatgaaaaaattatgagatttattcttgtggattatttttgcattaatttaatttttgaatattgcattgaaatattatctatcttaactagtgagtttatggcaccccctcattcaactcatgctagttccattggggtaagcccatgatgtttcaaaggactttcagctattttgcttgagcaattcggtggatggtgtagtatatgtcacaaataaatgaagcaactttttaagatttcaaaaaggcataataaatagacatttgaatatataaatctagaattcagagctggagatacaaataaaggagacacaacatagaaatggaatttagagtgagagggttaaatgagattacatagagggcaatgaaatgagataatgcattaagtctttttgaaatgatggcttaaatgaaatataattcatatatcatataattcacccatttaaagtgtaccattctaattttttttaactgtggtaaaataccacacaattgaccctttgaatcatttttaagtataaaactagtggcagtaattacattcagagtgttgtgcaaccatcaccactatctatttccgaaattttccatcatccaaaatagaaattatttacccatgggcgcagtggctcaagcctgtaatcccagcacattgggaggccgcagtgggtggatcacctgaggtcgggagttcaagaccagcctgaccaacatggagaaagcccgtctctactaaaaatacaaaattagccgggcatggtggcacatgcctgtaatcccagctgctcagaaggctgaggcaggagaatcgcttgaacctgggaggcggaggttgcggtgagccgagattgtgccattgcactccagcctgggcaacagagcgagactccgtctcaataaaaaaaaaagaaaaagaaattctttacccatgaaacactaactttccattccttcctcccaccagctcctggtaacctctactctactttctgtgtctatgaatttacttatcctagggacctcgaataagtttaatcatacaatatttatccttttgtgactgactgatttcacttagcctaatgttctcaggtttcatccatgttgtatcgtgtatcagaatgtcattgctttttaagtctgaataacattcctattgtatgcatataccacactttttaatcttttcatttgttgatggacatttgaattgtttccaccttttgggtgttgctgctatgaatattggtgtacaaatatctgtttgagtcccttttttcaattattttgtgtgaatacctaggagaggtgttgttggatattctatatttaacattttgaggaactgcgaaactgttttctacagtgactgcaccaatttacattctaccagtaatacacaagggttctaatttctccactccttgccaatacttgttgtccaacccccaacacactttttaaaaattttttttaattattgtcttttgagacggagtctcactctgtttctcaggctggagtacagtagcacgatctcagctcactgcaacctccgcctcctgggttcaagcaattctctgcctcagcctcctgagtagctgggattacaggcgcccaccaccaaacctggttaatttttgtatttttagtagagacggggatttcaccgtcttggccaggctggtcttgaactcctgacctcgtgatccacctgccttggcctcccaaagtgctgggattacagatgtgagccaccgttcctggcctacactttttattttttgataatacccatcccagtgtttgaggtggtattgaaaggtaaagctttctatacaatatttcttccttccccagtttgcctctcaataggatataaactccataaaatcaagtactctgtttattcactgctttatccccagccaggccacgcatatagccattgctcaatacatgtgttgtattgactgagtgaatgattttttttttttttttttgagacagggtctcattctttcaccaggctggagggcagtggtgtgatcttgtctcactgcaacctctgcttccaaggctcaggtgatcctcccacctcagcctccccagtatctgggactacaggcacacaccaccacgtctggctaatttttctattttttgtagaagtggagttttgccatgttgcccaggctggtcttgaactcctgggctcaagtgatctgccaacctgagcctcccaaagtgctgggattagaggcatgagccaccctgcccagccgtgaatgaattttaaatgctcagtaagtgagagttgtattcaattctttaataaataatatcatatatttagtcttatattacattgcatcgccattgctgggcttagtgttttctttttgttttattttgttcttatgaaacaacatcctttttgaattggaaatttaaggaaagatatgctgcatatacatagaatgaaattatttcaaaccatgacaggggaagaggagatgaacacgggatgaaagagttgaaaaatatgaaattaggaagtggtgaagaaagtcaagtaaaatctcatgtcctgccttcaaattagagcatcaagcaggtgctatgaacatgtaatttgagggaagtgcctgtgattctcttcttcagggagcacttctggtttgcgttttcattttctctagaccttttatagatgaagaatatcttgtttttccagatgcagatagtctgttatgttctgtctgtgtctgcagagtatggacccatttctaaatgtgctgagttcaaagatgtcactttttatacgaaactctgatcatgagttttggtaaatattatgaccaccttagaaaaagctgcctttgtaaagcttggagaacaaaaagtgatgtgcaacttacccaaatgtgactcacacatttatcttccctatcccttgtctttcacatcgagaatgtcaactatggttagaagaaggcctgttgtgtgtaggatgaaataagaagatcatcaggtgattgtgtgtagcttttcagtgcagagtatctttacaactctatgtcaattttttgccgggcatggaagacacatctgtttgccgtatatgctatcaaggaatatgtgttatttatagctgggcgcagtggctcatgcctgtaattccagcactttgggaggccaaggtgggtggatcatttgaggtcaggagtttgagaccagcctggccaacagggtgaaaccccgcctctactaaatatacaaaaaccagccaggcgtggtggcaggtgcctgtagtcccagctacttgggaggctgaggcacgataattccttgaacgtaggaggtgaagtttgcagtgagccgaaatcatgccgctgcactccaggctgggcgaaagagcaagactctgtctgaaaaaaaaaaaagaaaaaaagaaatatgcgttatttcaaaaccccagaaaatgaaagatggcaaaaaagtagtatggttgagtttaggtgggagttgtttagaaaggttaagccaaaaaaaaaaaaaaaaaaaaaagcaatcagaactttgtagctattagctaatagttcattcatttattcatgtaatatattgagagtacctcctaaatgcctggtactgtactaggcacttaaggagatcattaggcctttgaagtctttagcctcaacaggtcatcagtgaacaaattcctgtaatgaattaccatccatgtgtcaacagaaactgaaatgttcagaaaaggagaaagagtttaagagattaaaaaaaatatatatatattcctggtccctcaaaaagttaaaccatatgacccagcaattcaaattctagatatataccgaaaagaattaaaagcagggacttaaatatttgttcatgcatgttcatagcagcattattcacaatagctaaaatgtgaaaacaaacccaaatgtccaataagcttatgattggatacatggaatgtgatatatcatacaatgggctaatgttcagccaaaagaaaggaatgaagtactgatgcatactacagcgtggatgaaccttgaaaacattatgctaagtaaaagaagccagatacaaaaggctacatttatatgatgacatttatatgaaatatccagaataagcagatccatagagacagaaagcagatgggtggtttccagttattgtagggagagaggaaagaagaataattgctaatgggtactagcttttctagtcttagaactagatagaggtgatcattccaaatcattatcaatgtattaaatgccacttaattataaactttaaaatagttaatggttcattttatgttgtgtgaattttacctcagttaaaaaaatgtgtgtctaagaattcaaacagcatacagcttacttctttattttacatattatgagaagcatacatattaatagtggatgtagcaaaatgaggataaatactgtaattaaaaattgtgattgttggccaggtgcggtggctcacatctgtaattccagcactttgggaggccgaggcaggtggatcacgaggtcaggagatcaagaccagcctggctaacacggtgaaaccccatctctactaaaaatacaaaaaattagccgggcgtggtggcgggcgcctatagtcccagctacttgggaggctgaggcaggagaatctcctgaacctgggaggtggaggtagcagtgagccgagattgcgccactgcactccagcctgggcaatagagcgagactccatctcaaaaaaaaaaaaaaaaaaaggttaaaacggataaagatcaaagaaatcagccataggccctgaagaaattatatgtaatgtatgtaatcttgaacccatgtcctgggcctcagtttccctcagtgacatggtttttacttcttctccctcttatcttttcccttactcttggaatctacagaggtgaagtttgaaagtgttcatgtccaagaataactcagacagagaaatactggactagaattgtatatgcctaggccttctcaattctagtattccaggaataataggttagaaaaataaaaataggaaaattatattgatcactttctactaaaaaagagaagacaattatcttgaatttacagttagcaaaagactgtaggtggagttcaattcaccagttcaacaaaatgtttaaaaaagaatttcaaatgagaaggcagtaaactggcatttttaggttttaagcatctgctcaatggtctcattctaatcttttcaccaagggctgatttcaaccagggttaaatcaataggccctccagagctcttctgaaaagaaaaactaatccaaacaaatctctcatttagtattagtagctacaaacatactgtgtttaagaaagataagatataagagagggacacatgcatagcttcaggcattaccataaagactgacagaacaataaaaaaggaagaaaatggaaggctttaagattagaaataaactttcaaagtatatttaaggtttaacaaactctaagatgctctttccacaatctaaccttgacactttttgattcctaacactttatgtttacaactaatgattagacacgatggtcaaatttctggttgagaagctgccttccagacagttcacttctgcttgagtctgtagtaactgaaccttcagatctgctgccactctgtgctggttttcagtgccaaaggcttatgacacttgaaaaatattatgtgccttcattcttacaaaaaggaaagctcatgacttgaaaaatgaccagtgaatgttagagtagaccatataaaacacagaggcatagaacaacttaatccttttaaaaagttaatcaaatccctggctttcttacacactacttcatgaagtaggaaaagattgccaaacattatgaaaatggtatttcccttagggacttgaggattagcagaatatacaggtcatgtgtttagtgatcctattagaggatacattttacaatcatgtcactggtaattctgctagagtaagagagagataccaaacactacacattatcgtacatagggcatgtgattacagaataattaaaactgtgctacattaaggtatcacataaatggtttttaatatcctttgtcagtgaatcagtgatatacaaaatttccctttccacacatattttccttttttaccttctgcctgcactacccaaatttctgcactttgatctatagttatgcaatgtagtcatccttttaaaaatgaattttaaaatctctgatagcggccaggcacagtggctcatgcctgtaatcccagcactttgggaggctgaggcaggtagatcaactgagatcaggagtttgagaccagcctgaccaacatggtgaaaccctgtctctacaaaaaatacaaaaattagcctggcgtggtagcatgtgcctgtaatctcagctattccggaggctgaggctggagaatcgcttgaacccgggaggtggaggtttcagtgagctgagattgcaccattgcactccagcctgggcaacaagagcgaaattccatctcaaaaaaaaaaaaaaatctctgatagctcccatgcatatcaactctgaattgtcttctatttcaaagtacaacagtactgagaaacctgtggaggagttcagggtgctgctgtactgacttctggaaactgtatggaagtaattattttgaatttatttttgtgtcatatatcgattacttgtgttcaaaaatatttgggaattcccaatattttcactgaatcagattttttttttcttctttgtaaggcgggactcaaagccagtgcttcagaagtaaatgcttttatatagtagaaaaatatgaagaaaacatagtatttcaggtcatttgctcccttatatcacttatcagattttggggactttaaggacctaaattttcaaaaaaatcaagttagatcatggatttttttgaaaacttgggtcattaaagtcctgaagaaaatttgaaaatttaagtccttaacgtccagaagacgtttattttagactgtaaagtaaagtaaaaccaagggttaagggtaggtaactttcttttgttttaaacaatggtatgtctatatctatatctattatcatctataggtatatagcgtctatgtgtgctaacccagcaccaattgcctcccctagcttatagaagagaccagtgaattagaagtaggagatgtgagttctaaccccatttctaccactaattagataatagaattcgaaaaactcattgacttctttcagcattgggtccctttgctgtaacatgaagacattgaaagaagtaactttatgttagttgtttctccaatatgttgtgtgtgtacctggtgtggacctcacggtcacccttgccagagacaactagattttttttttaagtctatactaatattctttcctcactagaaaggatagtggggtgtttactctcagttgtaaataactctgttttctctgcctgtatgcatgtcctgtctctctagccattttataaatactgaaaccagtaatcatgatttaagtttttgtgtagactgcagctcatctgttataaacaataaaagctgagtaaatatgtgctaatggttttaccataagtcctgtaggagcattctctttaccccatttaccccattccacgttatttccctgacagcagagaaccatagcagttatgtcgcgagtttgatgatggtggaatgtactctttgctttgagagtgtgtaaattcccctcaggggtgtcatatgtttattaatgtgtcacaagttgcttgcttcctgttagctcttctcagtaaataggactatagcattcgttggatactactttatttttagctttttaaatcacctcctgatgaacagaaacagtaaacaagtattaaacatcgaaagtaatttgaaaatagtgccatcctggagagtctggagttccagacattaccagacactcatctcacagagctgaaggagaagttaggaaaataagaatacctaagtgatgctcctctggagccactttctgaagattaggggacatttgtatttaaagaagagaaagaggtgatggctgtggtagggagtccatatttaattcaactttagtcattcttattcaacccactcatatatttcaaatgaaaagtataaggacttatctggatttttaagcttcacactaattagacaccaaagaactgaaggcctcatcatggtagtattttctaatttgttaaacaaacactgtgcgactgtactgcaaaatggaagtataaagaaactgggaatgaaggaggcggtgccgataataagatctaacgcttactgagtgttctaagctctttatgagttttattgtattcgtttcccacagcagcctatggagtctttggtattactttcaccttatcctaataaggaaatgaaagccaaaggagccaagtaactttccctagttttctgttttttgagatggagtctcgctctgtcgcccaggcttgcagtctcgcgatctcggctcactgcaagctccgcctcccgggttcacgccattctcgtgcctcagcctctcgagtagctgggactacaggcgcccgccaccacgcccggctaatttcttgtattttcagtggagacggggtttccccatgttagccaggatggtctcgatctcctgacctcgtgatccgcccgcctcggcctcccaaagtgctgggattacaggcttgagccaccgcgccctgccaactttccctagttctcaaaaataatgagtgattgagcttgaatgagtgattgagattgaacccatgaggttgggctttggagtcttgctcttcacttgaccctgcctctctctctctctctctgtatatgaatgtctcgtattccatacaaagagatatagtacaacagacaaacaaaagtaatcaatagtttgaggagaaaggaaacctaagactcttgtgtctaaacgatttatgtggaagtttcaaaattatgatgcacagatttactttccttaaaaggcctttctgtttttgtttttgtttttttttttaattctgtgttctacaaatctgtatccttccaaaacctaagcattttctgaaagcatatttgaatgtgccctaaaatagttaataggttaatgtagataatttttttctgaaaaaataatcttataatgagcctagaaagagcatgctccagtcagccctggagtaaaattaataaataatgcatgagcagtattgctggcaaacccaaagagggatatctttttcacttgggtgtgaagctcaagctaaaacttaacacactcttttctctcaaagctgtttctttttcagtgttttttatgctgaaagattgactctacctttcatatactcaactgagaaaaattcttgatcatcttggatgcctctctctttcctttgcttcctcactgttacattgattcagtgtcttaagtatattttgaacatgatccctcttttctgtcccaatgtgtattgctttcattggggctgccatttgtttctgagtgaatgcagttgctttctaatttgcctcattgcatttattcttccttacagtcaaatccatttttctcattataatcagaaaaacctttctaagatccaaatttcatcattccttaacataaagtttaaactctttgaagtggcttatgtgactttcagtcttgcttctgtgcatttgtccagtctcaagtcctttatactccagtcactccacattatttgcaattacttaaacacagtaagttgttttatgccttccaggctttgtgcaaaccgttacctcagataacccttcttaaaattgccaaattcttattcagtctctaagatagttcaggtatcatcatttatggagccttcttgtttctttctttgataccactgtggtagttcatatctctttgtagtaattatcatattgaatttcagctgtttatttgcctatctctttccctggattgtgagggcctgaggacagggaatatgccttattctagcaaaattcctgaacacacacgctcaggacttttttcaagcttctgattacctttgtttaatggctaattatttcacctattaagtatctttcatctaattgtaggctaggtattataggaagctagagatgtctacattcaataaagaaccatctaattttgtggaaatattctttgttaccagatataaagcctaataacctacctatctattttctggacattctcactgtgtcatattagcattcaacaaaagcaagaatctaaataagggagctgcttaaatgtcaaagcattagctgaataaggaggaggacttaagagatgttgtgcatgtgtacagacacaaagaggaaccagcagtatcacggagcacctatgacaggccaagcagatttctatccagtatcctttttaatgctcagacaagtgctggctctcccatgagtcccacctgagactcaaaggagttaaataaattgcccagttttgtagagatggtaagcagtgagactcaaatacaggaatttgatggccatgtacatgaataagcagttgggcacttatttaccaaatgggaagttctaaagcaaactttgaattcaatattttattcctctctttcttctcattagccagcaccatgcctgacacatgatcagtgttcattgaatgtcctgagacttaaaaagcaagtagaagtagtgcaatttacccaaaaaacttcatttggtctcaacccttccaaaagatctctgcacaggatttatagcctcacttattccaagttataaacttgatttatgtaccaggaagaaaaaagagatgcttatttaatgacccaattctgtagaatctgtctatcaggatggggttgttcttatgtaacacagtagaatgcttagctctgacaacctggactctaggttccaacccaagtagatatgggtcgataaagatagtaactttgcaatacttttatccaagaatgtgttctgcccagactcagtaactactcgtcttagcaagacaaccaatagtgtaacttttatccaagaatgtgttctgcccagactcagtaactactcgtcttagcaagacaaccaatagtgtaagagtatgcagcattattcctgaacctcactgtgattaataggccagttacacttttctacttctattgaatttgccaattttagcataagcccaggcttgactttattctggacctaaatcttcctttattttttttctaggtacaaaatatctattaaacattttaaaacttaacctgaatgtaaaacaaaactttttctctggcaaataaaaacaaataaatatacatttagcttcacaagagcaagtattgtttagctgggtagcaagagagaaccctgtggaataagtcaagataccataaaattagttaaacagtgaagtttttgcttttcttttaagtgaattaaatacactgccttggcagcacttgctttttgttcacaccaggtcactgtatttattctgctttgttacagaaactccacttactgtatgaaagtatccatctcactgacagtgggtgaaaatgacactggactctgctataattccaagatgaagtattttgaaaaagctgaacttagcaaaagcaaggaaatttcatgccgtgacatagaggattttctactgccaaccagagaacctgaaatcctttggtacaaggtatggactgcgggtggttctatttcctattaacaaattaattgtgccttatattctgggacaaattggatagaaaacttagatgggtgtgatatagtttagctttgcctttctagaataatatagcaagttgtactggtcattatatgttttttaaccaatggctttagtaaattctagtcaatgtttgtattggtaatccactgtaataagctgttgtgtttatgtttatattttatttccatggacaattctttcaagtctactatggtctgggttgataatttcaggaactaaattaccttgaaccttcttttcagggttcttcacattagcatttcaaagtgtccccaaacaaaaggaaaaaggactgatttttttccaggataaaatcgtatactagtttttcatggaatgttctgtttaatggacataattttgtccatattctaatctttttcatgtataaacataaacattttaaagaaataacatctgaggaaattgtatgacaccagaaatataatattgaagtaactttcttccaaaaccagttgaaactttaaacttaaacagaataatccaacctctgactttcctatcaccatcattgatgtttatttactgatattccagatttgaacataattttaagcttgtttatacaataaaagaaatttttgttattgaatgtactcaaaaaataaagtatagatgctgtgaacattcttccagaatattttatacatagtttaaagaatccttatgtaacatttgctttgtctaactcactggaagtgggactttagaaactgggcctctttgtaactagatccacaaatgtcagtatacagaatgtgagccctcatgacagactgaagatgaattcaaaaactgttagaaataaaacaagaaacaaacctttaacaattttaaaaaagatttttccaaaacagcaatgctctttcctaagtaagacttacttttgattcttgataatgtgaaattgtgggttcagaacatcaagggaactgttggaagatttttatacttgtcccttgcttgattttcaatcctagaccatgttaaatggagctcaaatattagtcctgctggtttctgttactgtgggaatgaattttctttttctctttttttaattgttggagtatttcttatccttaaccaccctcacatctcaaaccaccctgtggtttgtctgacttccacaggcagattctgaggcaagccctgatgattgcttcaagggggagtggtattaggggaatttgacccaaagtctccaaataaacccttttttttcttagtactcatgtgtgacatcagcttctaaatatgcagtgtctttgttgttcactaataagtttattttaagagttgtgtttcttttctcaccttttgcaaagagcatcttaaaatttgctgaaagatgagagactacacacacacagtgtaaaaagtggctggtcctttagtcctatttccaacattgccacaataattttgaccttaagctatgcagactagtgaagtggtgggtggggatgcagtatatgtggtatttaaaagtcataacatttcagattatttttccatagtcaaagattagcccctgtagtctaaatagcagagatttaagggctacttctatagtggaatactataaaataatcaatctggctaaatgtagatgtcacacattcagtggaaaatttatgcaattaccacaagtcatgcaactaatatggcatatacagtgtatattttggtcagaaataacacgaaaattgcccccaattacacaaaggcattgagccacataaaataatgttctgcaaaaatttgatttggcaatacaattttttagaaacaatattacccctgaagaatgtcaaatgttttaaagctattttatcctcgttccattgatttcaaatctggctagaggaaattgacttctgttttggcaaaaacagaaatctcctgagccaacatcattattattcaaagcttaattcagagaccataatttgctaagtctattaacaatgaaaacagatatttatggaactctaaagaccttgcatataaatgttgattgtttcatggattatagcatgcatacactatgaagagatttaatttttactaaatgcaaaactaaaatgtttcaaatattgaaatagaatttaggtgcaatcattgaacggtgcaatcttttgtacagcaaattttctgctttccagtaaaataatatggtttgtattttatgttatcaatttcaatatggttgatttcacaataatgaaatgtgaaatatctgtttccaaaatgatgtcacggatagtcttagcatacatctctattcttatatctaataaatcagtacatatctggtttagatatactaatcttagaagttaattgacttttccaaaaaaataatcttcagattgaagtattcattggttcaaaaatgtataatgaccagtgcaacttgccatattattctaggaagcaaattgattccccagagattttgagaagaaatgaaattatttagcattagtttcaaactttttagtccctttaaaatgcaattttagaagcttttgttttagttatttaaaactgttctatatttttccattactatatgtactaccaaaattgtatgttcttcatataggaatgcaggacaaaaacatggaggccaagtattgtattcaaaagagatactctgcttataagagaagtcagagaagatgacattggaaattatacctgtgaattaaaatatggaggctttgttgtgagaagaactactgaattaactgttacaggtaatcacagtcttcaatatttcacttgcaagtgatgaaactactattttaagttagtttttatgctacacattgatatttttactctctaaagaattacataatcaaatgctaagtggattcctataggtgaaatttattcctccttgcttttgaatcatcttccactgaagtccattcaaaaggctagagacaatatgtttagggagttatagaaatgttaacttttgggccgggcaccgtggctcatgcctgtaatcccagcactttgggaggccaaggtgggcgaatcacgaggtcaggggttcaggaccagcctggccaacatggtgaaaccctgtgtctactaaaaatacaaaaattagccaggcgtggtggtgggcgcctgtaatcccagctactcgggaggctgaggcaggagaatcactcgaacccacgaggcagaggttgcagtgagctgagatcgtgccattgcactccagcctgggggacaagagcaagacgaagtctcagaaaaaaaaaaaaaaagaaatgttagcttttgaaagtacttgaaataaaaatgagtttatggtttccaaaaattatgcttatattttataatggtatcgtttttggaaacatttcctagagtggctaaatagaatatatgaaatctacctctgtcttcctgtcttgctccaaattagaaaagtcgcttttctcttttatttatttatcactctatcaatctgacatacatgtcctcatgaacttgaaaatagcataacttcaggtgcagtcattgaataattatgtgagatgtgatgcatagagtcattttcatagctggttgctaaggtggaaggacatgaggacaagattcagaacactacctgtaatcatgaatctacaactcactagtcacataggttggtggagttaccacagccttcagcatattagtttcttcatgtataaaatggtgttgataaaatttgctgttcttatttcatagggtttttgcaaggatcaaatgaagtaaggtaatatgtatgacataaatttgcaaaatgcagaattatatccaaatgtgcataatttttgtccatgaaaattgcattcatacattttttttctttatagtgcatttcttacaaggtggtttcatgagaaaagtggggataataagaacaacattcagaaattaaaaatattattctcatattcttattgagagattcttcttggtgacttttgtgtatgatcatacttgtaaaacttatatagaaaagcataaaaaggacattagctgttttaaattaaacagagttttatttgttcactggtccacttaaaattagttttccctgtatatgaaaagtgttttgtggtagtcacctacatcttataataatttatttcttttaaggtatctggctatacttgagtttctatacaatcaattttgaaatttgtttttcatctgttacttaattttttcctttaatctctactgaagtggtttttcaaccagtagtattgaggcaaaggaatttaaaaatataaagtaaagcaatctatcctgaatagaaaatagaatgcacttctagtctttattcttcagagtggagaactcatctttagtaagcacctctttcccctttctagaaatgctaggattctaaaccagtacctagtatgagacagttggagcacagtatcatggatactgaacactgggctctgaatggtaaaacagcttgtgtaagactattttatagaaccaaaaatagaactctttatatcctaaatgctttccagggcaaccgtactttcctaaacttcatttgtcccaaaatatcttgttttctttatataaaaacaaagagtaattgagtcttgatattcaagaggaagataaagttttaatgaaagttttcattccacttattatcataaatacttatatgtagccttacctgagacaatgatttgggcaaataaattatgaaacagtttgactggatgtgaaattttgggttaatgtagagctacatgccctagaattaagaacagtatatactaaaatgcattttaggtattaacaacaagtctactgggaagatatatttatgtataacattgttttaaatggtgtgacactatagcgcatttactgtggggccaaattaaagagcagttcttaaaacccaaattatattcctcagttaaagcaacaaacatgggcagtatctgaatgataaggaatcactgttttttatcttggttttctgcacatcattatcatattttacttaatgaaaatattatggaaaacataatattatttggttttagtggaatttgaagtttgttataatgtcactttaaaaaaaaaaaaaagaggaatcctatacgtaaaaaggaaatttctggccgaaggaagtggctaaatgtgcaggcagcatcgtgagcttttatgggtgatcgatccttcccttattgaaaatgtatatccttagctaagtgaagtactggttcaacaaaacagatcacagtgaaaggaattataaacctgtccagcacttttggtattttaaacatctttttttttttctttgggaaacagtttctctcttgttgcccaggctagagtgcagtggtgcaatcttggctcactgcaacctctgcctcccaggttcaagagattctcctgcctcagcctcccgagtagctgggattataggcccgtgccaccatgcccagctaatttttgtatttttagtagagaccgggtttaaccatgttggccaggctggtgtcaaactcctgaaacattctcaatttttttcttttaaattaaagatgttacggcaccatctctagcctctatcttttattagccttacccacattgaagttcttactccaaatgtcctccctctgaactcttattcatggttttctccctctggaaggttttttatcttctcctttgtcacatccctgattctcaccctttcttcaaggcacagctaaaatgttatccccttgttgaggcacgtactccatgcatccacagcacttttagcatctctattgcagcacttacctcattgcatcaaactatttaatgacactcctgtattttcataagaatgtgagcaacttagagtcaagggcaatgtcttttattttttaaataagcatttgattttagaacggttttagatttacagaaaaaacatagtagaaatcccatctagcctgcattcagttccccctgttattcacatctaatattaatatggtatattcgttatagttaatgaactgattttggcacattattattaaataaagtccgtagtttatttagatttctgtgctttttacctgatgtccttgtttctgttccaggatcccatctagaatagcacataacatttagttgttatgtctccttaagatactcttggttgtgactgttttacatttttttttatttttgatgacctttacaattttgaggagtattttgtcgaatgtcctatatttgggatttttctgagattttttcatgattaggtgagggttataggtccttggaagaaaaaacacagaggtaaaatcacaacatgtcatatcagcctgacttatcactgttgatgttgatcttgatcacctgaggtagtgttaggtaggtttttccactgtaaagttactctcttccccatttttatactgtagtttttgtcatccatgctatatgtcatccatgctaaaggagtgagaggttatgttccacctctctgagagcagaatgtccacatattttgtgtggtattctgctacatgagatatatgtctgttctcccacatttatctacttattcaattgttgctctataccagtttggacttaacagttattttatactttgctttataatccaaattaccttatttattttgttgctcaaattattacagttttggtcattaagagctcttttagttggctcctttgtccctgtgacatacttatattggggtgtgtgtgtgtgtgtgtgtatgtatgtttgagtactttcctactttctggccctttaagatgctctaagctcatcttgtatatttcctgccccagtccctacatcagatatattttttcaaagatgccatgttgcttttattggagaattataccaaaaatgaataccttcatgttgagagtactcattgctactgggatatagttgttttgaagcttttctaatcgacaaaaaaagaaaaatgtgtatagtaacacataaacatatacacatatctatagatatttatatgtgtaaccacctgtgtttatattaagttaaacatgagttcatactgatgtttccaactctaatttattaccatatggatcattttagcctcttcccctaccttatgtgtaacctcccaatccagtagttagaaaactggttctcaccatctgccattcttttactgaattgttcacttccagtataaatgtatagtgagatcagaatttgttaacctgtgcccatgtgggaaacaactttatcaattagaatatggtgtttacgtacaattgttttagcatttagccttacagacttcactcatttccaaagttgctaaggtcagcacctttcccctcacctgcttcagtgaggttatctcacatatttgtaatatagttagattgttttatcatattctgtatttcccaggatcctctgacctcctgaattatatttaaaatttgcatacattaaggttttctctttgtgctgtgaagttctatgagtttaaacaaatgcatagtgtcatgtattcataattaaaaagtaacagaatagtttcactgccctaaaaaagactctacacttcatatgttcagcccttctttctgccttccgaatccctggaaacaactgatctttttaccataactatagttttgctttttccagaatgtcatataattgaaatcatacagtttttggccttttcagactggcttctttcacttagcaatatgcatttccttcactcctttctgccttccttccttttaattgagcattttatctcttccatttttacatcaattttccttctttttagatatatattttagtgatagccctggatattccaattttaaactaatctcagtccaccttcaaaaaacgctgtgtagtacagataccttattacagagtactcccagttcctctctcctatcctttatgacattgttctcattcatttcacttacccatattgtataatcacccaatatattgttactgttattttaaacaaagttatcttttacatcaatttagaataagagaaataaaatattttattttaccttcatttattccttctctggcactcttctttatgtagatccaagtttctattccatacacttttcttctgcctgaaaaacttcctttggcatttcttgcaatgaaggtccagtggtgatgatgtcccttagttttcatttatcagagaatgcctttatttatttttcccctttgaaaaagaattttgctggatatagaatttttttgtttgtttgtttgttttgttttgttttgagacggagtcttgctctgtcgcccagggtggagtgcagtggcatgatctcggctcactgcaacctctgcttcctgggttcaagtaattctcctgcctcaccctcccgagtagctggaattacagacacgtgccaccatgcccagctaatttttgtattcttagtagagacggggtttcaccatgttggccaggatggtcttgatatcctgaccttgtgatccgcccacctcagcctcccaaagtgctgggattacaggcgtgagctaccgcgcccagtctggatgtagaatttttgattggtacttttttcgttttgtcactttcaatatgccactccactcttttattgcttgcatggtttttgatgagatgttcactctgatacttatctctgtgcctgtatagatatgatattttctctgtgttctttatttatttatttattttttttgagacagagtctcgctctgtcgcccaggctggagtgcagtggcgggatctcggctcactgcaagctccgcctcccgggttcacgccattctcctgcctcagcctcccaagtagctgggactacaggtgcccgccactaggcccagctaattttttgtatttttagtagagacggggtttcaccgttttagccgggatggtctcgatctcctgacctcgtgatccacccgcctcggcctcccaaagtgctggaattacaggcgtgagccaccacgcccaggctctgtgttctttcaagattgtctgtgttttttttttctctgtagattgaatatggtatgcctaggtatagtgattttgttatttatcctactcagtgttttatcagcttcctggatttctggtttgatgtctctcaattttgaaaattccatgaccattattatttcagatatttactctgctccattctttttttttctacttttgatattccgattatacatatattatgccttttgaaattatctctcagttcttggatgttcttttctgtttttatcattcatttttctctttgcatgtcagttgataaagttctactgatctattttcaagctcacacattgtttcctgaactggtgtccagtgtactgatgagaccatcaaagggcttcttcatttctgttacaatgtttgttttttaaaaactctagcatttcctggctgggcacagtggctcacgcctataatcccagcactttgggaggccgaggtgggcggatcacaaggtcaggagatcaagaccatcctggctaacatggtggaaccctgtctctactaaaaatacaaaaaattagccgggcgtggtggtgggcgcctgtagtcccagctactcgggaggctgaggcaggagaatggcgtgaacctgggaggcagagcttgtagtgagccgaaatcgcgacactgcactccagactgggcgacagagcgagactctgtctcaaaaaaaaaaaagcaaatctagcatttcctttcgattctttttaacattgcaatctctcttcttatattacccatctgtgggtatcgtggaggaataataccctccatacagatctcacactctacttttattaatatttaggttggtgcaaacataattgcggtttttgccataactttgcgggtttttgccctggaaagtaaaggcaaaagccgcaattacatttgcacgagtctaatactaccgagttttacataaaccttttcatttcctacattatattgctgatttgtattgagatttaagtcaaataacatcagttttcttatattgttaagtcaaatgcctgcctgtggttgaacttttaggtatgaatacagtgctgagtattcctatagagatgattatgttcatttttaatacgtcatcccagtgtatgaagataggttttatacttgattctgtcttacactataataacttctcttccttgacaaaagtcattacgttttttgttggaagatatgtctgttttgaatggaaacattgtttaaaatgttatatttaaaaggctctgtataaagctgtgtaatatgcttttatattttttctggaatgtattatttcacctctctttagtgagagatttttatcctaataagaaatacagaatccagtacatatttttacttatttcttttaataataacatatataaccaaaaagtgtataaaatgtaaacaagtagctgcttagcatgctatcaaaagaactcaactaggcaaagaaatagaatactgtaggccccatagaagcccccatatgcccttctgattataaaccccttcctctccactactggataggtacctcagtatgtgagttttggggtatttattttcttgcgtgtttaaaagttgtattagctgatagtgtatgacaaagcgatatagctacattttgcctggttttgaaacgtataaattaggacccacatgttgtgtattctgtctggcttcttcaactccaaattttgtttcaaatatgcatgtatgttattccattcatctgtactttattcattattcttatgctatgatattccattatatgaaaatctcagtttgttgatagacattagggcttgttgtaattttttgcttatgtaagtaatattgccattaaccgtcttatgtacacacatatatacacacaaacacttacatatttccttgaacatataagcaagcaattctgtaggatttttacctaggaaaggatttgctcattaaaagtatgtatattttcaaatttactaactattgtttgggctaatttgggtcatgggcgtatcctaaccgaattgactgtagggaggagagaagtactccaaagaaagttggaggtgccaaaataagtggaaattattctaaggaacataaaaagccattttctactacttctacacattatgatttcttaaagattataaaatataatttgatatgcataaaattctgttttgcattgtgtaacaattttctatacttccatattgttaaataaaaatgtgaaaacattcaactttgtattgatatacattgccatatcctaggattccttgcactaaactctaactcacatccagactacactataaccctagtcttctgccagatatatgtgggaatgtgggtatggggaaaacgtcatatccagaggtggtccataagcaatctagtgattccaaaataaattaaatcaccttggctcatcataaataccaactatgtagacaaaaaatacaaatattagtaatgatacatatttttggatttgttaggtctaaggaaaaaaatatacactatataggatttttttagatgtattgattacattacatgattttcatttttgcccatttaatgcttatttccccttctggccaaaacatttttctattattttaaaaagaaagatttaaaacaaagtaacaactgtattgccatcataaagtttggaaatgagtcagaccagttgcaacaccatttaatttctagggtcagatcatagaattaagtaatggtaagggaataccttgttaaaatgttatgtcagaaaaaattttcccaagtaaatttgagagtcagcaagcagagtgaggaagtgaagaaaggaaaactgattcgaaaagaagcaaaaagaatgaggtgattgttacaaggatgtgatagttttagtagcatttttatcctttatataactttttaacagttaatacagcagaatattcaaactacttcccaatcgaccacagactgaatttacgctctcaaaaggtacatcttcctcctcttttaatggatgaggaagctgaggcaaagaaaggttaagtggctttatcaaggtcacaaaacgtcacagtgacaaatttagaaataaaatttaattccctgaacctcagtctatgatttactccactggataattaatagcaaggcattgtagtgttcatattagctctgctgatcgctatgagagatttatattttaagtgcaacggaaacacatttaactgagacctctaattcttctgccatggatgtaattaagcagtgtatttgtggtctagcctggggatggagtattgcttctttttcttcctatttctttcaaaaaattgcgtattttatttctcctttaaaaaaactgtttttgttaaattacttcatggattaaagtgtgctttcactgactacagcctaacaataattgatgaaattgataaaaggggcagatctttccagactttactttgtatgtttgctaacattccaggatccatacccacaaaaaccatcatgtatattatttttgatgaattgacatatactacatttctagctgttttataagtaaatatctgccatatttttgtaactcaaatatcatttagattaattcacacttttgaattaaaagagaaaaatgctcataaatatggtgaaactgaatttaatcaacttggctatctaatgttgatttggagttgaattcctaaaacaaaagagctctttcatgagtggtttccaataactgtcctgaaaccactgacactcattacctttatttattatttaatcttaatatactaaatgggttgttcaaaaatgtatgaatcaaattaacatttattgttaaggtgtagtaagtttgaataaaaacaagatgtttttactcttgagcagaaaacgtatacattttagaacatattcatagcaaggttggaatgtgccatctctggccatggggaaaacaagacatcataaacttgaatgatttccattaatacaagaaaaattaaatattaataattagaatagttaacacctactgagtgttcaccgtgtgccaggatctgttctaaattctttttttttttttttttttgagatggagtttcactcttgttgcccaggctggagtacaatggcacgatatcggctcaccacaacctccgcctcccaggttcaagcgattctcctgcctcagcctccccagtagctgggattataggcatgtgccaccacgcccggctaattttttatttttagtagagacgggttttctccatgttgatcaggctggtctcgaactcccaacctcaggtgatccacccgcctcggcctcccaaagtgctgggattacaggcgtgagccactgtgcccggcctgttctaaattcttccacataacctcaacttactcacccttaaaaatttttccagtgctcgccaggtgcagtggctcacgtctgtaatcccaggactttgggaggctgaggtgggcagatcacaagatcaagagatcgagaccatcctggccaatgtggtgaaaccccgtctctaccaaaaatacaaaaattagctgggtgtggtggtgcgtgcctgtagtcccagctgctcaggaggctgaggcaggagaatcgcttgaaactgggagatggaggttgcagtgagccgagatcacaccactgcactctagcctgggcaacagagcaagactctgtgtcaaaaaaaaaaaaaaattccagtgcttgccaagtacctaatattcttctaggtttcataaattgcacttgaaaataattcactattttatttcccacttcatatggatttttgaatttaataaaagatgaacatccatttctggaaaatgcagtcaattagacctccatttgctgctctgaaacactgagaaaaattagatgaaataaaatagaaataccattttaaatgattagttgagcttgcaagaatgttcttttttaaaaaaagaaaaatctctgggtctaatttttatttagcagtattgaagtacaaaaaagttacataattcaaatcataattttatgaatatcaaatcacattttataatctttaagaaatcatgaagtttagaagtaatagacatctgctgtttatatttcctagaatatgtttcacttcttttgacacctcccattttctttggagtaccactcctctctttccttcagtccttttggttggtagactcttggtcaaaaaaatctccaatttgctgctcaagaagaattgaccagtctccaggaagggccttaacagggtcctcctggttcaagacagcatttaaaaaataaaaagagaccaggctcagtggttcacacctgtaatactggtgctttgggaggctgaagcaggaggattacttgaggccaagagtttgagaccagcctgtgctatatagtcagacattgaatctatccatacatacatacatacctatctgtattatatctctaaaaatgtcaggtactagaatccataaatacagactagaaattagctatgcctaaaatgatgggtcacatttttaaaaatctaaaacaataccagtatttttgatgcctgtgtgagagcataaatattaagaaaggcaattggtcagcaggactttctgccccagtcatatatgcattttgatttcattcaattttctggctgccctattgctgttgttgcctgacatagttcatcagccagaagtagttcttaattttttcactgattttctttgacagcattgaatttcaagtgtactgagagtgttttcattataataaccctgccagtgtaatccaacggattgcttgcctcttagaaatgatacagtcatcctttctgtccgtcccaggtgttagagctgtattacttctagattttcagaccactagctaaacttattcttacctcattgttaaagaaacaactacttttttttttttttttactgctaaccatatggcaggtactgtacacaattatttataggcattactatctatatttatcaaggagaaaagtcaaagtacattttggacacatatttaaacttttaaatacaaatcattatcattatttctaatgaaattcccttctttatttgcactctactgcttcaaattttcaaattctcttatattaattctaacaaactcaattttgagagtcaaaaagctgttcaataaatatcccttgatagaattattggtttatggctgggcatggtggctcacacctgtaatcccagaactttgggaggccgaagtgggtgaatcatctgagatcaggagttcaagaccagcctggccaacatggcaaaaccctgtctctactaaaaatacaaaagttagccaggcgtggtggtccgcgcctgtagtcccagctactcaggaggctgaggcaggagaattgcttgaactcaggaggcagaagttgcagtgagccgagatcaaaccactgtgcttcagcctgggcaacagaacaagactccatcaaaaaaaaagaaaaaaaaaattcttgttttagttagttagagaaaaaaaatatcaacaactgggctgtccaatataatagccacaagcaccatgtgtccactgagcaactgaaatttggctagactggattgagatattttaaatgtaaaatatgtgctaaatatttcaaatgtaaaatatgtgctggattttaaagacttagtttgacaaaaataatgcaaaatatctctttagtaatttttttatattgatatcatgttgaagtgataatatttagttaaataagatatactacaaaattgattttacctcttttcacttttttaaatgtagctgctagaaaatttttaattgtatatgtagttcggcttatatttctgttgcacagagctactcttgaaagtgaagtgtggtatcagcctggagaagtgtaagggaaacacacaagaccaagcatctaagggttgtcttagttccattggtggagctgccatgcctgggctcagtgaccttaactaagttatctgtcttcattaaatgttgtcttagtgttgagactgtgaatagtcatcactcacagtgctttggtgaggggtaaattagcgcagatgcatcaaaccggactgtgaaggaatatacaaatggaagtggctactgccatgatttggtttgatttttgaatctttaccttggtgatatggtttggctatgtcctcacccaaatttcatcttaaattgtagctcccataattcccacatcttgtgggagggaccccgttagaggtaattgagtcatgggggcgggtctttgccatgctgttctggtgatagtgagtaagtctcacgagatctgataggtttagaaaaagggagttcccctgcacacgctctcttgcctgctgccatgtaaggcaccgctttgctcttccttcatcttctgccatgatttcccagccatgtggaactgtgagtccattaaaccgctttcctttataaattacccagtctcaggtatttattagcagcgtgagaacagactaatacacgtggtttgtttcagttaatgtaattttaatatttataatcttttttttattattatactttaagttttagggtacatgtgcacaacgtgcaggtttgttacatatgtatacatgtgccatgttggtgtgctgcacccattaactcgtcatttaacattaggtatatctcctaatgctatccctcccccctacccccaccccacaacaggccccggtgtgtgatgttccccttcctgtgtccatgtgttctcgttgttcagttcccacctatgagtgagaacatgcggtgtttggttttttgtccttgtgatagtttgctgagaatgatggtttccagcttcatccatgtccctataatatttataatattaatctattccgtcaaatgtcactgattatcatcaatacaattattgactaacattcattgaccattaagtaatggtttatatgtgtggagaaaattcagaatatcttatttgtgtgcaagctactaacaaatgaatttcaatgtctttaactggggtaaataatgaatatgtgcatttctacctttgatatgattatatatatttatatgtatacaaatgcatacatacgtatgtatgtgtatatatatgtgtgtgtgtgcccctatattaatatatgtcttattgactattacagtcacttatttgcatctaagaaatcaggggaacatttttctatacttttttttgcaataatattattttctattttacaaaactgatttattttttgtggttaacattccaaagacccatttgatcatgattcctctcatatgaggtacctagaataggcaaattcatagagacagaaaatagagtagagattattaaaggttggggaacaggggaatgggaagttattgttcagtagttagcagagattcagtttgggatgataaaaaaaagttcaagagatggataaaggtgatggtagcacaacattttgaatgtatttaatgccatttaattgtacacttaaaattagttaaaatggtaacttttatcttatatatcttaccacacaaaaaaagattcatttgaaaataaatggctgttcttaatagtttggagcatatttttaaaattatttgccaagtgtggtggcttgcccctgtaaacccatcactttgggaggctgagacgagaggaccacttgagcccaggagtttaagaccagcctgggcaacatggggaaaccctatctctacaaaaaaatacaaagaattagctgggcatggtggtgcatgtctgtagttcctgctactcaggaggctgaggtgggagaatcgcctgagcccaagaggtccaggctatggtaatgagactctcactcaaaaaagaaaaatatcatatcaaagatttttttttaaagatcatcttttctctacttcatgttggctctctactttgacaggtattgatttttctgtaaaacttttgaagctcaaaccattatgtcggcactttatattaactgcttttagttttgacatcagcaaaattgactgaaaactcaatattgcacctgtttcaatacagagtctctggtgtggaaagattagcaagataagctaaagaaacttctattgttcaactttatcttctcagtctcatcaaatcaaagattgaaaatgtactctaggaggatgtatttctggtgaggttagatgactacacatctaaaagtaaaagttttaagagtaaaatataacataataaggatctagaatcttgaagaaagattccaacatattttatgacaattaagtctctaggtaccattaataaagatgactgtaacctcagagctaaaagcatttagttcattattccatgcaaactcgttaaaatatgaagactaaacttagcatctagtgtcaccactaaaaactgtttaaaacttatgtgatattgagtgagatacatttctttatggtttaataagtgaattagatgtctcagtgtgatgatgcctatatctacatgcacgtgaatgtgtgtatacatagatctatataatatatatctataaatatgtattttcattggatagagaattattaaccattttgtttttttttttcttttttgagacagagtctcgctctgttgcccaggctggagtgcagtggtgcaatctcggctcactgcaacctctgcctcccgggttcaagtgattctcctgcctcagcctcccaagtagctgggattacaggcgcgtgccaccacgcccggctaattttttgtatttttagtagaggtggggtttcaccgttttagtcaggacggtcttgaactcctgacgttgtgatccacccactttggcctcccaaagtgctgggattacaggcgtgaaccaccgcgcccagccattaaaccaattttatatatacagctcttatagttttaattttatttttgccacttagtggcaagaaatttgttacttggtataaataaaaccaagttgatttgtttaagcagtaggttcccattagacttaatgatgttgtatcatcccattattaatttgaataaatttctattatgttatttttcaaaatgaacaacagtgcatagaatcaacaattgagtcactgcaatagcagtataaccatgctactccttcaatatgggagtttttgttaacaaactaaactctgacagcttaatgtatgcaagattaagaaaaaaaataaaaccacaagctaatttcttattatactcactttgtgtattatacttaatggggtctcagatttgtttttcttctttcctagacaccagattaccaggaacagtgagaacttaggtagaaatgtggataatggtacactaataactagaggtttacaaaataggaaaggttaaaggaactgagaatattactattatttggattttaaaaaactctgggctgggcgcattggctcactcacgactgtaatcctagcactttgggaggccgaggcaggcagatcacctgagatcaggagttcgagacatggtgacaccttgtttctactaaaaatacaaaaattagctgggtgtggtggcacacacctgtagtcccagctactcgggaagccgaggcatgagaatcacttgaacttgggggggcagaggttgcagtgagccaaaatcgcgccactgcactccagcctgggcgacagagttagactccgtctcaaaacaaacaaacaaacaaacaacaacgaaaacctcaatgatgtgccataataagatgttaagtactggaagtgttcagaataatggaagagcagcaaagggtgactacattaaaaatccagcaggtaatgagtttcatgaggatttacaaattgttttttaaaaaatattgattaaatttattgctctgtgattttagcatttaaggatagttcctggaaaaaacaaacaaacaaaaaacactgctcaataatagggaagacttttggtgctgtattctttggaggttttaaaaatatgacagaaacccatttgaggcatgttcaggcatagacaaattggaggaaggtcactgagactctagtaatttttttattatgttaaaatttttatggttcatttttcctaatattttgtagtttaaaaaatagggagcaatttaaaaaatcaaaacattaggttttgatatgacagtttaataattacataaaggaatttaaaataatgaatgctatttttaaactgttcaaactattttaaagagcttctattactcttacactatgaaaaggtccactaattatatcccagggttagttttcccttgcctttatcacaatattgaaggctctttcttgatgataaaaccaagaggtaactcttaacttgcaattgatgtagatattttgtaacatatatttagaagaatttctaaaaactatttttgagaaaactgcatgaaaatggagttggtttttttcatgtcaaaatatataacttttgcatcataagagatttaatgttttcatttcttaaaatgcttgaccaagtcttttagtcattatattagcatctcttgttccatctggaggacctaaaaatccaatgaactgtaaatgggcagttcaatatgaatatgcaaattaaagacattatgaattctatgtaagatgtaaagaagtagcttactctgtgccttaattagaagaccttactgtatatttctttatcatttgttgggttgatcatcgggttccactccaacatatccaccaggaattctggtatataaatggcatcaaagattgtttacaaatatcgtggacaatgtctcaagtgataattgcaatatgtttctcagggaagaaaaaaatacaacttttgtgaatattatttttaaaacagaaatgctgtatatagtcactactgtcttctgatggtaatgatagaaattttggaacctttaatgagtacttattgttaaagttccattagataattatgttctgtttacatactgccatcatttgaagaacatatttgctttattcaccaaatcttgaagcatactctacacatgaatttaaatgctactatttctattacccaccctcagagtcttctaatttctaatatttacttaaatattttggttttcaaaattttacctatgattataaagcacacactgagcttttattttaaaattgaggcttgtgctgtcaatttaaggatgagagaagcacagagaaacgtgttctttttaaaaaagtaatatatatatatatatatatatatatatatatatatttttttttttttttttgagatggagtcttgctctgtcgcccaggctggagtgcagtggcatgatctcggctcactgcaacctctgcctcccaggtttcaagcgattcttctgcttcagcctcctgagtagctgggattacaggcccacgccaccacgccccactaatttttgtatttttttagtagagatggggtttcaccatgttggtcaggctggactcaaactcctgacctcctgatctgcccacctcagcctcccaaagtgctgggattacaggcgtgagccactgcgcccggccaaaaaaataaaatatattttaaacctttaaaagcaaacttggttatcaatgtatcatgtttctgtgtatcaacttttataagtccactactcaaaatgtaacctgaaaacagaatttttccaattagatattgttgctatggcgtaattgagctagttaatgatataactctttcagaataataagtcaataatagttatcagcaccaaacatgaaggaagtgaagtagaagatatatgaaaaataaccattaatattaaaacaatatattatgggggcagcaaataggtagtaagctatttactattcattagttggttatgacattgctaaaattaaattaaaacaaaaggtgaatacaaatacaatgaagtagtttggatgatgttttccatttggggtatataatcagatcattttatgttaatctaatttgtctttgagttaaataaacccaatagtgttgacctgccttttcatgtgtcattttttcaacattgtcgtttgataaacatttagtaagaaataaaattacactcagagcaataattttatactttcgcaagctatttataaaatctaattgtataaatgaatgtgttctttaaagatctgtatttgttgtttatgatgaagttaagaagttatagctacttctggtgctgttcaaaatgaagattggaaataatacagtgaagtagatctttaacccagatagtttgagatgcactcttctggatggcggatgaaggactgaaacaaaggccaggcagttagtttgcagaaaagaaatatgtaggaagtaagacaaaataattaattacatatacgtaatgacatatacttcttctcattcaaataatctctagtcattaattccaggaaaattactcagataatttttttttttttgagccagagtttcgctcttatcacccaggctggagtgcaatggcatgatctcggctcactgcaacctctgcctcccaggttcaagtgattctccagtctcagcctcccaagtagctgggattacaggtgcccaccaccaggcctggctgatttttgtatttttagtagagatggcgtttcaccatgttggccaagctggtcttgaactcctgacctcaggtgattcacctgcctcggcctcccaaaatgctgggattacaggcatgagccaccgtgcccggcctactcagataatttttaaaatgtgtgctttttttgtttgttcataacattcagagttctagagcataattacagagtatttcaacaatgctcagttagtagtggttaaatcttccacttcagtgcagctgttgctctgtcatgtaaacataccaaatgtaccttcaataggagtttaagattttttttatatgtatttctgtactttggaaatagtttctagtgggtgggtgtggcagaggagactcttgttggttagtatagagctgttgctgtggagcagctgctcagccagaaattcaatttcccagcccctcttgcttctaggtggaaccatgtgactagttcttatcaatgagtataagggaaggaatgtcatttctgagccaatgtaatgacgaagtagatatgctttttccctgtctttctttctccatcaattactggatgcagacaatggcaaggttttaacagatggaaggtgcccaggtctctaaatcacataatggggggaatttggtcactgaccagaaagactgtcattgaatgacttcaggagtgaaaaatgagtctcagttaaattaaatcactgaaatggtgaggtttacttgaatggcagaaagccttaccctaaatagcagtgttaggcaagttttaccaatgcaaagtcatttgaataaaagagaaatttattgtaaagtcacaaatggtctagaactgaaactgctaagctacacagctgccactttcctgtttgaatgcttctttctacacggtttctccatctgctatgcacttaccagatctctgaatgttcagtctatacatttttcaacagccaaatcaaaaacccatctcttctggtcaaccttcagtcctctctcctagatctggacagtcccattttccttagtggtcagtttgctttttgacacttttttctttcccctccacagtgatttggccaattggatatattcctactctttcacactagcctgtaaggccctcgagccacgactttgtcttcagcattatttagcatagagagaaaagatgattaataagtacttttgaaatgtttaataagcaaaagctgagttgggaatgtattttagaaatatatgctattgtagatagctaaatgtgattttagtctttatcacaaacttcttagtaattatttgagagctttcagcatatttataaaaataatttaaaatataactattttacttgaaagtctttgtatattcattgttcttgaattagtaggtaataatcctaatgagccataacaactgttctctcttcaaaataattctgatgatagggttttcttcttaagtcagcacaaaatttattctttatatagggtcaattgaagtgtttttaaaagcatgcacagctctggtaattcattcataaaacacaggaaaatgttttaaagtcaaaagcttcaaaaagattcacaatgtgaaaaacataaattagaacattaaggaaacttgtgttgtaggactttttccttagttcagctagaaaccaggttcttgtcacatgaccaggaaagattaggttcctagacacagtagaagggtgggaaaaatggaatttattgggcaaaaaggaaaaaggaaaaacaacacagcaaagtgagatggggtcctgctaaggggctctccacctcaccaaacgaatcccagggttaccaccccagaacaggagaggccaggctcctccccgctgcaaagggcatgaacttccctcatctccacactcccacacatacccccacccctgttctcccagtttgcaggccagttgtaggttctccaagaacccctttctcctttattacttggctgtctcacttagaagactgatgctagcaaaaaacatacacaggaaaaataagagagtaacagaaaaaaaaatctggcaaagaaggcagaagggaaagagactaagccataagagagagagagaaaaaaaaaatctctggtctgggaagggcatattttctaagcattagtgtgtaagatggagaagcaactcattaagctgtcctttaatgtagtattatccataatagtacaatatgagaaacaactcaaattccccaaaaatgatacagaatggattttataaatcacgtaagccagtgccatagaaaagagtctgaattcgagtggtgtgacttcagttatagtcctgtttgcagcctggtacaggacttaggcaaatattttaattcttacttgtatgtttgggaggcaaggtaaagacttcgccttcaccctctgaagataccctgaaaaatcaactcacagaaagcagattaattggaaaaaagacatatacatttattaacgtgtgcatgaggagaaccagggtggttacccatcttgccagtggagttcagaagcttatatgccatcctggtcaaacaggttatgggagtggagagaagaggaattttggtgagggacaataaaggatccttagggagaacagaacccatctgggagcagagattaattaagttgtaaatagttctctttggaatttgaatgagcctgagagacaggttagtcttccacagaggggaagaaacaacagttatcctttttggtgagtttggactttagacatataaaagaacttcaaagaacagcttcctcctggcttgagagagtcatttgcgggcggggagagggagggaatcagagaggctatgagactgctttttcagttcagcatgttaaagtgccatatttggggtatcggtttttgaaccccatcataggctacagaaccctacagttcctttcaaggctgaaagtttctaatacagtaaagtgtttaaaagtttacactattctgattttagcagatttcccaaatggtatatctcttcatagtgttaggtaaggcagaaagctattctttaaagagcaaatctctgaaagctaatgatgcctgggttgcaatctaaatgatatttttttctttttctaaaatgccaagggcaagttgacttttagagttaatttctttcatttatataaaatggtaatgagagttaaattatatttaggcacctggtacattacctagcctgtaataaactctctgtaaatgctagtttcctccctctgttgcattaaaacaactacaagatgaaaaacctatgtaaaccaaaaataaaagtctaagccccacaaccaacagaatggacccctcctttcggccaagagcattataaaggaaacctgaaatattagttcaggccttgatgaaatggatggttggatatgcctcattatactttcctccctttgatatttaggctaaccagcattagcattaaaacagagacctgaagactgacagaactagactctttaagcctgataagaaacatttacaactgattccctctaaagcctgctacctggaggcttcatctgcataataagaatttgggtctctataatcccttatcttaacccagacattccttctattgattccaagtcttagataaattctttccaccaattgctaatcacagaatctttgaatccacctactacctggaagcacccccacaacacacacacaatggcttcaagttgtcctgcctttctggaccaaaccaaagtacattttccatttatcgatttatgtcttttgtctccctaaaacgtataaagccaagctgtagcccaaccaccttgggcatgtattgtcaggatgtcctgaggttgtgtcatggacatgtcctcaaccttggcaaaagaaacttctaaattgattgagacttgtctcagatactttttggtttacaactgaaaacaatataggttagcgatacatctattctggtgtcaacgccagaatagtttgtcacagtcaaattttattactgtgattcaaaccatggtaaaattataacttaaattttataagatagataaaaacaattcaattaatattccctggttagtttcagtcataatgattatataagttgggtattctcaattacatgagcatctctttaaggcagatgagaatttgatgatgttaatcatgatgatgattactagcatttattgaatgtctactatatgcaccactctaagcaccttgcatatactatctaatttaaactggctcatagatgacatactagtttagagtgtactatttgttgactgcattttaccctgtacttcaatttgatagacagtgtagatgtactaaattcattcttcattccctttacaaaaattgactgagttcttattgatgtgctgtcctggacagtgtgaaaaatcaaaggatgaatcaggcagagacctcttcgagcagatattattgagcagaagaggtaaattatgcacacaatagggtgcaagatgaaaagtggtatgagatgaatgatcataaagggtggtgggaattctgagatgatcatgaaaagtttcctgcccaagtggaatttgaatttgtccttgaaagagagtgaaatctggactgggaatgtcaaattaaaaataaaaatccagactttgtaaggtggggagactattgcaattgggaagctactctaactataagatctacaagcctttcaaagttaggcaaaaggatttttctttcatagggaagagtaaacaaggctggaaagaaaaaaaaaaaaagcagatgtagggaagtgggatgaaaaggagtggcaagatgtgacagtggaccccagaatatttaatcctaaagccagtatagtctctggaagggggctattaagagggattgtatgttgcctcaggctaaggtggtgcaaagctcagggatctagaggaaggacagaatgttaaccgtctttctttaagaagcattatattctgattgatcacttggggcaaaacagttcataattatctatgaggcaaagagtgggaattttgagtctttttgtatggccctgtcataggcaagccaggggaacaactgtgaagcagggtggttctgtgcagtaagccatttcccaaaacacaaaaggatgtggggatttattaaacttcactgttttccaagatcattggtcttgggtaaagttcaacattgtcttgggtatgggaggaaaactcagttaggacttcttaaagaaagagatattcatgggaaggtttcgtttagctgggatgttgacattatgaaggaacgcactaataaatggtgatggttaccctttttgaactgccagttccttttctaaagttaaaaactatcagttcatttaatcttcacagtcatctgatgatacagttacaattatcctccccattttacagacaaagaatctgaatccctcagagtttaagtcacttgatgatactcctagtaagaagtacaacagggactccaacttatgaagccactgtaagcctgacagagccattttagcctcttttcatgacttcagactttccctttataccaaagggaatggaataaaactgcttggacaagagcaagaagacatgcatccatttttcacattccaaaataatggactccaacacatacacataagagaagcagctggacatagaagaacttagaaaaacagaaagtccaagtttggatatggtgcacaagaaacaacagcagccaatggagcttgacaaagcagagtggcgataacaggaaaggttctgagggcagggaacaaaacaatggagctagtcaagacagaagggcccactgtttgtctgctttctgttttttttgagaatgaggatggggtggagattagggttaaatttaacactgttatctttgtaggcccaggtttctctggttcatatctctgtcaatgagactatcacaggtctgtgaagtttttgggggatttggaaaatgcctgctggattagcttttttaaaaaaaagtattattattattttgagacagggtctggttctgtcgcccaggctggagtgcagtggcatgattacggctcactgctacctccgcctcctgggctcaagcaatccgcccacctcagcatcccaagtagctgggactacagttgcacaccaccacaatcagctattttttttttgtagagacagggttttaccatgttgcccaggctaatctcgaactcctgggctcaagtgatccactcgcctcagcctcccaaagtactgggattataggcatgaaccaccgtgcctggcctggattagcttttaagagcaaccctgagctaccctgaagacatctcaactagtacagtttagccctccagagttgaggacagttgctgaatccaacacacattcaactctccttcccttttccctttgccagatacatttgcatttacttctataaatcacagctatcattgtttttcctaataattatcttatgattcaatacactcagtccagtgagcccaggaatacatagtacatggttctaaattttattgaaaatatttataactttgaaatgtaaataattgaactaaattcatcttctataaatcatattttgggaagaaaccctgattgctctaaccaacagagatgttattagaaatgtaatataataataaaagcaattaacctttactgaggccatcctgtgtccctgaactgatggtaggcactttcacatcctttttcatcctcccaggaacctattagtagaagatatggtttctattttacaaacgaaccaattacagttctgagaagttaatctctttgaccaagcagttgtactttaggccttgagccaagttttgaactcagacctctctgactttaaaagtcctctaagccattctacttggaatcaattactcacattttcaagactactcaagggcagctgtgctacctaatacgtgtaatgttgggaacaatatttaactacccgttgacttagtttcttcatctgaaatgtaaaggcaatcagaacttccttagaggattattgtgaagattaaataaattaatacatgtaaactattttaaaggtatacagagctactattttataagtgttagctatgacgattgatgattatgatgacaatgaaatcatactctctttctcaagtgaatagccgtactcaaaatgtcattatgattttgtatgctaaacaaaaactacagaaaattaggagtattagtttgctcttaattaaatttacatgtaagtttcttttaatcataaatttggaaatctcttttgtgcctcccattatacttcttagtctctaaaataaaatttgcattttatttgagaccacagaatggcagttttgataattggattttaaaaacctttttaaaaaaaaaaaaaaaagatttgcatattatttccctggtataaggaatctggatcaccaaaatattaagaacattttctattatttctcatttgtgtggaacatgggggtgttaacattgtcttgacttatttgccccgtatggttgttaggttccagggagcttcagctgagcttaagtgttcctgtctgaaatatctgagtcaaggtgtatgaaccagagatcaaacaaatcagtaaagaagtaacaggcataagactgaagtaaaaaaacaaagatggttccctatcactactaagtatggacagcccagaggtgtgacaaaccctattggttcttcttgcctactgcacagtaaagccaatacactgagacagcagtgttgcagtagaggatgagtttaattctcacaaagcagctgagctgaaggatagtatgcatttctcaaatcgacctccacaagaactcagaaactagggtttttaatgataatttgatggacagggagctagggagtaggtgctactgattggctgggaatcaaaccatagggatgttgaaactgtctttgtgcactgagtcagtttctggtttgaggtcatcacaggaccagtcaagtcagttccttggtatgggtcccaggttcaggtggcatcagtttgtctgccaggatgcaaaaatgtctgaaaattatatccaagaccagtcttgggaagcaactggagaagttataaatcttgtgacctctggccacttgactcctgagcagtaagtaattatagaaaacaagcttgggaccaagggtaggttattgtttaactatgcttgcatcttagcagaattcatgctcctcccataagtctaagcttgtggcctttcattagctttacaaaggtggtttcagtctgaacaaggaggggaagggactgttatcatccttgctttaaatttaaactgtaaactaaattcctcccgtagttatctgggcctacatccaggaatgagcaagggcagttagcttgtgagtttagaagcacaatggagtcacctatgttagatttatttcactgtaataatttcacaaaggcagtttcagtcacaagtatttaagagcagagacaaccacccaggaattcaaatctagattgaagtacaagctgttttaaagcctgcaaggttggtgtgtgtctggatgacaatggcagtgctcatttacctcaacaaaggctttcaacagccatagaagttggtgacaaatttatactctagtaagtatgtggtttacagataaggcaggctgagtttaaaggtttgcagtagggattgcaccggatagtgtgaaaattgtattgaaactgatattaaatatcttaaatataaagcattaaatgacattaatctagatgttccgctatgacttttatactgttatggctttcatctgttgctgccttgaagttgaggagaaaagagcaagcagtggcctctttgtgaggtccatgccgactggaactatcatcacacaaattactactaatatttgctttgttaaaaaaaaactttaggaacaaaaaaaaaatgagtaaaaactttctaagactatgtaaagactatactgacttttttgtattcctgaaacaagaagaactaagatacaaattattcaatcctagacctgaagaaattgtgtcccatggacaaagatgaaggcatttttctgctgccacctgcttcacaccattctctgccctctgaaaccagatgcttaaaagcaatcagtgactcactccacattacccaaaggataaattcccaaatccttagttggtttaccaaaccgtcaatcagtagcccccactcataccccttaccatcatctgtctccatttaccttattacactttaacttcccaaaattgaactttctttagtgtatattgaggaatattctctctgccaagaccactatccaaccacaccatatacattcacttgattaactccaatgtattctttgattctaatttataactccaaggcgaactcttcccttaaccctcaaattaagtgactccccctttgtcctttcataatgtcagggcacatttgtttcaaacacttttatagtgatacctttaaagaaatgtttccaaaacttcagtacacacaggaattatctggagatcttgttaaaatgcagattctgattcagagtgatgccagtgctgctccctgtccccatactacagagtaagtagcagtctgtctgttccactagacctgagagtaggatcctcaaagccccacttatattaggccccgaattaacagctactggaggaatttaagaaaacaatacacaattggcaacacaatttagttttggaatacaagtggtacttacaaatagccatttgagaaaaaccttgttaacttccttccctccttctgtagcttggtatttccaccttttctttccttctctttgcctcagtcttcactcctaaatggaagtggtctctcagttccctccttaatcacggattcttttcatgcccagtagtcaacccttgagatattttcagtggtagcacttcagaaaatgaaaagcaaagggagccaggatagagacatgaagaaaaataaactcctattctcttcctcagtaatcagtgagttactttttctttctccagatctcacctctctggccccatcagactatttattaaagaatcacaagtacatctctagactcctcttcagtgttgcattgctcagaaattcgttgtgtaggtggtgctcagaaatagaaatgaacctcatatcagtcattcatttacataaagacttgtcatatatataattatagtgtatatatatgtgtgtgtgtgtggtgtgtgtgtgtgtgtgtgtgtgtgtgtgtgtatttttttttttaaatagtgatgtggtcttgctctgttgcccaggctgctctgctcttggacttctggcctcaagcagtcctccctcctcagcctcccaaagtgctgggattatagacatgagccactgcatacagtcaagaattgtcttttaacatctaagtagagacttaatcttgttttatgtctctctctgtctgtctctctctctctcccccaacgtgtagtcattttattccaaaggtttgtagttgcatggactataaaaatggaaaaataaaaataacacaaacttcctggggtccccttactacccatatccccataccttgtctcacctacgacaggtaaacagaatcttggagagcaagtgctgtggagtagtcactgcatccaaggtagagagtggtaaaaatgtttcatcgaaaaataatttttctatgaaatggacaggcctcttctccattaggtttaactgtgtttctgactgtgtataggagaaaatgggtcctcagatttccaccacagggtggttctactattagtacatacaaatctttgttaggctttctgtttctttattgttcaaaggcacaatataaggaatagggctagtctgtatttcagtgtaaaatatatgacactttatatatgtgtatatatatatatgtgtgtgtgtgtgtgtgtgtgtatgtgtatgttatgtatataaggttgatttggtctgtatctacataaattacatgatagatatataaatgtgtgtgtgtatatatgtaaataagtctaatgtatacttataatctatatatttgtatttcgtgtgtgtatatgtatatataaacctatattttcatttcttgtaataaaataattaaaataattaacatgaaaaagagatcagaagagaaactcttggtaaatgtataggtttgtctattaataagatgttagatgtgctatagatgtcatagtaaagataacatcccccaaataccaaggagaatagaatgattatactagggtgcgaattctagcaaattaaaataaatatctgcgtgatccatgtttgtaactatctgacagactgtttgctgttaataacttttctggaagccacaaacacagcagtagcactcaattatgatgcggtctacaatataacacaatgcagtttttctgctgccttcaagattacataggcagcagagcctaccataatgaactgtcccgaaaactcaaagtgctgtttgcagcaattttgcatgtgagtattcagattttacagtgtatgaagtctgacttgaatgtgctctacctcagtaattctcatttcaaaatattcacattaaaaacattcacatcttccttttttgattgaagaccatgctaataaaaaagcacatagaatattgcaaataaatagtcatagtgagctaagaactacatggaacactgagattcttcaaggtatgctaatgactttttgtttagtagatttcttgtgctgcagtacgcatgttaataagtatttcatcctcacacaaggtgcttggtgatgaacacactagcccagaattatcagcatacatttattcgattatccgcttgtaatcaagaaaatatattattccttttctcttgatattttggttcatattatctaagtatatgtctaaagcgttaataatattataattcacaaatgtaatgcttaaataggagaaaatattttaaagattctcaaaacctctgtaattttttttcccattaccaacatcattccctttttgctactacatttatcctaattagaaaaagtagcagagggtttgaaagaagaaaaaagaaaaggaaaagtgaagtcttcctaataagaaatattatgttaagtactaccacagcaaattatcattagtgggaattagaaggagcccccttaaatgtgtatataatgctatttttaaaggcttaaaatattttatttcaagttttaacagtatcctatgttactctttaaacattttagaaacttttacaactcagtttgtttcatattaaataagaacttagctgatctcttttggactcactgtggaacattgcattaattgttagccataggacaacaataaaaaaataattttagtaaaccacataacttaggtgactcatgaatgaaagcggtttacagatgtgcttattgaccagaaagccttaatgttcccctcagcttgactaactttagatagatcctttcatgattattggcctccgacctccctttgcttagagcattcactttagaaaatatggaatggtcaattctttctctgcccctttaaggtgtaaatcttctttcagtctcttgccagttttacaccccagaaatgtctttcccaaagatctgggagctagccctttgaaatgtaatcatcaagcaagatagtacccctacctctcaggctctttgggacagtaggagcctaactttgatagataagtgacaatctgcacatatggcctcatctctttgagcaactctccctacacaaagtcctctagtacttttccactagctcaccccaatacttaaaaattatcccaccttttgtactagtggaattgagttctgtctgtgtcacctattgcaagtctttaataaaatctttcttgcctgtttaactctgccttgtgcaatttttctatgacattatttagactccaagtttactgtgcagagtaaaggaatagataagtggagagattttttaaaagggtttaaatgaatgttctaagatatagcaatgactcatttacctgccatcacttgccttacccttttaaaccataatacttctccttctacttttatcattcatgatggaaatattcctaaaatgtagtagcaagccttctgtttctttctcaaaatgaagatttgtttctcaaattgaaagtagttttttgtgtgtgtttaaacaaaaatgtacatgtggaaaataagacactgcaaatcacagattaaagcagtgtttctcaaccttttaaaaatcattactgccccgctaaggagcttttttagttattttttcctgcctcatctccccatgagattttaataccatgaatacatggtatgtctgtttatgtactgctgccttttggggtgccataaacccttacagtatctaagatttgtttgctcccacccaagaaccagtttttgcaccattaggataatattgcctctttgaaaatgcatggtttaaagcacaaagtaaaaatcacttaaaatcccgtaccacagaggtgaccactgtttgcctttagacaaacatccttccagagatctttctaaccatattttatgtgcttttaaaatttgtttttgtgctttaataacaatatggaaatgtttccatattaatatagacatcatccctttcaagtatatataatttatttaaccaatttcctgtgacatacattcttccttcgatttttatattttaagtaatactttgatgaatatcatgtcgtatcacatttgtgcatttgatgtgctgtctttagaaataatttttcaaaatgcaatttctggatagagaggcacatacatttaatttgtttttataaaaatttccaaactatcttcccaaaagattttaccaatatacattctttcatatactgcatgagaatgcctgtttacaacatagggtattatcaatttgtttaatctttgccaaacttatagacacaaagtaagtcttcactattgttttaattctttattcttttatccttaatttgataactaattcattgagtttttaagtaagcatattggctatttgcatatttaaagatttccctcatcttgtaactttttgtcatttttttttactttttttctttgtagtccttattaattacattgcctaaaagataataatcatgtacagtaatgaatgcattttacagttgtgcctttgggaactgtatagggctctgtgcctattcatttcacaaattatttttgctttcttctgaactgacttcatataaaaataaagatgatgataactatggatacattaatgcatgtaagctttatagaaaatatttgtatataaaatagatattttatattaattttatgtgtaggtatttttttaaaaaattaaataatttccagtttttatttatcataaataattctcttttatttaaaaagagctctaacattctaatgtattcttttcatactgaaatttataaaccttctcagttcccttctcaatcacttctgctctatagactttgaactgacatatttatttgatttctttcatctttatctcttttgtaaaatgtcattaggctgagaaaaatataatgagtccatgaagagatattttttaaaaaaacagattttatggaaaggtaaaaatcaaggagaaaactcaggagagtgtgaacacatcagattaatatgatcattgctctcgttccagttaggctcattccaaatattttaacgtgctggtcatgtgaagtaatacttcttttcatagttgtcacactgttttttgccatctaatctgctgtccacttctccaaagttatttatgagatttgttattgatacatcttaatactttgcaaatgccaacattttcctaatattttgagtggaataatatatatttgtaaaacaaatgaaggccaataattatgctttagatttggggactttttgttgagaatcatcgatatagtttgatagtatttcattataccttacagagtatacttaaaaatactcatcaattattgttttaatttatagtttaggttcacaaaagcattatttaatccaaatagatttcacataatataaaatacactattttagccattttaaagtgtacaattcagtggattttagtatattcacagtgttgtgcaaccattaccactgtctaattctagaacatttccattactccaaaaataaaccccacacctttgaattctgcctcttctacctcctgccctatttcctggcaatttctgtctgtggatttgcctattctgaatatttcatgtaaacagaattatacaataggtgatcttttgttactagcttatgcaatagcgtatttttaaggttcatacgtactgtagcatttatcagcgctctattccttttcatggttaaataatattccattgtaaggatgtaccacattttgtttagacattcatcacattgatgaacatttctgttatttccactttttggctattatgaataatgctcccatgaacatttgtgtacaagttgataatgtgaacatgttttaaatttacttgggtatatacataggtgtgaaattgctaaatcataaggtaactgtttaacttcctgaggaactgccaaattgtttcccccaacagttggacattttatattcaaatactacaatccgtatgtttgtagtgtttgaagtttccaatttctccacattcttatcagcacttcctgttttctgggttttttgtttgttttattattgttgtagccatcctagtgaatgcgaagtggtacctcattgtggttttgtgccgttgtttttaaactgcttgatttatgaatgcatttgtggttttattaatagaattgctaaggtcaaaattatttaaaccattttcaaacatggtatgtgtcttgtgacatactacaaaaagttggcaatggttctctattacatttacgaaagaaaaaacctgctgatgaagttgaggctctgactgtatgtattaaactttaacctaagtcactattgacagcagagtatttcaacctctgaagacccagcctcactaaatttgcaaaaatagttttttaaaaattgtactaatacatttctatgttaatggaatggtcactttttcttttcaagtctagtatctaaagtactctgaaatggggaaaagatcatgcttttatagaaattttcttgacctgagcttccattaggggaaaaaacataacttccgattgaaaaatatatttacataataccaatatataaaccattctttcagggtaagccaaacacatctaaaaattccattaagtccattggactggcagttattatgttaaatatattttcatgaaacattttgcttccctggaagcaaggcaacaaaaaagataaaactaattaaaatgatatggggaagaaggagaaggaaagtcacagtcatagtatgttttagatttttcttactgatgaataaaaataactcctttgatttggattatattatagtaattttcatcacttttcaaaaatcttgttcaaaattgtttagttttagtaacaaaatgagcctctttctaccattttcttaggaattctgctactgggacattttgcaaaagctgcaaatgcagctttgattttactaagtaccgtgattttgcctgcattttcaagtacctagatagaagttagggcttaaattgtatttgctaaagttttgaggacttctgagaaaaaaatacaaaagaatataaacatcttataataattcccatactcccccgccctttttttttgttcccacttgtgtaggagacataacccaggaggtgatggagaggagcaaaaacctttccttttctttaatcacttgagaaagagagtcaatctaggaatagctaaaattactgggttctgagtgatgaagacttaagctatttgagaatgaaataaaaattttatgaagtgactgaaggcaaagtcaaaaataaagagttcacaaaggagaatatacagagtactctaataggtcctaaaggagattttagaaaagatattactttatcatactgtgttatttaaaattgccttcatgtttgtctatttttataaagtacatgtgtgtgtgttacaattttttggagatttttgctctcaattctttatatcttacgtgacagcaattagtaccatgtaatttgggcagaaattcctccaagcgacaagcagaatatttcacagtgacattttaatacatgtataaatatattaaaatttgtctctacaaatgcaaaattttaaagtaagatcaaataagaaaattatttaatttttattacttcctacataaacagagaatattttatttgtgggactttttataaatgctgagatgcctctccacctccaaatcagagtgttttaaattttataattctattatagattcaatcatttgggtaagtttacaatacatagctgttaataattattactgagactgaggtacatacaaatagtggaaagctaagatagtccaatatatgtgagcctctgttagcacaggacagtcattttatctgcagataaggacagttttatttcttcctttcctagctacgtatattttatttcgttttcttgccttattacacagactagatctttcagtactatgttgaataagagtagtgagaacagacatttttttgtcttattcctgattttagggggaaaacattcagacaatttgctctttcaccattaaatagcatcttagctgtaggttttttatagatgctcattatcacattgaagatgtgtcccctaatccctttatatttattcttctaagaattcttatcatgaatgggtgttacattttatcaaattcttttctgtattaattgataataatcatgtgatttttctttagtctgttaatatggtggattacactaattttcaattattgaaccagccttccatcctaagaataaactccactttgctctggtgtatacttctttcatatatcactcaatatgacttgttaatcttttgttaaagatttttgtgtttctgtcaatgaggggtgtttgacgtcagattaatactagcttcataaaattaattggaaggcattccatcttctcttttggagagaagaggtagtataagattgatgctaattcttctttaaatgtttcatagaattttccagcaaaatcatctggacatggagatttctttttttggagtagtgttttaattatgaattcagttttcttgatggttatagggctattcaaataattaaattcatattgagtgagttgtcacagttcatgattttggagaatagatccattttatctaagttgccaaattacaaagtgtagaattgttcacgttagtccgttattgtgcttttggtgtctacagggtctatagcaatagtgcctgtttcattcttcgtattggtaacttgtgtcttttctctttttgtctttgtcagttttgctagaggtttatcagtgttattgatcttttcaaagaaccagttcattgcttcgttaactttctctattgcttttctattttgaatttcattgatttctgctcttgtctttgttgtttcctctgtgcagtgtgctttgggttcatcgtgctttttcttttttcaggtttttgaggtgggagattagaatagtgactagagatttttcttcttctctaagtaagcatttagtactgtaaaattttctcttagcactgctttggctacatcccataaatgttgatatactgtgttttcattttcattcatttcaatgcattttttacattccttgaaacattttttggcttatagattatttactagtcgtttggtgtccaaatgtttggagattttcctgttatcttttttgttactgatttgtagctttactccattgtggccaaagaaaacactttgtatgatttcaattattttaaatcaattgtggtttgttttatcccctatctaggtatatgatccatgggaacttaaaaagaatgggttttctgatgtctttgagtggatttttctataaataatgaccagatgctgttgatttatgatgttgtacccagtcagtagatttggatctctagatcctgaagaatcttgccatgtacacagttggtgcttatgaagggtttgttaaactgtttggacctgccatagtattaccctttttcctgttaccacatatacctctcctgtggtctgttaaaatttccagaagaaaggcaagcagcttaggcagactacagtgatagtgtggcatcactaacaacccaaagttaaaaagtttgcaatagcagtcatttatttcatggtcaagggtctggagtttggcttggttttaattgatcttgtctgtgcttacctgtgctctactggactatcctggattctaggttttgggttagattcaaatctgttccatatatctaaattttaggattcatactgaaggagcaatagctgtctagatcatgttcttttcatgggaaaggatgtaagcctcaggagagctggcagaaacttggaatatctcttaaaggcacaatgtcacttctacctgtattccattgtccaaagccagtcacagtaaagtccaaagctaatgcgttaaaggtatatactctgcctattccagtaggaaacacttcaaaattgcgtggcaaaaggcatggatgtataagtctattacaatgagggagtgaagaactggaagctattattcaattttcctttgactttcaatctttaggactttctactctacacagggatcaggaaaatgaaaattaactctccacaggaaaactaatgctccacatgaaaatccctatttggattgaaaactataaagaatgtttcccttgacatatagttaagtcttatatattatattttggataatttgaagaaatggttttagtaaattaatgagaaaatgcttcagaatatactttatagtacatcaaaggcaatgtattttcaaatccaggctgtattatttgtttgtttggttttttttttttttttttttggttttgaactatatgtaggcattttgttgacaggactttttgagaatccattgcaagcctgcacagctacgttaaatatatgaatataaaataggactcaaccttatcaatttgacacgtgtgtgtgtgtgtgtgtgtgtgtgtgtgtgtgtgaatgtggtaaaacatctgcatttgtcatcaatttttggaaatattcgaaagacttttgtgaatcaaaaacctataaattatttggtatttcagatagagatcatggaatcctattaaatgatatatgtccagggttttgcaggtcacaacttgaattttattcgaagagatataatagtcattaaaaaataagagaaaaaaagaaccctggggacagaaattttaatttaaattcagggcaggcatgtagtacctgatattccatgtattcacagaatgacagaaaaccatccttacctgcatggaatgatggcagtgattgtttagtgtccattcaaaacagtaactggttgcagttgaagtagtacttttaatcatatggacacttgttccccaagaattgacctggagccaccaaaacataaacacagactattgagcacagaaggagccagtaattactttcaatcactccttgtcaaaatggtttgaattcaaaccaatcattcataagagaggagctacctcattaatagttttcttagttcaagatcaagaaaaatgataagccatattaaaaattgtttgtgtttgcaagcattcaggagaatgacatttgaaacacaattaccaaaacaaaataaaagcagctaacttataattcaattagagcctttccaatatttgtcaaataaaaaagagcaaatttcagtgaagaaaatcaatgaaggaaaccatttagaacatgcttattgctgtttgacttttgtcagttgcaagaaagggaaatagttgaaatattggcagtaaataaattttacagttattacttgtttcttctaattttctctcccttattgacttctcatttctggtaatatggcaataaacaatatgtaaagagctcagcactggatgtgattaatgtatgcagtatctgcagttaaaacattcttctctactgatgtctgtgtcatgatcctccttttttctcattttccttcaatgttgatttgcctcctcttaccttttttcttctgttattatctactttttacaactttaacaatgaccctgcatatccttcactggcctctctttcaaagaacccatcctacaaatatgcccagctacctactagacatgttcactggaatatgtccatgttaccctaacatctcccctcctttatgttgtgtcctgtctcctatccccttccctctaagtaaccaaaatcaactcattgcttttgattttctaattagttaattctggcacttaagtcaaaatcaccattgtctttgatttttgcctgcagacacttccttgttgaatatgtttgtgcaaacttctatcagataaatgtacctgaaacacacttctcattgtgtcattttactgttccacatgaatgtaaccattgttgatgtatactgggatgtggaaatgtttgggaagcactgatgaatgaattaacatgattacttcttcacaactatgtccctgtactcactggtgctagtctgctagtcttgaagatctggtgggaagaatagctctttcctatactgcacacttcttttcctgttgcggtggatattttctcaaaactttatcctcaggcaaatgattccacgtgcttacttatatccgtaaaatcctcaaatttcatagttagctgatggcaccttattattttattttggtgtgagaatggaaagactcattctcttatacagtttctgccatttcagtatgatttcatttgggaaataaagtaagataaatgttcttatttcagcattttatatatttttaacatctttattttgaaataattttcaacttagaagagttcacaaaataatacatagagttcctgtgtaccctttgtataacttctccaaattttaacttacataatcatagtacaattattgaaataagaaaatgaacattgattttatactattaactaatttacagattagttctggtttgtacagtgtaatgttcaactattagtatattcactacatttatccaaagttttgtttttagagcctgcatagccaaagcaaggctaagcaaaaagaacaaatctggaggcatcacactgcctgatttcaaactatactataatgccatagtcaccaaaacagcatggtgctggtacaaaaataggtacatagaccaatggaacagaatagagaacccagaagtaaacccaaatacttacagccaactgatcttcaacaaagcaaacaaaaacataaagtggggaaaggactcccttttcaacaaatggtgctgggataattgggggaaagagtgggaggggggtgagggatagaaggctacaaatatggtgcagtgtatactgctcaggtgatgggtgcaccaaaatctcacaaatcaccactaaagaatttactcctgtaaccaaatgccacctgtaccccaataacttatggaaaaataaaatgaaaacaaaacaaaaacacacaaagttttgcttttacttaatttaaaacaaagaaattttgtaggctgcatgtggtggctcatgcttgtaatcccagcactttgagaggcttaggcaggaagattgcttaaacccaggagtttgaaaccagcttgtgcgatacagggagactcttgtctctgtagaaaatttaaaaaactagctgggtgtgctggtccatgtctgtggtcccagcttctcaggaggctgaggtaggagggtcacttgggcacaggaggtcaaggctgcagtgagccatgatcacaccactgcagtccaacctgggcatcacggcaagaccctaactatctcaaaaaaaaagaaaaaagaaggaaaagaaattttgcacttgaaaatagttactgatctttagatggataagtaaaataataaaatacctaaaatattttttcattttattctcattttcaaaaattttatcttttacttatctaattattattcatcctagttgactattttcattgtacagagcaatccccaccattatacgatgaaaccttagcaagtttttgttctttgcaacctaaagactaagaatccttagtagaatcatatatatggaaactcttgcacaggaaccaaatgtgtaatgtgtctcattcagagtggaagtgggaccaagaaatttattaggaactgaagtgtgtgctctcgcttgctctctctctctctctctctctctctctgtctcaatcttagtgctcacaaattatttaatattaacctactgaatactgaatatgttaataatttattcagtactcagtagttttttcttcttgtctctatataactcttttacaaaacttttttctccccttacaaatggcaacattatgaccatcataatcaaagtaagtcatcttccagctctattattcgccatagcctagaaacttccctttgtgactctgttcataatgcaaaagaggaatttctgaacatcactggttttgggagggcagaccactgatgtgtcactggcttgtatatcgatgcctttcatcccttatgtcaggttcttacctctgactaaaccaaactagctatatcatttagtctttgctacattgcaaccatctaccccaaatatagtaacttatataataatcattcatttgcttacagtatggtggggtcgtcaatttgggctggactcagaatggcttatctctgctctacatgaggtcaacttatgtgtctgcaagttcaagtatcatggctgagcttctctttttatgtgttctcttatcctcaaggagcttagtctaggctcattcttatgttgatgaaaggggtcccagaaacagcaagagagagcaatccacaatacagaagtaccttttatgtctctccttgtgttacttttgccgatgtcccattgaccaaagcaagttacatgggcaagctcagattcaaggtatagagaaatagattttaccttatgttagaagaagttgcaacaacacattgaaaagagacatgtggctgggcgccgtggctcacgcctgtaatcccagcactttgggaggccaaggcgggcggatcacttgagatcaggagttcaagaccaccctggccaatatggtgaaactccatctctactaaaaatacaaaaattagccggatatggtggtgcacacctgtagtcccagctacttgggagtcagaggtgagagaatcgctttaacccaggacgcagaggttgcagtaagcctagatcatgccattgcactctagcctgggcgacagagtaagactctgtctaaaaaaaaaaaaaaaaagaaaagaaagaaaagaaaagagatatgcatacagaaatggaagaatttgtggccttttgaaaaatctgtcattctaggccaggtatggtggctgtaatcccagcactttgggagggtaaagcgggagaatcacttgagccctggaatcagaccatcctggacaacagaaaacagaaaaaacctatcacactaatatagggaacctgggtgttacaacgtagaacataactatttaggacaaaaggggatgtggacaagcatttccccagccagacttgtgaattagtagctccagaatgtggctgatacaatgagatcagcagggtgttatacttcatttatattgatgcagtttattttattaataattataatgatctcaacgagagtcacgaaacaggttgaggaaagtatataaataaaaggcacacctaccatccacagtcagtcctttgattgtagtctaattaagactagataatgattgaatatcattgtccctgatggtggttttgtagtacagacaaattaaaaaggtggtatacttcctgatgtgaaagaacccactttgggagaaaagacaaaaacatcatcaccatgaacattaattggggtcagtgttggaaaaatgggaatttattctagctttcctttcttcacgttagccctgtgggctgaagttgtacattttttaatttctcttgaaaattgcacagttactgcccactttgtgcttttagattgggtaaacagaagcagtaaattcccagtagctaatgctttgctgtgtaaaggtggaaaatccgtttaaaagtagtcatataaacctctattttctggaatgtttctaagatattagaattggacacatccataaaacagatttctctatgaggtcagcaggatgccatacttctttccatgcactaaaaggcacaccttggttctgaaaggcttaatagtctcaaaaagtgaacactccagtcttcactctgtatagattcactcccagggagagaagggattctactagtgagcagaaaatcaattgctgagtttctgtagctgctttaacttttacttaccagtaggacgccattttctctttgggaaccccactggcctaaacattagctcccttttcaccagcagggtcaggcccttgctgtttctgagttaggagttttatacaatatacagaaatgtccttatttttaaacatataattgcatataaaaatgtgttggtattccttagagatagttgttacaagagaaaacctacaaggaagtaaactgtaattgaccactgcctgacccgttatatggctgtatttaagttttatcctccataaaataattatgatggctttgtgtgttaaaaatagctatttatattcatttgagtgcaatacttgttattctctgccctggttcagtcataggagccctgaaaagcttatggcctgaaggttttgagttctgagttgaacaggataaacactcctttgacttaaaggggaagatgacctttaccattgtagaattcctgtaacaaagttgctgttcattaagtatcatttatgaattccaaaatcaatttgaaaaccacatgatatatttttaataattctagtacacgacatactgtagaaaactgctcaaattgagagaaaattaaactagaaataactaccagttgactgagtacaacttttagttgaaaacagtacagttgtccaagatgtatgatacagtaccaaacggttctcaagactttttgtcctatatattttttttaattagaaaactcactttgaaatttttgacctgtcaaagtgaaagcatatcttgaaaaacaataaagagcaagctggttaaacattgaaaaactgtgaaatgttgaaagcctccccggtgagtaggaacctcattttattacatctgcgacaaaaaacaaatgaaaccaaagatctttgacagtcatttttttataatttatttttagtaagtcatgctgtatattgcgtcttttaaattagggtgtatcagacaatacttagactgttctgtttagaaacttagaaaaccattttttaagggggaaaaagaccaatatgtgctacattaaataatcatctaaaaataaaaagcaattttggttctgctatttcctaaggcttaattaaaccatatatggccaatacagtctagtgactaaggaacaacacataccatgatgtcaggtagcagttttctttctgtgagatgctacttggagggaatatgtttttaggactaacaaagcacctgacaatttattgcaatgaacatattaataatcatttagcaacatacaagtggttacatatagtatgctcttggagaaaccagttatactttgtgtagccgtttcctcaagaaataatgcccagtataatttagaatggccttagaacatttaaaccagtggtgtgctgaagacaacttgtatcagctcgcaagagactggtaaatggtacaaatcactgacctacctccctctcagaaaaaaaagtgattaaatattcatcagtgtattactgaatttttaattatatatagtttaaaaacgattggattctacatgatcttattttgaatgaatatccatctttttattcttactgtggactctcagtgtaagttcctgaaatcaactaaatacatttataaaaataatttatcttaaaaaacatgatccatctatccttgtgcatatttgctattatgtcaaattgtacctcctagttagagtgcccattagtatacatgcatttttattatgccagtgtatgtggaaacccttttgctccccccaaaagacatgctttatcttgcctttgaaaatagaatttccagttgattagtttttattgcaaagctgcctttcacactttcacattgaggtaattatatgcgcctcatattgttttttaaaaaagatgtttcattcattgctttccaaaaaaaaaaaagcaaaataatttatttcctctgaagagggacatgaatttcagtgtttattcatgaagtttacaattgatatatgtattataattgtcctagaaacactttttacaataagatatctttgtaattacgcacctaggataatttggtataaaaagcagtgatattaaagagtgaatagtgtttgcaggtcatagagctttgctctagtattatttgctttactgcaggattcaacataaggcaggtgtcttgtctcatgaagtttattatagaaagagtccttataccatattttcacttatgatgtcgaaacttagaataattttattcaaagaatatcctttgagctccaataacacaaatcaggttataggaagtatcaccctggtacagaattgttcacatactcatttgtcattatttgaagaataaatgaatgaatactaagagcaaaaattagtggcataaatcagaaatccattcattaataaaggagaatacctagcatgtacttgaacagttagggtagacttcattgctttggtaagactttcatgaacatggagtttataagtggaaagacaagaaatgtttttggtagaagaaattgcataagcaagcatgctgaggtataacttcaagtacatttaaagttcagtaaggggccaggatggttgaagccaagattccctgaagttaattctggagagttggaataacattacgtcataggagagactgaaagttaatcctgttggtcatggggaaccactgagattttaccaaaacacttgatttagaaagattcttatattgtgtcaggagtgaaattagagtgggaaaaggaagcgaaagcctggactggttgacttagttccatgagattctctgctatttaaatgtgtcctcagtctccctgctgaaatctaaagaataatctgaaggcaaaattattcccaagtacgaaaatgttttagaccttcttcctaggcaaacatatttctcaattccatgtccatattacagagattgagtatagtagagactcagttttatcacttgtcaacattaatctgttgattgaaatagtaaaaatgtgaagaatttgattcaaaataattttaaacatatacatatactaatatttactaagactctttgacatgcataatacagaatcagagtcatgaaagtaaatgcgtaaaagaaagaaaatacgcaatgggtggttgaggaatacaaagacttttaatagaagtttcaggtatttcagttctcagagggaaatgggaatagctagcatttatccagcagtcctatatagtagtatagaacttgtcatttacagatgtcctagctagggctgctccacaacaataccatagactgggtgacataagcaatagggatttatttctcacagttctggaagctggaaagtccaagatcaaggtgctgatagatttggttccttgtgagggctggcttcctggcttgtagatagactccttctctcttcattctcacatggcggagaaggaggactctggtatcttttcttcttataatggcaccaatcccaccatgaagtcctgcccgcccttatgacatcatgtaaatctaattatctcccaaaggccccacctccaaataccatcacattgggggttagtgcttcaatatatgaattttgagggaacatattcagtccataacaacaggtgttaccatatttaatatttacaacgatccaatgaaaggtactattcttcccatttatacataaggaaaccgcgatagagatagctttaaaactttcccaagattagtggctgcagggtgagggtgttgagaagcagccagggtttgaagccaaacagattcctaggaaaaatattcttaactcattctctgagtttaagtagggtattagcagtttaatgatgatggggtaacagttatatgtaagtatgagtgtgtgaatgtgtttatctgtctatctgagtgaatgagagagtgaagaggcagggagagagagcataagcaataataacagaaggtaggatagtaatttaccactcttactatgaggtgtgggtgtactgttctagatgtgtaactaaaaggaataattttaacctgattattttcatcatacccacttggtggtcattttgtaaactcccacagctcttgtaacagtatatctcaatagtaaaaaagtctttgaaatctatattgggcacgctgagtaaagtgcatcttttttcttccaggaatctctttctaacagtggagaaaccaactggtgaagatcaataaagaatgcttgttttaaacaagagtaacttatgcatacatatgcatacacacacacacacacacacacacacacacacacacacacacagagagagagagagagagaatataaggaagaataaaatcatcttattttacaaaacaccagctgtgttccagtgttctatctattgaaaatgagaaagtatttgactaaaataaaaaaagaggaaggaaataatttaaaaatggaccaaaaaaaaaaacagtcaggagaagaaagctatattgaggaaatcctcttgacagctaatattatttttagcattactaatttgacttccttgataatatcagcacttttactattacaatcttaatgacttgggaaatgcaagctggatagaaaatgtcaaactggaaaggaaaatttcaaatgttttgctttgtaattaaggcctgacaaatataagtcaattttagcataatagatagattatcaagtagggacatttagctaatgttagaggtaaaaaaaattataatttatatttgaatacattctgagatggcttcagtgtgctgacatgttttaaaaagtgtaacaagtcttaacaagattccaggaggggatacacacatgtggacacacacatacattcccaactatctgtaaagggccagagagttcatattttaggattttatgggccacacactcttgatcacaactacttatctctgctgttgtagcatgaaagcagtcttagacaatatataatcaaatgagcatggctgtgttccaataaaattttctttacaaaaccaagcaaagagccagattttgcccccaagccatagtttgataagcacttatctaatacatattcatatgtttcatatagagggatagcttttactagcaagcagtagtaataggtgtgtgcatcattttaagcccttaaagagctaaatcatatccaatcattcaacctttaaaaaaatttgaaaattcatatattttatattttatctgatgcaaccgttcctattaatatttaattcaaatgaaagttgttaaaatgaagtggcattttcatattcaaatctactttaaatgtattcatgcttgtcagtgcctcaaatagaatctgtgaaaaattctcataaaatagatcctaaattttgtcaaataaacttggaaaataattgcagaatacttatttaccacttcccatacatgatttagcttaactaaggtgccgatatctgtgtatgatagcaagttaggtagtaggggggttggcatttatcttaaggagccacagtgacactaataattgatcagaaatagtcaagttcaaaggaagcacgttcaaaaaagatagtgaagtttctttaggtacaagacggaaaatggttgactctctctatacctaatattaaaaaaaaaaaagaatctatggtaattttcttttcttctattcttttttattatttttatttttttattttttattttattttttttttgagaaggagtcttactctgttgcccagactggagtgcagagtgcagtggtgcgatcttggctcactgcaacctccacttcccaggttcaagcgattcttctgattcagccacacaagtagctgggactacaggcgcctgccaccatgcctggctaatttttttatttttaatagagacggggtttcgccatgttggacaggctggtctcgaacttctggcctcaagagatctgcgtgacttggcctcccaaagtgctgggattacaggcatgagccatcacaccaggcctacagtaaatttttaaaaagcattttaattggtaattttacagtaacctgggatgcagaattgaattgttttatgaattaatctccaaggagttacttgaatttgttctctctctctgtctctctctctgtgtgtatatatgtacacatacatgtatatgcatatatatatgtatattctatgtagctctatatgttttgttccattagacaacctggaatacataaatgttaaaaaattttttgtgaaacagtggcccacattaaaaacggttctcatttttgtttgtcattcctcagaacaaaacagtatttggtggttcaacaaaatagaaaattaattttaaaaatagagaggaaaataaatttaaatatgatttttcccagtagtcctataatttatcttaataagaaaggagtacaggtttcaatgcagcattgttctaagactttttgtgcatatcagaatttggattcatgtttttttaaaaaggaaaagaaacacttgtcgtggaaaaagttattcagttagtcaaagtcaaaataacaaaataagaaacgtcaagtaagtaaatataacctgggagttctgaaataaagataacaaaatgattttatcaagtatctaaagtctatcatttctaaagtgggtaaagctatcataaataaagcagaattatatttacttttctaaatactaaattatatgcagtatatgcatacaatttgctttatttaagaagatggctaacttatctgattctttctttatatgttttagattaattttctagagttgactctcactcaggtctaggcagaaaattattggtgtggaaaatatgcccattccagtgaggtcatctattacatgtgcatgtaatatatggcagcaggtaattgagacaatgtctctttgagatggcagtccccttgaagtcattgccagggaatatatttctctttaattttttatgagacaatttagggaggggattttgtgacttatcagttccagaaattatacctagcaatacagaaaatgatatgttttttcttgtggatggtacagctttgttaatttttgattttgagatgctttagggtagagaccaggcttatcagctcaatgagaacatgtgtttttgtatgtttcattcttggccatatcacaagtgcctataacagtgcctggacaagagtacatgctcaataaatacttttgaatcacaggattaacctttacattgccgattgccagcagaaacttaggagaaagccatggtggataatcaaaaagtacgattaaattaagtggaaagagcaattataaataaataactaccttaccattccccacagtgggtctgggaattcatccttgtaaaaccacggagagtgttcctctgagagtgactacagattttttttttttttttttttttttttgagacggagtcttgctctttcacccatgctggagtacactggcgcaatctcggctcactgcaacctctgcctcctgggttcaagcaattctcctgcctcaacctctcaagtagctgggattacaggcgcccgccaccatgcctggctaatttttgtatttttagtagagacagggtttcaccatgttggccagagctggtctcgaactcctgacctcaagtgatccgccacctcggcctcccaaagtgcagattttgtttctcacataatgagaagctgagtgcaatctatatgctgtaagaatatcccattcctactcaatagtgtctttatgactattactttaaagaaatgaagtaaaaggtagttttacttcacatacaatatgtgaagtaaaatgtagttttggtttacatgtatatatgactatatgataatacttcaggaagtcattaatgaggaaaacgattccaagacacatacataatcggattttttagctattgtgtttgtagcttactttcaacattagtaagcagttgtaagagaacagccattaccaattactgtaaccgcagcattacacagggagaaatatgactgttgaccttgaaatgagtataagatcatccccagtagaagatcacagtccaacaactctcaactctggctgcacattgacatcatctgggggagcttttagaaaattttttttattagatctaggccctaccttcggagactcttcactgtttggacgtctgtacatttttaaagcaacccaagtgattctattgtgcaattatggttgagacgatcgaatgctcttcaaattgttttactcagataaatttaaaggaattttgaaaaaacgtgcactatctcccatatttcaactataaaacatttcagcatatgtttaaacagtttcaaagaatatacattcctctgcatcatctatgtgttctaaatatattttggttgaatctttgaattgggtatttaactcattttgtttgtgggaaaagataacattaagacagaggcttgccctgaatttttttccttagacaaaataaagatctgtacctttcaatattttctttaagatatcttcaatggactatcccaaatgctcagcgcattatttaatggtccttttgtttgatgccctggagggttttactccctggagcaatatgctttgataagatttgccatagtgaggtacgtctttcttcttcaaagtaagaaaagtgtggttagataagagaataggcacattatcagatcaattttagatgtgtctgaaagctgaagatctggaaatagattcccttaaatatgttcatgtctgtgtactccttgaaaagtcctcatattttagtgtatgtacctcagttggaaggtagctggattaaacttggagctggtagttttggggaagacagagacaaggggacaggcatgagaattggccaatccctggtgggatctccaaactgaccagcaggttgataggttggttgggaataaggtgagaactttttaatgagggccatgtgtgcaccacatatcatagcaaaataggagttcaaaactaagcagacaagcaacaatctaagcacaaatttataacagcagaagaaccagagttggagagaaacgagggaggtagccaggaatcaagaggaaaaaattctgaagggcaaataaagatgggagaatgaagtagaaaaattgttcaaaaatcagcaaagctatatggggaataaaataatacaataaacatgactacaccaccaatgagagatgccatcaccaaagaggtgagaatacatgaagctcgcctgtcttccgtttgatttttttttttttctgtgtctgccctttggagtaggaacaacttctcatgcatagtagaggcaaaaaccagcatctgatagttccatgtcttcagtgtggagtagaaagcaggaaagagtgggtagatcccgagtgcacaggaaatgcacttatgttcactgaaaagccatacagcatccaactatagatgacattggctggaaatatagaatcacaaaaattattcacagatcttttttttgctgaaatcattttaaataaagtctgacggggagggagagcatcagcataaatagctaatgcatgcagggcttaatacctaggtgatcagttgatagataaaggaaaccaccatggcacacgtttacctatgtaacaaacctgcacgtcctgcacatgtatcctggaacttaaaattttttaaaaaaagaaagtatgtgggaaaaaaaatatcttacagagaccagagatttttttcttttcaatacatttctttagtttttgttttaaccaaaacagagttccaacagttatctcttcagtaaatgaaagcatctccttaagctttaagtggtacttgaaattttaaaagaggattattttttccaactcagtgaggttataatatacactccaacaactttataaaagcaagagaagtagagtgttaattgttaattatatgaaagtgttcaggcaaaggaacttttaccttgaaagcctttactctttagcatcaaaataagcttgaaagttctatggtatttagggaggatattttaaatttcccctacccaagaaaactggataaggattaatacaaaaccccctccagaatattaatttaattaagtagttatccaaagtgttatcacaaatacatgatgtgagttcacacttcaggcccttacatttttatattgcatggcatttgtctttttaattaaaaaaaccccacagttctattgtattgccatggggtttttcatttaattttccatttaaaagtagttttatttctccttttaatttaattaaaaacgttaaaattgttagggaaaaaaagaagaaaatcctgagtcatcactctttccttccttatttattcacattattgatgaaggtctgtctagaacaaaccactgatagcacattatcctttgaaaggcagtgaaacaccgaaaattggagtttgctcactttgaggatcatcgaaaacaaacagctgaaatatttttttccttttagaaaattaaaaaaaaaactgatatgaaatttcctctatttagaagcccatgtctacccaaaaatagaaaaaaatgttttctcaaaagcccggaattagaacatcttacgacatcttcaactctaagttgaatttcattaaaatattttgttgcacgtttttgaagtggcaaacatcttgctttttggaaatctcagttttaagaaatgaaagaggtaaagagtatttgaattataatcattgtctaagccaggatcagttttctggggtgggagtacagagagatgcatcgggtagggggctagtggtcatggctaactgttataaaacttctattgatgccacccatttggatgacatgagattggatatgggctaagacttttgttgaaaggaacgttgtttacttggaagtgttccagtaggcatttgccagtcacagaatacaagaaagaaaaagggagtcattcattttatttcattaaaacatgtgttgaacatctactaaatgctgtaatctgtgctaggtgcagaagatataataataaaaccagccaaaagcgtgattctcatggtcgccagattgaaaaggggcttatcagttacggaagactcaatgcttccaaagctttaataccacccactttttattgaccgtttattaacccattttggctaggaaagggagtgaaagaatgtttacatgcatatttatatcactatttacataagatattttttctaataacacttgaaattgcgtttttaaattgttttatggaagaattttgagcccaagctggtacggtagcttactcctgtaatcccaacactttgtgaggcccaggtgagaggatagcttgagcctggaagttcacgaccagcctgggcaacatagtgggagcttgtctctacaaaaagataaaaaatttagccatgcatggtggcatgcgcctgtggtcccagctactcaggaggccgaggaggaaagatcacttgagcccaggagatctagtttgcagtgagccgtgattgcaccactgtactccatcctgagcaagagagtgatgccctgtcataaaataaaataaaatgaaatagtaatgtataccagcttttatttacctctattcttttttttttttttggtccaaagcatgtgtttcctttaattttttttctttaacttttattttagatatgggagtacatacacaagtttgttacatgggtatattgtacccaggtagtgagcataatacccaataggatgttttttgacccttcttccccaccctaagtagtctgtagtgcctattgttatcatgtttatgttcatgtgtgctcaaagtttagctcccatttatacgtgagaacatgcggtctttggttttctgttcttgcattaattcacttaggatagtggcctccagctgcatccatgttgctacaaaggacacgattttgttcttttttgtgactgcatagtattccatggtgtaccacattttctttatttgatccaccactgatggacacctaatgttgattccatgtctttgctattgtgaatagcatgggtgaagaagatacaagtgcatgtgtctttttggtagaattatttgttttcttttggtagaattatttgttttcttttggatatatatttagtaatgggattactgggtctgttttacattctttgagaaatcttcaaactgctttccacaggggctgaactattttacattcccaccaacagtgtataaacattctcttttctccgcagcctcaccagcatctgttattttttgacttttcaaatagctgttctgacttgtgtggatcatatcttattgtggttttgatttgcatttatctgacaattagtgatgttgaacattttttcctatgtctgttggctgcttgtacatcctttgatctcgaactcctaaccccaagtgatccacctgcctcagcctccccaaagtactgggattacaggcgtgagccactgtgactggccttgtacatcctttgaaaagtgtctgttcatgccctttgtggtttttacttgttgatttgattaggaatcttaagttccttatacattctggatattagacctttgtcagagcatagtttgcaaatattttctgccattctgtagattgtttactctgctgatagtttcttctgctgtgcagaagctctttaattaggtcccagttttcaatgtttgcttttgttgaatttgcctctattctgaaaaattctgtcacgtaccataaatattttgttgtagtaagttaggtaacacatttaaataattagctcaacatcctgaaatatggactactgccaaatggatacaagaatatatacaaagagagttctactccttgactgcccagtcaagttgcacacacacactgttcagatgggtccttggactatgtcaaatcacattgaagtaaacagtagttggtgattagattaggatgaaatataaaatccataaaagtaatcgcataaaacttttaaatggcaaaactgcaattacttttgcaccaacctaataaatagtttctctttattaggacatgcagatataataattagcctttctctgatcggtatggtctagatcagagatcagagaacgtttttgttttttttttttgagacagggtgtcgctgtgttgcctaggctggtcttgaactcctgggctcaagtgatcctcctacctcagccttctaaagtgctgggattacaggtgtgaactaccattcccagcctcagaaaacttttttacgtaaagggctagattgtaaatgttttcagttttatgggtcatgtggtttctgtcacaactattcacattctgtcacaactattcacagtcatgctttgtagcttgaaagcagtcacaaatactaagtaaataaatgcatatggctgtgtttatataaaacatgaggggatagatttggcgtgtggtccatagtttgccaaacactatctagacaacataaaggttcaaaggaggaggatatgacatcaaattggggcaatgagaaagtatttcattgaagaggtagcacttgctattattcttgaagcctggtagatgaggtaagctgacattgtggggtgatttctggtggacagaatgtggatagtttaagaaattgaatttttatgaacactgagcatttcgttatggcagaaatatagactctgtgtagaggagtgactctagatgagttaggaatgtagatttgttcatgttttagagttttcagtaccaggatgaggaacttgtacctagcttgacaggcaattatagaccattaaatagtttatatcacaatgggatttggtagaaaccacactggaagacagtcattctaggagtggtgtgtggaataaattagagaagtaagggactgtaaacaagcgagcggattggaagagtgtcataatagcttaaaaaggagacaatgagggccccaacatagtcaggtaagaggatttctaaaaaagaggttgttgaggtaaactgtaacattctaaaaattatttctttaattgacaaaaatactgtatataattgtgtacaacatgttttgaaatatatatacattgtgaaatacctaaatctagataattaacataagcattacctcacctacttatcacttttgtggtgagaacacataaagtctactctaagcaattctaaagaatctaatgcattgctattaactctagttatcgtgttgtacagtatgtctcttgaacttatttctcttatctaagtaaaattttgtatcttttgaccaacatattgccccccacagccctggtcgctaccattctattctctgcttctaagaattcaacctttttagattccacatataagtgaggtcatgaggtatttgtctttctttggctgtaacatttaaggatgaacaactgggaacctaaattatttccaagctgtagtcccaccatatgcaccagtacttttaacggagcctgcctagttcctgtttctagaaaactattcagtaaaacagccgtcttctatgtattatgtatttttcctaagtcgttacctagggactagaaccctgcctagatccctgtgcccagtgcttcaagccgccttaactatcttgtaatattggcctctatgaatttttaagtagcagaatcagctcccctgagattagtttatatctccccacctggagtggactgcatcttgggtctttgctcaactatcactggagacattcacatttgctgggcggcattgtgccgacccatcatattgatctgtaacgtttagcctgtggttgggcaatttcttcctgcaactattgtatcccactatgtcaaacaaacatcaggtcccatttctacttactccagcctcttgtaagcaactacccatactacaggcctgaatactgagatttgccatacttcagctttttttaaaaactgaggagtaagaattatagacatttgagctactcctccttgtatgtgtactaataccactatgcaacttgtctattaatattattacatacaatttgaaattatattcaaaatagttaacagcctggtcattgacccatcaaaacacttgccagacataaataactgcttgcttaccagctagaaaaatcagccctgcctgtgacacagaaataaaccttcacaaaaacactaaagagaagagctaaaactatgaaatgtccaaaagaaaacataagagataatctctgtgaccttggagtggaccaatatttcttaaatatgacacaaaaagcatgaacaagataataaatattcatgttaaactttatcaaaattaaacactttttttttcttcaagagatattattaagacaacctaaaaccaagccacagacttgggaaaagtattttcaaaatataaatcagatgagggcttttatccagaacatagaaaatgtataactcttgataataataagaaaaacacatttaaaaaaatagcaaaatatttgaatagacacttctcgcaagaagatatacaaatggccaacaagcacataaaaagttattcaataccattagtcattagggaaatgcaaattaaaaccacatagaaataccacattgcacccactagaatggctagaatccaaaagactgacaatactaaatattggcaatgaggtagagaaactaaagttgtcacacattgctggtgtgaatgtaaattgatataaccactttggaaaacacttttgcaatatatttttaaaattaaatatactatggatatactatatacgtaactataaatacactatatacatatataactatacaaaaatgtactgtgtatatatgtggaaatatatgtatattgcataaaacccagcaactccacacctagatatcttcccaagaaacatgtttatacaaacacttgtaatttaatgtttagactagcagtattcagagtagcccaaaactgtaaactctccgaatgtccatcaactagtgaatagataaacaaaatatgatataggcatacaatggcatgctactctccccaaaaagaaataaattactgatatatgcaaagacatggattgatctcacaggcattatactgggtgaaagaatccagacacaaaagtgtaggtattttattatttccattatatgacatttctagaaaggataaaactatagagacagaggcaaaatcagtgggttcctgggaccaggggtagaatcacagattagctacaaattggcatgaagaaactttggggtgatggaagtgttttaaaactgggttattgtgatagttgcacaagtatataagtttactgaaactcattaaactgaacatgtaaaatgggtgaattttattattatatgtaacagaaaagctgttgaaagcatagaatactgttatatgaggagattatttctgtttaaaggtgatttttctagaaagattttataatgtctaaaatataaaactggcacatcatagaatgagtacatataagtaaaactttttttttgcaggcatgcatatgtgaaattgtatggttctatttatggcaaacagaaggaaactttttacagtgaaactatgttcatagttttcaagggaaaaacagctccatgaaataaaatattgcttggggagttctttcataccgcttgtcaccagcattctcactggcttataagttataattgctctgtgataaaggcgtatgctttccttctctcttataaaaattttaatgagaacttggagtgaactctcactgaacctattttcattccaaaaatcttatgattttaatcttatgatcctcctgagacctggcactatggtctgtgacagcatgaatacttcataattattcctcctgtttgtagaaaacaccatgggcatccatcattccctctctcccctgctgcctccagggagtcacagcctctagcaaggtcagtaattgcagttttggttgacagttccaggccagctgaagcaaatccagctggtgaagactagccacaatggatattgactgacttcccttccttctttcacctcatagtcagtttggccttaaaactcttccttagtgatgtgatagatggacttaaatcatcccacaagagattccccagtacagagaaaatgaatggtttctctagagccatgtgtatatgtgtctgtcggtatttgggggacaattgatctaaccgtcctggggtaactgaaaggtctttcccttggggataaggaaaagactgtattggagcttgacatttaatattgtttggcatctcacatctctgtagataacctgcatgaaataaaagattcagccatgtgaattaagatggtattttggaagtggatatgcttcatttggctaacatcgaaaattctaataacagatttgccctgtgcatagaaaaaatagatgctttagatgtcaagcaaataattaagcattaattttttactttattttatgacaaatgcatagagagattcacacaagaaataccaaaggaatgccagatgctttatcaaaaaaaaaaaaacccacattatgaatccaaagaaagatagacaaatagccttcatagtatgtaatattggatggtatagctttacgaaaaagaagataaactttcatgtgaattgctggtgaattccagaaaagaaatgactttcgaaagtggtataatacctttaactctctaacttctcaccatgtggtttactcatagtgtagaccatgactaaagtaccggcagaaacaaacccaattaggcatggcctattgtatagatactgaactagtctagtgtctttaggtttgtaataagtcagggtttatttttttcttgcttttttaccctggtcccttgtttctggacttacttggggtttaaaagatgtatttgcttaagaataacttaattacccattctggataaaaatttaatggaatgtgttagaaggcttaagtgagatattaaaattaattgaaatcacgacccccacactctttgacacacctcccattatgaggtagattgtgagcggccttatagttactccacttaatagaataaagttgatgtgatgttatgtaacttccagactaagttagaaaaggtcatttagcttctacttggttctgtctagagacatactctgggggaaaccaacaccatgtaaaaagctgtcccgtgaccaccatgttgtggaggccccgtgtaggaatttcagccgacactaccgaccaacagttagcctccacttccagccctgtgagtgagtcatcttggatatccagcccagtccagtctttatgtaactacaaacctacctgatatttaactccagtcccctgagaggtgccaagtgagaactcctcagccaattccttctcaaatatttgtctcacaaaatttttagaatatctttaatatatgtgtaatagtaaaactactgtcactcagtaattttgatattaactgtatgtttattttggatattcagtttgttatgtgtctatttaaataattattgaatttctattaggaacacttgttcagcctatctaccatgagacttaaaaagcctaaatcacagtccttgccttagaagaatacaattgtcagtggagtagatgcaggatcatcaagtatcaaaactctggagcacaccattcatattatagtctatgtaaatggtctcccttgagttgtgcaatgggatgtcactggaaagataagacataaagtgttattttagtaataaccattcttatactggtaagcttctcaggattggtatatatgagtggtaaggaatactactaaattttatacttttccaaacttctttacagtactctgttgttgacaaaagtgaaaacaatttagttagaatgtaaaagtaacaaagaagttttaaaggaatatataatgttctgtcataaagacacaggcacatgtatgttcatcatggcactattcacaatagcaaagacatggaatcaaactaaatgcccatcaacagtagaatgaataaagaaatgtgctacatatatacaatggaatactatgcagccataaaaaagaatgagatattgtcctttgtagcagcattcatgtagctgtaggccattatcctaagcaaactaacacagcaacagaaaaccaagtacctaatgttctcacttataagtgggagctaaaccttgaggacatatggataaaaagaagggaacaagggcctactttaagatgaagggtggcaggagggtgaggatggaaaaactacctattgggtactatggttattacctgggtgacaaaataatctgtacaccaaacacctgtgacacagaatttacctgtataacaaacctgcaacatgtaccccttatcctaaaataaaagttgaattcaatttaatttaatgcaaaatataatcaaaattttagtctgggagtagtggcttatacctgtaatcccagcactttgggaggtcaaggcaagaggatagattgagctcaagagtttaaggccagcctgggcaacatagtgagtccctgtctctacaaaaaaatacaaaaatcagccaggcatggtgacatgtgcctatggtcctaagtactttggaggctgagatgggcggatcgcttgagcccatgaggttgaggcagcagtgagccatgattgtgccgctgcactccagcctgggtaacagggtgaggccctgtctcaaaaaaattatattgcactgtatgcaatactttgtaaatgcatatgctattcttctaatgcttttagacacttcagtgcgtgtcatgagaatatgccaagttgactaactataaactgatggttcccaaatttggctatacattgaaatcacctggggagttttaacaaccaactgatgtctggttcccactcccagggattcagatttaatggatcgggggtacagaatgggcattgggattttttaaagatctgaaattgttttaatggacagccacaaccgagaacaactgatatgtatttcttcttttaattaggtagttctcaaactcaactgcccattggaatcatctgtggaacttggcaaactattagtgatttggttccatttctagagactctgatttaattgctctggggtaggtcctcttggtacttttaaaaatgctcactagttaattgtgatttgagatccaccaataggatgctcatactgggtttacagattaatgtttttctgcatatatgtgtcactcagcctcagttaccacatcattactattgggacacagctcaggttgccaaattcagcaaataaaaataacttttcctggataagtttgaatttcagataaacaacaaatacttttttagtgtaagtatgtctcatgcaatatttgggacatacactaaaaagtaagtttttttaatttaaaattcaaatttaaccagataccttgtattttatctggcaactctaaacacagtataatttaggcaagagacagagcaaggcccaaataatgcattatatgaagtgtgaccacaatggtgttcaatccatattccaggacagaactaagatattcttattgtcccccagctgccacagagtaaccattctatcccataatactacttttaggcggtctcatctgtagcatccctcttatttattgagcaaaagcaatggacagatgtaggagacagacagaaaaaacctgaaacctcctgtcccatcagtgttaaatcttttggcaacagagagtgttaaatctattggcagcataagctgaaatcatgggactgaaacttatgacttaaaaaaagacaaacaaacaaaaatcctgtgggtttctattgtttttacttatgcaatttctcaaatattttcatgtaattatagaagagaaaaaaaaacagattagtgctgaagttctgatcactggctgaacttcatagccttagcagccactgttaaacttcgaggttctgtcgcatttatagtgacagccaattccctcagagttacacagcagttgctggcaagtataatctcacatttggcaaatgcttgcatttctgaagctcactttttcattggttcttctcaacaatgctgtgaagtaggcagggaagttatgatatccattatataactaaggaaaattagaatcaggaaagtgttgccttgacctagagtagtatttcttaacgtgtggtcctggacaaactgcctcagcattacctgggaacctgttagagacaaaaattctgaaaccctaccccaaacctactgacttagaaactgcaggataggcccagtaatttgtgtttttataagccttctagtgattctgttgcatggtcaagcttgaaaacccctgccttcaggggtatgtggtcccagctcaaacattactaatactaatgtttatttatttaatttatagtttatttgtccccctggagtttaaaggctgtgaggtcagggatggtgtcacactgcctaggtatataatagatatgcagcaaatattgcaaaataaattaatgaagactagaacgagtgaatgcatgaatcccacatatgggggcttccattgccatgccttgccttaaaagaagtgtcctgtgcttagaaaattccattgcttcgctcattctctcttttgaagaatctcagctaatgggaagaaaaatggttgactgcatgaatttatccacaggcatattgagactagatatttcccttgaccccttagtgggacttgcgaaggggtcgctcacttactcagcctgcagcactcaaaccccttgagggagggggagcacacaggtgagcggatgtgggagagccagggccaagtgcctttgggcaccggcaggaatgaaccttgtactggcctgtggcagagtaccacgtagtacctggaaggcaccttagtttatctagttcagtcctctcattgtatacataaagaaggtaaatttgtgagtggtaaagtctgtatctacgcaataaaatacttcaatagctggggctagaactctgatgcctttattccctttaatatgcaaaggttttgagtacagtgtcctgtgaagaatgcttgaaatctcaccatggggaatgtcaccagtgcaattctgctgtcttttatttttatttttatttattttatttttttagatgcagttttgctcttgtcggcccaggctggagtgcagtggcacaacctccgctcactgcaacctctgcctcctgggttcaagcaattctactgcctcagcctcctgagtagctgggattacaggtgcctgccaccacgcctggctaatttttgtgtttttgttagagacagggtttcactatgttgcccaggctggtctcgaactcctgacctcaagtgatccagcgcctcggcctcccaaagtgctgggattacaggcgagagccactacgtctggccaattctgctgtctttatttctgcttaattattacttttaatttcattattttattacaaaactttaactttttatattgaatggtattattaatatggaattttgtatttataaagtaaagattgaaggaagcgtatttactgctaatggaaagtatcgcttactttttccttcaaagcaggaaaagcaatgtgcaaacatgtaagtgaaggaaaaatccaaccaaatctcttacccgagtatctacattaatattgtttggtgggtgagatatttctgcaattctgcagtattaatccatccttctttattatgtccaccgaaggtgtaacactgattacagtatgttttagggaaaacaatcctcctaggcatagtggcgataattcttcgacttttttactttgctgtcttggctcatcacggtgacctttaattcattttctcttgtctggtcttctttgcagacactacgaagccactctgtggtgtctattgagctaaagtcaattaatcacagggtgacttttaaaaaatcaagattaataataggttatttcatagccagaatgcttgattaagatgggcacatttgtggttcccctcatggctagaaataatttagccaagttacaatatcttgggcaaatttttctctcttataattttcccaatgagaactgctcagtttaaatggacttccctaagcttccatcaggggttctcagaagggttatacaaaatcactttcgttagctactgggtactcctaaatggaagcatctttgtaaagccatgtagcattggcacctcttcacaaaaacttggggggagtccgtgaaaaaaataacgggaagtctgtctttaaagataataacgtctgcctccaacattttacacatctcagtcatgccctgtggtgggagcaaaagaattctcttttctctttagtcttgtgccaaattttcttttcctgttggcctgaatccactaatgtccttggtaggtggatcctggtgtattaaaagattcatagcatttcatatttatattctgcttaacaatatgatggtacaccttagcagtttagcaaaatggcaaatctgtttgcataataaaccatataatgtgctgcatcatcaatttgactttgctggatgaacgaagagaaccagttggctctgatgaagttgagttttacaggtcaatgcaccatccatattaaggaaatccaggacaactatgtacatatatattgtagctagaggctgaatacattttgtacaatatttcatttgctgttataaaagaaaaaaatataagcttgggtacagctaccatagaaatcaatttttaggttttatattattactgcctttctattccccaggtgtgctttttcatagcatctccatcctaaacacaattgcctttgaagtaccaatatatctcttagtggatgacaatttccaaactctactcagaaaatacagtgcaaatcctggtataatataatggaactaccaagagttgttatggggctacatattttctgttctctactctcttgagatcttagcaaaatcccttcttggtaaccttggcttattgaaaagggctaatttatttggcattaatcagaagacatataccatctctcaactagactctctccacaacgttcctttaaaatttttaatctagtgaaaacagggggtagctttattctgtaatagtaatatggttcatgatatggagactgcagaaagaagactgtaaagctgaatttcactgcaagaaaatcgtgacttcaatacttcaggagaaaatcttgttgttcagtttgctggaattaatagttattttacctgtcaaactgtagtaccatcgaagtttcaccagactgtctagaacagactaatttgaagaagtacaatttcccaagtaatgttttattctgcagtccctctcttcagggcaacacacccatgtaggacctctcccactgctagtttagtcatgtgaaagagaatacctcttgttgttgcaagttatttcatcatcatcttgctaaagaaatgtctcactctcctaagtctccaagatcttttattggccagattccatataaggctttgtgttctacatttgtgatctagggaatttaaagcttttcacttctagcttaccagaggcttctgtatgtggtaaatcatacattgatataaaaagtaaataataataatcataataatagttatggcttatgtaacctatctttctcaatagttattggaccatgataagtgatacctcaataccacataccccttcacccaccatccactatctctcatacccttcataaccaagcatctttttttcttatacaattttattaatggagatacaattcacataccataaatctaccattttatttatttttaaaatactttaagtttaaagtttattttatttaatttattttagagatagggtctcactctgtcatggagactagagtgcactggcatgatcatagctcattgcagcctcaaactcctgggcccaagagatcctcctgccccagcctccagaatagatgggactacaagtatgcatcgtgtctggttaatttttttatttcttggcatagacagggtcttctctatgttgcccactctggttttgaactcctggcctcaagcaatccttttgctttggtctcccaaagtgcctggtttattgacatgagccactgtgcctggcctaccattttaaattgtacaatttattgtttttgatatatttacaaagttatgcaactatcactactgtctaattccagaacattttatcacccccaaaacaaaccatgcacctgttcaccaaaaagtgactgaagcaggtatcaatcaatagaagtttatttacccaaagtcgagaaagtaccttggaaaatatacaaatcacaggagcatctgtgatctgggctttttccaaaggagggggtgggggaacttcagtatttgaaggggaaagagcaaataggagggaaaagaaagggagagagggtagcccctgaggtaaatggctaaattctagtgaggctctgtttagcttcagtaaatctacattttacatgtgaaaagaagaactagaggaaaaagtcaattaggcatttgtctcagggtaggcagagggttgataagctggcaattgacattgtcagggttagatttcatagaactgggttttagggctagtatatataggaagggtatgtatcctggaagatttaggtgctcacgaggcaattccttgtgagggaggccatctggggagacatgtgcccttctatagttatgggaaactggcttagagatgaggctatgacacggtgttgctgaattacagctatctgggaacaaaaaggaaggcagcattgtgattccgttcccaagcttaactttgcctttggcatagtaagtttggagtcccaagattctattttctttcacatatccattagcagtcactcctctttccccctccccctaggccctggcaagcacgaatctactttctgtctctatgaatttgcccattttgaatatttcatataaatggaatcatccaatatgtgactttttgcgtctggtttctttcacttatcatcaggatttcatggctcatccatgaaatgtctcagtactttattaccttttatagatgaataatattccattgggtataccaaattttgttatgcacacatcagttgatggaaatttacaattgctttcattttgaggctactatgaataatggtgcatagccagtcatcttgatagagttgtctatactcactttctttttctcctcatttcctatttactcttcagcctactccagtttgatttctgctccagtcacttccctaaaatggctttctctggtgtcaccagtgatggctatacaactaaatcctacccatttttcagtgtatgttgctacctatatctcacagctctaatttgacactgtagtgtagaccatgtcctgtcttcccttgatatgtatgaaagtacactcttctggttttcctcctgtcaccatggctgttgcttctctgtctcttttgcagactcactttttctccttggctagtaaatgtgggatttactcaagactgagtccttgggcaccttttcttttcactcacaagacccattctaggtaatttgacctccacctatgccttcaacaatcatgtatgtgcttttaactacaaatttatgtttataagttagattttggaactgtatacctgtcaaggccagactaatttatttaccctgaatatataaccatcttacatttttttattttcttagaggatgatttccattactcactcagcttgacaaggcacaacatttttaaaaaatctttctgatggataataatcaaatagttaacagctctggacactggctgcctgggttcagatccaaagtctacacatactccccgtgtgaacttggagaagtcacttaacctttctgtgtctgttacctcgtcagtaagatgggtacttttcagggttgatgagatgataacatgaaatgtaaatacgctgaagattttagaatcatgcctggcgtgaactaaatactttaaatgttcaccattttccctctgcctcatctcccatctctaattcttttctttatgtctaaagccagccagacacacagcttcccggtgctttagatataaaggctaaaatgtgtagcctggcctgttgtattagcttcgtagggctgctataccaaaataccacagactgggtggcttcaacaatatcagttaattttctcacagttttggagactagaagtgtgagatcaaggtgttggtggggttggttctttttgagggccatgagggaaggatatgttctaggcttctgtctttggcttgtagaaagccattgttatcttcttgttgtgtcttttcacatcttcttccctctatgtgtgtctctttgtgcaaatttttgttttataataaggacatgagtcagattagattagaggcccaccgtactccagcatgacctcatcttaactaattacatctgtaatgacgttatttccaaataagatcacattctgaggtactaggggttaaagctgcaatatataaatttgagagggatgggacacaattcagcctgtcacgtttggttagtcttctgccagcctctccaggtacatttttactctatgctttctcagcctctcagctagccatccacacagtagccttcttttaaatgggccacaatcttccagcctttccagacctctttctaaaagatatttcttcagctagaacactcttaattccatctcactgccccgccccccaccccccacgacccctcagaacacaggccattttgcatggcttatttctgttcatcattcagatttcaggtcaagatcacttagtgaggaattctctcatcttctaggctggatcaattggattatgaatctatcaaagaatgtaacccctaaagcatttatcttgcttcgtaattgtacatccattacatgtctttttttcaccctgcctatttcaccctgaatgatttgtcttaccctttgatctacagatccttttgagtatataacaggaactcaatcagtatttcttaaatccaaacattacttaagtattgctattttgacaaatcaagatctttactattcactgtaaacagctacttttttcccctcatttttaacacctcatttcctctaataatattgcatgtactttgacatcctttcacttgactgcatccttttgcttgagggaaggtttaagaaaggacgcatttttcatcaggtgttctattcccaacacagaaaagttgactgaatagttcttctttgtttgatatttataatgtcaactgattattatgttcaaggtgatttccaagaataacagacaattagagtcaagccatgtttctgtcccctgaaatcctgaacctatgtgtgttggctaatgtgtgtctttgtatgtacatttttacttactctccaaaaatgtaattgaatgtgaaatttttaactagagccagaattccgtagtaggaatcccaacttctacacttactagctatgcaacctggagtaaactgcctcaggaagtaatagtatttgccctgtagggtgatagtaaaaattaaaggagctaatatttgtgtctggcacggggtatgttaggccattcttgtgttgctataaagaaatacctgaggctgggtaatttataaacaaaagaggtttaattggctcacagttctgcatgctgtacaagcatggcatcaacatcgaagctcaaaatcatggcaagaaggtgaaggaggaagcctgtttatcgcatggtcagagagggaataagagagaaagaagggagaggtcccagactcttttaaacaaccagatctcatgtgaaactaactgaatgagaaagaactcatcaccaagaggatgttgctaaactattcatgagacatctgcccccatgatccaatcatctttcagcaggccccacctccaacactgggaattacatttcaacatgaggtttggagggaatacacatccaaaccatatcgggtagtaagcaccaggtgagtgttatctagtagaaggaggaggagaatacatagaattaacaggactagaagtagtaatatatgtaaagaaatatttcagcacttagaatgacatggtttatccttttatatgcctcacaagaaagaagtctcttttgctcacctttgcatcctcaggacatggcaccatgcctgttagatgctccagaaatatttgttacgtgaatattcattaatttattctttcatttcttaattcatttacaaagagttgctttcattgttttagatttagttgtttatgcttattgtaccagtgcctatttatactacactgcaggtctggaaaaatattacattttaaatttaatttgggtgttgatttggactcactgagcctctgaatacaagcctacttgagacaagtatgtaggatgttcattagttctcaaatacagttgatttatattttataacttgaagtactcctgctttttagcatctatgtgtgaattagcatataaagatatgagtaattgttttaatgaaaatttcacctctgcaccactctactgtgactttattgtgaatgcaattaggtttaccatagcgttctccctgtgagcctgtagataaggcatggaaaaattatttcttttactataatcctcctgcttaaatatgataggaaggcaccaatgaatctaataccattaatgttctctctgaactgaaactccttaaatcataaaatatcacataatgtctttttattaaaatattgacattgtttcaaaatgtgcatttcagagcaagttttatatgcgttcctacaacatatgggcatgttcttcatttggtctttcaattaacatgatgattaagacgaagcgcttatttctgtttctgatgtgttatgtccctaccactagtcacgtttcctataataattcatcacacgttatgaagttttttttttttatgtagtttcttttaagctttcctttaatatatatctgatgatggagacttacatataacagagaagttttcttttggaaacttagcatgactatattttagtttcattagaaagaaagagaattaaaggatggatttttaagaataattcattgtagagttgctatactcaagtactgaagcactttaggactcataagggcatccgtgtcttgcataataaagcagccaagatggagtaaaacgtaaaagcagacatcgaggtcattacctaatctggatggattagccatccagatgcctgaaggtcaaggactgaacaagatatctcaaggtacctacaaattctatgatttcatgttattaggctactgagtataaccagagacaagatggccatgtggttggaaatcatgtagaattacaggttagctcataataaaggcaaaaacaatatgtcggttagaaatttcaagtataagtgaggctaaaagtattttgtgaatggcatcactccatcttttataagataaccctatacatttttctctgtgtacttctattgtaaatgtatagttctattatcacacttgccattttacattattgtcgtgtatttatgtgatgtaaatagttataggtaagtcttatttatctgttctctgtaggacctagcagggtatctggtacagtatgtatcaataatcattagattaatgaactaataaattaaaagtgttataccccattagtaacaaatgacaagtcccaaaatattattttattcaaagtatttgatgccttaatattaactgatttgtacagcccattatacattccaagagggcaagggcagtattaaactgcatccctgaacttaacacgttacctgaaacatagcaggcactcaaaaatactcgaaaaaacaaaccaataatagctttcatttatatagcacttcctatgtgccacacattgttctaggcactttaaatacagtgactcatttactttttacccatattctttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatcccatattcttaactaatacaaaatatgggctctctacatggtatagatcagctgtactttcagtaaatctgtgacttgatttgaaaatggaaaaaataggattcatctcctaagatgttctgtgaatattatataaggcagtgtttgaagcatgcttggcctagcgtctggcatagcagaagttttcaagatatttttactattaagactattattattgctgctattattaaccatctcctccaatagttggcataagagaggttatacaattcagaagacaagaatagagaaagcgaatgctatttgtgtcatcagctatttgttgtgtttacatttctgcccctcatctctatatcctcgtaagcacactccatcttccaagtattcctaggttaggtggcatttaatggtatgtgtagaccctgaagatttgattacattgaaaacagcaatagctaacacttctttagtgcatctctatgtcagtcactcttttaagtactttatatatattaacataaaaacccaaagaggtaaatgcactattattatccccattttatagaagagaaacttgagatactgagtagttatgagaagttacgtgacctgtccagggtcaataagctggtaagcagagcagctggtaggtgaacccaggcagtctggctacaaagttcctatgccatgttgctcagtacatttaaaacttctgtaccaaaaaaatcataaacaaaattttaaaaacagatggcagagtaggaagttgaatttaatagaaaaatatctatgcaaaatacataaagacttgcagcaaaccaaaagaacaaaccacaagtaattcacagaagaaatacaaatagttaaaaataaccaaacaacctcactagcctttaaagatatgcaaattaaaacaagataattttaccctcacaagcaaaaataaaacagaaagaaaagagagcaaaacaaaaaaggaaagtaaaaataggactttgttagtattacctactcaatgtctgcttggtatctccacagggatatgcaatagttatcataagtttaacacacccagaattgagcatctgattccccttcacacctgctccttttacagacttctctatttcagaaaacgtcagctccattcaactagttgcttaggcaaaaatatttagagccctctttgactcctgtcttcctcacaactcacgtgaacccatgagcaaatcctctcagctccattttcaaaatttatccaaaattctgccgtgtagttcagcacctccactcttgcctctgtcatcctgtggctggatggctgtgtccccctgttacatctccccctgcttcagcccttgccctcctatagtcttccgttcaacagccaatcggccagtcgttcctttatgtctcaagacagatcatcactagtccctggtcagaacacccccagggtctttccatctcactaaaagtaaatatagagtccttattaccgtggtcttggagactctgcagacttaaccccatccccttctttcagccccaactcctgcctctctcatcacattttccagccctcttctcccaggtccttctctccactgcgatgactgccttgatctttcttatagttggtttctcatctgctttttctctctgccgggagtgttctttctcttagagctccatgcagttcacatcactgcctccccgtctcaggtcaccgcctgagtagagctccccctactgactgttcctgaagatagcatcctgtcctcacacccttcactgtccgccattccctgcattattttgcttcatcctacttaatattttatatattaaattgttaatttgtttattctcttcttaccccttaaactccttcattgactataatatctgaaagcagaagtttttttttttctttttctctgtctctcactaatgcattcctagcattagcccttagcatgtagtatcttttaaatgaacaaaagaatattcagcatcagctgggctctgtggctcacgtctgtaatcccagcacttggagaggccaaggtgggacaatcacttgagcccaggagtttgagactagcctaggcaacatagggagaccatgtctctacgaaatacaaataaaaataattagcaggtgtggtggcacgtgccttgtggtcccagctactcgggaggctgaagtgggaggatcgcttgagcctgggaggcagaggtagcagtgagtcatggttgcgtcactgcactccagcctgggtgacagagcgagaccctgtctcaaaaaaaaaaaaaaaaattagcattgtaagtgttgcaaaatgtataggaaagtaaattttcacaactttcttggaggattatttgacactacctatagcaatttatttatttatttttaagtttcaatagtttgagaggtacaggttttttttggttacaaggattagttccatagtggtgaattctgaaattttagtgcacccatcacctgcgcagtgtacgctataatgtagtcttttatccctcacccgcctcccaacgttcccccccagtccccagagtccattatatcactctgtgtgtctttgcatcctcatagcttagctcccacctataagtgagaacatatggtatttggttttccattcctgagttacatcacttagaataatggcctccagctccatccaagttgctgcaaaagacactatttcattcctttttatggctaagtagtattccatggtgtatatataccgcattttctttattcactcgctggcccatgggcacttaagttggttctatatctttgcaattgcgaattgtgctgctataaacatgcacatgcatgtgtctttttcatataatgacttttttttttcctttgggtagacacttttacccctctcttgtttggcttcaagccaacaacttcacagaaatcaatctttctttgtcctcgtatgttccctcaatccctaacaaatgttcgatgaccacttcttgtccaaattcaatggctttattgctgttctatatatttctgaccataaaactccatttagtactgtcaatatcaatatttacttttgggggcaataaattagacagtttattaattgaagcatgatatatgtatacacacacatatacatatatatatatatatatatatatatgcatacctttgaatggatctatttatgtacaaactaccaatggaatttggactcacaacatcggttataaccaaaagaatgtgccatcttggcctgatctacccctcctcttttgatatccttctatgcctattcttattaaaaagaataaaattgttttaaaagaaagacaattccactcattatatcacttaatgtaatccttgtgttggcacttttgcctttcattgatatagtttcaaccataataatatatgtaatgaaagtttcaaacttttcagaactgcctatttttggcggggagaggtaatgtgtactaaaggtaatccatattttatgtaaaaagtaaacacaaagaagtaaaaatcagttgcaatctcatcatctctacacatctcttattagtttgatgtttattatctccttttttccattttttcatctaatggagtctgttttacaagctgattttttatatagtacataatagttaatgttattaacataatagtttgctattatgtatactttcatgctatcattttatggctgaatgaaaatgccatttttaaccttgaaaaaaatcttttacttgttctagcagctttcttagttatgttttctttattgcaaaagtaaatattaatagcatccatccttaatacaaattatacttggtgactcagtcaatttaatatataatccaattttaaattttgttgttgttgaattattagatgtttaatgataaataacaaactaaaatattctaaaatcagccaataatttaagtttgtctttacattctctgcttcatttggctaaaatgaatacatctttaaaatgactagataaaatgatagtcatttgtcaattaatgataacctttgaggcttagtatagaagatatattgacaaatgggaggcatgtgccaaagctttttgcattaattgcatcagtatgataactttagtcactacggttccttcaaaatgtattcacataggccaacaaaccttcagtcattttaaaaaagcagtagcatctaatagtccaaggcaatagcaatccatgcacttctgtgacagagagggtgtttcaagaattttggcaaagactcacacttgaggaccaaggcactaaaggtattctaagctcagagagccaacggccattgcctgcttagctgaaatgaggtgctggtgtggagaatctgccctaggttgtataagccttgcacagcctgcttcaaaagagagaactggaggagatctagaggtgttctgagggatgtggtgttataaagagagtccattttaactctgcctcacccctttgtgggcagagctgttaaatggcctggttgctcctgtttttcctgcctcgtggaaactaaccaccacttaagaagtgcaactaccctgatgtgagaagtctacttgcatggtcatgacagaagataactaaatcacaacatctttgtaaattatcacatcatggcctctaactataggttggtgcaaatgtaattgaggtttttgccattggaagtaatggcaaagtaatatttgcaggcaaattgactcacaaaaggctgggcttctgggacacaggaacaattaaatgaagagggaggaaaaggaaaacatttatatgtatatgcttcacctttttaaaaaacaaccgagaatttgttaacattcatattatacttttaaagcattttaatttttcctattctataatacctgaaggatatggaacaattacacataaacatacagaaaattagtttaaaaaaccatccatgttccttctactcatcattaaccactatgaacttggaatataaccttcaaggcatctttctgttcaatttatgtaaatatgtctgattatacacaggtgattagcacagaggcagcataacatattaatgaagaccaaagctctcaagacctattgttcaggttcaagtctcagcatcctctcccccaccatcccttaccagctgtgtgaccttgattcattttcttaacctccctgtatcttatacatatgggtatgatactggtgtttactaatcatggggttgttatgaggatatttaatcacttagacttaagctttctaaagaacttaaaatgttcctggtacatagtatgcacaaagttagtgtttattaaatagaataattacatttcaaaagaaaaatcaaagaataggataaacagtattttaaaacatgctttcttaagaatgtggaataaacattcctcatcagtaaatacacatctatgctattgatttttaaaagctgcatagaatttcattttgtggataaagcatagttcctgattttcatacatttatgtcattccattttttgtttataatacatttcaacttttattacgggactttccaaacatacaaaggtagatcatacagtataatgaaccttcctgtacccatcacccaggtacaataattaccaacacatggtcattccttgtaatatattttaaatactcattttattccatcgattctgataagactaagataatggtcttaaagtgaagagcttccacatcttaagcaacaatattagggtatttgtgtttacgttagaaagacatgccttactctgtcctcaagataatggcttttatctgatgccaaagttaaaaagatcagttcctttattcaactccagtgaacatccttcattatatcttgtttccttctgatatatctgagaagaaaatggaataatttagaagatgccagtgggataaaacactatattcctaaatatagtgcagttttcagagctattttagccactgtaattgaaatcctcttgttctccactgacatattttggaagcccatatgtttagagtctgaaatttcattccaaaaatgatagaaagcctcttgatctcagaatggagagttactgaactgaattaaaatgggcaaaggcttcagtaaacttgaggaagtaatgtatggccttccacgtggattaatttcactctctatcctgggaagtatggtacccaggtagcccgtgtgaaaaatatcatgttggtgatgtccgtatgctaccatattagagacaaagtcatacgttctgcgatgctattttctaggcggtttgtttctttgcattacagtagtatattcggcaccacacagaagttaaaattataagagggaagtaaccttccttagtgagactacaactgtgaagctataactaatagacactaagatagaaataaattattcttatgatatataacataagcatgagcatgtaatattgttgggagctctagcagaaagtactacagtagtagtagttttttttttttttaagacagggcccggctctgtcactcagcaggctggagtgcagtggcacgatctcagctcactgcaacctctacctcctgggctcaagccatccttccacctcagcctcttgagtagctgggactacaggcacacgccaccatacgtggctgatttttgtattttttagtaaagactgtgttttgccatgttgcccaggctgctcttgaactcctggcctcgagcaatccacccgctttggcttcccaaagtgatagtactgcaggcgtgagccactgcacctggcccagtagtccattaaaaaaaaaaaaaaaaaaaaactcattgagcacctactttgtaacaggtactgttgtaggtgctagggataaaatatacttgtttctcctactggatcttgcttttcttggagaaagaaagaaacacaatgtcttagtccattttctgttactataacaaaataccacagacagggtaatttattttcaaaaaagtttattcagctcatagtctggaggatgggaattttaacagcatagtgctggcatctggtgagagccatcttgctatgtgataatatgtcgaagggtatcacatggtgacagggcaagatctttcttcttcctataaagccaccagtcccatcatgggggctcacccttttgactttatctaatcctaattacctcccaaaatccccgcctccaaatacgatcaacatatgaatttgggaattaagtttccaacacataaagtttggggaacacattcacaccatagcacacaataaacgagcaaaaaatactatattagatcataataagtgacatgaagactgatgcaacaaaataaaggaggtaggaggtaccagaggggaagaatggttattgttatttcagatacagtgttccaggaagaaactggtatctgagtagagagttaaaggaagtgagaaagtgcatgttgaaatcggtgacagaggtaaagacaggtgcaaatgtcctgaggcaggaacatatatcatgggcatattctagataaggctttggcttccttatgcttcctttttagtggggaagacagaacgcaaagcaaatgcaaaataaataatatgcagtcaggttgagattagtgttatggaataaaagaagagagagtaaacaatgggggaaggaacaacattaagtaggataatcaggagacttctctggagagatgacccttaccctcagacctaaatgatacactacaaaataaatgcctgtacaatcactaaaggattaacacaaactgaaggtaaaaaccattgtgtaagcgttttcctgaattcaagaattagattattattctgaagctattttaatattgggaaaatcttgttagcatttttttctgacaaagttcaaataatgatttctgaaatttaattctacctaatactaggtgtactttagaaaaataaccaaaatgagctgcagaagtattttactttattataataaatattacagtatgcatcatgaaatgaaagaaaaataatcctttgcctatagttttattatctccaaatgagtagaaactgaatgatgcatttggcaaagcacataaaacttcacttaagagatgtctgttaatacttgctgagtggaaaataatagctagcatttgtttgaacgcttgatgtgtgccaggtgggacactagggattttacaaacactaatccatttaagactcatacacctctgcaaggtatgtagtactattcttcctcctaggtagcctgagtcagtgtcaaagaggattctgtcttgggtctatgtgatttcaagtactgtgctcctttaaccccactcttaattgtgaaaatctttatcacaggactctgaaacttcctgtgattcactttctccatggtgtccacagtcctttcatgctatatgtaccacaaatagcatgaaaggacttccttttaacctaaagcctttttacaattaacccttgcaatttacgctttttgatttttgtggttagtgtctgttcttgtcaaaattgtgaattagagcaagtttctccttgatgtcatcacacttctttgaagtcatcaagcatttagttctcattaggcagaacaggccctggcgactcaaagtgtgagcaggagccagcagcatcagcagcatccccaaatctgctcaacaagagtattaacaagatccccatggaatctgtaggcacattaaagtttgagaagcgcagcgttaggccagcatcagcaacacttgggaccttgctaaaaatgcattatttgtacccgaagctccaggaatgtggcccaagaatctttgttttaacaagccctgcaggtgattctaatgcatgctcctagagagttactctttctcgggattgacatcagcaataccgacctgttgcaataaatcagtcattctcaagtctgtctgcatatgagaatgccctggaaagcttgtagatcccaggttccattccaatatagttggtctcaactatattccaatctgcaggatgggaccatggcattagtgtgttgttcgtttgtgtttgtttgttttcctgtgggctcctcagtgttaaaaatcattgccatagaattagaagatcagtattttaccactctcaagggatttactttttaggagaaattcgaatctccccaaaatagtgcccaaaggactaatctaaacacctgagttaccttcactgactatataactgccacttctgcccttcagcatgacactatgtctctttcctcattgaaaaatacataaaaggggaaattgtaacctctctattcccattggactattgttgagatgaacaaatgagtgtgagagtaggcacttgagaattctcaagtgctatacaaaaaaaaaaaaaaaaaaaaaaaaagctcgtggtctatctgagggtgggatgcagctctgctctgatgtgtaattatggataagtgatcagaagttcagaagttctcagacatcacagggactgcagctttttatttgtttgtggtgtcagctgaaaaagtgctaatgagatacactggggacagcctatggaaaataatctcatgaaatttttagaaaaagggagtatctatgatgatagttctgaaactccaaagctgtgctcctcagactttaatgtacacatgaaactcttggggatcttgttaaacaatactgaatcacaacaacaaattgtgattcagtaagtctagggtgagggctgacagtctgcctttccaacaagctcccaggtgatggcaacaatgctgattcgtagaccacacttttgagtagcgaggggctaaaacatacacaataattaggcctgttattttgcagatgccagtgtgattaatgaatcctgcctatgataacattcacgagtctgccctgaacatttttctgttcttttaaccctgattgcctttgccctgtagctcacatatgatctgtacctcctctttcttgcttacatataatagagcatattttatatatactcatatccagttataattctctaactatgagcaattgttttgttgagttttgttgtcagtgttcatatcataaattgcctcccccaaccttctttcatctctacaattcctttcactcttctttttgaactggcctgtgagtgtgctgttcttgccagattaaatgaatcagtcaatgggaatcttattcttaagtgtattggatcagatatgtacaagtgttgctcatgaggagagaaaagaagatgggcgtgcatgctattgattaatgtagtcacagaaatgcactggtcaatatgatacaagctgtttgcaaccgtaatagtcctgtgctgaggactattaaaaaactgaattggttaccactataaccactacagttatgcttttatttgggtaaaaataatctagcatgttgtggtttagcaacagaatgctgaagaacaccccgatgtgatgtttgaaggagaaaatccaatctattcagcctaatggtttgctacagtagttgaaaaaggcataaaaaatccaatctcctgggtagatgtagctcattgagtggggcatgggctggatttccatacccatcattccttggctagttctcttctgcaggacgtgaccttcacatctcatactgagtattgtgtaatcatcttctggtatctttcttctcttatgtccctttactcattattctttgttccccttttcatctttagtcttcctaagggcttctcagtttttttcacaggggtatatagatcagaaccaagtcctttcctaagcctgtgtctttatttcacaattcaacaaggaaggacactacagatcacatagctcacctccatacatcagagtataggccttactgatacatgcacacatagaaacaacagaagctggcggagcatggtggctcacgcctgtaatcccagcactttgggaggctgaggcgggcggatcatgaggtcaggagatcaagaccatcctggcgaacatggtgaaaccccgtctctactaaaaatacaaaaattagccgggtgtgggggcgtgcgcctgtagtcccagctactcgggaggctgaggcaggagaatcacttgaacccaggaggcagaggttgcagtgagctgagatcatgctactgcactccagtctggtgacagagcaagactccatctcaacaacaacaacaacaaaaaaacagaagccaataaataaattctgcagatctattgtgcagcatggtgactatagttaataataatgtgttgtgtattggaaaattgacaagacagatcttaaatgttctcaccacaaacataactatgagaggtggtgcatatgtaactatgagaggtggtgcatatataactatgagaggtggtgcacatataactatgagaggtggtgcatatataactatgagaggtggtgcatatataactatgagaggtggtgcacatataactatgagaggtggtgcatatataattggcttgattgtggtcattatttcacaatgcatactgttaacaaaagatcatgaaatttgcaggggcaaaaaggagagctttactttcctaaagaaatttgtaggtgggggagacgcccctttgggacagagcaaaagtgtgctccaaggagacactggagagttaaagattataatggcaaaaactgcaagactggggagagggatcagagtcttgattagatgacatttaagcctaaaaccacaaatctctctttgttttctgactctaggtggtcagtggttggtcacatgaggattttccagctgtagtctattttgagattgataacaggaactggtttagcttgattgcagaaaggggagtctcgtgacatttctgcaacattttttgagaacacagtgtatgtgactacctcctcatcttgctgtggcctcccagttctgctttaacttgagcatctcagccacagggggtttattttatctatatgttggggcataatttgacaatacatacttcaaaacattacattgtacactgtacattatacaatttttgtccattacattttggtaaagctggagataagaagaaaggcaagggggtaaaaggagaaacggaatacaagacaagtattaatgaatattttactacatgtaatgtttggttaattataagatgctaagctaaacaaaaaatgattttaaaaatgtcatacacaaaaattattaaaagttttattagatttccattaattcatctttaatgattttacagaatgacaaatgtgatgttttcttcattttaacccagtgtacaagtaatacattttttcttcaaagagtagtttcttataaaaatgtatagttttgttttaattagtaatccaccgaattacatcattataatgttctttataaggggatttattttctattatttaaatttcctctgataaatttttattgtgatatctgccaccaacatcttatagttaaaatagtatgcaaactaatggtcgtgcagatagttactagtataggcttaatactatgcaatacaaggagatgctttcattaggccaatggtttcttatataaaaattacttctttaaaggtctgtacagctagcagaatggcatttgaggggatttaggtctcagcctaattattacctttttagagctaacttctgtgaccaacacagttaaagaagttcaaagatcaccttatttaattttctacataggacttattaatctctgataccatgtggtggtttcatccttgtttaacagtttttctgactctcaatttcaagagggtaggacacttctcattttattattgtatctttaatgtctgtgacaattccaggcagcatggtacataggaactctataaaaattattgaataaatgcatgaatacatggtcaatatattaaaataaaattaaaatttaaaaaaaaagccataaaaaggtaatttgagactgggcacggggcagtggctcacacctgtaatcccagcactttgggaggccgaggtgggcggatcacttgaggccaggagttcaagaccagcccaggcaacatggcaaaaccccgtgtctacaaaaaaatacaaaaattagtcatgtgtggtgacacatgccagtaatcccagctacatgggtggctgatacaggagaatcccttgaactggggaggcagaggttacagtgagccgagattgtgccactgcactccaacctgggtgacagagggagaccgtctcaaaaacaaaaacaaaaaaagataatttgacaaaaatggaagtcgctcaccaaatactttgaataatgtacctactgtgattttgtatttcaagctacaaaataggaaagacattgttcttccttatttttgtttcttttctaacctttttcttttattattctataatatattggcatttcctttagcaaagggagttgtttggccttgcatccttcatacaaatagcaaatatttacacatacacacactcatcgctatgtaagtcccttgaagttcaagtacacagttactcatctgaggtatgtgtgtgtgtgtgtgtgtatatatatatattctgagtgtgtattttgcagctctagttttttataaatgtgtttctcacccctcgtagtcatttgtatgcacttaatgtaattgtcagaagttataaataaatatgtggttgttgtattttcatcattaggttgtaaattccttgtgggcaacaagcatcatataatgaagaaattaaagaaatcagaaccattacattgaaaacatgatgctttcaaatacacttttgaatgttcacctcagtgttctaattaaattctaatttcggtatacatatctccttatctgaatgcctttagcaatttgaagtgactgagtattctgattcatcccatattcaatggaagcatatcaaaattgtctgccatttaactgtgctatcacaagctataaataggacactactctctgccaaaggtgaattaattgtgataaagctatcttgataaaacttattcctcacttaagtgaaacatgcagtacctgattaatttctgcaacagctgtgttaaaagctctgcacttaatatcaaacttctacttcagtatatgtcaccatttttacagaaacagaaagtcccttgcatttgattagcctcaaattatggctcattgatgaatgcaaataatcaaacaaaaaaggactaattgtatagaacaagtaaatattatacatacagtgctcatttgcctacaattacacaggtaatgtctctatttagtttcttaatttctcattatgagacaattgcatctcatctagcagtatttaattgcattgtttctattgctagaataatagcatattcctttttttaagatgttgaatgacaaataaatttagattgtaatcacttattgttccttctctaagcaaaatcgcccaggcgtttcagttgcaatgaaaagttttattttctactaatgatggccaaaatgggagcattctagataagtctgtatcctgtctatcaccttcttcttcagttgtggtcataaccatgatcttaataagtctacttgactaataactttactattttctaaaggtgtcactataaaatcttacaatatttaacctcacataccaaacccctacaataatctttgtttctatttgtaactttacgtgtctgcattggtaaatgtcaggtacatttggaatgacaaacatgcagttacactgagtctagtttgtagtttcttatcctaattctcattctgaccttaacatcaaatcctctactatgagacagcagtattaaataaaactatcacctagcttctgagttatcttgtaagcataagtgaaatcttattcacaaccgtaagtgaagtcttgtaaccgtaagtgaagtcttatttacatgtttacatgtgttttttatgcttcgtgtattttctaaatgattcacttgctcttagccttttgcaaaaagtataattttttattgctgccgtaataaatacaacaaacagtggcttaaactacacaaatttattatcctatagttccataggtcagaaacctggcacaggtctcacttggctaaaatcaaggtatcagtagggcctcatttatttctggaggctctaggaaagaatctatttctttatctttgtcagcttccagaagtttctcacattccttggctcatggtcccttctgctatctttaaaggcagcagttatcagttgagtccttcttacgtggcatcactctgactcttctttcattgtcccttttctccctaactgcagctagaaaagattattcatctttaaagactcatgtgatcagtttgggaccatctgtataattcaggataacctccccactttaaagtctatagccttaatcacattttcaaagtccctttgccatgtacaaggaaatattcatatattttagtgatgaggatgtgggcatctacagggggccattattctgcctactacatatggtctcttattatttagcatgtctagtgcagttgtgtggggatgctggacttcttaacatgtgacattagttaggcttatgaagtcaagcattatagacattgcctgttaatgttgaagcaagcttgaacagagccacgcttcatctctagccttggtttgcttgtttttcctttcatttattattatttttcagtgaaaattgataatagagctgccttttctttttgcactggcattattgcattgcactactgaagaaatcactaaatctgtttattttacagaaaaagattgagggtccagttaaatttgtgtttattcaggacaatgagctctgtttttctcacttgggaattctccctcttgagacagatttcccaggtacgaccaagagttaagagatcaaagttttgtctggtgagaacagaacccaaatctctaggcaactcttgttaactaattttggggataccacagatacagattggagaacttttagaaattcatatcaagtttgatttatttaatattcatatttaatatgttacatgaatgtataatccaatgtaaatacgatttatttattatggaattgtttaatacatgacatgcttatagttataccgttaaggaatatctcttattttgcaacattttacttttttcctctcccaagtgctttgtgaatttcactaaataaatcagggtaaaatgcatgtagtttagtctaaaaatacttaataatccacccagagggaaaatatattttaatgcttgctgcataaccttaataaacagagaatactaatgtgcacttataggttaaagtaatatgtttaaaaatcatttcaacttttattttagagtcaggggatacatgtgcaggtttgttacatgggtatattgcataatgctgaggtttggggtgtgaatgatcccgtcacccaagtagcgagcatagtacccactaggtagtttttcagcccttgtccccttcccccactccccacactagaagtccctagtgtcttctttgtccatctttatgtccttgcgaattcaatgcttagtatcatttttttgaaacagagtctcgctctgttgcccaggctggagtgcagtggcacaatctcagctcacggcaacctctgcctcccaggttcaagtgactcctctgcctcagcctcccgagtagctgggactacaggcacgcaccatcaggcccggctactttttgtatttttttttttttagtggagacggggtttcaccatattggtcaggctcgtctcaaacccctgacctcatgatcttcccgctttggcctcccaaagtgctgggattacaggcgtaagccaccgcgtccggctgcttagtatcatttataagtgagaacatgcaacatttgatttttttgttcatgcattagtttgcctctagttgcatctatgttgctgtaaaggatatgatttaattcttttttatggatgtataatattccatgatgtatgtgtaccacattttctttatccagtccactgttgatgggcacctgggttgattctatgtctttgctattatgaatagcaagatgctggacatttccttaggttttagatggtttcttttgaaatgtatattgttaggtttaatcagtcctttgtatatagttgccttttgtgagaaatacagtaccaggtagcttgatataccattaaaattaagcatatagatttacctgctgtctctaatgccgttatgtgtgacaattcccatatgaggtaaatttaatgagttcgtttcttttaatatctagactaactaatgccttcaggaaagtatgaaagtatattgtgtctctttagtgaattccctttagataggcttaagatagccatatggctctaaacttactaaatgcagaaaatttaacttagctttacttctttcattcttaggaaaacagtcttcattttgttgattaacttccatttaaatgcttattttatactgtctttatttggactatgcttcattaagcctcaatttccatttaattttgcttgtgtcttattgttcgagttcctatgtctcagttcactaatgaaatgttttctaacctgtgaaaattcagaagagcacaaagatccatataaaagtacatttccagtttctaaaagaaaaattaaggtctactgggactctggtacactgcaaaacataaacactattcttactccaaattatagtcattgaggtctttcaattcccagctcccatatgttaaatctacctatctgataatgatattagttgcaaatgctttattgcttccctttgtatcctgtttcagtagctgttccttgtaaccttatcttgacattttcaaattcggtttgaaaatacaactagagtttaccattatttatggaaggtaaatgttaactgacattatatttacatttaggatgaaataggtgaatgctcaggtacaaataaaactaagtttatttatttctctgcttaattcaaaaggtgtataggttcaggtcatagcatagtttagggcaaagaaagtagaaatgagaacacagaacgcaggaatttgtcagttttgtgcatctatctcgtaatctaatctcagctaatgggactttacatttaatcacctttccagaccaagtctccagacccagctgaagttgctgttcatccatgcccaaatctcttttgctgacctcctaatcaagattctagtgtgttagcgataaggtgtggcaggcaataacccagtgatcactattgcttgtttcccccgacagttgtgccctgtttacacacttgagtttctctccttagttctgatttagagccctcggccaggttctcgaaatcactagtgatcttgaattcaaccacatggcttgcattctagcccttgtgcccaaacaacatgatcgaatcatttcaattgaaatacatactatcgctattgcactcagtctccatccctactgtctctgtctctgtccctgtctctgtcttcctctctctctctctctctgtctgtctgtctctccccttgaacaacctggtccttaattccaggcctattctctacaataagttcagacatttttctgcagtccctaagtaggcaaatctgaagacctcctagaacatccagcaagctttgcagttatatcatactgcagctatgaccatgcataacctttatttgacttttatttgaaaccatattttaatatactgtatttattatagagaagtttcttacattcaatgtttctaaatttacctttcacctatatatggtagctccctacatatagaatattaaaatttactgaagtaaaaatgtatttttttctcttttaaagccaccataatttgatacaattaaattatacggtgatatagtttgcatatttatccccatccaaatctcatgttgagttgtaatctccaatgctggaggtgggacctaatgggaggtgtttggatcgtggagacagatccctcatggcttggtgttgtctttgcatcagtgaatgagatctcacaagatccagtcacttaaaagtgtatggcatctccctccacactctttcttattccttttttttttttttttttttgccatgtgatgtacctgctcccccttcaccttctgccatgattgtaaacttccagaagcctccccagaaggtgagcagatgccagcaccacgctccctgtaaagtctgcagaaccatgagccaattaaatccgttttcagtataaattacccagtctccagtatttgtttattaaaatgcaagaatggcctcatacctgtggtttaactgagcacttaattcctttattattttagtgcagatgtctccatttttttcctttgttcatgaaacttttattgggaaaatgctaaatgagagttttactactatgaccacggagagtaggatgcacttgtgcaaagtctgggacctccagaagcttgcaatttaatcagtgaaacagactggacataaacaactctcttaacttctcagtgattggaaatgcaaacagtattctatttaaaaatgccatctggctttcataaggtttggaaaatacttactacttttaaacagcaaatcctccaatatttgaggtttgcaatgctaagcccatagggcatgaggcaacataaccctgatatgagtaattttgatgaattctccatatttagaagtaaattgtgtatcttgataataaattttataatttcattattgagtttcttcatacattttggaaaaaccccacggccctctgatttatttatagctgatttgtcagttagatgtaaaatttcctgcatgttgatcacataacttgcttttcctgtttgatttttttgtcctctataatttttttcagctcctaggtttatagatatttttaatgtagcccatattataataattcaacaattttcaacatctttaaactatgatttaagtatattttgctcattaagaattgctacctcctaaatttaataagaagattgaaagaagaatagctgttgacagtaattaataatattcttccatgtaggagctacatggcaattaattatttttcaggaaattcttttcacttttttgttaagaatatttcattatattatttttcagcactgtcagttttctaacattcatgtagctgttaatttattcataacttgaattcattttcagtgtcattcatgcagctttggctttttttcagcttgcttatattattttgtatatgaaaaatggataactttttgactaatttccttccacattaaaactgtgtagcattcttttctggttctggagaaaatataataatttaaggagatacattatgccatttatttcaatatattttaaaaccagtttattttcatgctatctaaactgctaactggttcatcttaaatttggtgatcctctatagtttaataattgtcagaataaagtgtttgagtaatcaagaatagagctaacaccaatccattagtttatatggtttgtactgattaacatcatcccattctgccatgggccttctcacaaaaatcttaatgagaaagagagacagagacactaaaacagtttagtgagaagtcaccaaaaaatttcttactagttacttggcacgcaataaggttgtccttgccaatgacgctaaccatgatgacatattaatcaatcaagaaatggtcatttatatcaataaatattcagttcttctattatttctcctttgacagtcgtgatttttctgtcagtctacatcaccattgcttccagatgagcctcttttagtccctctctatggtatgcccaagttctattcttcctcactctaggtggctgcaaacagttcttccccctcttggccatgtgtgaaggaggatggaaatgtgatttctgtaaaggctcctgccatttactttgcctgttacattgtctggcatttgcttcatttctatttcatttcttttcattgccctcttcattgtctcttactctcctttcttgtttttgcctcttaatctttattgatttttttctttatttgattccttacgcttagtcctcttcttctgtcattcttaatgaattcattcattttctattgtttcaattgttttctttttttttgttttttaaattgtggttttttcttttttaaaaaaaattttctctttagttttcatcatttaaaaattagcacagatagaatattccttagattaggtgcacacaaatattgaatatgtcattaaataacccgttattttatattatttgtactgattaacaccataccattctgtcccataaattcagaataaacatattgttttttgtatgttgtatgtcgtgtatgtataaagccatcttataagtttcactctgcatatgcctaggttacatattttggcattaagaatatcattaaaagccaactgtttttgagaaaacttttaatgttgggatgtaaaaaataaaccttattgaattcatcataattaaacagatgaatagcagcaataaattcagatcctgaataagaatcaaaccacaaaggttctttgttgactgaaacacaaaaatatgtgtgcattaattttattcttttgtaaagtgttactctaaataaaattactggagataatatcttgggtctcaacaatatcatgctttgcaaagtatttgtcactgctaattgaattttgtgtgtgaatataatgcatatctatacaaatagaacagcctctaattgaatctgggaggatttgaatattgtttgagtgttggccagtctactgacagatttaatcaagaaatggatatttatataaaagaattgtgcttaggagtaataacccatttagtcacagattcagtgttaacggattgaaaggtttgtggtatactctggctctatgagttttaatgaggcttcgtttcctcactttttttttcttttattcaggaagtgttaatgtagcatgcatttcagccttatgattttgtcaaatataatgtttatgttttattcattttggatcccctcctagaactgttattcacatatttgctactacacacatatcagatgagattcattgcagaacacacaactttaggctatatgtcaaatacgaatataaaatacaaatacataggtcagttcatttgtcattcacatttaaaagtggaaggtttaatataatcaattctctaatcccggtacaactgttcccccaaatctgttgaacccagccctctttctgtttgcttcctcaaagtaatgtaatggattttaaaacctatggtaaataaaccagtagaaattgaacttgtctattgaattataatctttgctgtttatttccttctaaacaagtttttattgatatataatatctgtacatattttgggggcatatgtgataatttaatatattcatataatttgtaaagatcaaatcagtgtaattgagatacagtcaccttaaatatttgatctttctttatgctagaaacattagaattcttcttttttctttttctttttcttttttttttgagatggagtctcactctcttgcccagacctggagtgcagtggcacgatcttggctcactgcaacctctgcctcctgggtccaagcaattctccctgcctcagcctcctgagtagctgggattacaggtgcatgccaccacacctggctaattttttttgtatttttagtagagacagggtttcaccatgttggccaggctggtctcaaacacctgatctcaggtgatcctcccatctcggcctcccaaagtgttgggattacaggcgtgagccatcgtgcccagccagaattattcttttgtagttattttgaaatatacaatagattattgttaactatagtcaccctactgatttatcaaacactaagtcttatttcttttatcaaactgtgtgtttgtacccattactcaacttatctttatcccctctttcccttacccctcctggcctcaggtaactgccaatctactctgtatctttatgagatctactttttcagctcccacatatgaatgagaatatgtgatatttatctttctgtgcctggttaatttcacttactaatgacctccatgttcatccatgctgctgaaaatgatttaattattttttatggcggaataatattatataatatgtacacacaatacatggctgaataatatttcattatattatgtatatgtatatatgtcacattttatttatccattcatctattgatgggtacctacactgattccatatttgggctgttttgaatagtgctgcaataaacatggaagtgtagatctctctttgatatatttgtcttttttcttttggatatatacccagtagtgggattgctagataatatggtagctctatttttagttttttttgagaaccctccatacagttttccataatggctatgctaacttacattcccaccttcctctacatccttgccagtgtttgttagtccctgtcattttttaaagaccattttaacatgggtgaaatgatatctcattgttgttttggtttgcatttatttgatgaataatgatattgaaaatttttcatatatctgttggccatttgtatgtcttcttgtgaggaatgtctattctgatcttttgctcatttcttaatcagattatttgtttttttgcggttgaattgtttaaactcctcatgtattctgactattaatcccttgtcagatgggtagtttgcacatattttctcccattctatgtgttgtctctttactttgttgattgttttctttgctgtgcagagctttttaggcggaggtaatcccatttgtctacttttgctacttttgctttggttgcctgggcttttgaggtctcacacaaaaaattctttgcccagagctatgtcctggagcatttccccaatgatttttttttctagtagttttatagctttaggtcttagatttaagtttttaatccattttgatttgatgtttgtgtatggtgagagttagaaatcttttttcattcttctggatgtgattggttatccggttttcccagcgctatttattgaagagactctcctttccccattggatgttcttgttgcgtttgtcaaaaatgagttgtctttaaatgtgtggattaatgcctgtgttctctattttgtaccattgatctgtgtctatctttatgtcagcaccatgctgatttggttactatgtctttgtagtatattttgaagtcaggtaatgtgatgcgtacacctttgttcattttgctcaggattgctttgcttatttgagtttttttttttttttttgtagttccatgtgaattttaagtttttttctatttctgtgaagaatgtgattgatattttgatagggattacattgaatctgtaaatagctttgagtagcattgtcattttaacaatattaacaatattaattcttccaatcaatgagcatgaaaaatctttcattttttatgctttttcaatttatttcgtcagggttttatagttctctttgtgtagaactttcactcctttggctaaattgattcctagatattttatattctttgtagctattataaatgagatttctttcttgatttctttttgagattgcttgctgttggtgtatataaatgctattcatatttatttggtttttttgtatcctgcaaatttactgaatttaccaattctaacagttttttggtgaactctagttttttctaagtataagatcatattgcttgcaaaaaggctaatttgatatcttcctttccaattttgatgcctcttatttctttctcttgcctagttgctctgtctaggacttccattattatatcgaataaaggtagtgaaagtgcgcatccttgtcttgttacagatcttagagaaaatttcaattttttctcacttagtacaatattagctgtgggtttagcatatatgcattttattattttgaggaatgttccttctatacccagtttgatgagaatcttttttatcataaagatatgttggattttatctaatactttttcagtatctattgaaatgatcatgtggtttttgttctcatgtccttgtatcgtatttattgatttgtatatgttgaatcatccttgcatcccaaggatgaatcacacttgatcatggtgaatgatcttttaaatatgttgttgaatttgatttgctagtgctttcttaatgatttttgcatctgttttcatcagcgatattggcctatagttttctttttttgttgtgtccttgtcttgtttttgtattcaggtcttacagaatgagtttggaagtattttctttttgtcaatttttttgaagaatgtaaatagaattagtattggttcttcttcaaatgtttggtagaattcagcagtaaagccattgggtcctgggctattccttggtgggagacatttgattatggctttgatctcattaccagtttcttcacattttctatttcttcatagttcaatattcataggttttatgtgtcccagaatttatccatttcttctaagttttccaatttcttggcatatggttgttcataatagtctctaatgattctttgtatttttgtggtctcaattgttatgttttctttttggttcctgattttatttatttgggccttctgtctttttttcttagtctagctaaaggtttgtcaattttgtttcttttcaaaaagccaactttttgttttgtcgatcttctgtacttttttgccttatgtcctaccattaccagagggtctcctatattccagggttttgtttgtttgtttgtttgtttcaatttcgtttgtttctgcttagatctttattatttctttccttctactaattttgtttttggtttgttattgcttttctagttccgtgaggtgcattgttaagttgtttatttgaagtctttctacttttttgatataggcacttattactatgaactttgctagtagtactgcttttgctgtgtcgcatagattttggtgttgtatttctattttcaatcatttcaagaaagttttcagttgcccttttaatttctttattcattcattgatcattccagagcatgttgctaaattatttttatttttatttttattttattatttgagacagggtttcactctgtcacccaagctggagtgcagtggcacaattacagctcactctagccctgacatcctgggctcaagcaatcctctcacctcagcctcccaagtagctgggactagtggcatgtgccagcatgcccaaccaatttttaaaaatttttgtagagacttatatttcccatcttgcccaggctgctcttgaactcctgggctcaagcagtcttcctgcctcagcctctcaaagtgctaggataataagcaggagccaccaagcccagcctgaatcctttttttttttttttggtatagagtcttgctctgtcaagtgcagacttgacagagtgcagtggcgtgatctcgactcactgcaacctctgcctcctgggttcaagtgattctcctgcctcagtctcctgagttgctgggattacaggcaccccgagcctgaatttttacgtgcttgtgtagtttccaaggttcttcttgttattgatttctagttttattccattgttgtcagaaaatatactgatgtgatttctacttttctgaatttgttgaggcttgttttgtggcctaagagatggtctaccctggctactgtttcatgcactgataataaagaatgtgtacttggtaacagttgggtgaaataatttttcaattctagatagccctatttggtttagtgtgtagtttaactgtgatatttctttgtcgattttctgtctggatgatctgtccattacttatattgaagtgttgaatcccatacttttgttttattgcagtccatctctccttttaaatctattaatgtttgttttatatacttgggagctctggtgttgggtaaataggtatttataattgttccattctcttgctgaacagaaccctttatcatgatgtagtgaccttcttagtctctttttacagtcttttattttcagtctactttatttgatgtaattatagctactgctactcttttttgtttaccagttgcatggaatatcttttcccaacacttcaatttcagtctatgtgtatctttataaatgaagtggaattcttgaaggcagcatatgggtaggacttgtttctttatccattcagcagctttatgccttttaattggataatttagtccatttacgttcaatgttattattgataagtaaggacttactactgccattttgttgcttgtgttctggttgttttagaactcctctctgttcctttcctattgtcttcctttatggttaagtgatttttctctggtagtatgttttaatttgttgctttttcttttcggtgaatgtattattggtttttgctttatagttactatgaggcttatgaaacataattataacattcttttgaagagacgacaacttatcttagataaaaaagaaaagaatagaaacaaataatgaaaatataaaaataaactctacattttagctacatccccccacagtttgactctgttttctcaatttacatagatttatattgcctatctcttaacagcttgctgtaggtattattattatgaaagatttgtcttttgggcttcatactacagttatgtatggtttacacaccaaaattacagtattagagtattctggatttgtttttgtacttaattttaccagtgggttttacaccttcaaatattttctttttgcatgttagttttttttcagatcgaagaactctcttttgcatttcttattaaacagatcgggtcatggttaattctctcaacttttgtttttctgggaaaaacattatttctcattcatacttgatggacagttttgccagataaagtgtttttgaatggcagttttttttttctttcagctctttgaaaaatgtcatcccaccccttcctgtccttattgagaagtctgttgcttatgaacttggaactcctttatgtgttatttgcttcttttctcttgctgcttttaggatctggtatttgtctttgacttttgagagtttgttgattatacaactttgagtaatcttatttgggtcgaatgtattttgtgttctctggccttctcatatgtggatatttgtctcttctcatattttagaaagttttctgttattatttctttgaataagctttctaccccttgaccgactccctcttgaacacaaatagtttttagatttggtctttttaagtaattttctatattttgtgggtgagctatgcttctttttattatgttttctcctctggttattttcaaatactctgtcttcaagctcactgattctttcctctacttgattcattctgctcttgagagcttctcatgaatttttcagtccagcagatatatttctcagtgccagtatttttgtttgatttttaaaattatttctctttgctcaatttttctaataagtttctgaattcactagaaatttttctgtgttatcttggaaatcagtgaatttccttacaactaccattgtgtattcttgttcagagagttcacatatcaccatctcattaaggtcggttactggttccttgcattgtccatttgaggaggtcatagttccctatttgttgtttcttgtggatgtatatctatgtttttggatttaaggatcagttatttattccagtgttccttgttttaatttttattggatgtgtttgcttaaagattcttttaatttacctgttgatttgattttctcttcttcttcttctccttctccttctcctcctcctcctcctcctcctcctccttctcattcttcttcttctttgtgcgtgcgtgcatgtatgctacttccttttcagcaccaggtggttccttaagcacaggtttgctttggttctagtaaaccatcagagtgcttcctgtcctgaatgagggaggtatccaaggggatattgcagtactatgggaaggctatcttgggtttcatgcccagggacctgtggaacaaacttcctacagtatagtactgctgaatggccacctaatttgttgtcttttttttttttgctgagttacagagtagtttccagggctgagaatggtagtctcacctcccctttgtatctctggctgtcctcggggatatttctgtcttcaggtactcctgatgtttccagtgggctgaggcagagacagttctgcccagaaacccaagatggtggggaaagtcattgctcacctcaatctcactttcactagtttggaaaccatgagttgtggggacatttttttttgcatacttggtgccaggtagattagaggagagggagtgtcatggatgtgaaagactgattctcttattctctgtcagagtttcttcacttctctatggccctaagaactgtctcatcctcatatttgagttctgggatattgctggtaataatctcagtgttgtgcatttgtttttggttttctgttgaggggaggaagtaaagccagcttagctctgcatcaccattatgaaaccagaagtctgtgcttatttattattattattttatattttattttttctttctttctttcttttttccttccttccttccttctttccttcctttctttctctctccttccttccttccttcctctctctctctccttccttcatttctcccttctcttccctccccttctctcccctcccttccctccccttcccttccctttccctcccctccccttcccttcccttcccttccttcatcttgctctgtttcccaggctggaatgcagtggctcaatcatggctcactgcacccttgacctcccgggctcaggcagtcctcccatctcagtctcccaagtatcagggactaaaatcgtctctacaattaaaaaaaatgtagagacatagccttgctatgttgcctaggctggatgtgcatctttattcttaaaaaaacaacttacggaaggactcaaaacatatgataccctcaaaagcttccattttagatagtacctatagtgtgttcaagaagctagctaacattctgttgttttctttactgacaaatttaagccaaagtttctaaatatggcattttacatgaggaataagtaggatttagctgtgcctattccagtattgataatacttataatctttaaaaaatagagaaaagtctattgaaaattgtaatagctgggattttcatttactttttttttggacttagcttttgtggtagaaaccacatgacaattagtctgcacaaaatcactgtaaactctatagtatgtacttggagagaacttgtttccttagaaatgctataagatttagggactttaagaaacattttcccacatgacagataacaattttggtggcaaatcttcattgtgaaatcaatctcctccttctactgttttttttaatacttaaaaacattatctggatttatatctctgtcctatagaaagtatgtcaagtgtacctgtggttgtcactcattaatgcacataagaaacacatgaaataagtggattcctgatcccagctcaaatacacttaataagagtatccgactttaggaagcaggatttttccagtttgtggatctgagtctcatgtgaactgttaggtaagaataattgtgatgtatgcaatttgtggacttaactgttcccaaaaagaagggtgtctgtctgaaaggctagcttaaattcaatggttactgaatgaaaataattatttttgtaagatattttctaaaatgtgattggtttatatttgacaactatataaaacaggatttctgaggctaaaattgaattgcatatttggttccaagcctcctaatacccaaagaaaaaaaacaatgaatattatgtgctttacattgtctatataaatttttgaagacatccaggatcatttacaatttctccaagaatattgagccttcataaacttgaaggattgaaacattagaggtgagtcagccctcactaatcccttaagatcaaccagtatgatatggaataagtctttatgtgagaaaaaataaaaataaaaatagaattgatggaggactagagattttgatgctgtaactccttggcagtgtcctacaggtttctaggtacagtcttgcctttctttgattgctaaatgatatttatgtgttattagtcttaccacttttttatatggagaagtcaaaaattagtactctacaaattctaagagtaacttataattctttaaattctttaacatttttgttctgttacaataacatttactaagtacttgcaataccactttatgccagtcacttggttcatatcctcataaaaatgttatagggcagaatatcagtcagagttctaccagggaaacagaacttgtagaagctatatattaagagatttattgcaaggaattgtaccacacagtgatggtggctgataagacaagttcaaaatctgtacggcaggctgtcagaaaatgtagtctggaattctcaggtacaaactgaagctgcagtctacagatggaatttcttcttcagaaaagcctcagctctgctcttaagcccttttactagattgaatcaggcccacccagattatccaggctaatcttccttacttaaactgattatggactttaatctggtctacaaatattttctcagcagcacctagattagtgtttggttgaattaatgggattgtagcctagccacattggcatgtaaaactgaccatcacaggtatgaacttttattgttctaattttacaaaatcaggaaactgactttgaaaaagttaaagtaaattgctacaattgagaaatgatggaacattgaacctaagtttgtccaaacccagaacccatattataaaacccagatggaaagttggcatttgactactaaactattaaagaaatgaatgctgtgtgtgctctggtgcacacacatgcacacacacgcatgcgcccacacgcacacacacacacaccactaccactgccatacagctattcaggaaaaaattataaagggatatttagtacatttgaatgcatgtattaatattgcggagattgaccagcgttttcattaattccgctaggttaattttccttttggaagccatgaaaaatgatctgttcgttataaattagagtaatcttggaagtaatttgacagtcaatcatcatttaataaaattgaaataaaatgtcaagagtaaactgtaaaagacaatgggatcactcatagtaattactgtcagtttaaactgaggaaaacagaatctgatttttaccgttatcagaatgaggtagttagtaatgaaccacaaatgtgaatctgtaaagtattgcatttaatttgttggatttctgcatattggcttaatggatgagtggcataaatttgtaaaaacagttactctcaaacacattatacaatagcacctaaggaaatatttattattctgagattactgattgaatttgtgatacattttattctgctgtgtatgttcagagatagctgtaaagtatgtatctactttgaaaaacaggaaagcctagatggaggacattggctgtcaacagagtgctagaataagcagaaagaaaaataaagcggaaacagaggtacaaacactaaaaaattctttgaaaggtggcatttgttctagagtttcacattttccaatgacacattattttaacttgtccatgaagttgaaatcatttgtgcaagccttgtttcataatttcactattttacttttgttcaaatatcaaaatatttcccaattagaccatacatatacttgcatagcctccctcctttcattatcttctttgtaaaaccaaccatttataatgagcaagacaatatcctcccttgaaaatgttcactttccttatactgtgtctctactcagcatgtgacattgcccatagactgcaaaaaccattctatctcttctagatcacaaactaccatgccatccttaggtcttactaccctccaatacaaacactttcttctagtcatacggggcctttcattcccaccatacttatcctacatatttccagaccaaccaacacctctgctcacattgtgggcctaacagtacactcctgacttcttgccatatatgtgaatactgtcgatctagaagcccagatcctgtaagatttctttattaagcctggtctctttctctactgaactcagataggagatcaaatctgaaagaagcttgaagacaacaggcatctgctgcttgaactccttctttatagtcgagtgagatgatctctacccatggatattatgtttgaaaacctctagtaaaggagaactcattacttttccatcaggttcagtctttggatagttttagaaagtagaaagttcttgtatgtaactattatcatttcttctttacttagctgttcctagatactagactataaacctctttatagcaagagtgtgttttttatttcccaatacttaacacaatactgggcatgcagtagatgttaaaaatactttaaaaaataaataaacctcatttggggttctttcactttcttaaccattcatctctgtataaaccctggtttgcgtatgtgcctcagagcaaatgcacaggtatagtctgacctttctaatccacaatggtctgcacagcctacttcttactcttttctagaaaagcagcctatgttcacattttccaattttccatagcttcataattgctgacaaaaatttctttatacacaattaaatccaaacccaagtattactacttataagacttatttttatttttaccccaagccatatatttcttaccaagtttttgtaacattggtgttttaggatccacatgtagaatacattttattcttattaaatgtatgctattaggcctatgagtctccccatcaagtcctttttgcattttgactctattcttccttattcagtaaacgagccagatttacattactgacaaattgtataataatttctggtgtgaccatattcattttattgacttaaaatattgaatagaagatgaaaacggctggagacctagcattacaagtcagtctctcaatcttggtctgtctttctctctccctctttctcttaaaattgagccattaacatattttagagtcccttagccagttcctatcacataaataaaaattggtgggatgagattcatgataggaatataatgaaatgacatgcactattaaaaataaatggattgatactagaaatgtagcatgtccaatgtaatcatacaacatttcgggggttacatagcacaggcatgttcaaattgttagttatctttattatatatatatataatctctctttctatttagcttcttaattatttaattacaaaatcgagtcttacataaatctgtatatccgtaacatgtaatggtgtaccttatgcataacaggtaaccaactgattgtggtttaatgtgaaaggactcaattgcaatgaaaaagaaagttatttagctacagttttcaagagtaactcccaggaaagaaaaataggtaggataagtactaagaaactctttccgaagctgagtgtaagatttcaagaaaaacgttcaaaaatattattacttcgttctaaaataaaatacattctgaaaaatattaggagccatataaaataatgtaatgatgaatcatactctcaacataaaacaaatgatcagtactttctaattttctataatttgtatgtcaaatctcgttaatatttttttaggtgtgttgtactgttgctgaggttgttttattatttgttttggagaaaaagactgtttagaaggttaaactgatgaattcacagacaattatacaagcttgtgctattaatattgttaaataattgcatacaacttagcacttgagcaagaacaagtgttatttgttactgagtctcttcctgtgatcaggtgattagcattacatattcccaagaataaatgattccacacctcagggatcaggaaaataaccacactttcacagtcagaatgtagataagcgctgtcttgtaaactgtagtaaagccaaacatttatagcatcttttaaagacagtcttatgatctctgaatggttttcatctattagaaattctgtactgtttgtctgacttaatgactcatgaaaatataacctaaaagtgaaaatactgagaacataaaataaataatggttttaaatcagtagtgatattgtcaatttgtgttagtggtctgtacttgcagacaagtaattgggctctcttgtcttaattttgtttcagttaccaatatcactatccaatttcagcagaaaatgtcagcattaaaatatgttatttattacaaagtaatagtttttattgaggaaaatttcaaaaacacagagaggtgtgaaaagaggaaaaaatatgctgtcattctatcaccttgaccactaagtagaatgaaaataaatggttgttattagcatctatagagtgtctttttgcaaaattttgattatcacctacataatgcttggtaacatcacttttaacaatgcattctgaacacttttatgccattagaaagtctcctatcatattatattatttttaagtaataaaattatatgctacagcagaatttatttaaccaatctccaattgatgggcatttaagttgcttttggtctcttgatgaagtaaaaagattgttttaaaaattcctttttaaaatgattgcatacagttctgagcctggtttcgtgtaaggagtgtatatttgttacataggcattcaaaagagcacacttctgttatctatttaaaattgtagaatcatgttaatgtaatgaaacaaatggctagctagaataagatggaaacttgtagatgcctgcattaaatcatagatttggactttgaaagaattgctattgcatatgactaatgtttcttagcatgaaagttgcttattttagaatagctggaactatttatcagtgcatttgtaaagcacaggtaccttaaaatggatccaatatctgttcatatcctcaattaatgtaatacatttttgactaaattttatttaaaaagaatcaacagaattgatacaaacaatgggtaaagatgacaaacttttttaggtcaaaggtagtcttttacaatttctggaagcttctttaaaatgttatctatcttgcctggtttgatttgacatatgaaatatatttctctatatattttctatgttttggggcataggtgatgtgcagggttacgttggttcataatattatcacaattttaatcaaacccaattacaaaagaaaaatgataatgatcaccttataatttatcgtaaaaattatacatatatatttgtgtgatgtttgatagatttgctcttatgtaagagaattatgaaagttagatagaaacagccttctgaaatataaaatatttgtcctaacttttcctgaatagcagaaactaagtatactaaaataaatgtcttcaagattttcttcacacgttcctcagactttgttttaaatcagacactttcagataacatatgtttaatgaaaacacaatgatgtgctgagttttcattttaaaatgtttttacttaaaaatagaaaagaatttggagaaagtcaagttgtattgttttgttttgtttgagacagagtttcaccctgtcgccaaggctggagtgcagtggcactatctcggctcactgcaacctctgcctcctgggttcaagcaattttcatgcctcagcatccccagtagctgggatcacaggtgcgcaccaccacgcccggctaatttttgtgtttttagtagagacagggttttgccatgttggccaggcttgtcttgaactcctgaccttgagtgatccgcctgccttggcctcccaaaagtgctgggattacaggcgtgagccaccgcacctggcaagttgaattgttatatgcagctatatttatccaagttgcacatatttaatataagcacaatctgattaaaaaaaatcaaagttcctgtctaaaacctaaagaattgtagtgaaatcaatcaagttgttgagcttaactgaacttctttaatgccataaccttgatattcactatttcctttgaaatataatattcccttttgcattatttatgcaaatgccatgccagtgtagtggaaggtgtcacctcagtgcagctatagccagtaacatttcctgttctagtcatagaaactttcatttattcatgttgatttgtaataattctcagtcaatttttcctgggtgaagacatgaatttgatgaaacagtagcagcagaattattgttttggatgtattcattaattttttagttaaactttctactttgagataattgtagatttacatgcaattgcaaaagacattacagagatctcatatatcctttaatcagtttccctcaatggaaacatcttccaaaaatttcttacagtggtaacatcttgatagtacaatatcaaacctggatattgaaattgacatagtcaagatagaaaacattttcatcaccacaaggattcctcctgttgccaattagtagccataccacttcccttctgctgtcactctctccttatctctggcaaccactaatctgttctccatttctattattgtgccaagtcaagaatgttccataaatggaatcatacagtttgtaacctttttcactcagcataattctctggagattcacctaggttgttgaatatatcaatagtttgttcctctttattgttggtagtattctctggtatggatatatcacaatttgtttaaccacttacctgatgaagtatatctggattgtttccaatttttgagtgttacaaataaatttgctaaaacagagcctcactctgtctcccaggctgtagaacagtgttgtcagtggtgtgatttggctcactgcaacctccaccccctggattcaagcgatcctcctacctcagcctcccatgaagctgggactacaggcatgtaccaccacgcctggatgagttttgtatttttgtagagatagggtttcgccatgttgcccaggctggtcttgaattcctgagctcaaacaatctgcccaccttggcctcgcaaagtgctgggattataggtgtgagccactgtgcctggccaaatcaattaattttaaattcaaaggtgatatgatgccctctttgtccttctgattttcagtgttttatgaattgattttagttgtttcagtggattaattctacagtatttgcaacagaaagtataacaaagatctctgacaaggtcatgcctatattgggctgtaggaaatacttacttagctacgtattttatacaaaatactggctactagaaaatgtagacatattaattggttgtgaaaaaattatcttgatttactgtaatggcttttatttacctatgtattcttaaaaatctatggaatgtgttctagatacaaaatagtatatatgccatatagagagaacttacagaattagagaaatgaactcctatgtatcagttatgagtttcaaaaatagagtagtacatcaccatattgaaacaccttggagcatggccttctggatgttatctcccattcttcttttggaggtcaccactattctcaatttgatatggtttggttttgcccaattttgttatataaatgtactaatctgattatattcactgttctatgacttattttttttacttatttcacagattatactatgatggtggcagtatcattatttattaatttccattgctatataatattttattgtatgaatatactccaatttaatgtatctcttgtattcttgatggacatttgggctgtttccattttttttctattattaacagtgttgctatgactatccttatacttgtttcctggtgtagatgtggaaaaatgtctccaggttccatatatatctagcagttgaacagctgagtctatatgcatattttaaagtatattaggtaatactaaattattcttcaaaagtggtgtaccaatttacatagccacaagcatgtgttctctcacatctgtaatcaggccctcagcatttgtttgctcacttttatattattggtcttaagcttattgattcaaaagagtacttcgcatattttggatactaggtgtttgacagtaatacatattgcaaatgttttctcccaacttatggcttatctttttactctctttatggtacctatgatcaaacgaagcccttaatttaatcacatttattatctttttcctttctagtttgtactttggaaagctttttgaattttactagggtttatagcttaagttttatatcagtaaaatgcttaccagaataatgttctttatcttgaatagtagcttgcatttatctaaaaattattaggatatatatttcataataatttctatttatagacatatatccttatgatttttatataaacacataccaaatgtatatatatatatatatgtaacaaagtttcttttaaggtttttaatttcagctatcgacctaaacatgcataaactaccttttcttttaaaatacattgctgtagttagctcctgaaaacacttctacttcactgaagcggtgatgatttttgtgaattttcagccatttgtctttgagttttctctttgaaagaccctgagactttattcagtgatatgagagaaactatggaattgttaatattttaagacatcatcatattcatgatttattgttctttgcacaattgattccaacccaaatgtcccatgaaataaaataacacactcagtgtgatttgttttactaattattatatgtagcaatcacttgactgtatagatcaaattttactttctaaaagctccttccattagtgctaatgtgtttgtccctttcaaaaaatacatctagtaatcattgggcaggtggtgaggaggaacagattagaaaatggttcctctctattttttaaatgatgaagtagaaattctgtcttttatgaacttctgctgtttggtttctaggaaagtatatgcttaattgttaaaatattgaagatcttactgttaactctaatttttccagagagaagaggaagaggaaccgtcattggttaaacgctcaatataggttaggcaatattctggccatatgacctctaatattcttcattcatgcattaattcattcaacaaattttttttgagtatgttctatgtgccaagctgtgttctaggaatcgaggtaaagcagtgaataaaacagacaaagaggcaaaaatcatgattttggtagagcttaagcaataaatatgacagattactgccttagaggtatctagaaattgagaaatgctatacaaaatagcatatggctctgcttgtaaaattttaatgtgcatgtgagtcacctggggatctcgttacaatgcagattgtgattccataggtcttgggtggagtcctaagatgctgcatttctagcaagcttctgagtgatgccaatgttgctggtttgggagcacagtttgagtagcaaagagtatatggcaagtgaggtgggggtcgagcgtggagagtgggagagaaactggctgcactttaaaatatgatgattagggtgtgccttattgaaaaggttataagtgagcaaagatatgaagaaggtgggggaatttagctatacacttatctaggtcaatgaaaccagccagtgcagaagggtgttacatgggagtgtgcctgacaaggaggtcagtgtggatggaatggcatgaatgagaagagtagtagtagatcggatttgagagacagtgggaataaagtagatcttgcagggcttcggacaccattataagttctttggcatttacgctgagatgcggaaccactccagaattcggagcagggaggtgacatgctccaacgtacgtatttaaaaaatcactctaactgctgtatagaaaatagactattataaaacaggatagaagcagtgagaccagttaggagtctgcaaaatatatggtagctcagacttaagtttatagcaggtgagatggtgagaagtgctaatattcagaacacattttgaaggtagagcctagtgaacttattgatgtcttaaaatatgcatatacacagatgtaggctgtgaaagaaagaaaggagtcaaggatgactgcaaggtttgtttgttttttgacctgagtttctagaaggatgaagttggcatcacctgaaatggggaagggctaggttttcaggagcatgtcagaggttcattctctgtatgtgttgaatcccatgtagccattagatcttcaaatagagatgtggagtaggcaattgtatatgagagcctggaattcagcgaaaggaccgtgcgagaggtccaaattttctcttatatcattcttaaaacaatcccttgctgctcatcttttatccacattttataattggggaaacatgttcagaggatatagcaaacattcagtttgtaagaggtggagcagagccccaggacaatctgtagctccaaaggccacactgctgttctgcttcaatagtaaaaagaatcaacactggtcactgcagctggttatgtgtttacttagagcaagtcgaaaatatttttaggcagaaaaattgagttggcagttcatctttttaacttccctacttggctactatagacagattttgttaagtcaatgcttggcagctttccatatgttctagagatgcgtgttcatctgggtgtgacagttttttctaagtcacttctgccatagcttgttaaaggtaagaaaaccatgtcttcactgatcttggggtcctagcgaagaaatgtgtgctttctcagtgttggaagggtagagaatggtaaaatgaacattggtggcctccctgtcccccagtggaattccaaggcatagcctaaatgatttctcagaggtccccagcagggttgattcccggttgctcacagcagtaacctgttcattaataccatttattggcttttcatgcatccttgcctcacattcctcattgttcacttcttaggatcacctcccaagtgaattgtctgaacctaagtccatgtctctggctaatctaagaaaggtgataatgtgaaatgtgcttaactggtctatccatgatagttctttctaatttctacaacagtgcctggcaagcagtctcaataagtatttgccacaccagtgaaggactgttattttccttaatgtttattaagtaatagtagtagttgttactattattttaggcaaatatatttttaataggacacagataaattcccctttgtcactaacactgccaatcttagttctttccttacgttcccagaaacaagagttcttaaaactttggtatgtatgcttctgctattttgacttttacctaaatcacatcattttatacatgtgattatgtaatttgcttttttcactcaaatttatgattttgagttctatcgatgctacatattttctgccttctatctgattaaaaatttcccattctgttttcttcctttatggtatttagcgtttttaaattctatttctattttttagtggttccttgtaagtctttaacacaaatatttgaatttacattttaagaggtactaccagtaatgagctaagatttttatcattgcttaaattaatgagcctttctgttcttaatggccaaatgtaggccatagtttaccttgtctcctagctatccctgtttacttccgtgttttctaggattttagtttgttcttgctcccaaataacaaaaggcttattattattattattatctttattggatcttataattaagttttatttctttcatttgcttattgaactcctttctttaaatatacttttcatgttggggaagtgtctgctttagtcactaggctatgatacttaatctaggtcttaacaagtagggttttgccatgaagagggagaaaggatcagtatgcaagggagtagtgtctgaatttgctttgtatgtgccggaatgtctatgagttaccctttgaacacagctttgtgttgctctcatggtttgtaatgtaatccatggtatggtaaatatgtacatcaaaaataaactaataggaaaagatatgaatatcaaattagaaagtgacccaaaatgaagtgttatctaagacaatacatttaatatgtaaaaatacacatagattcatttgaaaatatttgtcgtatttctttcaaacctcatccaatgtcagcataaacaaatataacaaactagttttcaaattaaatttaaaaatataattcttcatacctggagcctcggtgagtaggcattatgcctgaaattttcaatgtcgatggaccatagatctgcctaattactcctagagtcattggagccaaattgctgggatgagccatcattcccccatccccctttcacaccaatgtgattgtatgccttaattggttctctagttattcatgttatatgatctcaccactaccagtgcttctctattagtacctcagtcttcttgttagcattcttaccaaaagattatcagaaaatccaagttactaaaaacatatctaaaacacaaagcccgtgaacagcacatgaaagctggaagcccttgcacttccagaatcctgcttgcatgcctttcagatcacttacagtagcagaaaaggtgtgcaccatcacgctcagctctaacttgctctcttttgtatatgatgcggtaatcctggctcttagtgctttgggattttggtgatagatgtcatcaccagtaattccacagtccccaaagagttcaactctctcaatcaaatcttaagccatattgttggctccctataatactttaaattctactgtacatttcttatagtgtaatcatgttaaagagggggaaataggcttttttcctcttctcaatgcataatctttttaaagttatctattctgatttctcttgaggtctctttccaattacctgcaagtttgcttttactgtggtgttccctgtattgtgtgtgtcttattccttctgcaagaaggaagtggccaagctgacagattgctaatattaccattgtctaattacagctctattatgtctgtacaacagaattgcatatcatttaagaggccactacagcatttatcagtcgttgtggattctagcctaacttgaccattcatttatttttaatttatttttatttttgccttttttgagacagtatctcactctctctctctcacccagggtggaatgcagtggtgtgatctctgctcactgcaacttctgcctcccaggctcaggcaatcctcccatctcagtgtcccgagtggctgggactacaggtgcataccaccacacttggaaaaaattttaaggtttttgtagctacgaggtcgcattatattgcccagactggtctcgaactcctgggctcaagtaatcctcccacctcagtctcccaaagtgctgagattacaggtttgagccactgtgcctggccttgatcattcatttagacttgcagtctgtgccatgggaaatccaaaagctccaccatgacaaattaactccctgttacagacgtagctgttgtctctccgtatctggagaccctcagagcatttttaaaagcatgacattttaaatgttaatttttattgcccagcaaagttaatcacacctatctatgaagagttaatttccaattaaacagttctctgttcactatctataattccctcaaaggaaccaatcatacttaaagggattcagagcctgttatatttcttatcgtctattttcatgagagtatgtacttattataccagatttctggcatttagtgttatagatatgcaaattccattttaactccccttaagatttccaacacccaaatgaacaattaagttttaacttttcatctgtgttctctctctctctcatctgtgttctctctctctctctctctctcagcacatgctgttaaaactttagtttatgctataggtccttgtagcgacaattttagaaacacccctttcttgtgtttatactattataactttggggtctctaaaccaattctaaatatgcattataattataactttatatgttacattcttatcctacttttgtcttaagataatttatgactgaatatttttgtggcatcataatttaagctttaattttactaaaatgtgctttttggttaacagtaaacagttaatatgctatagtctcctggaaacacacgttcacatagctttttatgagccaggtttttggtaattcagcatatactttactattgaacttgcattcttaatgtgcaatctgatcaagaaaaatatcctctaatatttcttttgggttccaagagcactgtcccctttcccaagtactacattttacctgaaaaatatatgagaaagtatgagaattcttgagcctaaagcatttaaatttgattattttcaaaatttgttaagtcatttcaaactgaaattgaaaataaaattaatttccaaatagtaaaaggataaatgaaactaaatactgttactgagaaaattagtccatctttagggcttcaaaaaacacactgaatgtagctttcactgattatatacacttttaaggttgcactttttctaggtgctaggcagaaaatggagcctgaaaaatatcaaattgcagcatagtaaatcacgtttgaatccaagttttaagttatttgaccagtactttattctttgatgagccctgaatatatttttctcagccataaggtaggcatcatgcattcctaaaattggagttgattttctatgatagtttaatttactagctgctcagttcttctaactgtgcatgttatatgggaagattatttttttatttctttgtaaattcatgtcagatctacccatgggaggaaaatgattcctaactcttctccatttcttttagtgtttattcatatgctgtttctgtcttttctttttgcctttcccctagctgaaacaaggatgaatctataaactaaaaaaaaatctttttctttgtaatattagatagacatattatcaataatattatataatctattgcaacaatcaagtcaccattaaaatgtgtagttttctgagtgtttccaagtatgtaatgtaggacaatgctttaagtctggtttattctcatttcacttggcttttttttttttttttgcatactttgagtatatgttcttaagaatattcttaaaatattttccaagacacatttatgtaagctaatcaaaccatgcaatagataagaactcaatgttttagaactctgtcataagaagagatatatttgtgtatgtgtagatacacacatacatttagcacattttcagagacatatacattatggatttttattattgatttaaattctttataatatgcaattacagatatattttatatcagcttaagcattttaattgcaagatttctgtttaatttgtctgcaaagtactcttttttttctggtcatggtaaatttcatattctttgacaatagcttttgtttattactagaaacacttctcttgggctaggttgttaattaactgtcatttttgtacagggtgtaaaagagatatggaaagaagggtacatgagcaaatggaatttcacacattattaactgttttagtgtcttcaaacttcaaaaacatatattaatatttttgtaccacgtaagttcatcagaagcctgactttaatctctgatttattatatttgaacactgtgaagaagcagtttaacactgaacgaaagtgtcgtaatgcagctttcaaagtggccattaaagacagatctctgcttttctattagtacattttctaagatgactatcattgccattgtagtcagctttgtgtacctttatagagattccagtataaacccagaaacatagagcactgagagaaataatatcagaagtgtttcacctttggctactattgtaaattgacaaatgacattattgcttttagatttttaaaacaaacacactaagtagaacatatgcatccaaatcagtagggtcatttcaaataagtcatactttttgttccagtgattcattagcccaagtacacttgaagttcccattttagaattgctttcacaggccagtttatgaagcagaaaataaagattcatttctttctggttaacacctcatttttggccaaaagtgatatagcccaatataccacgaataccttactgaatctgatgcccaatgaattttaactgtttttaaagttcaaagcaatctttaaaagaatgaagactttcagccattgaaactgtctagaagctgagctatgatatttgaaggttcagtatttacaaatggcatcattactttttctttctagagaaggcactagaaggggggctttcatcagaaatacctggaggttttagagaaggcagattctgtctggaaagtcatgggaactagaggcagggtgccatgctatgatcagtcaagtctctaatctctaaaatgtatttcgaagacacagtttgagcaggttgaataagctttttgtcttgtaggcccaggatatactgcgttaccaaagtccaagccccacaaggaggttattcacctgcccataggtccattagaagtcatctgctgatgtgactgtattggtgatgtggaatattaacgtggaacagaaaactccatgggaaggcttagtgctgggggagagatataggcaaaagagatggaggaaagggttgaaataaggatttgtttagacagttcactggtggtgatttattgggtgtgttttactgctaacccacacatgaagcccctgacatcttggctgaggctggtaatttttttctgacaaggatcagcagaaatgaaggtgccatagcttccagtgctagatatagtagctaaacattatcttcagcagagatgggagttcagagtgtcattgtaaaatacatggaaatacctaatgtaaaggagtctaatgaatgaaagaaataccaaatgaatcttcacagagggaggtaaaagaaaagaagataaaatcaaggctggtgacaaggaattattaaaatagaatatgttattgtatatatttgcctcagagtttataattaggagtccgttgaactctgtttcaggatgtcttcatcatttctttaaggatttaaaatatactgcatctagaaataatccaaattaaaattgatttaatacactccaacaccacattataaaaatcattcactatgaccacctgggtttgatattggaaaatctattaatatcaatcactatattaatagatctaagaaaaaaatatacccttactccagtaatgctaaagcctggaataagacaggaatgaaattagaaaagataaattagaggcataagaactagaaaagaagaagtaaaattccctctatttgcagataacatgatagtatacctggaaaaccctagagaataaatggcaaatgtagctcaaacaatgaaataattcaacaagctagcaatatgtaaatttgacagacaaaattcgacagctaccatatgcaaaattaataatgttaaaatagttggagattagttagaataaattacaaaaatctcacaaaataaacagaaaagataaaataggaataaaattaacagaaaatgtgtaaaacatataagaaattataaagcctttctgaaagacacacagaagtagacttgaacaaatagaaagacattccttgttcttcaataggacatcacaacatcattaagatgccacttctctctgaattaatttaaatttaatgtgatgccaataaaaataccaacatgctttgctatatggagctaggcaagttgaaactaaggttaaaatgaaaaaataatgaacaaaaatatctgggaaaaacactaaaaaggaaaagctatgactagccctaccagatattagcatgtactacaaagcctcaacaaataacagtgtcaatagcacatgaatggacagaccaatggaataaaatcaaaagtcctgaaatagaaccaaatacatatagaattgtaatatataatagaggtgacatctcaaataactggggcaaagttgaacttaataataaatggtttcgtataaaagaggaaattagatgtcttcctcaagccatacacgagaataaacttcaaatgaatcagaaaactaaatgtaccaaggaaaactatacaggtactagaagaaaatattggtgaattattttaggacttgcatgtagggaaggactcttttttttttttttttttttttttttttttgagacggagtcttgctttctcaccaggctagagtacagtggtgcgatctcagctcactgcaacctccgcatcccgggttcaagtgatttccctgcctcagcctctcaagtagctgggattacaggcacgtgccaccacgcccagctaattttttgtatttgggtttcaccgtgttggccaagatggtctcgatctcctgacctcgtgatctgcccgcctcatcctcccaaagtgctgggattacaggcgtgagccgctgtgcctggctgggaaggactttctaagtatgactaaaaattcaaatgccacaaataaaaagattaatacattttactatattaaaaacttcgcatgacaaaatcaaaagccaaaagaaaactggaaaaaatgcatatattgtaatgtatatcacagataaagagttaatgtccttaatatataaagaacttttaaaaattaagtgggaacacagatcctgtagaaagatggacaaaaatataaatagacaatttacaaaaaatatataaatgatccttaagcatatgagaagatgattgctttcactaacaataagtaaaagcaaattaaagctattttgaggtacagttctcacccatcagattggcaataatatgaacatttcacaatatactctgttgagaagctgtagagaaacaagcattctcatacagtgttggaatttcgaaatgttctgaaacaaatggagggggaaatagaaatatctaataaaattacatatgcaatcccactttgacctagcaatctcatttctagaaattagcctgaagatatatctcctacaatgcaaatatatgtacatataaagttattcattgcagcattatttgtaattgcaaaatattggaaactacgtaatagtcaaacctaagatatcagctggataaactatagtacatatacacaataaagtactaggcaactaaagcaataatgaggatctcttgatgaactaatattgagtaatttctaagtgaaagcgaagtaaaagaatgtttttctactatgctgcctttgtgtgtaaaagaaactgaaataagaaactgggcatcactttagccaagtgctcaaaattagtatgtttgttttctgtgctgtgtaaaaaattaccacaaatttagcaacttaacatagcatttattttttctttcagtttctgttggacagaagtctgggtatgacataactggaatctctctcagatccttaacacttgacctcctccataaactctctcacacttacaatgtctgatctctggaagggcttggcccctttgaagccagattgggtaaagttcacccaggatacgctccttttttattaacgcaaaggaaaccaatatgggactttatttatactgcaaaacctcttcacctttgttatataacataacttgatcaagggagtgaaatccaccatctacccgttattcctagagtagggattttacagggtttatgtacaaaggcatggggatcttggagcccctctttgaattgggcctatgacagttaatatcaccaaaaaggggcaaacagacatcttgtgtgtgcctccagatgcaatactcttggcaggatataacaccactgagaaggatatgacagcactgatacagtattcccacccaaactgtataacctgaatttagtcataagagagcatcaggcaacacaaatcgaggtacattttataatataattggtctgtagttttaaaaaaatttcatggtcataaatgatatagaaataatgagaagggattccagattaagagaaactaaagagacatgacacccaaatgtagtctataatactggattggataccaaactgaaaaaaagatattgttataaagaatattatttgatcaattaacaaaattagaatatgaactacagttgaaagtatttgggccgggtacaatggctcatgcctgtaatcccagcactttgggggtctgaggtgggcggatcacctgatgtcaggagtttgagaccagcctggccaacatggtgaaaccctgttgctactaaaaatacaaaaattagccgggtgtggtgatgcgcgcctgtaatcccagctacttgggagcttgggaggctgaggcaggagaatggcttgaacccgggaagcagaggttgcagtgagccgagatcgtgccactgcactccagcctgggagacagagtgcctctgtctcaaaaaaaaaaaaaaaacccaacaacaacaaagaaaatattctattagtgttattagtgttagatttcctgagtttgatcactgaactgtggttatataagagaatatcttttgttcttaggaaatacatactgaaatattaaggggtaaaggaatataatatgtacaacatactctcgtggttcagaaaaaaatactatatgtgattgtgtgtgaaagagagagaaagggaagagagaatgataaagcaaatgtggcagaattttgaagattggtgaatatttgtgaagtgttctttggattgttcttgtaacttttctgtaattttgaagttatttcaaaataaaaatcaaattaacaaaaaacaaaaaataaactacacctaaacatcttagcagagggcctgcctggcatataagttctcagtaaatggcagttaataataatatcactattattacctaattcttgcttacaacttgaatccaatcaaatgaacctatttattgccactaccttgggggtttttattgtatttttggtttaagaatacttagtatttttgtttaaagtctaaaataattttataatataaatgtgtagagtaactggtaaccagaattcctgcaaatttaatgccactgcattaattgattgttttagttttggttccccagaagctgacccctagaacccaagacaaggtttcaagttcacatagtttatgtgagaggaaataccaggagatgttagatgtggggagatgagaaagtgaggagaaggaattgaataaagggttcattattaaccaagttaccactgtaggcaaaagggacttaatcctggtggggaaatctaggagacagtgtaatacatgcttcagactttgcctgcccaaggagggatggaggtagggtatttgtacactgacccccatcggtcattgactgagggcttctggagcatgcaaattaaattctaagcacttccagactgctacagtatcatatcagattcctttaggcaatgggttgcaagagctgacatgtgggagacagggctggatgcatgcaaatgatgaattctgagggtatactggtaagtgtctcacagaatctgctgctttggtgaggcagaaatctgctgaatcagtctccctggtattccaggaagcatgtggagtgattgcagctataattatggtgaaatctacactggaactaggtttctaggaacaaacagatctgaactgaattattattttttccagttgctagctgagcgactttggatgagttatttgttcgaacctttggtttcctcatctgtaaaataggggcagtaacagtttgtcttcataaatttactttagaattaaagacattatgcatttgaaaggttgggcctagaaaatactcagtaagtgctagttttattatgtttgcatctcttatagttactattacttttcacttttaatcagtctgttagagatgattgttcttatcttgaactataagatgcactccaatctgctagattaatttgtaccttggctttaaaaaaatctgttttttttttaatagccattgaagactcagaacaatagggactccaatttgctacctgttcttgaaaatgacaatcagttacttaggaaagcaactttgaaaaatacaaaggaaagtcagagagattggaaccaaataatgaaggtcaagcatcatcaaaaacacaagttgtgagtgacacataaagggaagaaaaataagcatcgtaaggactggattagccatgtttagtatgcttttgaaatatttatgaaataatcacagtttaactgtttaattgcatgagctagatttggttgagtacaagcagaacactgcctattctttctcacttcctctttaaatcaagtcatggtcttgtcctttcctacccatgaatgaaaccgaacgcagagtccatagcttaccagtctcaaagtgtatttgtttcctagggttgtcataagaagataccatgaaccgagtggtttaaaacaacagaaatgtattctcacagttttggaagtccagaagtccaaaatcaaagtgttggcacagccatgctctctcttaaggctcttgagggatgattcttccttgcctcttcttaacttctggtggttgccagcagtccttcactttgttagcttatagctgctttactccagcctctgcctttatcttcacatagcattctccctgtatctctgtgtcttcacatggttattttgttaaaaggactccagtcttattggattaggggcttaccccactctagtatgacctcattttaacctaatggactatatttgcaatgaccttatatctgaagatcacattctgatgttcttggaattaggatttcaacatatcttcgcggggagagggggggcgcataattcaaccaataacacatagataattacagtctaagcccatcagtattcaaaccctaaatcttctccaaaataaacatcccccctttcttagctgaggaccactttgtgcctgaaaggctgcattggagtgagagtgacccgagtgtttatttccctgccccaccttgttctgtccctcctcctctctctctgacaaggatatgactgagtcttccaagattagagtaggtagaaagcgtgagctaaggttgggaggaaatgagaagggagaaaaggatgaagagttattttgattgatggaattattttggctttggtgtcctctgaggcagcagattccaaattctgattcttactctcattaggttgttcccttgcctcctcagaagcccacttactctctactctaaatatctctcacttgtagctaaattgatgcaggtagggcctctgacactaataaccaaatcttcagacccttggtgtctcattctgttgcttagttgggatctctgtatcctccaggcagtcatcttgagtggaacctttcttgaaatgaataaaaatttcttccccaggattgacactgatccaacaataaattcatgaatctgtcctgtgcagctgggtcgatctcataaagcatttattggtcaaagttcagccttaaacagttgtttcttgaattttcaagaggcagataccagtgcccatgatggcctttcaggtttactttttaaactcttcaagcatttcttatggaagttctcttacttaacttgcagtaaggtgaagcacctctcttccctaccccattgactcccaagaagcgatgggcaaatatggagaggagattgtaggtattacaggaatgcagagcactaacaactccctctaaagaaagccactctgttgaacatcttcatctgtccaaagatttcttaaactcctatgaacagcctagcctagagacataacagtctaataaaaacctggcagaacttgtcagaactcatcttttaatattttctaaatgcattgtttttaaagtgcttcactgagatataattcatacacttcaccactcacccatttaaagtacacagcacactgttttttagtatattcagagagttatgcaaacatcactacaacctaattttagaaggttttcatcattacaaaaagaaactccattcccattagctgtcactcctcatatctccctcttcctagccgtgggcaaacattactctactttctgttcctgaagatttacttattggggacattttatataaatggaatcatataccatgtggattttttgtgactgatattttagcataatatttgcagggtcatccattgattgtagcatatatcaacatttattttgatttctaaataatattccattgtatggatatatcacattttattcatccatcagttgatagacatatcaattgtttctgctttgagctagtagaaataatgctgctatgaatgtttttgcacactttttatgtggacatatgttatttctcttgggtatttatccaggagtggaattgttgggtcatatgttaactctatatttaactcttgaggaactgctagattgtattctaaagtgactgtaccactttacatccccatcagccatgtgtgaggtttcctaattttcaacattctcaccaacactcgttttcgttttttatttatcatatccactctattgggtgtaaattgattgtttcatactatcttagcttattttcatagataatccatttgctagagttggaatgtgttcccacaaagttcatgttttggaaacttggttgtcattctggtgatggtgggaagtggggcctttgggaggggattaggtcttggaggctccaccctcataaatagattaaggttgttattgcaaaagttgctttgctataaaagcaaactctcttgcatgtactctcttattctcctgcccttccaccatgagatgaccttcaccaaaagctggtctcatgttcttgtactttccagccttcagaaattgagccaaataaacttattttctctgtaaattacagagaaatttacagtgtgtgatattctgtaatagcaagagaaaatggactaagacaccattgcttctctttaggatgtgcaaatagtttgtgcttgctttatttttctgacttacgagccctctgttaaaactcaaaaatcataagaacagtgacatttaacattcagttaaaatgacaacaatttgaccaaaaggcattagaactctatgcctagagttatcgtaataccatgtgcacaataaaatatgtatatgtcataaggaataaaaagtggagtaaacatgagataatctgactatattctgagtgctagatgtctatgagggctttcaggttagttgcttgttttttagtaataaacacaacagtaataatgatgataatacatagcctatattgctccagccaggtgtggtgactcatgcctataatcccagcactttgggaggccaaggcaggaggatggcttgagttcaggagttcaagaccagcctgggcaacatggcaaaacctcatctcgacaaaaaagagaaattaggccgggcgcggtggctcatgcctgtaatcccagcactttgggaggccgaagcgggcagatcacaaggtcaggagatcgagaccatcctggctaacacggtgaaaccccatctctactaaaaatacaaaaaaattagccgggcgtggtggcgggcgcctgtagtcccagctgctcgggaggctgaggcaggagaatggcgtgaacccgggaggcggagcttgcagtgagccgagattgtgccactgcactccagcctgggcgacgagggagactccgtctcaaaaaaaaaaagagaaattaaccgagtgtggtggcccatgcctgtagtccctgctacatgggaagctgaagtgggaggatggcttgggcccaggaggtggaggttgcagtgagtcaagattatggcactgaactccagcctgggcaatggagtcagactctgtctccaaaaaaaaaaaaaaaaaaaaaaaaaaaattaactccctttattcctatgagaaccccactgaatagacactattatctttaccagttgtcagatgagcaaacttcccccagataataagattaatactacctttttacagattaagtaaaactagggggagattgagaggatactaaaaatatctaatgcataaaaatgtataaggttaaggacaattgttttgcctatctctgcccagatcttctcagatcccttttgaagatttttgttgtctaccctctctctggtttctgtgctctcacttttatcaactagcactaaaggctctttgtggggtaccatcctagggctactgaagctgtacccactcctccaggtgggagatcaaaagcctgggaatttcctgtaaattgttggaaattttcctactgataaatcctttcatgtttttactggctttccctggaagcattctttgtttggaatgagtcacttgtacacaaatcttgatctcagggttagcttaaggagaacacaagaaacagagaaaggaggatctcgataaaatattgaactagtacttagtatgtgaagaaaatgagtgatagtatcaaggtaaaaacaagaacagtagaaaattatcttaaaccagggggaattgacattagaaacaaatggattgtcatgatttgaaaatgttagaatgggctatttactcagaaaaagcttcaaacttgctttctgagaagactttataaatgtgcatagctattttcctgggttagtttaaatgtactgcagtccttctggaactgaataactaaatcagtggcttcccagagcctctacagctctaatagttgtataagagcacaacctatggttgtaaccaatggttaacaatcattaacctaaaaagtaaagcctttttgattatgcattgtgctaagggctttagaattattgttaaatggattcagtccctgctttttaggaacttaagagaaaaatttttaaaagtaaataaaagaaatctaccgtttatggtgtactactaagaagcattaaaacaagtatgagaatcacttcagagaaacattaatgaatttacaaatatcagtatttcagaaaagtaatatctactttgattttacaaatgagatatgtatggacaagaaaaatctattcatgacatgtctactccaaatagcttcattagtatttttcaggcgaaaagaagtaacaaaatgaaaaagaaaaagaaacattacactgcattgaggcaaaagattaagaaataagtttgtcagaaaaatgtgaaggtttgatgcttatctttgcagtaattttaagtaaaatgatgaagaaagaaaaatgtttgtggtgagaatattaaaaaaaattgtaggataaaatcccattatatcactggggaaacaaattaatatttcctggtaaagagcttgatgctaggatctagtgtcagaaacttttcttaaataaatactttttcttcttgaacctttaaacatattttgaactaagcaattttgaaacaaattttattcaagtttcttcaagtaataataaaaggaaatagttatcaagtatacaaataactgatctttaaatatatatatatatatggatattaggaaaatatttgagtaggtgggtaggtgttagaggaagcaggaaagataaaatacacacccttgataaaattgtattatataagcaactgcatatattgctttttattgcttcatacaattttattatataagcaatggctttattatataaacaatggcttatataataaaattatataaacaaaggcttagataataaaattatataaacaaattttataattttaaaattggcatgtagagtacacatataatttccttaaaactgtgttattactttccatcaatcacatggatcatgaagttgttttcagttcttctaaacatgctagaaatgtggtcagagactaaaaaacaggtacaaatatattgttttcaaactttacctgtgcgagtacagaataaagacatatttggatatgcagaaacactgaatattttctttcatggcaccctttcttagaatattatttaatgatattgtctatcagaactaaagagtaaaccaaaaaagaggagagcagtgaagagaagcttcacaattatagctatttgttgggtcccaatactgagcaatctgtcccagttaaaaaaggaaggaagacttcagaatagaaatatctgggtgattttattctaccctttattatttggaacaatataaggaaggaataaatgcagaaaataaaaggataatagaataacaagcatacaagatctcagcacccccttttattggagtaaaaggactacctgatgataaaatgcaaacaattaagatcaaatcaagagaaaacagatcaaaacaaaaagttggggaatgatgaatatttggtaaaaaaaaaaaaaacaacctggtgaagagctgtgaatacaaaaaatacaaaattgaaaataaagactatgagggttgtagttgtagaacagaatgtaaatattataaactttgaaaaagtgaatcaatataataaaaatgggaacatgttgaaggaggcaagaagcttattttctctcctttcacagcaggaaataaatcagtctgacttaaaattgaaatactcattttagaatatcataattgtagcaaaaccgatttcttaatgctgttccatattaatttttcctaaacttctaaaacatgtaaactgaccattaagaaactagtaattatttcacttcatattatttcttaatttatttgcagatacaattacattaactatatttcattcagaatatatgaccgtgtttactaaaatcatattttatctttatctctctgtatggattttagagatagctgggaaaatagttacctgatctttattgtttcttgtccatactttaatatcactttaatattgatttttatattaaaaatatattattttgtaaaataaaccattaaaaaaaaagccaattactaaaagtaacttgaaagtcagtacaactttgtataaagtccctagaaaaccacaaagtaaatttgatttatattatagcaaaatgtgtaatatatataatcttaaaggtttttcttttcttttctttttttttttttttttggagacggaatctcgctctttcacctcaggctggagtgaagtggtgatctcggctcactgcaacctccgcctcctgggttcaagcaattctcctgcctcagcctcccgagtagctgggattacaggcgcctgctaccactcccagctaatttttgtatttttagtagagacagggtttcaccattttggccaggctggttttgaactcctgacctcaggtgatacacccacctcggcctcccaaagtgctaggattatagggataagccactgctcctggccaaggttttttttttttttaaagcaatttagtaacctcccaaattaccactatttcttattttacaaatgtgtagtcttcacccctcttttcagctagaaaacaatttaccttaagtgtatgatcactgtcaaaaatgttagttaactaatagaacttcaacataaaagattataaattaaaagcacaaaatacaattttggcaagatataggtcactcggggatgaagttcagtctaaatagctgcctttcttttgcaagatgcttcagattttgtaaactccttttgctcttaaaagaatatctggtggattcatagccaaaaatctaccagacatgaaaagagagactggtaccaatttcaccgaaactattccaaaaaatcaaggaggaagcattcctccgtaactcattctatgaagcaagcatcatcctgataccaaaacctggcaaggacacaatgaataaaacacccaaaaaactacggaccaatatccctgactaatatagacgcagaaatcctcaacagaatactagcaaactgaattcaatagcacatcaaaaagttaattcaccaagatcaagtagatttcattcctgggatgcaacgttggtttaacatactcaaatcaataaatgtgactcactcataaacagaattaaaaacagaaaccatgtgatcatctcaatagatgtgaaaaaagctttcaataaaacccaatattgcttcacgttaaaaaccctcaagaaactagacattgaaggaacatacctcaaaatactatgagggtcaaaaattggatgcatttcccttgagaatttgaacaagacaaggatgccccctctcactgatatggtttggatctatgtccccacccaaatctcatgttcaattgtaattcccaatattgggggtgggtcctgttgggaggtgattggatcatgggggtggagttctcatgaatggtttagcaccgtccccccttaggactgtatagtgagtgggttttcaggagatctggttatttaaaaatgcgtagcacctccccgtctctttcttcttcctgctctgccatgtgaagtaccttactcccctcttgcgttccaccatgattataagtttcctgaggcctccccagaagcagaagccactatgcttcctgtacagcctgcagaactatgagccaattaaacctcttttccttataaattaccaagtcccaggtatttttttatagcagtgcaagaatggactaatatactcactactccaatgtagtactggtgctagccagagcaattaggcaagtaaaagaaataaaaggcatccagattggaaaagaaggagtcaaactatatctcctcatggatgatattattctacacctataaaaccctaaagactttgccaaaaggctcctggaactgattgacttcaataaagttttaagatacaaaaccagtgtacaaaaattagtagcatttctgtacaccaataatattcaagttgagagccaaatcaaggaggcaaccccattttcaatagtgacaaaaaataaaatacataggaacacatctaaccaagaagatgaaagatctctacaaggagaactgtaaaatattgcaaaaaaaaaaaatcatagatgtcacaaacaagtggtgaaacatcccatgctcatgggttggaatagtcaatatcattaaaatggtcatattgtccaaagcaatctacagattccacactattcctatcaaactaccaacatcgtttttcacagaactagaaaaaaactattctaaaatgtatttggaaaccaaaaacagcctgaatagttaaagcaatactaagcaaaaagaacaaagccagaggcatcacactacccaacttcaaattaactataaggctgcagtagcttaaactgcatggtactggtacaagatcagacacatagaccaatggaacagaatagaggaccctgaaataaagccgcatacctacagtcatctgatctttgacaaagttgacaaaaataagcaatggggaaaggactccctattcaataaatggtgctggggtaattggctagccatatgcagaataataatactggacccctgcctttcaccatgtacaaaaattaactcaaaatgggcaaaatatttaaatataagagctcatactctaataatccaaaaagaaaaactaggaaacaccattctggacattggccttggcaaagaatctatgactaagttctgaaaagcaattgcaacaaaaacaaaaattgacaagtgggacctaattaaactcaagagcttctgcacagcagaagaaactgtcagcagagtaaacagacaacctacagaatgggagaaaatatttgcaaatatgcctctgacaaaggtctaatatttagaatccataaggaatgtaaaaagttggacaaactaaaaacaaataaccccattaaaactaggcaaaagacgtgaacagacacttctcaaaagaagacatataagtgaccaataaacacatgaaaaaatgctcaaaatcgctcttagtcagagaaatgcaaatcaaaaccacaatgagacaccatgtcacaccagtcagaatggctgttattaaaaactcaaaaagccacagatgctagtgaggctgtggagaaaagggaatgcttataaactgttagtgggaatgtaaattagttcaaccactgggcaaagtgctttgacggtttctcaaagaacttaaaatggaactaccttgctccccagcaatcctattactaggtatatagccaaaagaaaataagtcattctcccagaaagtcatatgcacccacatgttcatcccagcactattggtaatagcaaagacatggaaacaacctaggtgcccatcaaaggtggattggataaagaaagtataatatatattatctacgctatggaatactacacagccataaaaagaattaaatgttgtcctttgcaacaacgtgggtgccgctggaggccattatcctaagttgattagtgcagtaacagaaaaccaaataccacatgttctcacttgcaagtgggagctaaccattggatacttatggatataaagaaggcaacaatagaaactggggactactaaaggatggaggggttcaagttttgaaaaacgattgggtactatgctcagtacctgtgtgagaggatcgttaaaaccccaaacctgagcctcacgcaatatacccaggtaacaaacccacacgtgtagcccctgaatctaacataaaagttgaaaaaaatgacataaaattaaaaaataattttgatacagaaaagaacatctgggaatggaatatatttgcttttaatatatatctacaaaagtaagcaatgatctctggtaaagtcatgaggcacggtatccttactggctgggataagagcatgcatcagaaaacaccaacatccaaaacatccaagctcaaaacactaatttatagccatctagatgcttttatattcagaattattatagaaagaaagcctaactgaaatcaggtgttctacatgcttttcattcaccagtgaaattagtccaaatagtgtgagactgaaaccagggatatcagctttcatcatcctgggaaagctcgtgctgcttcatttccttccacttcttgctttccagtcaggtctctggttagcagtccatgcagcccataattatgaccaggggtactaagcatgactttttcactttcaataggcctgcactttacagcaagtagttctgagattattatccaaaaatatctaataaccttatacttggaccaatgggcttgtggaataatttgggttcagataaaactacttcttctatctaaccatatgtcagaatacatagcccaccaaaatctttctaactctctgaatccctatggagagtaacacatagtttagcacttaatctttctctaattatttcctacatgctaattttatctccacaactgaaaagtaaattccctgtgtgcagtaacatgccctaatctttatgaggcagtaccataaacagtgttgagcatatttgatgcctgtttaataaatagttgtttatgattatccgatattaagacttagactcctgattgggagctgctttcagttaacataatacagaaatgaaacctcatgtcttttaggaaacatttctagattcctctccagcctcctctgaattactttaacgcttgatttgaatgactaaaactggaacatctttagaaggaaactagagttgtaaatccctgggaatgacttagggtaaataaacaaagacataactcaggtccagaggccaaaaactcagagttcatgttttcaaatattggccagtctgtctttcatacagctgtgtcagctaattgcccaatagcaacctttttgtttgaccatagcaatctgttcgtttctctctctctctctctctctctctctctctctcagcatttactgatgactgtaagtatctttaggtatatttatcttttctctgagtctgcagggtcccttatgatactcagtaactgtgctctcttctccattgcattcttattgctgagtataatgcccagcacttagtaggtgtttaatatatacgttggaagaatgaataattggatggatgaatggatggatgagagatgaaaatactgcctaatgaaagaaggtatcccatcttattaaaataagtagccctccttccttggattgtctggtgttctaaagcgttttttaaaagacatatatgagattaaacctaatctaggctctctccctgtgcgaacacaataattgaaacacatgactttagagaacaaaatgtgacttgactagctgtctgaatcatttcagggtggcatttaatatctttttaaacaaaagacatatatatatatatataactcaacagtcatttaactttctctgtttctcaattctcttatctctaaaatgatgataatatttgcttctttgtacctgtttcgtagttgaattaaaattttgacccctgccatatgattctgcagcccttccacatctttctgcagatactgacataaggtagagaggtcagggaaaggaccattgtagtgacctagtgaggtgtcagcaatgggacgataaggagtagacaatgtaagaaattcatgccagagtgtgggggtgggaatctatagaacttaatgcagatctcaaaggaaacagaagagtccaaatgattaacattgggtttcaaaatccacaccaaaaaaagattttaaaagttgattctttgttcacatgtctcatatatgcttatacaatagcagcattcaaaagtattttgagtcttatagttacatagatatttttacctaaatttctcctgtagcaagggttcagggactttgttaattttatactttttagcttgtcacccagccctttgtttcctctctctggatgtgcagaaagattttaaaatctatccctgccaaacaattctctttcgtgggaatttggtttaaaccagttctgttgctatggtacctagttttcagttaatggaaaaatacaaaaccaaaataatactgaatttgcagtatatatgtccccactcattgcatatcgacttattcatgttgattggattcgtaaacgatcaaaagttgctcagtgctataaaaaaagtatctaacctacttagaattcacatactgacacttatacctttcaagtgttgtgtgtatctgtgtgcatataaatggtagaagagatggcatggagcagtaagagtttttggaggtgaagaaacctgacattgaatttcagcttagccagctaaaagctaattgactttggacaatcacttattgctctggaccttttttccaatctacagagtgggtattcgtaatataactacttttcaggaatgttattaaaattaaagcaatatgttttaattgcctagaacaatgcctggtacttagcaggtttgcagaagcctactagtgttttcaaatgtggagatgatgtgtgtgtgtgtgtgtgtgtgtgtgtatgtgtgtgtgtttgtgtgcatttgtgtgatagggtgaattgtaaccccttaagactcaaatattgaagccctacccccaatacctcagaatgtgactgtatttggagagattgcttttaaagaggtaattacgttaaaaatgaggtccttaggttaggctctaattcagtctgactgtcatccttataagaagatgaaattaggatacttggaggaagcaccaggaggaggcatgcacccaggagagaccatataaagacacaacagaaaggggaccatctgcaagtcaaggagagaggccttagaggaaaccaaacttgctggcaccttgatattggactcctagcctccagaactatgagaaatttccattgcttaagccactcagtctgttgtactttgttactgcagccctggaaaactaatcctatctatctatctatctatctatctatctatctatctatctatctatctatctatctatctattggacaacaaatgttcgtaaaatagaagtgaaaataacatgctagttttcctgagtctttttctcttcatttactgcctccagtgtatagtttgttattatttactttttactaataccttacatggtataaagaaacacaagtcttaaatgtatatcccaatgaatttttgcatatgtgcacatccatgcatccactacccaaatcaagacttagagcattccttgttccctagcagcctctctcatgctcctccaggtaaagagccattcctcttccccacagtaaatacttgtgacttcttgtgttttatatattttgaacttcatataaatgagtcatacatcactcttttgattctggcttctttcacatagcgtcatgtatgtgaaatccattcattttgctctgcgttaaatgttcactttattcattgctgagagcagtattccattgtatgtacatcctccaatttatttattcattttggtgtcgagcatttttgtagtttccattatttataattatgaataaagttgctatgaacattcttgtaactatttttggtggacaaaaccactcttttctcttgggtaagaagtacatgggaattctataaaatgtttctatcttaatgttacttacaggataaagtctatttttctcccttctgagtattgctttttaatctccctactagaaattctcagtgcttcttaacccggggcaggcatttttgctccccaggggatatttggcaatgtctggagacacttttggttgtgacatcttcggggaggatgctactggtagtgggtaaaggccaggattgcagcaatatcctccaatgtgcaggacagccaccaccaacaaagtcaattatctggccccaaatgtcaatagtgctgctgttgagaaaccctgtatctagaccaatagaatttaattttgtatttttactgagtaggtattcattgcttgaccaacccacatattctttctgatacatcttttttagaacccttaggaagaaagagtaatggcagcagcattttccacccttttctattggggttattaattctcaaaaactatacagcctgactttagtgagttcaaggcatcagagcttgtctttatcaataaatatttccagaaaagggaaatagcatgtgtcctttttaagatggtgatgttgcattctgcgaagaaatatatatataaatatgacataaaaatatacatacatatattgcaaatgccatttctttgcctctatttagaaccagctaagatagccaggcacatggatacttgttctatttcaaaatgtctacagaagattcttgaaattcttcctgtcatttttcccagtctctaaaaactgtgatcaatccattcccctgaccgcatgtcatccattgttttctcaggcaacctcttctcaccttcagagtaactgaaggtatattatattcactttagttatcagaagtacctaaaagaaaaaaatgatcaagttatttccatttccatgagcctgagccttctcctctcccatattcctgccagttcttgcttttgaaaactgagcttaagggcaatattgtaacttgcactttttgctgattttatatcattcatctagctataggtctgacagaggtgattacttagctctccaaataggcaatgatgtgattgccttcatttatttcagtgacattgaaatggaggaatgatatttgttggctttgggctttaaagacatgtggtctgctatatttttggctgacagctggaactagtagtgcctgacactagaaaaccaaaaaagtcagcatttgcccttttcattttgaaaattgaaaatcacaggtaattaatcatattaaatgtgaatgtaacccatttcattgctataaaatcacctcttcaattaaaatttttttataaataattatatttgtgcagcttttagcatactaactttttcgtgagttgttttgtaacttacatattaatatgttttaactctgcttccttaactgcattactcattgttattgatatttgatgtctaaggtccgtgatgcccaaagtcttactatgtttgggagagtcttataaaatgaaggactgtctatattaaaataacaatgagaacctcattgatgataagtgatgtaaaaagagagaataactaatttttcaaaatgattctcaaagaaaaaggtactttctatgattatagaatcatggaaaaatgctggaaaagcttagttctacacttaagctcttgggaaatattttatttaagctgataaccaatattatagagaaatgacaattttggcctattttaaaaatactttcatcttcggtagcattatctaaactctaaatctataatatgtcattggaaagaaaagggttccgtgctttcttaaagacaatttgcattttagtaaagagcactatatcaatcagttcactaaataaggttccaaatatgaagaaaagcaagcataacgtgaagccataacagtcattgtttttaattgtgatcaataatctgtgtcgagaacaagtttttgttaattctagaaaaaagatatgacagacaagttgtccttaaacataagagaaacaagatcgatttcatattcactgtcactgtgggtgacattcttctgaataagatttcaaaataaatgctgcaaaatttcaggataaaaaatagaacattagcattaatcatattcatgctcacttctctattttctccacctttgccttctacagtcttcagctatacaggtgatacgcttgttccatttcaagtcaaatgacaccattagttaattagtgttgcaagtctggcaaatgagatctgaaacgaaacacctgtcctttgaccctaacttgttccttgcttatgcaaatgaagagagcagtttaagcattttaaatgttttatttctcgtattatgctgcaggttttatgctgacaaggaacacttaatgtgtgtgaaactagttctgatcatctggtttcagctttttatttattgaatggattttcagtgctgtcattttctttttacctgaagatcacataaaggttgcacaggtttacgtttgcgcataaggaccagtttggttttaagtttagctgtttgagtaacttcatgaaataaattagaaatatatctgttaaatttacccatatgttaaaatagcttttcggtttatgcattatgactattgcaatatgccacactaatatatgaacatttctataactaatatatgtttttaaaatagaaaattaaacgtgaaaggttttttatgaaatatatttatcagcatgaatctttactcactgagcaccatttaataagcatactgattgtaatgattgcattttctccactaaagttctcaataacaacccttggatataaaaataaattcactttcgttattttaaagcaagtcaacaaaataaaattattttggataaattgtataactgaattttcataatgatttatctcagtaagaatagaaaatattattactgtgcagataaggtggcaatggaaatccaatgagaaataaaggctatgaacattgaatgcaatattgttatctgtttgccttgattcatcaaggggtttccaaaatgtttttacaaagttcttattttcaataaatcacatcataaataaaacctcattaacatgaatagagggttattgccttgaaaactgtctattggaattcttggcgggaaagtgagactagtagttatttatttatgtataggtttttctttgcatatacagtagtctctcctggtccctggtttctctttctgtggtttcagttacctgaagtcaactataatctgaaatattaagtggaaaattacagaaatgatttctaaaatgtaaattgcacatcattgtgagtagcatgataaaatcttgcattgtcctgcttgtcctacccgggacataaatcatctctctgtctagtcaccatattcaagctgtacatgctacccactctttcatcatttagtagccttcatggtatcacagtgcttttgttcaaatgaccctttttttacttcataatggcctcaaagcacaagtacagtgatgccggcatactgttgtaattgatctattttattattagttatcgttgttaatatcttactgtgcctgatttataaatttgattttatcatatgtacatatgtataggaaaaacatagtatatataggcttcaatactgtctgcagtttcaggcattgactgggggtcttggaacatatatcctgtgaatagggagggactactgtgttttatggaaaaatggaaattatttttattagaaaagttttaacaaaaggagagcagagcaaatatttcctgtaacagtgggaaacttgttttgttatgcatatggctttctaggtagaaagaatgcttttggggaattttaaataagttgggatgaaaacttgacttctttaactctaaaagatgctttgaagttttagtttttagtttttgtaatgccaatcgtgtaagataaacaactttgaaaccccatatttcagcttatcaaaaatatttaaaatgttcaatcccaccatttaagaattattatatacagaagtatgcattatacagtaattcctactgggaagcttagagcctttagatatttccctctcttaaagagtgggagaaattccaagttataattttttagtattacatatttcagtgtcaaaaaattctcatgaacaactaaatgtacagaattctctttgatataccaagatatgattttacaacttcttttaatgtaatacattttagtgtctaaaaagcatcactaatttaattttagaaattcttttcttttcttttcttttcttttttttgagatggattctcactctgtcgcccaggctggagtgcagtggcgggatctcggctcactgcaagctccgcctcccgggttcacgccattctcctgcctcagcctcccgagtagctgggactacaggcgcccgccaccacgcccggctaattcttttttgtatttttagtagagacggggtttcaccgtggtcttgatctgacctcgtgatccgcccgcctcggcctcccaaagtgctaggattgcaggcgtgagccactgcgcccggcctaattttagaaattctactcaatccaagtaaagtatatgtattccagacctctgccctattaaaaatggagaatcatattcccaattaaaaaaattataagcacaaaggtttctttaaaaatccttaacttttttttttctgttgacttcttcacttaactaaataaataccaattaaaagtttgctctcatggcattgtacagttgatggaagtgggtcaaatgagtgggagctattttactggtccagggaaaagatgatgatcacttaaatttagatggtgcaaaaggaaaacaagaaaagtgcacagattttgtttgtgggtgattgtttttactgtggtaaataatcgcataacataaaatgtaccatttttgccatttccaagtttacagttcagtggtataaagaatattcacatggttgtacaaccattactaccgtcatatcttcaaaactgaaactctgcacccattcaacgtcttcccacttccactccttctagccccaggcaacaaccattctattttctgtctctatgaatttgatttctgtcggtacctcatacaagtggaattatacactatttgtctttttgggtactggcatattttacttatcataatgtcttcaaggcccatgcatgttgtagcatgtatcagatttgcttctttttgaagctgaacaatattccattgcgtatatatacaacattttgttcacccattcatccataaatgagcccttgggttgtttccatgtcttggctattgtgaatagtgctactaggaccgtgggagtagtggacagagttgaaatatattttgttacgtgctgatgaattgaatatgaagactaataaattgtcagaaatacctatccaaaagtatagaatatgatttaaaatttttttcttctgaatatcatatgatcttttaggatactaactattacataatggaagctcaataaatataattttataaattagtccatgaaaggcatctttaaaaactgctttaaatgtctgttaatccgttagggtatcaattttattggccttatttctgcagtttcaaatttgctttatttaattttctcattaaaattgtttatatttaaggtatatagcatgatgttttgatattcatgtacgtaatgaactgattactacaatcaagctcattaatatattcatctctttaaaagatgctttcttggggttcaaaaaccggtaccccacaatatggcactttgacatgttggactaaagaaacattctcaaggtctctctttcaccccaccccacccctcccagcatctctcaaccttctgtctctctcaaagcacaggatgaaggttttctctgaagttcccttatcagcctgaagcctggacccaccaaagaagaaaacagttacctctggtcccttccctgagtttcattaacttaacacatattgcaggaagaaagacaagtctgtcagcacacctggacagactttcaaaaaactatcgtcttctatttcattcccattcaggatttcaaagagaatcatttaccagctattgtctgctctgcaggcccaataggctttgttccaggccattgtatgttttccaggttcactcattttcccttaaaaatatttactatccctcaaattgccacatttcctccacctcccctccccttatgaagaagaatatataaacatttttaccccactgtgttgttgggtcattctcctgtgattcccctttgccatgcacattaaaatacattttatatgccatttctcctattaatatgccttttgtcagttaattttcagcaaaccttcacaggtgaagggtcaatattacccttggcccctacagttttaacttatttttcaggagacgcacatttgtttttttgtgcatgggtacgtaggtttctgtgatgattttactaactaaatgggacaactatatcgttacataccatggtttcactcattcttttaaaattatttttactactctagttaaatataaataccataaaatttgttattttaaccattttaaaatgtatacttcggtggcattagatacattcacattgttgtgcaacagtttcactcgttttaccaaattgaatgttttgtctactggccaggatttattgattgttgtaatgaaaatcttttcactcatagtttagcaatccttttgtaaatgccctaaatctgtatttattgtataattaaataccttagcaaatacttttaaactgaaaatcccggtgtactaagttcattcatgtttttcactctcctttttttttttttttttttttttttgcatttcagtttggcaagtttctattgattaagtgtcaatagacttttcttggttgtgtcaagcctactgatgagctcatcaaaggcattctttatttctgtcataatgtatttgatctctagcatttccttttgagtctttcttagagcctctatctccttttaattactcatttgttcttgaatcttgcctactttttcctatagccatcaacacattaatcacacttattttaaattctctagtaattccaacatcaatgtcatacctgagtctgattctgatgctcgctttgtcttttcagacaatgttttatctttcttttttgtgtgccttgcactttttgttgaaagccagacattttgtcttgggtcataggagctgaataggcctttagtgttaggatttatgttaatatggctaggagttgggctgtatttaatgatttctgtagctgttaggtgcccatggcttccgtttcctctagtgtgtttgtttttagcttcccagttttcttttgtcttccctaagaagtttttctcagatagagtctgtaacttttggttctttcagctgtaatccactgtcattatactggggccccgttagtttggttgtagagtgttgaggagaggaagcattctatcatcataaattaaatcacagtcttttagtgggcctgtgtccctggactgtgaaacacactcataaacgtttcttagctttttgcttcccctcttaggtgagacaggaaaaccagagggagctggagttgggaaaatattcttctttcagatgggataaggctctgataaagctttttcctcctggaaaataggactgtattatggagaacactcatactctgggcatagttcacaatgttttctcatcctgtccccctgccagaaccaccagaggatcaatcttggctcttcactgtgagaacaggaggggtggggttcttagaggtaaagtacagataactgtagaggccaccaggaaatttctgactctcatactaatccacattcagtttccagcaattcataaaaattacggtttaaggattcttacaagtttatggatccagtggccttttttttttttttattcgagggaaactaattgctgctttgactctgtatttgcctgtatctctgcatttcagtgtggaagtttgctttgtgacctcaattttctgatggatccaagaaaagtcaatgatttttagtttctttggctttttcttgtaagcatgacttcctagctctttacatgttggagctcttgggtggccttttaaactactaactagtagaatggaatgcagtaaaaccaacaaaaacgatggaacaacagagcctggaccattaatcgcgccatccaatctagagtagaaaagacaatgtaagtaaggcaagtgaccttttaggtcctaaaagcaactttatcaccagcccctgtaaacttttaggaaaaaaagattcaaaattataataaataatattcatacatatttgagtgagatcaatgatctggcttcttaaattcttcatggaatatcaattttgacatttctttggctcatttccacagtggctgaatctgttctcagtcagaaaggaaactcgtattttcttttttcaaactttgtaattttccaactttctaatgaaacattgtaggccttcattagaaagattacctcagactaacttactgctagccatgtccttcaacagtgcacctaagataatttattgaagtatcttctctcagatggcaaatgtttcttcattcactctcttagcattttaagttccacagtaggagctatgtaagtctcctaaagcccacaatttttagccctaaagagcattaatgtccctctaatatacagttgatccataatggtgtgccttaagctttcttcaaaaattgcctcaaaaaaaaaatcagtgatgtgaatctgcacttactgtaatactgtggtaactgggagtgggccatgtgtatactcatgtacataaacacactacacattcctagtttaactatttgctaaccctgtccattgattttcacagtatatttttttctcctctcaatagtttttaaggcttcctaaaatacaaattgaaataaccttttgctgcagatattatggaatccaggcaggcctgcaagtctgtgcagagtttactctctggcaataagactgagaatcccctttaacaggccctgccagaccacctgttatatttgaataattcacaaacagcttttcccattaattcatgccaggcctctaaatataatccaaaataagtcatgttataaggcatttggattagaaataaagtcattataaccatatgcctgcatttataaatgtacttttagacaacatagtaccattctaaattttcaccacaggatctgtttgacctacagagatatttgggtatctctaacttaaggaaaaaggccgtgaggcaaccattttaaaatacttacagacagtgagtttgaagaactttgaacttgtagtctcctgatgcctcactgatacatccatttcaaggcagacaattgccttccttaagcccaaagttagaaaaaatgaacaggacagtttttcaggttttgtctcaattcctgttcatgcacagtgcaatttttgccacactatcctcatctcttgaagagatggctagccatttcttctgtgatgtctcaaatgtgcttcaaagttcattgtagcccttataacactgaaacctacctgtgtgcacatctgtctctttcagttctttaaatggtatgagaacatgttaagattagctctataatgagtcatttctgcatccctcagatccctggtattgaacttgacacgtaatttgtatttggtgtggttattcagtgagtaattgacaaattcaatgatccatattatgcatgtcacattttagcttcccttaaagaaaagtttttaggaaaggaaaagaacactggggaggggggaaacaaaattaacttggccatgctgagaattgcaggaatgtgcactatgcaaacaagttaagtaagcacagtgtcttccttacttccatcagagaccttgcttggctaaaaagcaagagtggagcccactctctgtattcatttgcataatttgttcacactctgccttagccacagaagtggaaagcctttcctttcctggtagtccctaggacatgtcatctacctccctcgtgagttgtaatatggggaggactggaaggcacagcttagagccccatggtgtccagtcaggggaacatggggataatgtgtccattcactgacactagcgcttttctccaatatggttaacagtcgaaatttgattaaagcaagttaggaaactccagtaaggctaattttctcttgaactatatatggtgtctgttggcaagaaaacaagagttacacatttaagtaggttaatatcaactgagaaactcttaagaatcatagtttaagatcaggccaggcgtagtggctcacgcctgtaatcccagtactttgggatgttgaggaggatggattgctcgaggtcaggagttgagaccagcctaaccaacatagtgaaaccctgtctctactaaaaatacaaaaattagctgggtgtggtgttgggcacctgtaataccaattacatgggaggctgaggcaggaaaatcacttgaacccaggaggcggaggctgcagtgagctgagatcgtgccactgcactccagcctgggcaacaaagcaagactctgcctcaaaaaaaaaaaaaaaagaaaatcatagtttaagatcaaagttgaatgtatattgtgatgagtctacagtgtgggaacaactttttgaaaagtgtaataggtttgagaaaaatggcttaatttaaaatatgtattttctattatatgtgcatgatttttatgaagatatattctcagaattctttaaattagtggttctcaattcagtctatgtatcagaattgcttgtgaagctttcaattaatacatatggatacctaaacctaacccttgattctgattcatttagtctggagaaaggttggacattttttagcaactttgtttttgatttaggattgaatatcactgccccaggattatgaagaaattcatcatcatcctaaaaatattatagtacttcagccctttattatagtcatttttccataagtggcaaataataagaatccaaagaaacatgttgtgtatgcgtggggccatctcgatacagctgatgacaattaagttgttggctgtctggttttaaagatatttggaaagacaattccttttataagaaaaccaaacaaattccagccaatgaatggtcttaggcggtcaagaattttattctggcttactgacatcctcaagatctcaagacacagattagactatgagaagacacagtaaaatactccatctttattcttagagattctattctgaatcccacttttttcagttttattgagatgtagtgacaaaaaattgtatgtatttaaagtgtacaacacgatgtttcgatgtaagcatacattgtgaagtgattgccataatcaagccaattaacatattgatcatcttacatagtagccatattttgtgtgtgtgtggtgagaacacttaagatctattttcttagcaaatttcaggtgcacaatacagtattattaactatagttactagctgtacattaaattgagataacttattcatactgcatcactgaaactttgtacactttgatcaacatctccccattttccctactctcagccactggtaacctccattctactttctgctcttaggagttttaatttttagattccagatataagtgagattatgcagtgtttgtttttctatgtttggcttattttacttagcataatgtcttccaggttaatctgtgttgtcacaaatggcatgatatccttttttttaaaaaaaaatgctaaataatattttattgtgtgtgtgcatgtgtgtgtatatatatcattttctttacgcatttatctgtgaatgacacttctattgtttatgtatatttgctgttgtgaataatactgtaatgaacatgggagtgcagatatctctcccaatcactgatctcatttcctttggatatacacccagaagtaagatgctgaatcatatgataattctattttttcattttttgaggaacctccattatgttttttgtaatagttgtacaaattttcattcccaccatcagtgcacagaggtctctattctccacatccttgccaatacttcttctcttttcacatttgataatagccattgtaacagttgtgcagtgatatctcattgtggttttatttgcatttctctgatgattagtgatattgagcaccttttcatctacctgttgatcacttgtatgtcttcttttgagaaacatatattaaattctttagccaattttaagtaggcttatttgttgttgttgtttgctattgagttgtttgagttccatatatatttggatattaaccttttatcagatgcatggtttggaaataaatttttcctgtttcataggtagtctcttcactctgctaattgtttcctttgctatgcagaaacattttagtttcacacaatcccacctgtttatttttgctcatgttgcctatatttttggagttatgtccaaaaagtaattacccagaccaatgtcaaaaagcatttcccttatgttttcttccagtagttttaaagcttcaggtattaagtatttaatcaattttgagttggttgttgtatgtggtgtaagataagggtccaattttatttttttgagtgtggatatacaattttcccagcatcacttgttgaacagactgccctttccccattgtttcttagcatgcttgttgaagatcagttgactataaatatgtggatttattgctgagatctttattgtgtttcattgctctgtatgtctgtttttatgtcagtatcatactgttttgtttactatagccttgtagtgtattttgagatcaggaaatgtgatgcctccaagtttgttcttgctcaaggttattatggctattcaaagtcctttgtagttacatatgaatttggggaaatgctattgcaaatttgataggcattacattaaatctgtatgtggctttaggtagtatggacatttcaacaatattaattcttccaattgatgaacatggaatatctttccacttatttgcgtccctggaatagatccaactcagtcatgttttaatttgctggtaaattcagtttgctagtattctgttgtggaattttgcatctatgttcattaggaattttggcctgtacctttcttttcttgtagtgtatttctctggcttttgtatcagggtaaggctggccttgtgaaatgattttgtaagtattacccgcttttcaagtttttggaaaagttaacattaacaaaaaattggcattaattcttctttaaaagtttggtagaattccgcagtgaagccatttgatcctgggcttttctttattggaaggtttactttattactgattcagtctccttacttgttagtgttctgctcagattctgtatttcttaatgattcagtcttggtaggctatatgcttttaggaatttattcattccttctgttagacagtctactttgtgatttgacaatgtattttcagtagtatgctttgattcctttctcttagattttgtgtatctactaattttttttttcattgtggttaccatgaggtttacataaaacatctaatagttagttatgtctattttaagctgacaacttaattttgactttgtacaaaagctctatacttttatttccacctttcacattttatgtaattgatgtgacaatttatatctttttatatcatatattcattaagaaattattaaggctctagttatttttaaaacttttctcttttaacttttatattggagttacaagtgacttatgcaccactattacagtattattctgaatttggctatgtacttacctttaccagtgagttttatatttttatatgtcttgatgttactaacaagtgtccttttatttatatttgaataagtatttttcgcatttcttgtaaggcaggtgttgtgatgatgaactccctcagcttttgtttatcttacaaagtctatctcctcttcatttctgaagaattgctttgctggcatagtattcttggttgacatttttttcctcttgtactccggatatataatcccattctcttatggcctggaaggtttctgctgagaaatctgctgatagccttataaagaatccctagtatgtgatgaatcatttccccttattactttcaaaattctttgacttttgataatttgattataatgtcttgatgtaatctttgagtttttgtatttgtgtacttttgagcttcatgaatctaaatatctatatctatctcaatatttgggaagttttcaacaattatttctttaaataaactttctgcccctttctatatctttctggaactcccgtagtgaatgtatcggttctcttcatgggaagctctaaattctgtaggccttctgtactattttttatttctatgtttgtttctcctctgactgtgtaatttcaaataatctttcttaagttcttatatattttcttctgctttatcacgtctgctatttatgctgttcattgtattcattatattcttcagctccagaatttctatttggttctttttttatgatttccatattcattgaactttttttgtgaattgtttttctgattttgttcatttgcctatctgtgttagtttgtacctcactgagctttttgtaaagagttactttgaattatttgtcaggcagttcttagatctttatttatttggtgtcagttactaccaaaattgtgagttgtttttgttgtgttatgtttccttgatttttcatgttccttggagttttgcattgctgccctcacatgtgaacaaggagtcacctcctccttcaatccttactaactgacttcaggatacaaagactttcattagtcagcctgacattctaggggtctcgcagacctttactatggatacacctgccccactcctcttgtttcctcttcaagaagaagctttatgtttgaatgtcttctcttgatcctgcaaagccaggctgggtgctgactgcctctcttttgtttttcctagggcattgccctgaagtactcaaagttaattgccttctcccagtcccagagagttaagccagatgtctgtgtgtgcttgtgcatgatttgcagaggctatgggtagggatggacagaagggcatgcagagtgcttggagacacatacgagaaagttaaatgggtccacaagtgttgcatcttttgatgttcatgggcagggttcatggagttcatgatgcaatgagtagaaacaatggccctttgtttagttctttactgaagttgctgtgagctctcaccccttttccctgttcttagctttcccaagactattcaactgagccagtttcttctgtgttatgggtgaagtgagataaaagtaggcctcttgggcaacattctgactagctatgctttcactttcccctgtgaaacaaatcgtgggccaagaatgtctctcttggcactgagctgtgtgctgccttgggaaaggggtgatgcaagtaaaatgaaactgttttccttaccctcttcaaggtaatcgtggatcatttttttctcccatggtgcgttgggacctctcccctggtccctgggctctacctaatatacttttgtctgtgggtagttgtcaaaattggtgttgctatggggataagaactgaaaactcttatcccaccatctttctaatgtcactcttctctgaatggattacattagaaaagaacaaggtgttcaccttctttaatgatgtagttacaaggaatctacctctgggagagacagttatgttttcataaatcctaaggcaaaacattagatatgaattctttttatttttatattttctttttctttttcaattctatctatctatctatctatctatctatctatctatctatctatctaatctatctgtctatctatctatctatctatctaatctatctatctatctatctatctatctatctatctatctatctatctatctatctatctatctagtagagacagggtcttactgtgttgcccaggctggtctcaaactcctgggctcaagtgatcctcccacctcagcctcacaaaatgctgccaccatgctcagccagatatgagttctttttctaaaggaagggtttatttaaaaggagtcatagaccatcactggattctagtttcctgagagacatagagggtactctggcattgaagagagacactagaaggatggacatttttggaatgtttaacaagtctctcactttacagcatcagcagcagagagtgttaagcttgaaaaaataagaaaaaagtataaaattatgatcttagtgaattaatgacatattgccaagacttaggccatcatttatatattaacattaatgggatgtgaatgtttataataaaagacaaaaagatgagcttaaagaaattagacctattacccaaacataaatatttacttttacatgttgtcagagagtatttgtacctgtcatattgctgttttgcaaattagagagttaaattgactcctttttatagatattctatttccgtcctaaaactctttccatcactaaatctctcactaaactttgtggtgttacataatcctcactttctagttagtggcaatcataaaaacagataaaaaggctttcattattaggagtggcatggatgaagtagttgatactattggcaagatagaacatgacaaagagagcatgaccattatgacttatgcattaagtgaggtgttttgggctctttctggctatgcaccatatggtaaggaaatgatatctctgtcaggatagactagattgtaatgcagtaacaaatgaccctacttaaaaaaaattattgttatttgaatatttgcaaaatttaaggatcatgacatcatgatgaacatctatagaaatacatagctctctacctaagtacaaaatagagatatagagataaagtacaactgattcagatagttaaattattatgctattatttaatgttctcatgtgcagttttatgtattccagataatctttctaaataacttatgtagacatttatattttggtcagtctatttttttatttccaagtaatttaatttttgtcccaattgaattttaagaatagagctaaattaaaactgttactcagagctttttattcacttttatgttaataaagggttccttagagatgatatacctagttttctgtaagtggtttttattttcttggtaatctacaagtcagattttaggcaacacctgttgaaaaaaggttagggcaccatttacatgtttttcaaattgtaaagttctaatgcaggtttctgcagttagaatattcatgacacaaactgtttcaaatacaacttaaattgagattcaggtttaaatgttgatttatgaaagttcttctttaatgaaacttgtttttatgagatctctgaattgcaagaagtaggacttcagctttggaactgaaatagctcttggctatttgttttaatcactttccacacaaacctcacttctgaacggtcatcttatttagagttattatcaacttacttgccttagtgctgacattgttgatggattcgaagaagtgaaattggcaatcctgtatctaatgctagtgtctttggaacaacaaaaggagtttcaaagggaggctgaaattgaacacttaatattataaatcatgatatatgtatttttttgttttgtcttgtcttttactttggagaggggtttctttactgcatggacagttgtattcattaaatatatagaaaggtcatggctttcctaaaactttgggctgttctttaaaaattaatcttattctcatcaggagtttgtcacttctaaactgatctgagttaatttattggaactgtgagtaagagacattacataatttgggcacaaggagagaatctgtgtcctggaacttgctgatggcaccttcaaaggtgacccagttgaccagaaagtgttgatttccactttgtaattttaaaaatatatgacaatcaaagggcatttcatgacccaggagggagtggaagtagcaaataagcatgattattgcaaaagcttactagattgagtagaaggaatatgcactgctgtcaaaaagttgcaatgtaaaatagtcaaaactttttctatggctctgatgatagcaatcaacaaaatgaggaaaatgatgtggcaggattcagaatctgactaaggagtactaacagagaaaattatcatgttcttggctttagagacaaataaatgggccatgtgggcccaatcttttgtaacttaaaaaatgggaaaagctacgggagagttaacgttaccattttatgccttaagtgagatgttttgggctctttctggctacaaggtttggaaccacaattggattaatggtagttggctttaatggtccgtgggaagctaaaggttacaggcaatcatttcatcagcctcctggctggcctcaatggaaataaaattgtcagactgtaactttaaggaggctgagttagcaaatatattaatttcctattgttgttgttataaattattacaaatttagtggcttaaaacaacacaaatatattatgtcacggttctataagtcagaagttcaccatgggtctcactgggctaaatcaaggtatccacaggaggctgcaggaaacacgtttctttgccttttcaggcttctagaaactccgtgcattccttggctcatggcccctttttccatcttccaagtagcagtatagcattaccacaactacttcactgactctgcttctgtggtcatactgccttctctcgtctgtaacctgaccctcatgcatccctcttttcatttactgaaaaagcaatgactgtgacatgactaaataaagaaaatttatcatatttcttaaaataatgtatcaaaataattgtatttatcaaaatgacagcaaattaaaaatttaaaaagaaaacagataacaaatcaatacgcagggtatgaaattactccagatgaaatgaatggacaagtgattagaaaataattatattcatggttgctcaagatataaagagatagcagttactaaaaaaaaaaaacacaaacatttagagtcgctaaaaatctcaaaagaacacaactagtgagtgtgtaaaagaaattctagtcaatatgtataaaacaaaagatcactattcggaatatgcagatacctcttatttattaataatgaacaaatgacctaatagaaaaatggagaaaatatttaagcagataatcaaagcagccaataagcacatgtagtttttcagcttcactgttaatcatgaaaatgtcaattaaatatatatgtactattttctactcaccagattgcgtaaattctaaattgtcagacaattgaaaggttgatgaaaaatggctacaattttgcatattgattaaatctaaaaactaatcacccagaaattaaaacttttggtatttacccttgagaaatactaatacatgtatataaaaagacgtgcacagagatattatttatttttatggttgtttgtggtagggaaaaattaacatcaaaacaaacataaaggccatcaaaatggagtaaataaataaaatgtggtaagacatgtaatgaagaaatactattctgaaattaaatgaaatgcactaaatgtatgtttcaatatgtggggaaattttttgttgttgttttttttttttgagacggagtctcgctctgtcgcccaggctagagtgcagcgtcgcgatttcggctcactgcaagctctgcctcccgggttcacgccattctcctgcctcagcctcccgagtagctgggactacaggcgtccgccaccacacccggctaattttttgtagagacggggtttcaccgtgttagccaggatggtctcgatctcctgacctcgtgatccacccaccttggcctcccaaagtgctgggattacaggtgcgagccaccgcgcccggcccatgtggggaaatttaaaaaagatagtgagtaaatgatatgaaatatttatgtaaactaaagcacagcctttctgtagccagctaggtggtccgcacctataatcccagttatttgggaggctgagaccagaagataacttgagtctaggagtttgaagccaccttgggcaacatagtgaaactccatctcataaaaaaaaaattaaaacacaaaataacactagataatttgattggctacatattcatatgttcagaagtttgaaaactaattgagggataaatagcaaatttctaatagtgtttacaccagtgtagacgaggagtggatcatcaaaggaggtgaggatagaagagagcctggctagatgagtgatatctctaattattttctgtcgaaatatacctgtattcatattttcagtagtttgtgaagtatgcacatggggggaaatgtgtttatgagtaaactaaataaagtataaaaagtggttaattctggaagctagcaatataggttattaatattatttcttttttatgtgttttctaagtttgtaaatattttatcaggataattataccaaaaaaagtagttttaaaaaacagtgcagcagattaacttcagaacatacagagccactgggcaaattcctgagcagaggaatttatatcaaaagcaggatacagaggcaaagagatcttaaaaagacagttaagagatgagtatagcttttgaagctccaacatagatctaactgattattcataagaaattaataaagagaataaaaagaaggaatatttgaattgataatgtcaaataatttttcagaactgaaaaataagagtagagtccactgtttaaaagtatgcattgaatgcccagtatgataagtaaaaataaatccacctatagaaatcaaggttaatgagaacatcttattagataccagaaagaaaagacagactacctacaaaaaaaaaaagacaattagaatgacaccaagcttctcgttagcaaggagagatgccagaaaacaactgaggataaaatatttcaaccttaaattctatgcctacctaaacaattgttaagaagacaaaataaataaattttctgatgttgactaactaagacaacttctgtccataaatttagtggagaggaaggttttttaaagcaccagcaaatgtgaaaccaaaagacaaaaataggattcatgtaacaatgcattttttcttcctcctctcgaaaagaagttaaaacttctatattacagtcaattgaatttccagtaattttccttttgagaacaaataaagtaaggaaaatctttacattttgcctcctgtttcttgataaaatgttaggaaaagtcaaaataagtcgaatatttgatgaaattgatgcagttcatgtcagtatgcagtaattggaagccttggaaccctatgtaggctgacatagaaagcaatgtaaaaatggcacgtgaattttctttcttctttctaaaaagaagagctagatttttagataggaatacaaatgcttcatttgttcataggttatcaagattttctttcatttgaagttttgtttggcagacatcttcctttgaaaatgggagacttgtggaggtttcaaagggacttgtgaggaaaaagttttggacagaaccagaaactggctggattgagagacaacatttttatacaaatgcacattgaaagggaatgaaataacccttaattccaacatgatctgtttcagattactaaaggaaatatattatattgtatggtatataatgagcactcaacaattttatgttgaactagtagcaattatcttgtgctcccgacccactaagcttatttaaagatcaagaataacagattattcttgatttaaagatcaagaataacagattattcttgatttaaagatcaagaataacagattattcttgatttaaagatcaagaataacagattattcttgatttaaagatcaagaataacagattattcttgatttaaagatcaagaataacagattattcttgatttaaagatcaagaataacagattattcattagattatttatgtactagataattaattcagtttaatataagaataatgaaatagattaaaagagagccatgcatgggttaatgatattaaaatgtcacaaacgaataattataccaattgtgtacacaggagctttttgagaaaaaagtagcggattttatgttctgttgaaaactgtaaagttctatataaatgttatttcaacagcattgaaatggtgattttctgagaaaattttctgtactagtttaactaaattatacatggagatcaaatgaattctcaagtgggcctatttattttgaatcaggaattatataaaatatggaggacattattaagaaaaatagcatttaagactaggcctaattaatattttcaatgagggtaatttcataggattgaagagagaataggatttttataactgaatatggtataatagagaccaagagttttctggtcattcattaccaagaaaattttaattatgtggaaaaaagcaaaagaacaagaaagtcaagaggatctgaagcagagtatttatccagcccagtgtcacttgattaaaatagagatgttgtagtcctttagaatgtccatagagacaactgaaactgacctttaaaaagtgttgactataggttttgttgttactgagctttgatagccactttaaatcccttctgatgcaatttatgccctcccttctttatcaaaaaggaaaaaaattgtttagtagataatatggaaatatgcctcatttctctacagtctagcaccactgaactagaaaatataaggcatttatattttctagtttggtgatttcgaccattgaagtgttcttcattccacgctttggaatggaaacttgaaaatgatgtaggaatatagtataaacattctgactagagtatgattgaaaaaaatgtaactagagtggttttctcttttctgtagactgttctttcagtgcacctcttaatatgattatggctccaatctcagagagcctgagaaacttgcccaagtccacatggctagaacataacatgattcattcagggtatattaacaataaggtttattttcgggttaagaataagaaaatgccttatattttttgagtgttcgtttaaagtccacagtcaaaaaatattatatgacttcatcaaggcctaactctcttcactttatcacattgcttcaacaatagactgttaaggcagtggaataatctgggatgattaattttcttgtaatcattgaggaccatgaataaaattgcaaaaaaaaaaaacaactgccattttttccatttatatttttaattagaaagcaggcatttaatgagaaaaattcacgtttgccttgcaactacttatggtcgcgttaaaatgtctatcaatgtaggataaatggaaacatgttaagatttgattattaagctttgcttaattaatatatttccaggaaaatatcagactactgatttgggctacaaataacactgcctggttttttgtagccaggtagtgttatttgcagctgaaatcagtaagtttgtaatttagaacctgttagcctaataaatcatcatgtgttactatgaatatgtgaaggcatttaactaaagtctaagtatgatccatcatatggaaatacgtgaaggcatttccagtctttagtaaggacatggcaatgtcactatcatatagaacagtggaatggctattatttgcctcatcagacggatgcattcttaataaaagataaattagattgaacccataagcggatgtcaggaactgtgagatttacattttagaaacatttcctagaaatatcatgggaaaacttatcaaatggatttttattatcaaaaatagctgagaattgttcgtacatctacatatgctcatgttccttaattctaaatttgcttcagaaacaagtcagtaatttaaatgacaaataaaacattggaaaaatattttcaatgcatataagctaatttttattttaataccaatagacattacatgctttcttagaaaaagaactgaatgtgaaaacgaaacagtttaatctctgctctgatatcacgcatttcactggtgagtctactatttttttctcatacattactacttaaaagtatgggagtttgataaattcaacaaaataccttttattgtagccttaggtggcttcctttgttttctcagttaagaagaggacattaatgagtatgaaaacatctaagattgttgctttatttactaaatgctgggctgattaaatagtaagtctgccaaagatcacagccttgaacaaaaggcatagatgcatatcacagagtaccaggaggggattccattcctattccatttgagtctcccctgacaaatgatactgagcactacgttacattgattcacttgcccacaaaaggttgtgataagagtgtctaatctttatgcttgaattgccttattgtacttgtagaaatgaaagcagaagaaaatatatggaaaacagattgtgtatcttatttgtcttctgtccaaaggatacatttaaaataatttgtctagccaggcgcggtggctcacgcctgtaatcccagcactctgggaggccgaggcgggtggatcacgaggtcagcagatcgagaccatcctggctaatacagtgaaaccccgtctctaccaaaaaatacaaaaaattagccagacgtggtggcgggcgcctatagtcccagctactcaggaggctgaggcaggagaatggcgtgaacccaggaggtggagcttgcagtgagccgagatcgcgccactgcattccagcctgggtgacagagtgaagactccgtctcaaaataataataataataataatttgtctaaacagagttctttcttcagtgtgctcttcacattttaatgctgatttgaagcctgtaaccattaaaattaaaatggaaagattatactttaagagtagaatcctcaaatgcatatagaagtataaacctaatgccctttagcaaagtctaggaggcatcaagataagattagttcctagtagttactctttgttaattaactccctgaagaaacctgagaacatttgatattaaagaaaatatagtagttcattttcagatagattgaagttttccttgctcttctaatagatgtcttcctaatatagtttccataatctctaaatatcataccctgcttttattctcttgtatatttcccctcccatatataaagtatataatgtactgagaaacatagaaataattgcaatatacaatattcctagttacatttcagtaattgttttgtggcatacagttacatattctttctgggagagtgtgatgaaggatatagatgaaagattggtcatttcagtgccaaatcatcttagactttatgtcccttcctccctacaatgtcaccatcctctgtaacgcttttctcagaattgagactccctgaaggtcttagagtttaacgatgccctttttgtccattagtttatttaataaatgattattgagcaactatatggcaagtactgttcttgattgtaaaatctggcaaggacctttaaggtcctcccagggtcttttatcttataagttgtcaaaaaggcttagtagtaattattttatttgagttcacataaggatattacaaggttaagacttttatcgtgacaaaagtttttgtgttttatttttcgtgtctctagttatttttgtttcatttttattctcaaaccagttttgaatcaagggattttatttttgtccagcatttcactttaagacagttagagtttcttacaattcctgtgctcatgaatgaaaattaaagcatataatcattcaactaaagcgtattgcttgtcatcttaaaacctattttaggatgtgaagtattatttattgaaattttaagttagcagtgtttgacgtagtttgtatcagatactctccaaagtcattttctgattaatggagaccatttaaatatataaataactgatacagaatgaatagcactggctattacaatttctttgtctttaaattcacaggagaatggtgttgcctaagaattgttggcattttttaatgaaaatttgtttatacatttacataataaaattaaaaccctttttcaaaggcacttgacatttagaggcattgtttaaaaatattttccagcatcttctagattttacaccaagtgaatgttctgtttaaaaatggttctatggtcaaacaagtttatggaatgatgcctgcttattctccctgtagaaattcataatgcccatttctgtatcagaaaaatcttagagaatcttgcttatctttatgtttccctttagaaaatgaaaactatttcaaacattttattagtatgtagaaaatactatgacagcagaagtattttatcagtctttaaatttttcccaaatagcaatacattccagttgcatgcaaatgtaaataccttctctcaattgcctgaaattaatacattaaaataacagaaaaatagtgttatcttagtctgtttgggctgctataacaaaatactttagacttgtaatttacaaacaataggaatttatttctcacagttctagatgctgggaagtccaagatcaaggcaccagcaatatcagtgtctggtgagagctctctgcttcatagatggtggcttgttgctgtgtcctcacatcatggaaggacaaacaaactctctcaggcttcctttataagggcattaatcccattcaggagggttccaccctcatgatatagtcacttcacaaaggccccacctattaatacatttgggattgcatttcaacatataaatcattgagggacacaacattcagaccataacaagaataagcttggatttggaaagaatttgaaaaggaaagtaggaatacaattgactttcccaagttcataggtagtaacaaagaatgagcaataatcaagatgcctttgttcttatctttccccaactcaaataagttatatataaaaattcatttcttactaggtccattatacttgtctatctcttgaaaacttgagtgtcctaatgaaatgagacttctattttgtaagatgagagaaaggtgaggcaaatattctgaggcaccttctagactgcagagcaacatgcactgagttttttgaaagatttaccagttttaaaaaataaatgctgtcttgttcttcatcatcctcccatcactggcatatcttggtaaaagtgagatgttatcagtgagagccctttaggtagatcctcgtaaaagttaccattttgagaattgtatttatgattgttggtgtgttaacaaaatcatgttgcaagagaaatggacttttggctaactgcctagctctattatcctagaaactagttaaatggtatatgtcaactattttatgataaaaatgtcccccgtggatggatgagatgtatctaggttggaagaaccataaatacttgagaagaagtcacagctttgggtgttcctaggtgcagggactcttgatatggggcatatcccttgaaggtctttggaagctgtattagtccattctcacattgctataaagaactacctgagactgggtaatttataaagaaaagagatttaattgtctcatggttccacagactgtacaggaaacatggctggggaggcctcaggaaacttataatcatggtagaaggcgaaggggaaagcaaacatgtcctatgtggctggagcaggaggaagagagcaaagagcgaggtgctacacaaccagatctcctgagaacttactcactatcatgagaacagcaaggggaaaatctgcctccatgatcatgtctaaattgcatgtcagattgtaattcccaggcccttcctccaatactgggaattacaatttgacatgcaatttagacagtgacacaaatccaaaccataactttccgtccctggcccctcccaaatctcatgtccttctcacatggcaaaatacaagtatcccttctcaacagtcccccaagtcttaacttattccagcattaactcaaaagtccgcagtctgaagtctcatgtgagacaaggcgagtcccttctacctatgagcctgtaaaataaaaaacaagttagttaattccaagatacaatatgtcttggctattagcattcggctcctctttacttatgcaaatctctgcagccagcttgagtactccccagaaaacaggtttttcttttctaccacatgatcaggctgcaacttctccaaacttttaccctctgctacccttttaaatataagttccagtttcagatcatccctttgctcatgcatatgctgttagaagcagccaggcaacatcttgaatgctttgctgcttagaaatttcttccaccagatactctaaatcgtctctctcaagttcaaagttccacagatccctagagcaggggcacagtgctgacagtctctttgctgaagcataacaagagtgacctttgctccagttcccaataagttcctcatcttcatctgagaccacctcagcctgggtttcattgtccatatcactatcagcattttggtcacaacaatttaacaagtctctagaaagttccaatctttccctcagcttcccatcttcttctgagccctccaactgttccaccctctgtccattaaccagtcccgaagctgcttccaccttttcaggtatctttatagcaatgtcccatttcccagtaccacttttctgtattaatcagggttctccagagggacagaactaataggatatgtgtatatatcagaggaagtttattagggagaactggctcacatgaacccaagtcaaagtccccaaaagtctccaagctgggaaaacaaggaaatagtagtggctcagtccgagtccaaaaacctcaaaagcggggaagccagcagtgcagccttcagtctgtggctgaagggctgacagcccccagcaaatcactggtgtatgtccaagagcccaaaggccaaagaacctggagtctgatgtccaagggcagaagactccacaagccagcttatcccaccttcttctgcctgctttgttctagctgcactggcagccagttggatggtgcccacccacattgagggtggatctttctctcctattccactgactaaaatgtcaatctcctctggcaacaccctcacagacacactcagaaacaataccagctagctaggcattctgcaatccaatcaagttgccacctaatattaaccactacagaagctgtcagtggtgttgtcctgaatgacgttggcctgtacctgttagggtgatagctcttctaaatcagaacaatttccccatctcaataatgtggatctgtttccttgaacctaaactgtgtctctgagggtatagcttccagagggctgtgtgagctgtcatacacatgaaatgcagcaaggactcttatggagaggacctctatcacctgacgtagtttctgagaagactcatggcaacagcgcctatcatagttttgagtgtctgaatgtttaattaaatctacagtgaccccttggagggtgattgaatgatatttctctactctccaaatatgcaacttcgttcttaccctctgcatcatcatttataaaatagaaagactagagctggttttctccaggtgtggatctctgataatcctcagcagagtcacttgggatacagattctcaggtctcaaccaagagaaattaaatcaggatctttgaggttagggtcctgtaatcttcttttttaacaccttctcctccccatggtacttgaatacacagctggacaagatgctcattagtttattttctattttagcccttgaccttataattctaatgatttgttcctcccattctacataatgtcttaatgcaattcaaatctcatttcttcagaagaccatcaaggaataaataactgggagtttcagaaatggcaacagtttagggaaaatctctgtagttaagtcaggtttgagaaacccctggaacaatttgttgtaattgtatacttttttaaagatccttttggtcccctgtaatccttatgattattaaaacatacaggtccttagcaccatataacgattctgtttaaactgttggcttttcttttttttcaacatgctatcaccattgtcactgttgccttgactgtagggtagtgacttgctagaaggtcagagattatattaggtcttaccaaacaagtgaaaatcaatattttcactctctttaggagaatgagtttcatatatactcgagatgaaagaaaaattccctttgttgttctgctgaagttgtcaagccttccattagtctaggttaagtttctggggttatgaatttaattttggtttctaatattgatttatatttcataaagactttgttggttacaaaaaaaaaatcctcagtaaatttttctacttcaagggcagtgctttagtttagaaaaagatgtgtttctcagtgatttagtttccatttctggacttaacaataatgagtgaaacaggaaattttgctgtgaattatgaaaggttattatacagtatttccaagccactcaaaattatgcattcatcttaggctcttaaatttaacaaaactgaatgagattcaatactattttctctgttttatcaaaatgttattgaaagttgtttaagattttatactcctcgagggcacatatcttttgtcatctttgcattttcagtagtgtttttatactgcagataatttatgcacattttataaatgagtgaacaaatagatgttatgaaaaaaaagtactgttatcagattccaggataaagtaaaaagcaatatttagcaatcctccatatactacaatgccctacccaagcctgttaattccactcctcatcctcatcctgccacaaacattttcagaagtcctcagacatctctgctatattccctaacttgccccaaactcccgtgatccaaaagtaggcttccctttctcaattaaacttccctttcgctcagtaccccaatctgagcttgctatcctgcggagagttacctgggaaatgaagagatgcagctgtatgatatatatgaacaagtttacccttactggggagatttgtattttaaaagatggtgatggaaaactacagtgatatatacatgctaacttttcccaatgttcaaatttcaggtagtgggacatatggcaaaggtatttttcaatagcaacctaaagacctctcagggaggtgacctccttttctgcctccaagtattgctggttctgctataacctgatatgattttttatttatagagtgctttttataagttgccttcttcaggaaacataaaagagtgggaggggaaatgaataatctctcatgcttttgtatcagttattatcaactttggctgtacattagaatcacctggggagctttaaaaaaatccttgtgtccaggccatcctccaagccaattaaatcagaatctccagggatggagcccaggtatcagtatatataaagttcccaggtaattagattgtgaggcccactaatctaaatgaggatgaggaatgcagtagatctctgatgcttacagaagacaatagttataagaaaaagccatgtgagaaaaattggaaatggttgaccctttgggaactggagagcaaagacagtggctactgagctccaaccaagtgttgcaccatgggagggaaggagcaagatgattaagaggatcagccctagtggcagatcccctgaggttaaagtacttttctgcccttcactatgtgagtttgaatgagtgtcttctttgtacttgttttcttattagcaaagtgaggatgatgattatacctatctcttaaggttgttgtgaggattaaatgaaatcataagcataaatcacttagcattatgttgggcacgtaacaaacatattctacacttttgaactattttgttatgatgatcaactttgaaatactagagttcacttgtcttcttttcagtaggaagttggcttccaatctagggagagagaaggaagagaagcaagagctagggagatgataatcaaatggttctgagaatgatcttaaatttttaagatttttaaatttttaaaaaggctttctatccccttgttcccaccctcagccctcaagaatttcttactgtctttatttcctgccatttcttgttcttttataatcttgtacctctagtttcactatacatcaaaaagatgggaagtgatatgctaacataaatgggtgaatttgtagatgtatcagttgagattttgctgtgtagtaaactacctcagaacaaacaataattattttgtagcttaaaacaactattttgtttgtgcctcattaatgaatgggcaatttgggctgtgttctgctgggtggttgtttttatggccttactcatgtatcagtgtcagctgttggtcatcagggacactctttatttcaggatggactggctgaggctgggatgaaggggttgactgagccatgtgtccctcattatataactagttaaccttggcttatttacatgatggaaacagtttccaggagtggaagattggaagcttttaagatcaaggctgataaccagcactgcatacttctcccaatttcttttgggcataaaaaatcataaggctagcgcatatccaagggaaaagtaagatgagagttgcttcaaagcgttatggccattttttggtaatctttgacaataacctgttgaaataaagcaaatgggaggaaatgaggtcacagtgaggctgatagcattggacatataaaagtcatattatagataggctttggcagatgactgggtatgtgtggtgagagatagaaaaaaattagtggaagttgcagacttagtaattatgagaattgaactttgattaactaaaataggaaagccagaaggtgacaaagtagcacggaggcttacctatatattctcttacagaaaactttgtactgtattccttttctaaaattgcttttgttttttaataaccattttttcccaagggcaagatgtgttttaaaattcattagttaaggactcaaatgaccaattcgatttttctacttcttagttgactccttcatgaacttttggaataataataaaatgtataaatagtgtatgtactttatgctttaaatgaatattcctctaatatcaactccaaagcaggttattcaaagtatgaaaaccaacatatctaactctgtgctcagaccaagatttgtgtagcatctctagagaatctgagagaaatctatgagaataaaagacagtggcactgagacattatctttacatatgtgcttattgaatctgtatagaattcttctataaaaattatagacttttttgttacagatttgctctcatgaatttaattttatattgccttactcttatattgtcactttatataggccactagactgtgaaataaaatcagataaaggtagatgttttccaccactaccccttctccccaatttagtattcacaattattttgctatagcaagatggtctctcctttttactggtattttccctcagaaagtcttttttttttttttcactttgacgtgcattacgttaggtactttaaaaatagcatattttcctaaattaatagtctttaatattcatttataaatacccagcaccacttaacctagtgctttaaaaattgattattatttattattgccattacttaaaatgtgcttttaaataattaaatgactttttaatattcccctctctctctcactaacttgaatacattttaccagccttgatttgtggagatgtctccacatggatagctagctctactggacaggatagcttgtgttactagctcaggcataaataattatttacttttgttctcttacagtattttcctgatctgttactttgctacttccatattattgctgcataataaactatctaagtactcagtggtttccaataacaatccttaattctcactccgttatccgtggatcttctgggggttggctatctgtaaggggcttagctgagttagactctaagatgtaggttgagtctcggtctgtgtcatataactcattctctttaaacccatcataggtttgaacatggtatggtctaggaagatgactctgacagcactttttctctttgccaatttgaacgcagatgactagacatctcaatgtataagatgtgaaacaggaaacaacatgcaaatatacctttattgacttataacagatgacagcaattccattttcctctactattgcattttctactctatttgtgaatgtgagctttcctcatcaatttatagaatctctgtatgactcattctgtcttaatctaaaactgaaataactttatattgtggaaataaaatatcttacatctcaatgtagtctaaaataggttaaatgagatggttcttcctgagcaagcacagcaggtctgcaatacatcttctttctccacatacattatgtcaagtattcctttagcatttatataagttgtatatgtcacacagatatggatctataaatgcaaacagagcacagatgctggcacgatacacacttaaaattgttttatagcttttggattttatttgtgtcgacttaaaagcaaatttataaatattttttatttaagtaaaagatgtgagctgctattaacactgaaagtgattttagagatcatatattctacctcccacattcgtcacattagggagtacaattcagatgtgtcaagtggcttatcagaggttggactgtgagttagtagaagacctggaaatgaactccagctctcctgactacccagttggctttttccatcctattgccatatctcctaggcctctgccaggacagagtgccacagaactgtcagatggggaaatgagacacaattgtttcctggattctattattgttgagatttttaaaaatgtgttttaattcctaacctagctttgcaggcacatcaaagctgagtgcatgtccttccgaaatcttccctggtatcctgtaatggacactgattttttttttaaatcttcgaattcttgtaacacttaaacattttggtgtgaggatagtaaaatcattaagaataggaagcatatctcttgctccttctgcaccctctcacagagattagggcagttctggctgtttaatattattgacaactccccagaaagatgaacacaataaactgttgattgagcacagccaagtttactagatcaactacagtaagagagagcaccatctgaatggagtcttggtaatgtgtcaaaatatgatatttttaagagtttcaagcccaggctgtataattttagggttggtcttgcaaaatgggtagttagttgaggcttgggctgagtttatgtcctaacaggtttgaatgggtgagaacaacactacaagaacccatgatatgattagtgatgggtaaggtattccagtatttttagtgcaagacgaggaaagcatgcatcttcccagaattgcttaacgtgggaaaacatagtggtatcagtttttaatatttgcttatggacaggtcattattacataatcctaaaaatgaaactgggtaaaccccaagttatatgtaggaggcatttctaaataacactcagaaattggaaactatgtaattaatcaattaattaattaatttttggtatacaaatatagctctattaaactaatgataaagatagcatctttttttttttatttttttatttttttatttttatttttattttttatttttttttatcatactttaagttttagggtacatgtgcacattgtgcaggttagttacatatgtatacatgtgccatactggtgcgctgcacccactaacgtgtcatctagcattaggtatatctcccaatgctatccctccccgctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcatttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaagatagcatcttaaaaggatacattgggcatcagattcaggaactagaggcagaaaatttatgggaaaggattgcaggcactcagaagtaattgtggcacaacaaagtgatctctgtgccatatcatttgtcctacagtgcatgctttctagtttcctttgccttgacttcatagtaacctcctagatagagtctaagattgctcctctggcactggtcccttgcttacttgtgcttggcctgtctgttgctgacttcatctcagacttcagcctacagccctgatccctgccttcagtccatatccttggtttggtaacttgtttatgcggtcttcccagtatgtaaccactgtccatactctgtccatatcactgctccaaggtggcttatggtactatatttccaaaagcctgctaaaggtcatcactacagcaattctcctttttctcccatcatcaattttctcttctctactgaatattcctgaaaacatacgaacagtccattgtttttcccattctaaaagaaagaaaacctttcttgactccaatttccattatatttaactccttattatctcttttccataattgcaatatgcctaaaatttcttcaatttctttaattaatttatctcctcccattcttacctgaatctaccccaatcaggccttcaactccaccgctttgctcaaagtgtactggtgaagttgagtcttgatttccatgttgctaaattcagtagtaattctcagtcttcatcttacttaaaattatccaggctggagtgcagtggcaagatcatggctcactgcagcatggacctcccaggctcaagtgatcctcccacctcagcctcatgaatagctaggattacacatgtgcaccaccatgcttggctggtattttttattttttgttgagatggggtctcactatgttgcccggtctagtcttggctcctggactcaagctatcatcccgccttggcctcccaaagtgttgggattacaggcatgagccatcatacctggcccatcctacttaaaatttcaagaacacttcacacacagctgatcaatctgttctctgtgaaacattttatcctcttagcttccaacataatcacttgcctgtttttccttctaggtatctaaatgctcattctcagatttgtttttcttactggtttctcttaatttcctcatcttcttttttaaactgtattttattgtgttgagaacacttaacatgagatctgccctcttaaaaacttttgaatgtacaatacagtattgttgactataggtacaatgttatacaacagatctttatcttatttaactgaaactttatgcatattgattagtaattcccatttatccccacctctatcccctggaaaccatcattccactctgattctatgaatttggctattttagatacttcatgtaagtggaacaattcattatttgtctttctgtgactggcttattttaattagcataatgtcctcaagtttcattcatgttgccatttattacacaatttccttctttttaaaaggtgtattccattgtatatatgtatcacatcctctttatccattcatctgttaatgcacatttaggttgtttccacatcttgctattgtaaataatgctgcgatgagcttggggtcattgatatactgatttccttttctttgaataaatacccagagttggattactggatcatacggtagttctattttcagtttcttgaggaaccttcaaactgttctccataacagctgtaccattttacattcccactaacagtgtgccagggtcctaatttctccacaaccttgccaacacttgttttctttctctatattaaccatcatgacaggtatgaggtgatgtcatatgtcattttgatatgcattttcctgatgattagtgacattgaacatttttctcacatacctgttggccatttgtatgtcttctttaaacatctgttcaagtctttagcccattttaaaaattagattactagtgtgtttttctgtttgtttgtttgtttgtttgctattgagttgtaggagttccttatgtattttggagattaactctttatcagataaatggcttgtaaatattttattccgtgctataagttgcctcttcattctcttgattgttttttgttgttgttgtcgtgtaggagcttttcaattttaagtagtccctcttgtttatttttggtttggttgcctatgcttttggtgtcatattcatgaagcaattggtaagattaatgcatgaaacttttcccctgtgtgttttcatagtagttttacagtttcaggtcttatatttaagtttttaattcattttgagtttatttttctgtatagtgtaaaacaaggatcccattttatgctttcatatgtggatatctagtttccccaatatcatttgttaaatagactgtcctttctccattgtgtattttcggtactcctgtcaaagatcaattggttgtatatacatggatttatttctgggttctctattctgttagattggcctatatggctgtctttatggcattaccatatcttttgaatactgtagatttgtaatatgttataaaatcaggaagtgtgaaacctctaacattttctttcaagactgatttcatcgtttatggtcttttatggttccatatgaattgtagaattttttttacctatttctgtaaaaatgccatggagattttgatatgaattgcattgaatctatagattgctttgggtagtatgaacgttttaacaatattaattcttccaatccatgaacacggatatctatttgtttgtgccttgcttattttttttaatagatgttttgcccttttcagtgtacaactcttttgcctccttaagtttattcctaagtattttgttgtttttggtgctaatgtaaatgggattattttattaatttcttctttagatattttgtttgttagtatatagaaacacagctaatttttgtgtgctgattttgaatcctgcaactttaccaaattcgtgttgtagcaggtttttggtggaatctttaagattttctttatataaaatgttgtcatttgctaatgggaacagtttttttctttcagatttggatgctttttgtttctttttgttgcctaattactctggccaggactttaaaaccatataatttagtctgcagacatcgttagccatgaaattcacaggtcttatgcaaagctgggactgctgaaagtgccatttgaattttaagaaacaacagaggagtttagtcagttattctttcatgtgttattgaaactcagttttgagtgccatctcaaaactaacagaataaaaagaatgtgggaaaattctgtatgtactcaatctcaactttcctccttgaaagttaatatttagtaaaatgtagtctgaaagaaggaagccactagaagtcatagaaacagagagtagaatggtggttaccaggggttgaggttgtgggcggggggttggggggcattggagtatgttggtcaaagggcacaaaatttcaattagataggaagagtaagtttaaacgatgtattgtataacatggtgactgtagttattaacaatattcttgaaaattgctcagagtagattttaagcattttcaatgcaaaaaataagtttgtgagttaatacatctgttaataacttgattagccattccacaatgtatatgtacttcaaaacatcatgttataactataaatataaacaacttgtatttctccatttaaaaaataataaataactatttatagaaaaggaaaccactgggctcccccttgcactattggtcttatctggggaaactgttagcaaaggcgaaataatatgccagatgttccaaatggatacgtgataccaacaggcttctgttagaaactatctcctgcctacaatccaccaactgcagtagtgcttttgtgtcctgcatgtgtactgtcgaatgccaaattatagctccattttccctcagcttttctctattcaaactattgcaggaagttcacttgtacattttgttttgttttatccacccagtgctactatttggctccaattctaccataagcacagatatatccccatgcactgaaatcttgtggcaatgcttacagtggttaatatttttggattatcttcaaaatgaaagcagcacactatttttaaattgttcttgagaaccctcaagcctcaatttgaaagatactgccctagagacctaacataaacatgattctctttttaacatgcaaacattcattccttcagtaaatatttattcagcacctactatgtgtcaggcattgtactttgcactggagattcaatgggaagcaacaatggataaggctgttgccctatgaatttatggtgtaatggataaggctttccttgaataagtcacaattataatgaaccaggcagctaaggacatgttcacatttttatgtagtatgaacagctgtagtacctcaaattgatagaagctatgagttatatgcaacttaaacttgaagtatttttaccactgaaatagtctagaagctgttcctgagagattaagttgttttgcattatcattaccttgtcatcatcagtggtatgtggatgtcatggttaaaagaggaaatataatttcggaatttgtggcttctcagtagagaacacatttaaggaatgatctctaaactactatactacgatggaagagagagttctaagaagtgaaagaggataacaagaagattattaggaggcaacaaagataggcttggcctctgttgatattttctagtgataagtgcctggggatcatctaggtgaagctctaggcgaatagtcagaagttgttgatgtctggtaagttatattaatgtaaaaccaggcaccagctgatttaaaacatacataattcaatagaacacttctatatgttaatcaataacatcaggtctgatcatttaggctacttgggttctatgttatttggagcaagccgtgctccagatcctacgagacaggtacactgaggatacctagcagagtccagctctgctactcctatggtccttgaatcatcctgatggacataattggtaggcatgttaagagtgccgaatcttaggccacatttatactaagtcagaacctgtattataacaagatccccaggtatttggaagaaccttaattaaagtttgagaagcacagatctagtaaactgactctctcttagatctactgataatgcattttccaagccattgattctcatatcaattttacctttttaactcattttatagcattctctgggcttatcatttttccctcattcaacatcactttttaagatccttcattcatactttcatgcattcaatgtattcatagttagcgagcatcttctatgtgtcagtcactgctctaggtgctagggatagaggagtaatccaaacaggccatatccctgactttatgaagattttagattatcatattttccatggcactcctattttcaggtattctttatgatctcagatcattgctcttgatttttggtataaaatgttatgtagcatgacagaataaagttgattatactgagattgaaggaacagaatgctttgagtcatcacagacttttgttacagtcctggatatactatagcctactagctatgtggtcttgggaaagttacttaatctcttcgactcaatttcctaaactgtgctattatatattaattagtaggataaaataaaataatatatattaaatgtctagtaggatatgtggcctaagagactttcaataaattggaggaagaacaactctggctgttcttgtattgctataaagaaacaacagaccaactaatttctaaagaaaagaggtttaattggctcacagttctgcgggctttacaggaggcatggtgctggcatctgctcggcttctggggaagcctcatgaagttcacaatcggcgcagaaggtgaagggggagcggacacgtcacatggcttatgattaacgtatagaagctttctattgaattatgtatgttttcactcagctggtgcctggttttacattaatataacttaccgggcatcaacaacttctgagcaaggagcaagagcaggaacgagagagagagagggaggtgctacctgcctttaaacagatctcacgagaactaactcactatcgcaaggacagcagcaaggggatggtgctgaaccatttgtgataaatccactcccatgagccagtcacctcccaccaggcccactttccaataccagtgattataattcaccatgatatttgggtggggagaaatatataagctacatcagagcttatacaagaaacagcatgaacttgcttggggccagtttattaaatccaatgaagctctattagatacaataaaattagacactttagaaatgtacaaaaggcctaaatttgggtagtctcatgccttcccaagggcaggtattttccctcttcctccctgcctctcccgagtgattccttgcacacgtggaagggagatctggcaggatgctgaactagcctgacgctatgctggtcatggcctccatgtttcctgtgaaacccacaagaatagttgagcacaattcttaataggatggcagtgtctcttgctgacccgcccatgctccttgactctgcagagggcttgtaacaggggctcatccaaggtcaacctcaaaactccacctcagacatcaaatggagtctgaaagagcccaaggaagcctggctccttatagaagtcacagtgatcattggagttgatgactgcataaactataaggtgaccacctgacgacagagtagcactaacctgacatcattaactcacctaccacagcttctctggcctcgaaggaatttttctgcagtactgtgctgtgaagtattcaggaattatgttttgtgctgtaacgtgccatagccataaaccaaaataaagtttttaaaaatgagatagctacttaactaacctgttaagatttaggctaatgattagttctctggcattacacatcctcgaggcatgcaccgtagggtaaaggacaccagaatatgagatatcagtggtctggacaaacagatacttttacttcagagcagtgggaggggagatggaagtgttagtaccatcctgtgatcacataaaggtgactcttcacctgcagttgctagggagaggcttgtttgttactcaaatgaacaggaaattaagagatgagcttagttaatgctaggaatgcttcatggctctctataagtaagcacaaacttgtggggtaggcattgtgacaacgaggtgcctgtaaatatgaagttcagtgcacatgatgtggcaaaaaagacttctgcgattcagacaagcacttcttccaaagagctctaagcacaaccctgacgctgtttccttcattctcaggacacttctgtgaattagccaaaggtcaaacccagtccttctgcttagacagaggtagagggagagcaagtcaccagtcgggaggagcagagggggcaccatagtggggactgcctggctcgtccctctgcccttgtcttcttcctctgccgggcactctcctgtctctccacagggctgagcaggatgtggttctcacagccagtggcctaagtgcccagcagtcaccggagaaccaggcccactgaaccttgggggaagccctctgctgttagggaaggagacagatgcagctgtttattaagggtgaccctgtgcatccactgtgcggagcagcaatttgcaggcccaagtggactcaatctttgggaaaacacagagctagatggattcttattactgccatttcacacaggaagaaacctgctcacagggagtaagtgaaggtccaggatcacatggccagaaagtggtgaacagggatctccaacccaaatcctctgacctgctattgaatctggctgggcagcctctggccagctgtctatgaaaggctggcaggcagcagagtgtggccctagaggatctgatgaacgggtgaaaacctaaaatggggaaactcacacaggatgggttcattttctacaatgcttcaggtgacaccatttttctaagttttaacttaacaaagaacatgagagtgttaataagaattgtatgttcttgggtacatcacgtgggacagaatttacatagaatatatatatatatctttcaaaacatatattcagccattgataactctgttgctttattaaatattatgattcttagattagttgtatcatctgtgaatgagattgataattgtgtttgcaataagatatattcataaattccattcattaataataaccattaagaactgcttgaatttcatgtcttagaccatatagtagcttatatgtaatattatcatttaattcaccagtgtccacagagaggacagagcaacacatgtcacaggaagaatcacaacactatttgataatccctgtcttgggttcttttttggaatgaggtggggtatatataaataaatagtaaatgaagtcaacatgaccatgcttttgtatatttctttctggtttacctcgtttcacctctcttttcatatgaaagttcttgctccattaagttcatatcaactgcaatgccacattctctttcccattgccatcaccttctgacctttagaagttccctatatgaataatgccttcagcacttttgtcatcgttttcagcttcaccccaactgccagcatgattctgagattttatggtgccgagaggagcccccctcaccaatgtcctggcctcacaggccttgatttcctcagagccagtgaggcagtcctctctccccttcctcctcagccagctccttgcaccaggcccacagtttacactgtcactgtaagaaattgctggccttctctgaatctctggtttaaccatcccatgctgatgccaccttctatccctctttcaaggtctctggaggatagtgttcctcctgcagaaggtgatccacgctgcttacagggaacttcacttctgttcttgcagagtgggaaacaagtcagttttgcatacccgttggagctccaacagttcttttccccagccatggtgtttgctaggttttgctcagatgggccctgcttggttgtcgtattagcctgagtgtctaaggacaccagtgttcattcctccctcctcctccactttatcccattctccagcccctcgttagtcaggcttcatgactcctaaactttgtgatgtcattggtgacactgggctctgatcagatcttggcatatggttcctaccaggttcgtggtggaaacctgattaccctaatggccgaatccacttttagaaggaagccttgactttctacattgtaggaaagtaaatgagggtttcagtggaaaactttgccttgtatagagtacatcactctaggttctctgacactaaccttgcatttgtctttgagctcatttctatcattttgtaagttgtaggtcactgacagacatgcttaatatctcgtacagtggaggttcagttgtatctcctttcatgttataataaaaccagttttgcctccatttacacgttcatttcaatatccttgatcaatattctagtatgtattctttatattcttttttgaaccagccacaatttctactcatttactcattagttaaatagactctttaaatacatgttcatttcatatctgtatgagtatcatgattttactctgtttgaaaaatatttttaactgttttggaagtcccagtgagatgcccaatgtattcgcttgccagatccagattatctttaatgacaagaaattgcacctcctatgtggttaaaacccaaatgtgtcttttcttggccctctttaggtgaatccaaagcaatgagagaacattgttcactctctatttttctagctttaatttccctctctactaattttgtgtttctctttggttttgtttcatttacagccaataagttattctcctttgttggcagcaatcgttgtgaacttgattttagggtctgacgatttggagatccctctaagtagataaatggtgtatagaaatctaatgactgttgagtgaaagagaacagagaatctggcttatctttctttttgtctgtcttttttaaatctcaaatcagtgaagaattccatgtcctcttacaggaaaacagctcttctatctagactggggagtttttctgtttctgtgttgaattttgacccatgtctgaacaagaatcgaagctataagttgtacttctctgtgcctgtagggataccttcacctttgattgtgtgaatgtattgtgtttcttagttccatgtggtaataatatatattataaagtctctcaaattaaaggagccctgttctgattggtatatctgaatacttgcttatataaataaaaattgcctaaaattctctgaaataaatgaaattgaactaatactttaaatgtgctagaatacaatatatatattcttcatgaaaccattcagaaccataataaaaaatttaactacacataatttaaataaatatttggcaaaaatgaatggtttactttagaatttattaaaaacagctatatcttttttgatgtcagtgttattacaaaagtgtgttttttaatgagttggggattttttatttgtatttatttatttacttttaatttattttttatttcaataggtttttaaggaacaagtggtgtttggttacatgaataagttcttagtggtgatttctgagattttgatgcacccatcacctgagcagtgtacgctgtacccaatgtgtagtcttttatccctcaccaacccccaccctttcctcccagtccctaaactccaatgtatcattcttatgcctttgtgtccttatagcttagctccaacttatgagtgcaaacatgcgatgtttgattttccattcccaggttacttcacttagaataacagtctccagttccacccaggttgctgcaaatgtcattatttcattgttctttatggctgagtagtattccatcgtatatatacaccacatttttcttttccactcattgattgatgaacatttacatttgggctgattccataattttgcaattgcaaattgtgctgctataaacatggtgtgcaagtatcttttttgtataatgacttcttttcctctgggtagatacctagtagtgggattgctggatcaaatggtagatctacttttagttctttaaggaatgtccacacagttttccatagtggtcgtactagtttatattcccaccagcagtgttacagtgttccctttatactacatccatgctaacatctattattttttgatttttttgattatggccattcttacaggagtgagatggtatcacattgtggttttgatttgcatttccctgataattagtgatgttgagcatttttccgtatgcttgttggccatttatatatcttctttggagagttgtctgtttgtgtccttagcccactttttgatgggattgtttgttttttcttgctaatttgtttgagttctttgtagattctagatattagtcctttgtttcatgtaaggttgtgaagattttctcccactctgtggattttctgttaattctgattatttcttttgctgtgcagaagctttttacttaaattaagtcccatctatttatctttgtttttgttgcatttgcttttgggttcttggtcatgaagtctttgcctaagccaacatctagaagggtttttttcaacgttatcttctagaatctttggttttaggtcttagatttaagtctttgatccatcatgagttgatttttgtataagctgaaagatgaggatccagtttcattcttctgtgtgtagcttgccaattatcccagcaccatttgttaaatagggtgtcctttccccagtttataaaagtttttgtttgttttgtcaaaaatctaagtatttgggtgtgtttctgggttctctattctgttccattggtctatgtgcctatttttataccagtaccatgctgttttggtgactatggccttatagtatagtttgaaatcgggtagtgtgatgcctccagatttgttctttttgcttagtcttgctttggctatgcaggttctttttttggttccatatgaattttaggacggcttttctagttctgtgaagaatggtgttggaattttgatggaaattgcattgaatttgtagtttgcttttggcagtatggtcattttcacaatattgattctactcatccatgagcatagtatgtgtttctatttgtttgtatcatctatgatttctttcagcagcgttttgtatttcatttttagaggtctttcttgtcctcggttaggtatattcctaagtatttgattattttttgcagcttttgtgaaagtggttgggatcttgatttgattctcagcttggtcactgtcggtgtatatagcagagctactgatttgtgtacattaatttgtatcctgcaactttgctgaattcatttaccaattctaggagctttttggatgagtctttaggattttctaagtatacaatcctatcatcagcaagcagtgacagtttgacttctgtttactgattgggatgccctttatttctttctcttgtctgattgcgctggctgggacttccagtattatgttgaatagaagtggtgagagtgggtatccttatcgtgttccagctcttgtgcagaatgctttcaacttttccctgctcagtattatgttggctgtagctttgctatagattgcttttattaccttaaagtatgttctttctatgctgattttgctgagagttttaataataaagggatgatggattttgttaaatgctttttctgcctctattgagatgatcatgtgatttttgtttttaattctgtttatgtgttatatcacatttattgagttgtggatgttaaaccattcctgcattcttggtatgaaacccacttgataatggtggcttatctttttgatatgctgttagaattggttagctactattttgttgaggatttttttttttttttttttttgagactgagttttgctcttgttgcccaggctggagtgcaatggcgcgatatcggctcactgcaacctctgcctcccaggttcaatcgattctcctgcctcagcctcccgagtagctgggattacaggcatgtgccaccacacctggctaattttgtatttttagtagagacggggtttctccatgttggtcagggtggtctcaaactcccagcctcaggtgatccacccgcctcggcctctcaaagtgctgggattacaggcatgagccaccacgcccggccttgttgaggatttttgcatctatgtttatcacggatactggcttgtagttttctttttttgttatgtccttctctggttttggtattagggtgatactgacttcatagaatgatttagggaggattccctctttctctgtcctgtggaatagtgtcgataggattggtattcattcttctttgatataattcagctgtgagtccatctggtcctggactttcattgtttgcagttcttaagttacatttcaatctcactgcttgttattgatctgtttggagtttctttatctttctggtttaatctaggagggtttcaaagaatttatccgtctcatctagattttctagtttatgcacgtaaaggtgttcatagtagccttgaataatcttctgtatttctgtggtatcagtagtaatacctcatgttttgtttctaattgagcttatttgcatcttccttcttcttttcgtggttagttttgttaatggtctgtcagctttatttatcttttcaaagaaccagatttttgtttcatttatcttttgtaattttttgtttctgtttcatttatttctgctctgatctttattgtttcttttcttctgctgggtttgggtttggattgttcttgcttctccagttccttgaggtgtgaccttagattgtctgtttgtgctctcgcaaaccttttgaggcaggcatttaatattatgaactttcctgttagcaccgcttttgctgtagcccagaggttttgataggttgtgtcactattaccgttcagttcaaataattttaaaattttcatcttgatttcgttgttaacccaatgaccattcagaagcagcttatttaacttccatgtatttgcatggttttgagggatccttttggagtcgatttccaattttattccactgtagtctgagagagtactttatataattttggttttcttaaatttactgagacttgttttgtggcctattatgtggtctatcttggagaatgttccatgtgctgatgaatagaaagtatattctgcagttgctgggtagaatgttctgtaaatatcttttaagtccatttgttctaggttatagtttaagtccattttttatttggtgactttctgtcttggtgatctgtccagcgctgtcagtggattattaaagtcacccactattatggtgttgtcatgtatctcatttcttaggtctactagtaatcgttttataaacttgggagctccagtcttaggtgcatatatatttaagattatgatgttttcctgttggactagtacttttagcattatataatgtccctctttgtgttttttaactgttgttgcttcaaagtttgttttgtctgatataagaatagctacccgtactcctcacttttgctgtccatttgcatggaatatctttttcctcccctttaccttaagattatgtgaatccttatgtgtcaggtgaatctcctaaagacagcaaaaacttggttggtgaattgttttccattctgctcttatgtatcttttaaagtggagttttgaggtcatttacattcaaagttagtattgaggtgtgaagtactattctattcattgtgctgtttgctgtttgaatagcttgtgttttcttttcattgtgttattgttatatcggtcatgtgagatttctgttttggtgtatttggaggatttgtttcaagattcagagctccttttagcagttcttgtagtgctggctttgtagtggcaaattccttcagcatttgtttgtctggaaaacactatctttccttcatttataaagcttagtttcactggatacaaaattcttggctgataattgttttatttaaggaggctaaaaatcggaccccaatacttgtagcttgtagggtttctgctaagaaatctgctgttaatctaataggttttcctttataggttacctgatgcttttgcctcacagctcgtaagattctttcctttgcctgactttagataacctcacgattgtgtgcctaggtgatgatcttttgcagtgaatttcctgggtgttctttgagcttcttgtatttggatgtctaaatctctaataaggctggggaagttttcattgattatttcctcaaatatgttttccaaacttttagatttctctttttcctcaagaacaccaattattcttatgtttggacatttaacatagtcccaaacttttcagaggctttgttctcttttttgaaattcttttttctttgtctttgatggattgggttaattcaaaagccctgtcttcaagctctgaagttctttcttctgcttattcatttctattggtgagactttccagtgcattttgcatttctctgtgtgcccttgatttccagaagttgtgattgttttttatttatgttatatattttgctgatgatttttccttttatatcctgtatgatgttttttatttcagttagacttcacctttctctggtgcatccttgattaacttaacaatcgacctgaattctttgaattcttttactggtaatttggagatttcatcttggtttgcctccattgctggtcatctggtgtgatctttttggggtattaaagaaccttgttttgtcatattatcagaattgtttttctggttccttctcatttgggtagactgtgtcagagggaagatctgggactcaagagctgctgttcagattcttttgtcccgcagggtgctcccttgatgtggtgttctcccccttcccctaggaataaagcttcctgagagccaaactgcagtgattgtctttgctcttctgggtctagccacccaatggagctactgggctctgggctggtactggggagtgtctgcaaagagtcctgtgatgtgatctgtcttcaggtttttcagccatggataccagcccttctctggtggaggtatcaggggagtgaagtggactctgttagggtccttggttgtatttttgtttagtgcactggttttgtgttggttggcctccagccaggagctggtgctttcaagagtgcatcagctgtggtaatataaggaggatgcaaacttgccctggagacacgtggttaagtattcaggtttttcaggcggtgggcagggccatagacctcccaagagattatgacctttgtcttaggctaccagggcagtagagaaagaccaccaggtggggggcagggataggagtgtctgagctcagactctctttgggtggggcttgctgaagctgctgtgggggatagcggtgtggttccctgaccaatggagttaagttcccatgggattatggctgcctctgctgagtcctacaggttgccagagaagtcaggaaaagcagacagtcacagatctcaccccgctcccacacagctaccagtcctaaaggctggtctcaatcccaccatgcccctccaacagcactgagcctatttccaggcagctggtgcccagggctgagaatttgccccagaccatgagcctccctactgaaaaagcaagcagactcacagtttttctggtgtctctgggagcctgcagcagtgatcgggttccttcaaagggtctgtggattctctccacaaaggtgtaattttttaacttgggtatgtttttcctgaaagtaaatagatttactaatcacctaaactagcatacttctagttattatttaaaattatgaggaatataaattcatgtttgactaaattgaaccattgtgatgacagtcttttatttccagttataacatttagtagtacgtcaacttaaagaaattttccaagttgtttagataatccttagattgatattgtattagttgatgaacattaactggatgcctagatcattcctatgtaagataaaatactgaaatattaattattaagcataaattgaaatttgtatactttggctttttagtagtaaatcccacagagaggctgtattttaaggtctatcagtgaacatgttcctttctgccatgttgagaattctatagggaaattgtgctgctgtagaaacctgggctgtatgggttccccaaaattacagaatgttcacaattacccaccctttagttttctttataaaacagatgtgactttgtataaaagtcataattaataatatctgaatgagactctgctaggagtcttaaaaaaatgagacatgctttgattaaagtaaaagaatatagaatgcttctgtctataagtgaaatgacttttgttccagaataagaaagaggatggtgaagggcaacacaacatatagagatctgtttgaggttcacagaaagtgaatctgaaagggaccacaaatttgtgttaaaattttgcaaaacctggttcggttttgatgggtgtattcataagatttccaaatgcaaacctagaatttggtttcttttcaaatatagtcacagtttctttggagtattcatttgtttgtttttttgtttgtttgttttttgttttttttgagacggagtctcactcttgttgcccagtctggagtgcagtggtgcgatcttggctcactgcaacctctgcctcccaggttcaagcgattctcctgcctcagcctcccaagtagctgggattacaggcatgcaccaccacaccctgctaattttgtatttttagtatagacggggtttcaccatgttgatcaggctgatctcaaactcctgacctcatgtgatccacctgcctcggccttccaaagtgctgggattacaggtgcaatccattgcgcgtggcctattcttaataagaggttgtaaaagtttgctcttcacattagaggccaatttgcccaaatagcagagatgctatatctcactagaatgacgttccacactgtgtttttgactttgtcatgctcttgattattctcttaaaaatacaaaaaaatacaaaaataaaaataaaaacccacaaatactctcattactgaaagtgttgagtttttgtttatgtaaatattgtattgtcactttgattaataggcagccaagccacagccattcgtacactaagacacccatgatcccaatcttaagtgttcaaatctcctggcaaattttaattttgcctttctcaaatcaaatccttaatggaaaaggaaataaaaaatataaaaccttcacagtgtctttggcacattaaggtttctttaatatttcccaggctatcttaaagactttcccctggaaattcacaaagatttcttttatgcctgatggaaggagaagtaatagaagtaaatatgttcatttgttatgttactattgatgagtttcataattgtccaattaaaagtagatgctacttaatatctaggactaccctgaatttgcatatatcatataatcatcatttgtgaatgaatgagaaagattatgatttttgataatttatttcagtggttataatcaaattttcagataaaatagtgaacaaggccaggtgtggtggtgggcgcctgtaatcccagcactttgggaggccgaggcgggtggatcacccgaggtcaggagttcgagaccagtctggccaagctggtgaaaccctgtcgctattaaaaatacaaaaattagctgggtgtggtgatgggcgcctgtaatcccagctactcaggagtctgaggcaggagaatcacttgaacctgggaggcagaggttgcagtgatccaagactgcgccattgccctccagcctgggtgacaaagtgagactctatctcaaaaaaaaaaaaaaaaaactgaactaaatgtttaataatatttatgaaatgtagcctatgtcactagtatgactttttaaaattatttaaagagattttattttgtccagaatcttggcagtcaggaatcccaaataaatgctgcaactgataagtgcatcattgttagctgatcttaggaaaccatcacaggcatttcaactgtgttttccaacatacggatttgtttgttgaaatgtagctagtcaattttcatttttccacaagtcaaccagctgatctcgcagcccaatcagtttttttatttttatctttccaccaccccccaccacctccactgctggaatacatttgtagagaagttttcaaaagtttagagtttaagaattctgtttctagattgttaattgtgcatatgtgagaattatgggagatgacactgatcctgtttggtgaccacatcacataataatggaaatgtttccaaacataccattttcaaaatattttctccataataaagtttattttttaaagctatattttcattgttaaagtgaaacctccattttgagtaaatagagtatatgtcatttatttattgatttaatatattctaggaagtaaatcactgacgaaaaggtggcaacttttgaattactcctcatttttatgaaaagaaaacatacataacttctgttaaatttgacaactctttgaagtactctacagtgagtgaaataaccagtaagcctccatatggcctgagggatttccatagtcactcttcatttaattgcagagtattgtacagattttacagatttttaaggtaatgaaatccataaattcctttacatggacaatatatcaaaatatgttaaagatgtacaaatgattgaggccacatcaacctctttcccctttcaaacttctactttctcctctgaatagctgctatgatgtgaatgtcttataagtgtctgatgtaaactgggtgaggatcaggatcaatctatatatgaaatattagcaaaactttgaaaactttttgataaaatggatagaggaaaaccaaaagctcttaatattttcttctagtattccaatggatttgacttgtgtgcctcatttttggaagtcagtggaataaattgttactttacttttattttatttatttatttttttgagaggtagtctcactctgtcacttatgctggagtgcagtgatgcgatctccgctcactgtagtctctgccttcctggttcaagcgatttgcctgccacagccttccgagtagctgggattacagacgtgagccaccgtacccggccccaaattattacttttagatgatcacttttcacttcctgttagtggcatattagtaagagtttctgataccataggaatgtacaacatacaagtcatttttgaatattccagtgacataaactcttcagaccatgaacccaaactgagaatggaatagaaagtgcttttttaaccctaaagtaagaagacttcctacagaaggtgctgttggttgcctatcatatttcccagctttgcctttcctaatacaacccgtatttttttcaggatccaccctcctcccataacccatgtgctttcagggtgggctgacccttctccacacccaggccaacatggtgtaaaccaactcatccccaacgtcagtgattcattttggaatggatacgtattacagtttggctaatgaaatcagaggcatagactttttgggagatgcttctgtgctaaaatttcctaagtcttaaacacacacacacacacacacacacacacacacacacacacacacacacacacacacggagggagggagggagggaaggagggagagagagagacagagagaaagagaaaggtctcttttcctcttttgtatattatcaaaggacatgatgcctggagatgcaggtgaataaggctgaagatcacagaatggaaggaagccatcatgtctttagacttacagttatgtgtattaataacttccccttatttgtttaagtagctgaattgaggttttctgtttggtgtaatttataacccactaacacatcataacttaccaatacatggactatatactgttatatggtaaggcttcactcattgttattgagtattattcacctacatttttttttaatgtgcttgtttggttttcctacacatagcaccttcaaagcgggaatccttaagattaatgccaggatatcagatattagaggatgttagaggcaaacaaatgactgtgggggatatgaaagctgacaggctacttttgaaggaagaagatgctaaaaagaaaaagagctgggagacacagacttatactgtaatacacaaaatggatactcgttattatggctttgagacatcaagggaaaagttgaattatcctttttatataaagactgagaagtgtatattttacaaagactttcatcaaaaaattctaaaatgtattaaatgtgtaatgttttttgaagagggaagttatgcagaacattgttaggcaggcaggatattctttatttctcccaacacctagtacagagaaagggatgaaggacatacttaaaatttgttaaaggagtaaagagatggatttcgaagacaaatgatatataacagaaacatttccaaaaacactgttttcgaagtgttttctccgtagtaagaaacctagctctataacctaaatctattttgcagtttcataacccatctaacatctgaatgattacttctaaatatttttctctacttaattttctatgatgtctgttccccaatttatcttctttggatgtttaagaaaaaatattacaaagaagttttgaaggttttcctttttaagttatgcatagaaatgtacctgccaaatttcgaatttcttgtcaaatttcattcatgtagcaagatgagatttcagggtcacagtgaaagtctatgaatgaaaaaaaatgttaaatattcatattagtgatgcatggggtaggaagtagtggggagcggtcctcctaataggcagacaataaagggggaacgtgtttgtagaataatttagaaacaataaggaaactaacaggtgatctactttttatcaccgtacaccagcaattctaaacaatgtctgtgatgaagtattttccccccaaaatattctactggtctatattctaaacaactgatgtggctactgtttgttttaatcatctttatgtgaacttcaaattcgcacattattggtcatccatgaataaacatttaactctacatagcagttaacttgaagacctcccaattgcacatacagtctctaccacacagactcaactacatgcatttattttcagagtaaattcataatagtttggaattgcctgagctacctttgggagaagttactgtattccaaccagtggtactagatttttttttttctttaaacaggagaattcatgtaatgaatgatggcacagtaactttaaagataaagacataaaacatgacttgcttaaattttgacattgtatgacacccctttagaatttttgtgttcagaaagttaaacagtgaagcaggatgtgacctataaggggtagtatttttgtttgtaaggagtacatttttaatgaatgaaatatgttactatattggaaaaagacatttacagtgaaaattattttattgttttgaaactaaggaagaaattcagaaaataatgactatcactgagttttgcatgatttttagtgacactaattttatcatgtagaggaagagggtgttaaaatatgattcactttcgtagtcgggtaccctattacttctctaggtcatccctcctatgtaacatgcacactgttaaggcatgaattaattattttggaagtcaacttaccaaataaaccagtgctaccattttctagtctccatggatcagtttgagagccatgaaaaggattaaaatgatccttacaatatacagatagtcttctagtaagtcatgacacactgtaattaagttgtaactgttagtctctctgcttgttcctttcctatcttgaaatgaatatgttcaagatcaaatatgaacaagcatttactcagtggaagatgaaatgggtatgatatgaatagattaatgacatcacatgtgccttctttgaagaaattaattatccaaatgatgttagtgacgtgaagcctcctgggggcacttctcattctactttcagtaatgagctgtatcctgtcaacttactcagcaaaattcacaggaatgcatgtttctctttcatgggacacttctctgggacttaatgattccacactctttctctttttctactacctttctggattttcttctctgtctcctttgctggctgatatttgttttactagcctttccacatgagagttttttaatactatgtcctagacttcttcctcatctcatgttatattcttatcaaagataatctcatgtatgctcttgacttcaaccagcatgtatgagtggatagcgtcaaaatttctatctccagtctctccataaactccttgtagtcactaacagttggagattgccacctgactgtctcagggacacttcaaactcaacctttatgtttcaattatctattgtcgtgtgaatattatagctaaaacaatgaagatttattatattttaaaattctctgcactgactgggtggtttttaatgctccacttggtgtgggctgtagagttactcgtgcatcagatggaggctggactagttggaacctctaagatgtcccctctttccacatgatgtctcttccatcagggcctcttcatatggcctctttctttaacaagttagcctggactttttaatagcattacagctggatgtcaagattgcaaaagtagaagcttccaggcctcttaaggccttgtcccagaagtggcacagatcagggaagcccattgctttagccaagtgcatgtacctatgaaaatcttaagttttagagataaagtaggtattaccatcatagaaggggtttcaaaaaaaaaaaggaaggaaggaaggatgggagaaagaaaggaagaggaaagggagaaagaaaggaagaggaaaggaagaaagaaaggaggaaaagtaggaaagatggaaaaagaaaagaaaataatctcaaatcagcttcttaaaataagaggaggaggccgggcgcggtggcttatgcctgtaatcccagcattttgggaggccaaggtgggcggatcacgaggtcaggagatcgagaccatcctggctaacacggtgaaaccccgtctctactaaaaatacaaaaaattagccgggcgtggtggcgggcgcctgtagtctcagctactcgggaggctgaggcaggagaatggtgtgaacctgggaggcggagcttgcagtgagccgagatctcaccactgcactccagcctgggcgacagagcgagactccgtctcaaaaaaataaaataaaataaaataagaggaggaacaaatattcagcaatcagcgtcattgacactgacacttgatcagtgtctgaagtgagagcagctgttaggaaatcctacttctatctatcaagaagggtttatttaagaaaatagatgacatacacgctataattatcaatatagtttcttccatgggctaccaagtccaaagtattattgcttttgcataatttatgctgataaccttggaatcatggtttggatggtttaaacctctctctccataccaattgaatcattcatcaaatcatatggaatctccctatgtgtaacctcccgtcaagtcctccattttaatttctgtcaccactactctgctgtattttcctttcgcctcaaatttgaggtattataaaaatcttataatggcctatcccggatctaagctatcttacacattaattacacagattccccattgcttatgtaatacaggccaaacatcttagcctggcattgagtgttctctataaatcgttgctttaactttatttctagctcccttatacacaaacttccctataaggccaactggatgagtttcctgtatttaattggtcaagctcttctccacctgaattgttcttccctcatactaattttcccaaatcctgccttctttgtgtgtcttggctcaagtaccatcacatatctttctggaccaccctagccttcaatgatcatcagtcatctatgttcctcttaaaatcagagccaattggcttttagtgtaaaccagtttactgtttcttaaggtttcacgagtcttaaattaggtaacaaagtcttctggaatgcatcaatataattagtcaaaaataaatgttcaatgtatttgttttctttacttttgaggaaaaaagaaattaacagtctcggattatgtatctcctttatacaaagctgctgtctgccaccaaacttattgggaatgaaatgaacagcataagaatctgcttttagaaccagagacagggcagatctagggatccaggtgtcaagaacctcccagtattttcaggtattgaccatcaggatgaattaaatcttaccatttttttttatttttctgatacattttgttcataaattaatttgaagagagagtgattggcagagcttcaaccacacacactttctacttgaagtatgagggggagtgggtctgatgaaaacttgaatgacttcctatcaagactagtgagagagaggtaattctccaaaacagactagtgaagcagttatcagaaaagaaggaagcaaatgttaggcaagcatgtaattctttctttatattaaatcatatgacttacctgtgtttaatatattcagagcctgacaatgagagagaataacttagaaagcaagggagattagttccagtagaaagactaatatttattttgttgagatggtaggaagtgggagtagaggaacaattcaaaagctgttcttgactcgcttttaaactcttcatggtggccagaattgctttcaaaaatactatatttcccgtagacagcatattaatttgcatttcaagcattttgataactgttaaattatttttgtcttgaatacactattttatagtgttttataatgctagttgagctctctggaatttctaagaaaagttccagaaattaaatctcctgggtaatgtgtgaataacagaaaaggatccaatgtattctcaccaaaagataactgtccctaatgttaaaaagcaggggaagatgtcatcattttattgttaacctgacggtgaaactggagaattccctgaactccttgcaggtcttgtgacaggggtgtgactcgtttgttagtttgcgcaattgctgctgcacaaaccccttacgggatggggagcacacagatgggcaggtgcaggagccggggcaagcacttttgggctcctgccccacagtggcgtctagggttgtgttacaattaatgctcttttagcagttgccatctgcacatggctaagtgttgaggactaagctctgattttttatcttgcccaaattcctacctaaggggcctagggagtcatgccctacaaaccatgaattctcatcagatgggttttatttgaccctatatattgtgacttacttttctatctgactctggcataacattataagacaaggaaaaaatatttaaccccaaaatatatttccttgccataccttgaaattgccctgcaaagtctcttgtgggaaaaatccacattctatagagaatccctttccccctttgttttccttcctttccttcctgatccaggagataatcaactaagagccaggtacccttttaggtccaataagaaacattttacaacctgctctctccctctgaagtcttctgtctgagagcttcctctgcacagtaaaacttggtttccacagtcttatactaacctgaacattcctttccattaatcccaggtcttaggtaaactcaaccaattgtcatttaaacatttaaaccagaaaatgtttaaatttacctgtagcctggaagcccctgctttgagttgtgccacctttctgtaccaaaccaatgtatttcttaaatatatttgattgatgtctcatgccttcctaaaatatataaagccaagctgtaccctgaccaccttgggcacatgttctcaggacttcctgagggctgtgtcatgcgccatggtcactcttatttggctcagaataaatctctaaaaatattttagagttttactcttttctcaacagtgttaaactggctcagtggagagtcatagtgacagccttttgcaccctgccctcttggtacctgggtccttgtctggtgtccaggaagaatcaggtcagacatggacttgaaggatgttgaatgcagggattttattgagtgatggaggtggctctcagtgggatggatggggagctcgaaagggtatggactgggaagatgatcatcccctggagttcagctgtccttgcctgatctcctcttggaccgtccccggcctaactcctattgacattcagacactccttctcttttcttctctgctataccactctgctgctctcctgctcttctgctcatctgtccatggagcctagggtttggggtttatatgtgtacaggataggggggcatagtaggacaaaaggtaacatttggatgcaaaaacaggaatgcctgttcccatttagggctgcaggtttccaggcttgacatgaggcctttgctaaagaaccaccctcttctacccagtatttccctgcctcctgtccgtatcaattctatttaattttgtaatagagcaatgggtaatatttttgagtcaatggaccctttagtaatattttttaagtcaatggaccctttagagttaccgatgacagccccagtattctctccccaaaacatacatttgcaaaatgacacacaattttgcatacaagttcagaggatctacatgtttctgaagcccatctatggatgccagatttaaactcattttattaaaaaaaaaaaaggatattagaactacaatgaaagagcacaggagaaaggataactgtctttcatgggaatgtgcacttttcaattttgctgtattttcctaaattatctctcagctaatacctgacttcatcctttgttatatggcagcaaatctcactaaaatggaactagtacaaggatcctagactttatcactcctcctcccacccatctcccttctgtagtatgtgttaaataagaaagtttttagtgtgtttctgagacttgttcctgatttgatttcacacttcaacagtagtgatccttaattattacttaggaattactttatgatttggtaatatttaaggacttaagctacaggttacttttttaatccttaggtgacatgctacctaacactttctctctgcttattttataattctaatttgagttattagctcttaattactcaataattattcactgaaccctctgtatgtgccagaaactgtcctaggtactgagaataaacaaatgagtaaacacataagtttcctgccctctgggaatgcacattcttaatttactaactgttaaattcaccacatacttttgttaatttgtctgttttagaagtctggctaacttgtttaaaatttattgtactcattctttctgaagtggctcttctacatcagcactatcaaataaaaatataatgacagcccaaagatgtgattttaaatattctagtagtcacattaaaaatcacgtactaagaaacaggtgaaattaattttaatagtatatttagttaacccagtatttacaaaatattgttatttcaacatgtaatcaatgtaaaaatttattgatgagatattttgtcttttttatactaagtctttaaattcgggtcacatttcaagtgttcaacagctacatgtagctactgattaactattggctagatcaggccaaaatgttcaaccctagccacttgctcttcctccgagagcttcaatctctcagcatttcttatgcagagctacttagctccttctcagatcctgtctctaaaatacaataacaattcgatccctcctcaagctccttaatgtcttaattcataaagagactcttgccatgaactatttgcctaggagggcaatgaaaggttataaattcaacattgacaacaaaaacagtttgctataaatgatagataaatgataggactgaaagggataacgtgcttgggtcagcgaaacttgggtgtggtaggacaaatgggagaagctgggtttttttcgtgtgtgtgtgtgtgtgtgtgtgtgtgtgtgtgtgtgtgtgtgtgtttcttttttttttttttttttttgagacagagtctcgctctgttgcccaggctggagtgcagtggcgcaatctcggctcactgcaagctccacctcctgggttcgcaccattctcctgcctcagcctcccgagtagctgggactacaggcgcctgccaccacgcccggctaattttttgtatttttagtagagacagggtttcaccatgttagccaggatggtcttgatctcctgacctcgtgatctgcccacctcggcctcccaaagtcctggattacaggcgtgagccaccgtgcctggcagagaagctggtttttaaaatgctatgttcttatattatggaacacttacttgtcctctggtatactcaaaattatgaccaaggatcttctgagagatttaactcatctggagtaattacatccgctgacaaatgcatatatagtgccaatgtcatacttgccttgttttctcaaccttccaattcctaggcaaattgtcagattctcaaggtaatagctgtcccacatgagactctggtatgtgcagatctttattgtgacagttccttttggggcttctgtgacccaatgaagtgaaaataaagatgaaatatttcaagattttgaaaagtagtttctattaaaagttattcgtctaaaatgatttctgttttatagtatttagtgcataaagactggaataaaatgctgtaaactaactcatttaatatccttctgtgaattcgaatgagaaagacaaattgactggattaaaaggaaacattgagtaacattctgtctttagttaaaaaaagtccaacaccagcaagacttaccttcttttacttacacatatagttaatattagtgtacggtaaagcttctccacacatctaggaaagaaacaggaaaatgcattatttcctttgaaagctgcctaaacacaaatctgttattcttctgagaaagagtgatgcctatacagtaaaaaagttattctaaggaaggaaaaaacaaaatacagtatgtctgttgtttaagccaatagatgtctttaaggaaacattttcttaagaatattctttacaatagtgaggctgaggcaggagaatggcatgaacccgggagacggagcttgcagtgagcggagatcgcgacactgcactccatccagcctgagcaacagagcgagactccgtctcaaaaaaaaaaaaaaaatctttacaataatataattttcaaagttctcagaattctaaaatcttgctggatgatacatagatgtatagacatgtacccaaaggtgctctactaaattaatcactacctccaacaacctaaagattacagtttattgtttaaatgaaggatgcaaaatataggtgtatatacaaaaagcccctgttttatagctcttctaaatgtgagtatcacacacgggaaaaatcgaaaaacaaatgtaagtctaaatctccttacagagaagaaaatgtagtgtggcctggcctaatattacgacttttccaaggagttactatatatggtttaacagaagattatttccatcaaaaatatccattgcttgtgaatcttaagaacaggaagtttttcaatccaaattaagctgaagaaaaacaaaggagaggaggggaggggaggggaggcgaggagaggggacgggagaaaaaagttctctgctagcttcctaagcagttcagctctgagggtatgctttgcagcagcaacagcacacctgcccagaccactgcagcaaaggctttcaacaattcttgggaaactaagtgagggcaaagatacatggtagttccaggacatcccacagtaggatttgtctcacggaggtaactcagggaggaagaagtgagcagttcactctgccttaacagtttacatatatgaactactaaacttaaaaaaaaaagtttttcaatccaaattaagctgaagaaaaacacacctaaatagtatatacccaaagtattatgtggcataatattttaatcataaaaataatatgtatctatttttgtttctcctttatagtcaaagcactgtagaagtacagaaaggattgttctgagagagttcttgaagtagaggttgggggaggcagcctaggattcttatctgtaaaatgtgtggttccaacatcttatgcctacacttgatctcactgctagattgtgggcaaggtgctttgaagggatgggcattaaagggaccctccaataagtgaggcttaatggagtttgcagagatcatcatattctagaaatcacacatgccgtttttgtaggaacagagacagggtcccaaaagtatcactggatactggagcagaaaatgagaaaactcatcttgtgatgccaagagaagcaaagtcttcaagattctttctggtttatttctatagtatagctatcaatgttagtggcataatgtagtatttcatgttcattctgggtcactttagactcatcgtagcactgatttggaggaaaacagtatgaatgggcacaactggatgatccaggagggattcttttttttttttattatattatactttaagttttagggtacatgtgcgcaatgtgtaggttagttacatatgtatacatgtgccgtgttcgtgtgctgcacccattaactcgtcatttaacgttaggtatatctcctaatgccatccctcccccctccccctaccccacaacaggcctcggtgtgtgatgttccccttcccgtgtccatgtgttctcattgttcaattcccacctatgagtgagaacatgcggtgtttggttttttgtccttgtagtagtttgctgagaatgatggtttccagcttcatccatgtccctaccaggagggattctttagggaagccaggcaagtgggagtggtcatgtaggaggaaagtctatcccatagtacctgagaggtgtgcactaaacttgccacaggagacgatgctgactggggaactctattgagggtggcaaagcccacagtttaggtggaaaagcacttgaaaggggaatggattcattgcttttgtcatttttacctagactgttataagggcttctttttttatatctctattatcagtttttttcttttggaagtctgtcttttaagtttactcattaattgtataaccatttattgatcatttatacagcaggcactacgctgtattctcctaatacaacactaagaacaagtccctgtcctcatggagcctccagtccaagcaaccccaatgatgtgagagaactgccacaggatatataggagcatgtagcgctgactcactgtctgattatcatcactcttttaatgatgccaagatcgattagtgggttcaactggttacagcctcatccctgaattgtaaaattccctattagcctaaaggtgcccaggatttaattgttctggataatgatttcttaagaattctgaagaaggtttattcagagtttcctttcattcattgatagagctagtatttattcagcttattctaaacactaggcattatgttgttgctagagatacaaaactaagtgagccaagatgaatatagaggaaacataagtgagtaacttcagtgcaatatgagaaatgtgcagggctagatgcagagtcctctgggaacagaaaggaagcacagtccttaatgacagcaatctctggtgagtcaatgaatctctcgcagtttatttaggtcaggagctattaactgtcatgcattagtgagcagccaacagtgggactgggcagtctgagccctgtattgaaaagccggcaacgaaagaaacttcactagaggcttgatgaaccagttcttaaactaaagctcatgtgtctgcaatggacaatcctgcctcaacctcgtgaaaaacagaccaggattctctatggttatgcactactgcatttgtttctttagcgttcctagagttgttttcatcagttatttaagtaagaatgcccgaggtagtccacttcactccctagatccctattaatacatttcagttgaaaatctgttgtcccttgcctattttactgcttccaacattgagatttgatggaaagaaatcagctctcaaataagaatggtgtcacctgctgctggttcagcggcactgcaaactacagattatgcaaattacataaagatccaatctttctacccggagcctaggaagaggccttcttttcccactgggtcttatattctagagtcagccatttacttaatttcccaaagaatactgcaagagaatactgtgaaagcattatctaaaatacaacaaaagaattctgtaaatgttatctaaaatataataataagaaaaaccaaaagaattcataactaggctgaaagtattctcttaggattttaatattagatacaaaattgctcattagcctttaggttttcttccctctcccaagcactcaacaattgatttccttgcatactaggtaagtgtcctatgacacataatactttcaaatatttatatcttttgtaagataatatttttcatgtaatcctagatggattagtttcctatgactgctttaaaaattgccacaaacttagtgactgcaagccacacacgtttaatttttttcatgtctggaagtcagcagtccgaaatcacttttactggtctaaaatcaggtgtcaacagggctgtgctccctccggaggatctaggggaaaatcattttccttgccttttccagcttctagaggctgcattttcttagcctcgtcttccctcttgttgcagtcgtcccaatgacttttgtctctgtagtcaagtctctctttgcctccgtcttaggaggagatgtgtgattaaattttgcccacctatataatccaggataatcttcccatctcagaatccttaacctagtcatgtctaaaaagtcccttttaccttataaggcaacacaaattccagggattaggatctggatatctttggggaccaggaatcagcctatcacactaggtaatgaagtcattatcttaatctgaagtatctagatcctcatataatctaactcctttagtctatttgagttgttttaattttttctcaagtacattagctgccaaatttaaaattattgcagatggaactcttgtaggtctataatgtacagcttgctgagccacagtaaacagtatcatttttagctttctatcaatgtttgacatacaaaatggtcaactgcagaatgtttcagtgacttctctagaaccctattgaatatttaaaatgtcatacatcatgttgttgagtggtcttcgtggaaaaaatcatgtttttaagaaatctattccccttcgatttagtgcttgggtttgtatattccgatgaactgatatgcaactagagctatataactaatcctgatttttaaaaatttgtcttggcttccaggaagtacagactaaatttagtatataattacagtaactattcttagctagtatttcttgtataattatatattcttcaccccaaccccaataatcatttctcctactccttactaggatgcttttgataatttatcttcatttaaacaagcttattgcatgggttttctttattataatctatctcaaaatcttttttggaagcagatatgaaataaagcaaacaaacaaataaacttggaagatatatagaccctatgaattatagcccatctgcatcttttttgagtgccaaagacataagttcagctatgaatacattctgttactacaaaagcactttaaaattgtgtttctgtgcattatatagctccttagaatagacagatatatttagaggggaaggatatgctaatcaatgccactagagccagtagttttcttgatttcattcaataccttccagttttaataatttgcaactgatatcaatgatcataataaaattttaaattaaaatgtgtgagctgtttttttgttaatacttcatgcattgaagagacataaacaaagttttgaaatcataactacattttctgaaaggcttccacaggaaaaaaggcttcatattgatattattttgtacaattttttggacaattttccctccttcacattcagtttattagaactgaacataatatctgacataagtgattcatatatgggctaaataattcatgtatatcagaggccaagcctattggatatggtggaagttttgaaaccctatctttgtggaacaacaaaaaattaaatgtaagggtcaaaatgtgagggctcctttctcatttgttctgtgaatccagtttctagtggttacttatcatatcaaaatttctcgtggcgttttcagagctacacctccaataaacctaaatgatgactagctttaagacaatagtctatacagttacgtactgcttaaccacagggatgtgttctgaagaatgcgtcgttcagcaatttcattcttgtgtgaacatcctagagtgtacttacacaaacctatatgttttagcctactgaatatctaggctatatagtatagcctattgcttttaggctataaacctgcacggcatgttactgtactgaatactgtaggcagatgtaatacaatgatatttgtgtatctaaacatagaaaaggtacagtcatatttaattttaaatgtattaaagtaacccatttcctcttcccacttgactagctatttcctttttgagaagtagacattatgtttaaaaatgttttaaaatactgcaatattgttgatattattagtttactaaataagacaataaagacagaactcagacaaataaaatgcagcagctgtcagttgatgggggccgccattacttgtagaagaaaccttcagtaagcgttgaactagtggcctgggatagttgattttaagaagacaaataaaaatgcctggagagaaaaaatattttactcattccatatgagtagaaaatatcctttgaaatattatcagtgacttacttacgtcagtctttcttaacttgggttgtctgttaaatactttaatatggcttttgccatagctgggtcattgctataagttaacaaagggctgttttctatatcgctggaactctcctttgttagaaccttctttaaatagaaagaattctcttgcagtacgtggtaattgccatagattattgaaatgaaaaatggctatgattactcctaacaacttgagatgttctgcttacagtggatgttaagaacatatcttagtaatttaaaatttttcttaataggcataagcaagtttttattctttaaatgtacttcaagtggttacaactaataaagattggtatataacaatagagaagaggttccaaagtaaaaatccacattaaaattaaatttaggttacattattgcttagcagtttaaaacaatatgttccatatatacatacatgtgtatatatttatatgcatacaaaacatacatgaacatgtataagtatatggatgcagatgagtatatgtacacatatatatagaataaatgcataaaggtatataaatatatggctgcatttgtgtaattggatatatatgatacatattttatatctgtatgtcatgagtatttttctcattttttcctctttgagaataagtctaggtctatactatcaataaaatattgaaaattaaattaattacccaagtgaaaaaagaaagttctcagagttatgctgttcatacttatgggagaagtgtagattttttctgatttgcttatcttttcctttatttaaatgtaatttttactgatatgtaatagatgtacatttttaagggtacacatgacaatttaatatattcatataatttgtaaagataaaattagcataattggaatatctgtcaccttaaatatttatattttctttatgctagaaatacatgaaatattctcttctagcaattttgaaatatacagtagattattgtaaactgtagtcaccctactgatctatcaaatactaggtcttatttttttctatcaaactctatatttggacccattaaccaatctctctttatctccttctccttcctacgctgtggtaacaaccaatatgctatcttcttgagatccacatttttagctcccacatatgggtgagaacattcaatatttgtctttctgtgctggcttatttcacttaacatattgaccttcagttccatccatgttgctgcaaaagacggatttcattttttatgtctgaataatattccagtgatctgccagaactgaattttaaatggggttttaggcctggattgactttagataagcttataattatagctctctacttgtggtaatcaatagcataggcctgaatgtgttattgtattaaatatttctcattcattgacatcacaattgtggatcaaatctctgtggtttggatatttgacttctgacaattcattgttttgtctgactttaagttgtgtttaagtgattattttcttggtttgctctcattccaaattactggggaatttaactgatgaatgaaccagacatatatttaatatacatctgctgtgtgcaatatattgtactggagggatgggtaggtatagacatgtaagacataatctcttacttcaaccagaatatggtttcactgggttcctaagatcaatatgcataactgcagggacctcgtgctacattggatttgaatctggggctccagttccagtcccattccttcatggccatgtcaccttagcatgtcacttcacctatggcctcttaacagttagataacccaagaccactactatttctgaagagtatttttttaattacaagccaaatcagtatcaaatattatatttataatggttctgtgtaatttactaactcatttaccataaaatgacatatattgtactattagaagaaaattgtgggatttattaaaaacatcaatttattgtaccacacacttgatatgggcttataattgaacacaaatatatagaatatgaatatctttttttagttctgtcattagctctttgagtgagtatataagcatattcataaatgatattgtatctatatttatctatgttttaagaattcttgcagccgggcgcggtggctcacgcctgtaatcccagcgctttgggaggccgaggcgggcggatcacgaggtcaggagatcgagaccatcctggctaacatggcgaaaccctgtctccactaaaaaaaaaaaaaaaaaatgcaaaaattagcctggcctggtggcgggcacctgtagtcccagctactcgggaggctgaggcaggagaatggcatgaacccgggagatggagcttgccagcgagccgagatgcgccactgcactccagcctgggcgacagactgagactccgtctcaaaaaaaaaaaaagaaagaaagaaagaaagaattcttgcatctcaggcatggccaagaagcatattgcccttcatcctttctcaaataccatagaattggctctgacctcacctcagtttacttatgtttcttaagctataagatgatttgtaagatcccattcacacttagtatcctatggttataaagacattctcttgatagttatttgacatggtgtacacattggatcaatttctttggtgaaaacagtctcgccatgaccttgatgtgccatttgatgttcttggaaataccgttcctctactgttaacagtaaagtttcaaagaaaatagattcccagattatttcaaactcattaatataggaataatatttttaattcttcaagatgataagattttacacattttgatgccagtaaataattttgtgataaaagcaaacacctggtttgctagaaaatattggcattccgcaagcctaaattcattagagaggaattccacgtgcatcgcctctgagctgcagctcctgtgaactgaaaaaactgctagttaatgtctcagaagttattaggaaatgtaaagtacatacaattgtcagtgcttcaaaaatagagataacatcttagtccttatgtagcccccatagttagctggagcttggacatattaggaagtcaataagaatactgacaaactggcatgtaagtcaggtttgcctgcatcaggtttgaaaattattctattttagaataatcttatttatcctatcgtttctcaactaaattgatgtgtagtccatagatttcttacctttgctttatattcctttagagctgtgatgcaagctaaatcatttttggggaaaataacttcttaaacatttttgttgttgttaatgcttcggatgggcagttattgtctgaacatcatcaaggcacaagcaactgactgtagcatccatatttttttgacagttttcattgcttatgtgttccaagagctgcctacaggatttctttccttatatgagaaatattgtaatgatactcaattatgtataagagcaagattcctgacttgactaaatacaactactttagtattcactatttaaactacgtggctttttaataagtaaatcaacattaaaaagtgaataggagattgcaatttagttttcttagaaaagcttgactatttttattatctgatattcatgtcacatgtaatcacacatttgatttttaagtaatttttattggcttggcatggtggctcatgcctgtaatcccagcactttgggaggccaaggcaggtggatcacctgagcccaggagttcgagaccagcctgggcaacgtgggggaaaccctgttttttacaaaaaatacaaaaaaaaaaaaaattagctgggcttggttgctacatgcctgtagtcccagctgctagggaggttgaggtaggaggattgcttgagcctgggaggtcaaggttgcaatgagccaagattgcccccactgcactccagcctgggcagcagagtaagaccctgtctcaaaaaaatattattataattgaggtgaattaattgacatctatatttatgaaataactatgaataatacaagatggccacttgaaggtatgccctaagacaggggtctgcaaacttttcctgaagggaccagatagtacatattttaggcttgtgggatacacaaatttagtgctactactatctactatcttctgcctttgtagcacaaaagcagtgatagtcaatactgaatgcaaaaatatgtgcgtggctttgttccaataaaactttctttacaataaataaggatgggccatagtttgttgacccctgccctaataaattcattgacttggcctaattttaagaatcatataattttaataaaagtctgttaagtttctttatataatttgtaacatcagtaatatttttaagaaaaatgtaagtcatctgaaagtataacctaagtaaattttatttgatgatttgaatggaaatacatgatgattttttcttatatttgatttaaatatattgatctaaacctacctgttcttaccataagcctagctattataaaaattatacaataacttaatttttaaaaattattttccctagaatgtactggactcttggacaaatacctccttattattgaactttgggctaaatgactgcaaaataaatgtttggtcttgatttagctaagtgtcttcaaactacacaattctatatttctgtgagtgtcatatcatttgccggtaggactggtgcccttgtttgttgtgttgttttaaaactctctcattgagaatgtcacttctccaagtgatcatattctttttgaaagtcacttctagtttctatataaaaaatgtcttctaaaatcaataccagtgaaagttaatcagtgatataatgattacaggatgccttatttatcattggaaggctaagatggttatctctgtgatgatccttccatgtgatttgaaaggacagaggggtagctttttctggccatgccacttctaatttgtaaaatgcccccattataactcttatgtaagaaggcagcctgcctttattgccatatcctaaaaagattcgttagtattatgcccaagtgctcagtatttcaccagccctgctcccgtcttaaatttattatagattcgacattgtcataaagggcataattagaaaatcatctcacgtctcatctcattatgtaattgtgcataaggaaacaatcattttaaaatataaagaagaaagatttgggtcatgcagctgcttcctaaatgttatatttttatttccattgcgtctgtttttcctcattgaagtgcagagattactcatattgagatacaactatttttccgcaactgagtcttcaatgcctgctattttattagccccaaataagagatgattggaagtgtatcaatgcaagtggcaagtgagaatcagcaggttcattcttcataaacccttctgtagagcatgctcatgtttctggtaactggcttttctttctgctcctctttttgagtggttacagtggaagcaaccacatttttacaaggtgaccatatctcacccatagagatgaagacagaggtttgctcattacataagctgaattaatataagtccattctcaggattttaaagttggaactagaaaatattcacccactgaaactctgagctcttaagtaaaagtgatgcaaactcacaagctgttggcagaagttgttttctgatatgttgtttttaaaaatagaaatattattctaaaaagagagagaagaaggaagaatgaaacacacacagagagacagagttttgatatgaaaaatcaacgtcttgtttctctacagtgtttggatcagtggttccagttcaccccattactcagctggatctctgcctttgggttgtgtgagatagctgtgtatatgtttaataagctcacttttgctaaacttagttcaaatgggtttccataactttgaactgaaaaactaattgtgaagtttatttcatactctacacagcctttataatatagaatgtaaatataacgcctacgtaactgttctctcacaaagtttgatggtaaattattaaaaggaattaattactcatgagatactccccagagaaaaagaccacaaaaagttcatatgtatgtattaagttatttatttttaataatttttgggtcacttctgtgagccaggcaacagtgataagtaggcaacagtgaataaatacaaaagtgaatgtctagtttgttgggggagagatgtattaaccaaataattacccagattagcagatgattttaaaatgtggcaaatgctgtgaaggaggggtgagggacagtgagccaggtagaagaggctgtacgtgaaggccctatggcaaatgcaaacaaagcatttcggcattgataatcggaagggtttttggttttggttttggttttggttttccagaaagccatttattaattaggttggaaaagcattgtttctgtttcctgttcatcatatttagcttttatgtcagaagagcatttttgtttttgtttcaaatgtgtttcaagtcacctaaaaccctctgtccttaacattattcaagaaagtatgtaatgtacaatgttatttacaccatcgatttgtttaacgaactctctctttgtagtcaatgccaaagaaaatttcgtctcacgtatattcatggtttcctgatggattgaccagtaagttactgaagtcctacttagtgtgatgtgactgtggtggtgttccatcacattattctaagccattctcagccccatctaaccccggtggtattcagcaaaggcatacaagcccagaaccatgggaatgttcatctccatcagaattaataggaaaagacactttagtaactgtctttagtaagatacacttaggggagcagcgtgaagtaactctcttggactagcatccctctgttcttaaactgccaccaatgctactgtaacattgcagtcatattctaataaatggtgtcaagcatagaagagagaaaaattctacttttgtgacttctcctgatttctgagtgctgtatgcatgaactatttacctgtgtacacaaacagctgtacatttagttgccatggcaatgcttatctgttatctttacagggaacaaaatggtactttaaccacagttgactcatcccgtgaggtaaaattgataaagctgcctttcttaactttcagccagaatgcttcagttggcaaaagttggttgtttttgttcttcttaaagaaaggctacttgttgacaaaggcaggtttaacccccattctcaataattgatatagcctcgagcaaagatcaaagtttcctggatatcattgttataatttacacttagtaactggacaggagatattaataggatggccatcagagaaattgtgttttcctgacatgtgtcttcttggattacaggtaagtattggtgaatgcgtgacactgataactgctggtattattgatgagggactatcaatgatctgatgcatagggtgcccttgataagaaatctttattgttcatcagcatgttactgaaaagagtccagccaatgttaggtatgtgaggttaagaattccccagtcactatgcaacttggaaatagaaaggacaagtgattctaggacaaatgtgagaatccatgtatgtatttataggcatgatacccaggcagaattattaatatcctcccttgggctcccatagcactgtgtccatacttccatcatgacacttcacttcaaattaattttctttctatcccgttgggttactagctttttgaagtagatggcgctattatttttattgattatcaagtccgaagaaggaagagctcaatacatgcttgttgaataaagtctgctttgagaaagttatgctcattttgctttaatattctgcaagagatacaaagaaaagaaggaaggaaatctgagagctatcagttgactggatactcgaattggattacttttagggcaatgctcttggttgtgcctagacttgtaataatagctctgatttcaacttatctagaaaagcttaaagaaaatagtccaggactgagaaagctatttttcattttcttaaataattggcacctttgaaaggctccagaaactacagttttggaagcctctaggaataaagatttcttatttcctggacctggcatatagttttagtaaaggaaatgaattattctagatcccaaccaattgtcttcaatcaaataactccctgacagaaatgaggcaaaattttaatcactaatttaacctctgcaataaaattcctaagaaagaattttgtcaaaggcagagaaaaaaatctacagtatcaacactgaatatacaaagtgtactaaatgtttttaaatcaggaagtatgcatctttttatctttggtagtttttttttttaattaacaaaacttcaccatcaagactccactcaaattattgtaggttatcctagaagtttgagaaatacaaatgggataatatagaaaagattataaagtttgtattccatgagattttgcaatttactcttcattgatatagaaacaagtattgaaatctctaagctattcaagatagtaatatgtagtgtatttgggaaagtgaaattacagcacacaagcattatctcagtttaaaaagtaggtgtaggtggtgtgttgcatagcttaatgtttgtcttctgaagaaatgcatttagttcccattctttcttgataacctctatgttatcatatctaattctttgtgataaaatgcactctgttttagtttcatgaaccacagtcaattttgttttcctttgcaaacaaagaacgaaaagatcaaatctctctctgtgctagactgtggatctcttcctagcttgggtggccatcccaaagtcatttttgcatcttcctctcccactggcctgaaagagtcaactggaacccgttcaatgctgtttgtattcatcaacacttaatgtatcaggaggattttccaccttctttcctttaaaatattttattatacctaaatgagtatcttagtctgctcaggctgctataacaaaacaccacaaagtggataacctgtaaacaacagaaacttctttctcactgctctggaagctggaaagtcccagatcagtgtgccagcagattcagtgtctggtgaggatgtgcttcctcatagacagccctccctcacatggtgaagggagaagggatctctctcaagactcttttgtaagggtactaactgcctttatgaggacttcatccctatgacctaaccacctcccgaagactcccatctcctaaaaccagcgactctggagtgaggatttccacatatgaattttggggggacataaacatttagatcatagcaatgactatatagtaaaattctattaattcaggtttattgggagaaaggtggtttgaatttagtgggaaggacttcgttgctgtagatatctaaattcaaatcaccttattaagaattgtcaatacaactatttcactaccagtctcttattagaaatgaaacatttaatactccagagaaaatagtttctccagactttttttttttttttgagacagagtcttgctgtgtcacccaggctggagtgcagtggtgcaatctcggctcactgcaagctccacctcccgggttcacaccattctcctgcctcagcctcctgagtagctgggactacaggcgcccaccaccatgcccagctaattttttgtatttttagtagagacagggtttcaccctgttagccaggatggcctcgatctcctgacctcgtgatccgcccacctcggcctcccaaagcgctgggattacaggcgtgagccaccgcgcccagccctctccagacattatttaaatggataccacttttaaatatttaactgttctatcttttttgacatattaaatttgcattttgacttctaaaaatgtaaaatgtgcatcaaaattatacatttttggtttaaatatttgaatcataaatggccaatattgaaaatatgttttttcaatatattgaacatttattcaatatattcctgttctaagaatctgtatagtgatgggttaatacaagtaaatggaagcattagattgtgatctttaactaaacaggcactttttgtcattgtaattgccttgggactaatgtatgtgactgttacatttgtttccaacatgattttatttatttattatttgtatttattttttttccagctcttggttgtgcttagacttgtaataataactctgatttcaccttatctagaaaagtttcaccttatctatctagtttcactctgtcacccagactggagtgcagtggcacaattaggattcactgcggcctcaacctccatgggctcaggtgagcctcccatctcagcctccttggtagctgggactacatacgtgtgccaccatgcccagctatttttttctattttgtaattttttgtagacacagggttttgccatgttgcccaggctgggctcgaactcctgggttcgggcattctgcctgcctcggcccccacaaagttctgggattacaggcatgacccaccatacctggcctcaacatgattttatacctatttgaaaagacatgctatatgtcatagatattcagttaaaataaattagccgggcatggtgttgggcacctgtagtcccacctactcggaggctgaggcaggagaatcgcctgaacccgggaggcggagcttgcagtgagccaagattgtgccactgcactccagcctgggtgacacagcaagactctgtctcaaataataataataataaaatagttcagttgattacagctaattgaatcacacacacaaccacaaaactctattcaagtaatattcagtacaaaactaatggatacaaaaaggagaagatttagtattaagggtcagatagcactgccttgatctttccgagaaattataattattggcaactgaacttctaggtgttaattagtgtgacagaaaaatcaagccctttctcaccttactgtgactaattatatagttatatgagttttaatctcttcccattcaatctcaaaatggtgcctcaaacatgtatttcctcagaagcttaaggataaggcagatatagttttggttgtaacttttttttttttttgagacagagtctcactctgttgcccaggctggagtgcagtggcatgatctctgctcactgcaagctgcgcctcctgggttcacgccattctcctgcctcagcctcctgagtagctgggactacaggcgcccgccaccacaccctgctaatttttttgtattttcagtagagacggggtttcactgtgttagccaggatggtctcgatctcctgaccccgtgatccgcccacctcggcctcccaaagtgctgggattacaggcatgagccaccgcgtccggcctgtaactttcaataaactatttatttcactgaattctaggcttctgagggtgtatactgatatgtgggcagtggaaaaatacatataaaaattaaaatgttttatgttcataagatcataagaatgttattactctggtgatactgaagtccaatgaatctgaaatagcattcttaatcttatgctgacggtgtcttgttagctttgtcatctgtgtaggcaaggaggaacctcacggtcagtcacttcagcaaatctgagctttacgtgggtgatagtttcaggagtagaaaggaatcatgtcatttttttcactcttttccaaacctttatggtgatgtaatattgaacgaatttacagacactaatgattttatgtctgtcaatcctatctcacaaatatttgtctgctacatgatacccattcttaatgataacaccagcaagatacctaaccttcagaaatactctcaagctttgctactgggattgtatattagtaatatcatttttaaaaactgtcagtatctaataaggttgaacatatataattcatccttttctttcctaggtatatttccaacagaaacatatacaatatacacgagtatgttcatagtagcactattggtaataggccaaaatttttaactacctaaaggtccatcaacagtagaataaattgtgatacattcacataatggaataacttacagcaataaaaataaatgagttccgatttcacacaacaatatgagtgactctcacaaacataatattatgtgaaagaagccagaaaaaaagagtatataatatatgatttcatttacctaaatttccaaaacagtaaaattaatcaatattattagaaatcagaatagtacttacctttgctgagaagaggtggaatggaaacagaagagaagagcttctggcatgttgatctaatgttctatttctgaatctggttggtagttatgtgtgtatgttcagtttgtgacaatttatcgatatatatatacacacacacacacacacacacacacacacacacatatatatgatagattgaactcaaatatttaatttgtgcttatattagtttcccagggctgctgtaacaaattaccacaagctgggtggcttgaaacaacagaaatttattccctcacagtgctgatggccagaagtctgaaataaaagttttatcagggttgtttaattctggaggcttgtggagagaatctgttctatgcctgtattcctagcgtctagtgtctgtcagcaatctttgttattcattggcttatagatgtatcactccaatctttgccaccttttccacatgatcttccttcctgtgttctcttctcttctgtctctgataaggccactggccactggttttacccagcacccatctgggtaattgagatttttaacttaattatatccacaagggcgcttttttccaaataaggtcacattcacaggttcctgggtgacatgccattttgggggctactaattaatccactacagtgttccttccccaaaccccacagaaatcatgatagcggaaatataaaaatattgtacagacaagaagatttaagaagggttaaatacagatgagataggttcaagattttgaaagatcgtgagtcgatattacttgattcagcaaaatgcaggaattaaagttagttgccagtgcgaagcaactcaggcagtctcaggatctggagatacgaggtacttctggattcaggggtaaaggctggggcttaacatagtaaatttggttaacaatccacttaagaaagttaaagtcttagatcaatgtccccactctgggcatcaagtgaatataaccatcccatattgaggcagaaagaaaagataattacagctttataaaaaaaataaaacagagaggagtcaaagtggctctggactagtggacatgaagaattgctgagggagggtgagttactgtactcaaacaaggaagtaaagaagcagcctataattttaatggtgtagactccctcctaccacccctctatgcttatctaccaggaccctggcagttgggctcataccctagtcacgagattcttctcagcagaaaacactccaacccaagagaaaagacctgcctttggtgtgggtgtggtgatggtggtggtggcagggggtgtctccaaatgaaaatatcaaaacttccctgatctcataccctggagttcaattagcaatcaccatccttctgcacacaaagcttccattcagcttttcattacctcacttataaatagcagtggtcagccaagagttacaagatatttgaggaaagcttgcattgtaaaagacagagattttttaaaaatgagtgtacagataaaacgaactattagaaaataaaggctattcagggagatgaaaacttcaaaaaattacaatgaatattctcaaatacattaaagaagcactttataacatccagaatgctataaaaatgaacattgagggaactaataagaactcttgagagaataaaatattatggcataaatcccccagaaggtagaataaattatcaaagagatgacaagatttttttcaaaggaggattgatacaggaggtctggttaataggaattttgaatacctgaaaaaaatgagagaaatagagaagggggaaattatcaaataagtgatgcaagaaaaatttatttaattaataagcctggttttccatgtttaaagggttcaacaggtgaccagcaaaaggaaattaaggtaactgacatcaaggcatagtggccagaaatgttaggacaccaagggtaaagattctaaaaacttttccaaaggtgttagaggaaggtgatatacaatatgacacaaatcagagtaccactgacttctcaggagcaacacttgaagcaaaaatcaataaagtaatgtcttcaaagtttcgagagacaattactaattgcttttcacttataattctaaatctgaaagatcagatagatagaaattttcaggccaacaagttctcaaaaaacataactacaatgtatcatttcacaagaaagttctggaggttatatgttaccaaaatgagtgaataaactggcaaagaagagttgagaaccagacagcagggaacacattgataaaaaaatatattaattaaagagaaaacctcttgagagaaatgtgtggattataagcaacagagaaaacagaaacagaaatatatagaagaaaatcattttcagtgaattcaatcattagtaaatttagatgttaaatatgtaaatggatgcttccggaaaaaaaaaaaaacccaaaaactaaagatctctaaacaacttgctatatgtttctgccttttctatttctttgattgatatgccctttctccatcctcattgtaggtacgctagtcattcaaagactcatcttaaaatgtaatcccttcaaaaatataggaagatatccatatgtccttggttaaggagagctttcttagcatagacccaaaatacagcaataaaaatagaaattaaaatctgaccacattataatgttagtcttataacaaagtctaaagcaaaaaaaaaccataaacatgtttaagaggtaaatgacagagtgaaaaattaaatttccagtggataatatgacaaaaaatggtatgtaaaatctgtaaagttttctaagtcaacaggaaagatatcaaacgcaataaaataaactcgtgcaaaaaatggtcaaagttatagtattataattcacggaagataaaatccaattatgagaggatgttcaacttctacttttatcagtaaacaacaacttaaaacaatagtgagttcctatttttcgcccatcagattgacttttaaaatctgtttatcacgtgttagggaacatataaggaacgttttaatctcagatattgccagtaagagtatacatttgcacaaccatttttggaactatttagcaacagctcataaaattgaaaatctggatgccttattacaacattaatcatataatttattattcattctaggacacctttgaacatgaaagagagcactattaaaatgtatgccagaacaaaggcataaactggagttatcccaggccaatctcctatactgtcaccctctgtatgatccacttagtgtatagaacctagttagcttcttgtccatgtgtactatgtgtatgtaaagctactctttgtcacatagtttataacagcaaaaaaaattaggaacaggctgggcactgtggctcacgcctgtaatcccagcactttgggaggccgaggtgggtggatcacctgaggtcaggagttcgagaccagcctggccaacatggagaaaccccgtctctactaaaaatacaaaattagccggtggtacaaatacaaaatacaggtggcacatgcctgtaatacagctactcgggaggctgaggcaggagaatcgcttgaacccaggaggcagaggttgcggtgagctgagatggagccattgcacttcagcctgggcaacaagagggaaactccgtctcaaaaaaaaaaaaaaaaatttaggaacagtctgtcaaaaggaaactcaatagataaaatagataacacagaatagtaaataataaggaaaacagatgaactagatttctctgtatatcagtaccaatagacatccagtacacacacttaggtataaatagaaaattcaaaattccagaatattcattaacatatataacattatatatctcttatgttatatatataacatatatatatatatatatacacatcaaacattacatatgatgttaattgatgtgagtgcaagtataaaaatggaatggaagaatatacctccaatttataacagtggttgtctctggcaatttagaaaagatctggatgtggtttaaggagaattaagctatattaataacgtttaatttctttaaaaataatctgaagcaaatatgacagattttaaagttgatatatatgaattggagaaggtatatatgtatgttttaaatttttttgtatagtgattttttttctcaaagtaaaaacaaaataaatcctctttcacaaagctttccttgatctctttaagccaaacatctctgtgtgtcctctgtatgcctctaacactatagctctcataagaattaagctttctgcctatggagtttatctctcccattacattggaaaagcttaattgaaaaagcagtatctcatccccttttgtatctctccacagcacctgatcagatatctgttgcatagtaaatacccaataagattttattaaacacaatagcaaaggaatagaatggtgtacatagaaacacttgctctttttaggcaactctagaaaaatgttaaatttttcattttttcatgcttttcttcacacagcggacctatgtttgttttacacctatgttatgtttctattgacatacttttagaatgaatacttagaaaatatagtgctttgtaataatatacatggtcctagcatattggagatacaccagacaatctaattgctgaaccaaatgtaggctagcttggtgatcaaagggaattgttttgatttctcctgtctcatatatatctgttatttgtcctaatgctgagctctagactgctgaatgaacggtgacatttttcttggttactccattgtgccacctcacctccatttgtcactctagtaatgttaacatctgctgtcaacaccaattaacttttttttttttttttttttgagatggagtttcactccatcgcgtaggctggagtgcagtggcacaatctcggctcactgcaacccccgcctcccgggttcaagcgattctcctgcctcagcaattaacatttagtaaacaccttctgggtccatagtagaatgtcagttacttgctgctcatttaaagactagttgttaagcaaaacttgaatacagtatggcatttgctttgagtttattttttttaatttcaagtttcatggcttttgtttttccattctcataaataaaacatatgcttttattccttgacagttatcagagtttgttcagttgaacaatgcccaacttgcaaatgaatacttttgcaaatacatatggtggatatacaaatacatatgtgaattcatttggctctaatgtgaacttattgaatgtgctatgtcgagttatcttttatcaaaagaactgttagtaactgaggacatcaaaaaattatgcttgctcatacatacataaatgctatatttaggttttaatgctagcttttaaaatgtcttctttgcccgctacttacactaacaggatttccttgttcttgaaagtgaaatatatttttaagaacaggttttaaggccaggcgcggtggctcacgcctgtaatcccagcactttgggaggctgagacgggtagatcacaaggtcaggagatcgagaccatcctggctaacagggtgaaaccccgtctctactaaaaatacgaaacattagctgggcgtggtggtgggcgcctgtagtcccagctactcggtaggctgaggcaggagaatggcgtgaacccaggaggcggagcttgcagtgagccgagatcgggccattgcactccagcatgggcgacaaagcgagactccgtctcaaaaaaaaaaaaaaaacaggttttaaaaaaatttttagatttgttttttttgtttgtttgtttccagttttctctgctgtttcagacttaggactagacatgcctggctctaattgtcctcttagattgttatccagctttcctttgagacaatattttgcacaaagtgtgttctcttagctggttgattccagtgatggctggaatctatgcatagtgtggtgtttcacagttagacctgactagttatcctggcactttgaaacagttggtttcaggtacccttccacacatacatacaaaagatgtgctgatgatagcactgacttttcagagtggtcttttcatcataattaaaagttttttttttttttttttttttaaagcctgaatacacaatctgtgcatggctttgatgattctgtagttaagaagggcaggaacagccttggggaacacttactaacttggaatcatgaagaaagtcacaagcacctacagatgagcagaaaagcaagattatttcattcattttacgtccacaataccacagggactggctggtcagttacttgcgcatgttgtcaaagctaacctttaaagacagttcatctggctaaaaatcaaataccttatacccagagtattagatatgcatcagcgggtggccagggtcttaaggcaggaagtatattataggtggcctggtattttgcaggctcttctgagccagaagcattttttatcagaaaggttttggaaattatgctcagcccctggcatctttttggtcctctcttgatcgctagtccagctgttgaatgaaaagaaatgaagctgaagagacatcactgtggctacagctggtgttacggaggttggtgtcatgctacaagataacacacacatcatttttactcatgtggaaggctgccttgctgtgcatttccacggctgtcagaaagattgattcctgaaatactttgaaaaaatgctaagtactagctactttgggtgtttacccaggggcaccacagctgcctggcattgtagtatggcagctgaacagtaatcactgctatttctctgatttgtttgtgtctttgtcagcatctgagaggagggaggttcaatcccagagtggggccctcactccacagtgatctcattcagcccatggctttaaatactctctgcaatgctaatgactcccaaatttatgtctgtggccctgatgtcatccctgcatcccagactcatagatccggctgcctattaaatagcactgctttgatgtctatgaggtatctgaaatttaacataagcaaaaccaaatttctgatctgtccacccatatatgacccaacttatcatcccaccatcttcccacaggagtaaatggcaactccattcttgtggttgctccagccaaagccttgtgatcatccttgacccctcccttactttgtatcccacatcccaaggtatccaccttgaaagtggattcagtacatgaacacctctctactgctgctgtcttaatccaaaccaatgacaaatctcatctggacgattgtaattgcctcctaacatgtcaacctgcttccttttcccaatagtgtactttctcatggcagtaaaagggaatccttaaacacaaattacattacattatcttctgcttagaaatcaccagcggccagatgcagtggctcacacctgtaattccagcactttgggaggccaaggcaggaggattgcttgagcacaggattttgagatgagcctgggtcacaaagtgagaaccccatctcttaaaaaaaaaaaaattaaaaattagctaggcatggtggtacgcatctgtagtcccagctaatttggaggctgaggtggaagcatcagctgaacccaggagatcaaggctacagtgagtcacgatcgcgccactgcgctccagcctgggcaacagagtgagaccctgtctcaaaataaacaaacaaacaaacaaacaaacaaacaaacaaaggaaatcactagtgaatttcaatcccaaggttcaaaccacatctgtaaaaccataagcgatcagactgtctcatacttgtttgcttatccttctgttatttccttagccgatttccttaactcattcacctgcgtattcaatggccttttcatttctcttcgaatagtttccacctaagtgcctttgaacttgatcatctctatgactggaatgctcttctcccaggtgtttacatggcctggttcctcttttcatttaaagcccatgcccactcaaaggccatatctccttgtcagtaagatctttcctcaccagcctttataaaatatagcactgctcccaatggtctcttattctgctatattttcttaatggactttataatcctgatgtcttttcccactgagtgaaggctttgtttcgttcactgccagttctccagcaccaagaacagtgcctagtgcacaaagggctttgataagcatctgtggaaagtgcaaacattcacctgactcttctttctatctctatctccaccagctgtaaaactgtgcttagaatccctgaacattttattttaatgaaattacctctgcaatatctttagctcttcagtggaaaaatctttcaaaatccagggtctcatggagctcatgtctccatctctgacttaaatagtccatgaaacacatgattctggaaactgagattgtgaaaagcacatcttgctgcaccctccagtctttgtgtggtctctagcacttggtgccatagtgacagtgtctgggtagaacagatgtttttagtgatctgaaaatcactataaagaaaaggcatttcctacatcttggagagaaacttgaaagttcacaaacatgttaagtctaacaatttcttagacttgccatttgcttttatccactttcaggataaccgtaatgtttgcaactcatcttctgtgtctcccccaaataattcatgtttccttttcctccttgtcttatatttcaatgagtgagaagtgaggcatcttactcttattttgtattaaagccctgcgctaatatttctaacgttctcttttacgatttagtgagatttcagaagtgagagggatagttttgttctgttttccatgagttttctagttctttgagaggaagagggaccacgaaattcaatattagtgtttgtcataatactcagcaaaagccttgcctgtggtatacactcaataatgtctgttcatttgggttttaacttttttcaaatctcctcagtgttataattacctgtccttttcattagaaatccaaacctgattagcaattgtttttccagagaataagccacttgccttctctaatagtattggattggatatcaactaaggcatagcttcccaacggatgtgcagtggcacatgactgtactccacatggatttcaaatgtgctcagacaatgattcctgtaagctctcaggggcagctggaggctctagaccaatcatttctaaccacaagattgtgtattccagggtgctctacaaaaattataatttccattatgtgctacggcatgagaaatgttgagagttagtctagtccagtactgcctaactaaactatctgtgcagtcatggaaatgttctagatcttccttccaataaggtaaccacagtgcagctggaatttaaactctaaactatataaactattaggaaccaaagatgaaaaataagcacaattcagcaatttatcagactcgacaaatattaatttgaggtgttaacaacccacagtggtaccagcaggcagaaattaaattaatatatcactaacttgagaataaaggcatcaaaggaaacctcattttttaatgtggctaacattgttggatattagctggctgatgctagctatgtacgctttttctcttgttgtcttctttttgtttgacgatgtggcaaatgacagtgctgttgcctgaaaatggcttcaaagtcacacttgtatgtcttactgtattgggtttaggtgaattctggtgtctgtgttgttcttctaatggggcctggagcaatctaataatttgcatttgggtcctatagaccatatggtgtttatcacccacttctccatcttagatgatctgccagtcattgatgaggtgaaagctgtgtttggcagtgctttcatgctaggttaatcattgtggaattagctattgtttatagcactttttaatccaagcaagagtattctggagtctgtacatctgtaagtcaaaatttacaacctaacgtcgatttacaatgaggaaaagcaagttagataacatattgcatattcataaattactcctaagagataattagtacctggcctccacttcatgattcctctgtttgttagttcttatgatacaatggttgtggagatgcctatttgatcgtatttctcaaggagactctgatccagtgtgttccactgcctcattaacctctgccctcaaaatacaccaagtcaacctctgtttctttattcatgctgctccctctttctggaatggcccatcccacctttcttctcaggtacattttagccttacttatggaggcattgaaatctttaatattagtattaatgtacactagcatttatggaacacatttttttgtgtgtgtcaggcgtaatacccgccaccttaactaggtatttcacttaaacgtcacaacaggacttcaagatatattttttcaagatatatatgtttaatacctatctcataaatgaggaatctgagcttcaaatatgtgaagcaattttcataaaacaattttgtaatgaagtagagtaaggttttaagctaggacttcctgactctaaagtctttgttctttccattgcaaataaagaagacaaagaagtctattaaaggtatctaatgaaggaatctgttctccattaaccttgtactcacttgagacacagttgaaacacagtaaaacagctttgtagattgcttgcttggcttattgatttccaaatcctgttttctttttgctaccatcttacttcctgtgtcatagtggaaaccaacaaaagaattaattctttgtcaagtgtgtgaggaagagcatggtggaccagaagtcttggtccttcctgggcaaacagatacattgtcttctgcacctatacatgtccctcattcgtgaatttcgccctctgatttatatcctatctgttctatcttttaactaagaactgtgaaatcacccatatccaggactacatggctaatctttttattaaacattgtctatcatgtgtttttttttttgttttgttttcttttgtttttgtttttgagacacgtgctcactctgtcaaccaggctggagtgccgtggcatgatctcggttcactgcaacctccgcctcccatgttcaagtgattctcctgcctcagcctcctgagtagctgggactacaggcatgcgccaccttgcctggctaatttttgtatttttagtagagatgggatttcaccatggcagccaggctggtctcaaactgctgacctcaagcaatccttctgccttggcttccataaatgcagtgattacaggcaagagccaccacgcccagcctctgtcgtatgttgttgaattcttggtcatgcctattcaatcagagtgtaaattgcttgtgtgtagtatcttatttggtcttgccctatggcaccagctcaaatgctaggctaatcactggcagtttttacatattgttgattatgtgaatgattatcttcacattataactagacaaaaagagaagtaaaacaattagatattttccccagagatgagtgaaataactgaataaactaactcttgttcataaatttcttaaagaaggatgacaaatttatcttgtaaacatacaaataactggtacctaatatttttcagtggggtggagggtggagtaggatatcagaataggactctccagccattgtctccctgaagaaactttaatttgaacaactatccatgcatgaaaacatcttcaccagggctaaggaaatcaggtgagcaatcaaagcactaggttatagtgtaatgctaagaaaagacgcatcaaagagggcaagaaaaacagttttattacctctgtcacccctccacaaacccagtaagcatagcatggaaagagattctgtctgcttgggggaaagagagggaagtaagcataagactttgcctgctacaatgaaatctagcatcagtcagaattccatgaccactgactccaggctaaaacctatgtacggagcctttagaaccaacttggcacccgagaggagcctgtagcccctatgaaatggaatcaagttttggtctgcattgtggccagctgactacagtggccttgagctgtgaataacccacagtgataggcaggccttagtggctgtgggtttcaggcatgccccagggctgtgctagcctcagtggccacgggctttaggcacactccaatgctgcaccaacattggtgaccataggattctagccctatgccaagctcagcagccgcaaatccaatcttagtacagcataatttgcagtggtctagggcttagggaattccctagcactgcaatgactgtagtgctcaagggcataggaaccataccggacaaccttttcaaaatgtctggacaggcttactgctgaaagatgttttcagacaaaaccagattgtgaagggcctacttgttcagtgcacagacattgattcatgactacaaggaccaaaaataattaggaaaacatgacatcataaaatagacaaaataaggtgccattgactgaccttaaagagatggagatatatgaactacataacagaaaattcaaaatacctcctttaagggagatctacaaatgtcaagaaaataaagagaaataataaatttcaaggagtaaaacaataagtgaccagtacaataaatttaacagcaaaattgaaatgataataataaaatattcaacagaaaccctggaactgaaagatataaggaatgaaataataaatgcaacagagagaatcaacaaaagtattcatcaagaagaagaatctgtcacttgagaacaacttatttgaaaatatacggtaagatgagaaaaagaaaaaagaataaaatggaatgaagaaagcttactttggggatagtatcaaaaagaaaaagcaaattatgagtcactgacatttaagaggaaacaaaggaatataaagctatagaaagcttatttaaagaaagaaaagcagaaaactgtcaaatctgcagaaagatataaatatccagttacaggaaggtcaaaggtctccaatcagattcagtctaatcagatttaaataaaagccaagtcatattataattaactgttaaagatcaaagacaaagagaagattatatacacagcaagaaaaaaaaaaagaaaataaagggagtttcagtacacttagcagtagcagcacatttctcagcagaaaccttacagaccagaagagagtgggatattttcaaagtgattaaggaaaaacatgcccaccaaaaataccgtaccaagaaaagctgtccttcagaaatgaaggagagataaagacttcccaggcaaacaaaagtcaagggagttcttcaccaccagacctgtcttacaagaaatgccaaaggaacttcttcaagctgaaagaaaagaatgctagtgagtaacacaaaaacatttgaaggtataaaactcactggtacaagtaagtacaaagtcaaattaagaatactctaggccgagcgtggtggctcacacctgtaatcccagcactttgggaggctgaggtgggtggatcacctgaggtcaggagttcaagaccagccaggccaacatggcgaaacctcgtctctaccgaaaatacaaaaagtagctgggcgtggtggcacgcgactgtagtcccagctacttgggaggctgaggcaggagaattgcttgaacatgggaagcggaggttgcagtgagcgagatcatgccactgcactccagcctggtgacagagtgagactctgcctcaaaaaaaaaaaaaaaaaaatactctaatacggtaatgatggcgtgtaaattccttatatctttagtaagaaggttaaaatataaaaatactaaaaataataactacactaacttattatggtacatgtaatataaaaagatgtaaattgtgacatcaaaaattcaaaatatgagtgtgtgtggagttaaagtgaacaatttttttgtgtgtggtcgaagttaaattgttatcaatttaaaataacttataaaatgtttttgtaagcctcatggtaaccacaaagcaaaaaacttataatagatacactaaatgtaaaaagcaaggaatcaaaccatagtactaaagcaaatcacttaaccacaaaggtagacagtaaaagagaaataaattttaaaagcatttacaaaacagctcgaaaacagtgaaaataatggcagtagtaagtccttacctatcagtaactactgtgaattaaattgattaaattatccagtcaaagatatagagtggctgaatggattaaaaaacaagactcttctatatggtacctataaaaaaattcactttactggtaaggacacacagagactgaaagtgaaagtatgaaaaagatattgcatgtaaatagaaataaaaaacaataggagtagctatacttaaatcagataaaatagactttaagtcaaaagctatgaaaagagacaaagtcattatataatgataaaggggccaattcagcaagaggatgtaatgattatagacatatatgtacatcacattggagcacctaaatatacaaagaaaatagtaatagatctgaaaggagagaaagactgcaatacagtaacagtaggggcattcaacaacccactttcagcaatggaaagattatccaaacagaaaaatcattgaattgaaactgtactctagaccaagtggacctaacagacatatacagaacattccatccaacggatgcagaatacagatccttctcaactgcccatggagcatgattcaggatgggtcccatgttagaccacaaaacaggtgttatccagctttagaagactgaagtaatatcaagtatcttttcagaccatgatggtataaaactaggaataaataacaggaggaactttggaaaattcacaaatgcatgaaaattaaacaacatgcccctgaacaagcaattgatcaataaagaagttaaaaggaaaatttaaattttttaagacaaataaaaatggaaatacaacataccaaaagctatgagatatagcaaaaggagttctaataggaaagtttataacaataaatgcctatatcaaaaaagagaaaaatcttaaatagcctaaggttgcactgcaaggaactagaaaaacaagtagaaactcaacccaaaattagtagaaggaagggaataataaagatcagagcagaaaagagtaaaatggagatcagaaaaacaatacaagagatgaatgaagcaaaggctttttgaagacaaaatcaacaaacctttaactagattaagaagagagaatattcaaataaataaaatcagagatgaagaaagagacattacaacctagactgaagaaatgcaaaggatcataagagagtattatgaacaattatatgccaacaaattagataatctaggagaaatgaatatattcctggacaaatacaacctaccaacattgaattatgaagaaatagaaaacctgaacagaccaataacaagaaaattgaatcagtaatagaaagtctcccatcaaatagaagcccaggctttactgctgaattctaccaaatatttaaggaagtaataccaattcttctcaagctattacaaaaaattggagaggagggaatacctcctaaatcattctgtgaggccagcattacactgataccaaaaacagataaggacacaacaacaacagaaaactacaggccaatttccttgatgtttacacatgcaaaaattctcaacaaaataggagaaaaccaaattcaacaacacataaagatattatttacatgatcaattgagattcatcaaatggatacaaggatagttcgcatacacaaatcaataaacatgatacatcacattaacagaaggaaggataaagaccacataatcatttcaatagttgcagaaaaagcatttaataaaattcagtatcctttcaagataaaaactctcaacaaattaggtatagaaattaggtatagaaacagtgcacctcatgaccataaagaccatatgtgacaaacctacagctaacatcatgctgaatggggaaaagttgtaagcttttcctcaaagatctggaacaagatatggatgtccactttcactacttctattcaacatagtactagaaatcctagccagagcaattaggcaagggaaagaaataaagggtatccaaatggaaaaggaagatactaaacttttcatgtttgcagagacatgatcttatatatatagaaaaccctgaagagtccaccaaaaaactttagaactaataaacaagttcagtaaagtggcaagatataaaatcagcatataataattagtaacatttctatacactaacagcaaactatctgaaaaagaaatattattttaaaatctttatttctagtagctacaaaaatgtaaaatacctatgaatacatttaaccaagagggaaaaccatctctacactgaaaactgtagccgttttacattttacagaatcttgatgaaataaactgaagaagacacagataaatgaagaatatttgtattcacaaactggaagaataaatactgttacaatgtccatactactcaaagtgatctacagagtcaatgcaatctctatcaaaatacccatgacactttccacagaaatagaacaaagaatccaataggttttataaactgcaaaagacacaaaagagccaatgcaatcttgagcaaaaagaacaatgctggaggcatcacactacctgacttcaaaatgtactgtgatgcaatagtaaccaaaatagcatgatactggcataaaaacatagaccaatgaagcagaatgaagagcccagaaataaatctacacatttacagctaactcattttttttttttcaaaaactgccaagaatacacaatggggaaaaagcagtctcttcaataaatggttttgggaaaactggatagccacatgcagaaaaatgaaattagactattatatctcactctatacaaaaatcaattcaaaatggattaaagacaaaggtaagacccacaagtgtaaaactattagaagagaacatagggggaaaactccatgacactgttttgggcaatgattttttggatgtgacttcaaaaacagaggcaacaagagcaaaaaaaatagacaaatggaattttatcaaactaagaagcttctgcacagcaaaagaaaaaatcaatagaataaaagcagcctatagaatgaaagaaaatatttgcaaactatacatctgataagggattaatatacaaaatatataaggaattcaaacaactcaatagaaaaaagtcaaataacccattaaaaatgggcaatagacaggtatagacatttctcaaaagaaaacatacaaatagccaacaggtacgtcaaaaaatgttcaccatcactaatcatcagggaaatgcaaatcatgaccacagtgagctatcacctcactcctattagaatggctattgtcaaaaaaaaaaaaagataagttttggttagattgtggagaaaaggaaacccttgtgcactattggtgagaatgtgaattagtgcagccattatggagacagtatggaggttcttaaacaaattaaaaatagagccataatatgatccagtaattccactcctcggtatatatccaaagaaaacgaagtgagtatgtcagaaacatatgcacttctatgtatattgcagcattattcaccatagccaaagtatggaatcaacctaagcatccatcaatggataaatggataaataaaatgtatatagatacacaatgaaatactgtttagccaaaaaaaaataagaaatcttgtcatttgcaacaacatagatgaatctggaaggcataagtttaagtgaaagatcccaggcacaatatgacaagtactacatgatcacactgacgtatggaatctaaaaaactcatctcaaaaaggtagaactttgagtgatggataccagaggctggggtggctgggatgggagtgttggggaaatgttaggcaaaggatatataattatagttagatagaaggaataggttcaagtgatctattgtgcagcatgatgactatcattgatgacagtacattgtattcttgacaaatgcagagactggatgttaggtgctttcaccacaaaaatgacaactacgtgaggtaatgcacttgttgattagttagatttaaccattctacaatggatatatacttcaaaatatcatgttgtacatgatagatacatacaatgttatctgtcaatttaatttgaaaaagaaagaatgagaaaagatacttttcaaagagtattaatagtcatttttctgaattcctgtagtgtattttcaagatgaataagttttctaaagtaactgaagcatatctcattagccatcaaaaattatttttaatggcagtttttaatgtagatcttcagaaaaaaagcacacaattactgccttttaaaatagaatgcatgaaatacaattaaatctttccttgactagtcaaatcaaaaaatttttttggaatatcttctgttttacctgttatgaaaaacactaaaatccagggaaataaaagtttagaaatttattcttagtgcgtttacaatctcaatggaaagttaaatgtgtagaaggaaaagttacaatctggcctcttaaaggcgggacagaggtaaacagattgtgtttaagagtcccagaattagtaaagtttaacctacaagttgacatctgtggtagtcatggaaggatgggttaggatttaagaaggagggatacggaaggatgggttaggatttaaggagggatacagcattctagaagaaaaggaggggcattctaaatgattccaagaaagtggtaaattggggaaatggtaaaatgttcagtgtgcttgattagtagcagcttgagaatagttccagactttacaggagcatgaaaaaaattcaattcggatcacattactttcttgcttacaaaccattgttctgctgttactgagtaaaagtcttagcttgttaaaatgcaaaaaatgtgagcaagcccagccaagatgagcaaagccacatgcttgacctgcagttaaccacagatacataagggagtaaaacaaagatcattcaagcctggccctgatcagttatcttggagacctatgaccaataataagtgaccattattttaagctactaagatttgggatattttgtaactcagtagtatttcactgatgaattgtattagtgcttttctattcttctaccctaaagtaaaaatgtctttgctacttatcacattcaaagaaatgtggagctgtaatagaaacaaattttgccaggcaaataggaccatggtattgctttgggctggcatagatgcaattccatgtaattccatttcttgttataaacttggctctaactgtacaatgtatacttcagtatatggacagatgtagatgtagatactgtgtataggtatgcactatttatacctctcaaaaatttaccaaagtcttcatatccatagcactgatattttttaaattaactcttgttagtatggacaattttagctataatattcacaaacgtagagagaataacataatgaaaccctatgtacttatcaccaagctttagtaatttctaacattttgcatgtgttgttgtttgtaacaggcttttgttttgttttatttttgtttttgttttcctttcttttgacaacatgagtggtgttcaatgctactaagaacaaatttgcagatttttcctgcaatgcttgaaatgattaacctctgtttgttgccaagtaactcttgggtacgtactgatagcaaaagtaatataagaatattcacagcatagttaaatttggatagcaagtattatttaaagggtgcctgatattattgcttataggcatgtttttctttcttgtacctcttatttttggtagtaatcatgtttttaatgacttgtgatagacttgttttatgaaacaatagaaaatcaccataggacctctttagtaagcttttagagtgttgaagctacttgaaatcttctctggtgggagattattatttgctaaataattgtttgcataaactgactcctccaacagtgttagttaaatgaatcataacaattagtataaacagagaaaagtaatgatgatctaggcaagtaacttataggtgttctgtttgttgaacaaaagaatgaatggaaaattagggctcttatttatttatttatttatttatttatttatttatttattttttggctgtatccaggatagaataaataaaatgtttgttttcagtctgccttcacctatacttcttggtaagaaaggaaggatgaaaggaaatggtggattgagggaggatgagaggaagaaggaaaaaagaaaggaagtgagagaggctaattatctggaggttttttttaaaagcagtaatgccaccaaattaaagtagcttttcaatttaatgcacaatatttatattactattatattggcatttcagggtgccaagtgtaaagaggttatcttagatgcacagaatatcaaaaaaaacctgtgctatcatctcccagtgcagcctaatcattgacagaggtcaagaaagttaaagcaagtgctgaagttgaatatattaatatacaaaaatatagtatttgtattagtctgttctcatgctgctaataaagacacacccaagactgggtaatttataaagaaaaagagatttaatggactcacaattccaaatggctcaggaggcctcacaatcatggcagaaggcaaaggagaagcaaagtaacatcttacatggtagcaggcaagaaagcttgtgtagaggaactcccatttataaaaccagtagatgtcgtgagacttattcaccatcacaagaacagcatgggaaagacctgcccccatgattcaattgcctcccactgggtccctcctcccacgacatgtgggaattatgggagctacaattcaagatgagatttggtgggggacacagccaaaccatatcagtatcattacccataaagacacagatcaccaatgaaatttaattcatctagagaaatgcattgtagtagtactaaagttatttggttaactttatgttcctatattttatgcaaatacgaatttttttataagatttgggctgttataaaatgtcattctaaagaacatctctaatattttatgtaattactacaaaaattaaaaatagttttatatttataaaccttgaatttcagtggaggccatgcttattaaaattcactttctttttggttacagcattaaaggggcttctagaatgcttaccttttttcagtccactatcataatgagagcctcaaattgtatgtcatcattgggtcatgtaatcattaaagagttctacttatgagagccaataacagacatgaccctttcttctagtctgttcaggcaagcagatcaaacctcttcaaatcctacagtaaaagtttcactattgtcaaatatagcttagtcctaatgaagtacattaaatttacacaaaactttctgtccttgtttccaaacttcatctaaataagtttctcccacctccctcccacagcattgctcataatcaggaaaaatatggtgtctagtagaaaccatgttggaaaacacaaatgtgaaaaagcaatctacaggctgggcctggtgactcttgcctgtaatcccagcacttttggaggccgaggtgggtggatcacctgaggacaggagttcgagaccagcctggccaacatggcgaaaccaggtctctactaaaaatgcaaaagttatccaggcgtggtggtgggcgcctgtagtcccagctactcaggaggctgaggcaggagaattgcttgaacccgggagacggaggttgcagttagctgagatcatgccactgcactccagcgtgggtgacagtctccaaaaaaaaaaaaaaaaaaaaaaaagcaaactaccgaaatagaaaatatttgaagtatgtgaccattaaaattagaagaggtaggtttgaattctggcttctgtcctcactggacatttgtttttgaagtttctatgtctgttcctttgtagcaaactgacagttttaaataaagtaacgtaaccgcacaccccaaaacataagtgttaattttccctactgcacaccccaaaccacacaccccaaaacatgttaattttccctatgcatatgcttacttgtgatcttatatttatgttcttgtatcttataagccttaaatttatgctgagagttctagccaacaacacatctacttaatgttttgtcagtgaaattaagcagagggtgttatgtcaatatttaatgatagattgatatattgcatgggctactttgtttttaatccttggccagggccgttaaatatttattgacagttaccaaaaaaaatggtttttaggctaacttctttttgtaaatatatgttcagtaattgccaataacttccatactaactgaagtatattagtatataggaagctgttgctatgaaataactgtaatatttcaaaaactaaatgttttttatttcaatagttttgggggaacaggtggtgtttggttacatgggtatggtctttagtggtgatttctgagattttggtgcacccatcacccgagcagtgtatactgaacccaatgtgtagtctttaatcccgcactcccctcccatccttcccccaactccccagagtccattatgtcattcttatgcatttgtgtcctcatatcttagctcccacttataagtgagaacgtacaatgtttggttttctattactgagttacttcacttggaataatggtcttcaactccatccagggtgctgtgaatgccattatttcattcctttttatggctgagtaggtatttcattttatatatatatatatatttatacaccacattttctttatccactcattggttgataggtatgtaggctagttccatatttttgcagttgtgaattgtgtcataagctaaatgtttggaaatacattggaattatttctgaagttccggaatggctttgctattctacattaggtggtttattgaatatttttagagaagaacctcttgattttcagttgtttgtgtggggagaagagatggtggtggtggtcattcttcatatggggatttggaagatgaaagagtaggttactcattctttatatggattttcatcagtccttctcattttggccttgcatctcttccccgtaccctatcatacctgatctttctgggtactaagcctgtacaaggtttctaaacccttcatggcttccttcatggctgtggtccactctatgacagcccaggctgcagtttccaccactatgtatcaacagctccatgttaacaatagctttctgtctaccagaaaattgaactttcctgaccatttctgtttgaaatataggtaataaaaccacttttaatatgtggttatcatagggcagaatttttcaacctcggaattattgagcactattaacatctagggccagataattcttgcgtttgtctttcctgtgcatcgtaagatctttagcagcgtccattgtcaagtaacaccccctaccaattgtgacgatctcagttgagaaccactgtcataaaaccatgccaatgagtaatcatgcaggactgtgtatcacaaacagaataccaagaaatgtaaataccttctgcagaagcgcaagcatatgtaaaccaactcaatataatctggaaggtcattaaattacattatactatactttagaaatataatgtctttgtgatatcctgagacaagcagattatttaaaatgttctgactttcgcagtgacattgtgccttttttgtgttccaaaattttcttttgataagcatttctaaataacttgggatttatcctttttcatttatgaaggccttttatctgctaatagaaagaagaaaaaaagatatgctatgatcattttgcatactgcctcattgctagagatgctttccctcacaggatacataatttcttggaatagactattgttcctagaagataattagtgactgttttttttttttttttttggttttttgcctgtcaatagaagtgaaaacagtagttggcatgctcacctacttgattatagctattacatcaatcagcatccttttcctatgcttcatcatcatttatctcaataattatatattgtttcatttttctcaccattttttctttagcattaactatacacaaatttatttaaaatggctgaaattagtcatgcaatcagttggaattcatcctcacaacatttatgcaaaatctactgcagtaattgttttaaaagtgaaatttaaaaatattgaaccacctttatttattctacatctagtcgtactctcttttgtttaccctccatgtttttctccactcatttggtcagaatcagggtttagtgggtggttaaatgtgttctgggatctgccgtgagtcttggtgcatcaaacagggctgaagacaatgaaagctgtggcataaaggacaaatgtagaaggtgaaaaacgaatagagaccctgaaccttaacattatctccatgttgaccacggtttcctttggtattcttgagtaattctatgacgaaaataatgaatagagtattttcattgtttcttttaccttggaggtttatcaagatgttggacagcaacgaaatgtaaattccgtaactcatgtgttaggacactacttcataataaatattttttaatgagaaaaaactaaatcatgattatatccaatttgccagttaaatatgttccacacatcagtgaactaaggaagtgctggagaattgttcttagtaacttggataagcaggaccccgattgtattagtcaaaaaataaatttgggtgtatactttttattgatgtgtcatagttatacacattttggggtgtatgtgatattttgatgaatgtaggcaatgtgtaatgatcaaatcagggtaatggggatagccctcatctcaaatatttaccaattctttatgttggtgggaacattacaattcttctcttctagctattatgatatatgcaataaagtattcctaattataattttcctgctgtacaatagagtactagaatttattccttctatctaactatatttttgtacatgttaatcaacttctcttcaactgcccaaagcaattgacacattcattgcaatccctatcaaagtactaatgtcatttttcacagaagtagaaaaaaaatcctaaaattcatatggaacgaaatggagcccaaggagccaaagcaatcctaatcagaaagaacaaagttggaggcatcacactacttgagttcaaattgtactacacagcaacagtaaccaatacagaatggaactggcacaaaaacaaacacatacaccaatggaacgaaatagagttgttatgaccaaccattctattctctaccttcataagattgacttgttttgctctcacatatgagtgagaaaatgtgatatttttctttccgtgcctggcttatttcacgtaatataatgactttccatctatcttgctgcaaatgacagattttcatactattttattgctgaatagtattccaatgtgtacatatgccacattttctttttattattttgaggaaactccatagagttttccacaatggcagtactactttacgtttccaccaacagtgtacaggcattcacttttctctgcagcctctccaacatttgttattttttgtctttttgataataaatagcatttctagctgggctgaaatttctcttcgtggtttttgtttgtgtttttgtttttggtttgtttttgaaacggagttttgctcttgttgcccaggctagagtgcaatggcgcgatctcagctcactgcaacctccgccttccgggttcaagcgattctcctacctcagcctcccaagtagctggtattacagctatttgtggttttaatttgcatttctctgatgaagatttttgctgttgagttgtttgagctctttatatattctacttactaatcccgtgtgtattagttcattcttgaattcatataaggaactacctgagactaggtaatttatgaagaaaagaggtttaattgactcacagttctgcaggctgtgcaggaagcatggctagggaggcctcagggaattcacaatcaggcagaagtgaagaagaagcaggcacatcttcatatggcagagcaggagagagacagcgaagggggaagtgctacacacttttaaacaaccagatctcctgcgaactcactcactatcatgagaacagcaagagggaagtccgcccccatgatccagtcacctcccacaaggcccctcctccaacattgaggattacaattcgacatgagatttggatggggatgcagagccaaaccatatcaccttgtcaggtagatcatttgcagataatttcttccattttgtaggttgtctcttcactttgttaactgtttcctttgctgtgcaaaagctttgtagcctaatgtaatctcaattatctgtttttgcattggttgcctgtgcttttgaggtcttaaccaaaaaatctttgctcagagcaatgtcccctagcatatccccaatgtttttgtctagtagttttatactttcaagtcttatatttaagtctttaatccattttgagtttatttttgtatatggtaaaagatgggtatctacttttctgaatatgaatatccatgtttcccacaccatttattaaagagactatcctttccccaatgtatgttcctggtgcctttgtaaaaaatgagttggctgtaagtgcatgggtttgcttctgggctctctattctgttccattggtgtatgtgtttgtttttgtgccagtaccattctgtattggttactattgctttgtagtacaatttgaactcaagtagtgtgatgcctccaactttgttctttctgattaggattgctttggctccttgggctctatttcgttccatatgaattttaggatcttttttctacttctgtgaaaaatgacattagtactttgatagggattgcaatgaatctgtcaattgctttgggcagtatggtcattttaatgatattaattcttccaatgtatgatatgagtgtgggatgtcttttcatttgtgtacatcctcttcaactttcttcatcagtgttttatagttttccttgtagagatctttcatctccttggttaaacttattcataggtattctattttttgtgctattgtaaaggggatttctttctgagctagttaattatttgtgtatagaaatgctactaatttttgtatgttgattattatcctgcaacttcactgaattcatttatcaaatctaagagttttttggtggagtttttagatttttctatgtataagatcgtgtcatcagcaagtaaggataatttgacttctttctttcaaatttgaatgccatgtatttctttctattgcctaattgtttttacaaagacttgcagtactatgttgaatacaagtggtaaaagtggacatctttgtcttgttccagatctgagtggaaaggctttcagtgtttccctattcagtaagtgaaggatagtagagattagccagagcttatctcataataaatgactatgacattagcctaaaatatgaaactttccaagaccacttccctttgggggatcacaaggagatgagtcatcagtcactgccttacatttttgaaatataaatcaacattgaatagtaaaattagccttatggataaaaagaggtgactaaactgatttataaaaacttgtctctggataattaatccaccctaaacttgcttctcttatgttgtctccacatatggttaaatggtaccaccattcatgtgtttgctcaagctcataactagggatcatgccccttaactcatgaacattcgtttataattcacatctagtcagtcagtaaattttgttagttctacttaccaaatagatacttaagggaaaaaaattctaccacttccaccaccaacactgtgccgtcgcctttcagtggactgcctcaacatcttcctccctgccttcctgcctccattctgcctctctgcctccacaccacttcattctcccagacttgaacaccaaaatgccagagtgatacctctggtacaaatgctacttggggctctcttatttttaaaactctccaaagcattcctcttatacttaaaataaaacccaagtcctttccatgttctacaaggcccttcctgcattggccagtggctatctttgaattcattgtcactctttttttacatcattatagatacagtggcattctttgccctctcttaagcatgccaagtatactccatctcagcacctttgaacttgctcttccctctgcctggcataaacatcctccaggttttgctatgactcacttcctcccttctcacagatatgttccaaatgatcatcagagcaagctttcctgacagttttttctaaaatagcatttacattagtctctatctctttagctgctttaattttcatagtacttataatcacctggcattatattgtgtgtgtatcaatttatatgattattttgcatctccttctctggaatgcaggcttcatgaaagcagaagttttgtctgtcttgttcactattatagcccctagtacctggtagagaggaaatattttaaaaatattttttgaatgaataaatgaatatttttatagtttaattacaaaccacacttatcaaattaaatgaacaaaatactaagtatcaaagctagccaaatgaattccttggctttcctaaatacatgtcttttgatggatatattatgagttacttccttggaagtatttgttctgtctccttggcatgactcttaagttaccttgtatatgttgttagtttagtcatcaactgacctccccgcacctttctgttcagttgcttagtcactcctcactctttgaggctcctgaggctccatgactccgtggttagtcaccacaattatttgcaacagaaaggagaaatgttgccaaccccaaagcattagagataagtgaaaaatagagcacccctttcaccccaagtggattcacctagtaaatgttgatgttttcttctgtccatttccttcttctgcaaggaccatgagattgtgtttacattctacagctctcacaagatgtatgctccaatattagaaactaatgtttaaacattccaggccaaagaaagcaaaactgaaattccactcttgagtcattcagaggttgaagcattatgggtgatccaagttcccctgactatctgtgaacacaggcagttgtttgtcaattcttttaagttaaaaaaaaatgcacaaacaacctattgtaaaatggagtgagtcagtgcaattgcacaaagcatgttttattgtcagctgtataaatctgtgaatatttttcgtgaccagttttagttggtggatttaaatgaggtcaccaaaaagttatctctgagtatagcactcgccacagtgcatcataaatatgctctcatctatgaacatccttatgaatgactctatgtcttactcattcttttatctctaaattagtactgactattttaggtccttcataaatgcttttgaaattggattatggaggtatttataattatctagattataagctctttcaggactaaatgctatgttttgtttacatttgatccccttatagtcctgtacattgccttgcatatttaaaagtctttagaatatttttgttgaattgatttgttaagtatagatcaatccccctgctatggaaactaatgtggaaagtgttaatgattcttaaatcagggtctaaaccccttttgatcctttggttggatgtccagttcattatttcacaaatagtaatatttttcttgtcaggctatataggctgctaaatgctattatcccaaactttgatggatataattagaacagatttattttccgtctactatatgcaggaacttaatctgttttcctattaaatcctcacgacaattcatgcaggaagactatgtcacattctccatataaaaagactgagactaagagatgttaagtaatttatccaacttgccaaacaaataaggcagaatcaggaactgttagacctgtttccttgaacactaactgtgtgaaatctttcctactctaccacaatgcttctaagaaacaaagtgggccgggcgcggtggctcacgcctgtaatcccagcactttgggaggccgaggcaggcggatcacgaggtcaggagatcgagaccagcctgactaacgcggtgaaaccccgtctctactaaaaatacaaaaaattagccaggcatggtggcgggtacctgtattcccagctactcgggaggctgaggtaggagaatggcatgaacccaggaggcagagcttgcagtgagcggagatcgcgccactgcactccggcctgggcaacagagcgagactccgtctcaaaaaaaaaaaaaaaaaaaagtgaagggaactagttaaaatacattatgaaaattatatatgactttgaaagaaacattttatggtaggataagtatagatatccaaaatgtatcgaatattctcaatagtatttgagggattagtatgtgaaggattaaaattaacttttaaaggcgtgattgttcaacagagaaagatacatgtattatagacacctcacatttctctccacgttaagaactttaaaaagactcaagaatcttggcctctttaccctggtgttgtcatatttgttttaggaagatagtgttttactttttaccgttccatagctcaagtgtaaaagggatggggaaaagagggagaggctgtatccctttatgaatactcaggaaaagttaatatagatagggaatcaatcctgtacacatcttcatgtgttctgacttctagatgtttctctaactggtagctagtaagaaaaattagtgtccttaaaatgttccttctattatgcagaagctttgtcaactgagacattaataactctgtaagagaggtctgttattatttaaatgtctatagagctttaccgttgttaataggatgttctgaagaataaaatgaggtcttgaaaatacttttgttggtgaatacaaagctatgtttaatgcaaaattagtgagagaaaaatctctactataattgctgtgggtttttgtggacaaaatatgattaggatttaaaattaccctgtgcttcatatcattactgttacactttgtttagttttcaaagtgatttccatttgtgagtgagtgtgcatatgtgtgtataggtgttttcaaggaagagagaaatgtcttcgtaacacaagttgttttcttaactataaaaagccagttggcttagtcatggtctaatgctaagaacgtttcttttaaaattgtaatttgtttgaatttccttctagtttcacctttgccagtgcagaaaataaagagggtttttgtggttgtgtgtatgttcatcttgattggccattaccatagctgcatttgttttccagttctgtgttctgtcaatttaatccaactaatatttatgaaataccataatgttccagaaacattcaaataatggaaaattcagctcatattcttcctttgtgactttgtgacagcaaaattggtcaccctcaagtgactgtagaactgagctacatcttagctttagcagtcacctccttttcacagtcattttgccaatgtgtcaaatcagtggctcagccattgtggtctctggaagtttcccttcacttctatcaaagacaggcaaatcacatgagaaatgtatccaactgatacccatgataataccaaaacatgacacttacagatgatgacagattgcatggcaagagctctctgccgtaggttatgattatttagttgcatgtttccagtcttgtaacagattgcacacaccttgaggggagactgcacagacccatgcaatatttgcttgacagaattttccaaggagcacataacaaagaatggggaggaaaagatctaggaaggattctagtttgaatttgctctgttatttttggcaagccttttgatctttttgtacctcagatccttgatctctaaaataatagagttgaatcagtccagtttttttttaagttattaatattttttattaaattaaaatttatttttaaatttttattaaagttttttaactacaaagcaccgtaaggtataaggacagaaactaaagatattccaaaccctgtatcataatatctggcacattattctgtttaatatatatcagttgaattgaattggatttgtttggtcaacatcttgggtgaaatactgatgtataaggtaaaataaaagcagaactaattttgtcaaagaggaatgggtggcacaacaaggcagggaactgagcccagtgggcacccccaaactccacctactcagaggggcatggtgaaaatcataccatgttagagaacacagtttccaaatcaaagaacttaataaccgtgtaattcttcctggcttcaacattctataattccatgactgagctttaaagaattcctttactaacatctagtttgccacatgaaagtaatatgaaagatgttaaggatgttgtaacattatgccgtcaagtgggtggtgggttatgatggagaaccacaaaaccgttttgtatttctgaacaaatgtactgcatacgggttttattatctttctctgtagatctttattttttgccttactgcaaactaatgtggtatgcgtttgaacagggaacagttctctcaggtgctttctgtaaaaaactgtcaagtcgtctacttgtaactacatagtcacaagattatataaactgacataatttactgaatacaacacttatttagataccatagttgcttttgaaattcactgaaaccatttgataaccagagtctaagaaatgtagatttccaacctattaatggcaaactattttgccaatatttagtgaatataagctgattatttaggcagtagaaaaataaaatccattaagatcactttaggcaggaaataagagtattaaagattaatcagagtgatatcatatctttgagaagaatttcaaagcgattgatctcatcctattacccaaactttcctttgccctttatttctgtcctcttgttaaatagtaataaagatgaatggataattattccatgagctatgaacaaaagctatcaatcatatatgaggttgttcttccaaactaaaactcaaaactcattccttttattctctgacttggggcatgtcattcctttgtacttaatgtgttttcctttaaaaagaagaggaggcaagctgctaaagcttgaattcttgaaccctctggtgataagtatatgtggccaactcttggcaattctgcctagattagccttccagttatcaaccaagctggcatgtcctcttggcaaggaagaaagaaagccctcaaagcaaaaacatttagtttagcaatccttaaatgataatttatatacttgatacagagtagaaatttcggtgacaggtttcaagggacctaggcaattcgatgagagagggcagggcagagtgaggaggctagatgaaggagagctgactaactaaagtccagatatagtctagtttagctaggaatgaagtatgcaatggaaaacctatcttcaagatttctaatggcaaactcttagatttgtgggctgataattgaagttgacgagagcacagagcagaaatgtgtagaagcttaaaatcgaagagagtatatcatgcaaattagcaataaacactataaaatgtaacggataatagaaagagtttagactaaatggaaaatatcatttaaaatattcccttggtgtgggtgtgcatgcttgtactaatttaatgccatatctacctcacttagattatgtatgtaggaaatacttaatgtaataactaaatggcagattttgaaatgatgtgatctaggatatggaaactaggaatggaattaagaataatgagataaatttatgccaaaaaaaatcattgtaatacatgccacatatatcatgtgtagctttaattaacacagaaaaaaatgcaggacatcccattaaaagtaaaacaaagaacaaattgaaaatgctttctgaaacacagttatatgttcacaaggactgaccaatcctgatggtctaattcattagtgtcatgtgactgtcagtctggaagtgttatattttactcacgtacaatctaatagcttttcagcttgcctgaaggtgttatctgcagtatgttcatcgttacttggtagagcactttaacactactttgaaagtgaaaaatatttgggaaaatagactgtattctatcttttagttttatgcagcataactataagtctctgtattattattgttgttgtttttcagcccctctgactgataagccacccaagcttttgtatcctatggaaagtaaactgacaattcaggagacccagctgggtgagtaattccttaattctagttaatatgctgctctcgttacattgtgacagttaataagcctagattgtaacccgatgtaatactcgcagctaaatccatttgtattcatagggaacagaattagaaaatgctagcatacctagccatttcattccttacagtgcgtgccttaggacccagttggacatatggatgtaaaaactcacatgctatttagatggttattggaaaatgagataggctgatgattttagtgatggtattacagcactgtcttacaaggtttgaattggttttcaaacagacactatggaacaatttgatttataatatctattaataggttaagatgcaatttctgaaatttaggggaaagggttcaaatttattaaaataaatgtcaccattatggttaaaaaacattttaagtgtaatcaaatataatataaattttgctagttatattttggataatctattaataaaatatgaccaagtgacttttggttaagggactagcagatttgggacataaggctatagacaaaatatgtattgaaaaaatgtacaattatatacgaatcagaattctgacttatcttagaggttcatctagaaattttgagtttgatttagctatattcagttatactaaattatgaaaaatttccctcttaattataaatatatacatagcaattctgttatattctcttaggtcttattttatttgaaatgtagtatgcaggcatatgccataaactttggcagaagagtttttgtttgtagtggtgcattataaaaggttatcaaaaatatgaatttaaatgaatatccatgtttgttaaggaatttcttcttagattaatcatacaagagtgaaaatgcatgtactgtatataactaaaaagaatcagtataccatcccttaagttattaatgttattcttattcctggagtgagaatttgcatcaaaattgtaaattcattttccaaatgaagattacagatgtgataatctttactaataacatacccaaagttatagtacacaaagatatgatgatggttttagcacctataaaattattgtggtcaatggctttctagcacttgaaatgcttatatttgctaagtttaaagcatgaacatacaggatttatacaagtcagggtgttaatatctttctttgattcaagccttttgaattaatgtcatataaatgcaagtagtattataattgctgttattttgagatggaaggttacagatagcattgaaacagtgccacatatgaagcaaataggtgtactcaaattttatcatgcactttatgcatgccatggcatccttaattacactagaacttattgctacattatgaatacatttttatttataaattcccataagtagccatgctcatactgatctttcaataattcataggaagatgtatttctaaggagttatataaaactattaaacattttgggccgagaatggagggttttatggtaccagttactataatgaacatagtaaaaatgaaattaattgtacgcctttgcttgacaatataatgaaaagaattttatggttgattgttgcccattgggtttctttttactgtccttgaatttgtaataagtcagattgttctctacctcttactacactgttttacaaaatagaataattggtaaagctgtatttaaagctttaccttctcttgaacaaagtcacaaagactaaccacagcaaattaaaaatatggaaatttcttaagcaaattggaagtgactatacattcatttgaagaaatatgggcatgtctgttactaaaatgcttcaaaaaatactcttaaatcctttattgtcactcaaaaaggagcatgaggtctctttaaccactgactaaactagtggattattttaagcaacttttattttgttgtgttttatgattttggttcatagtgtacagataagtcgtttactagttagagaaattcaaccttaatctttggatttgtgagcaacagttgatttgaagtaactaccttaatagtattcttgctactttgctagcattgctagtaagtaggtgaatcaaaaagggtaagtgaaaataggaaagaatattaaagacaaaaaaggcttgagatgaggtgtctaaaatatacgttttttccaaaatatgtatttggacttttcattttcttaaggatttaatttttgccctttccatatttgacaaaactgcctattcaacaggttcaaaatatgatataaatcctaagagggactgagtgaagagtcacgggttgggagtaaagagggtggcctgcgcccatgatggggaacttataacctactctgttgaaaaccttcaacagaattttacggtccaagtattcagaggtttgcctccacttgttcccaaattgagagttgacctcagagggataaccaaactcttgtaagagttacgttataagaaaaatcatcaggaattacacaaagctaagcttgtacatgtctggtgacctaacttgagcatcctagttaagttacacacgtatccaatcaaccctagtaactgtgtgtccatagattctctagtttgctcacaaatatatgtaattcattaataatgaactttgatataatcaggaagtgcatggatttgctcttcatcttcaaattcattttctctgccatttgctagccgtgcctacctttcccattttctatatttctgtattttcttgtgtcctgttcttctaattcctccatcttttcaaactggaaagggtttgatagtggtcatttaaattcttttattgtagaaagaaagcaaaaagcactaaaagcaaagtacttaggaaaaaatcatataatggaaactaaattcatataaaatatgtaaattgtcggctttgaatttgaatcaatacgtggtcacaacctggcatttccattttaagtggcaactgtatgttatttctaaatgtaaaaaaaagaacactgtccatttacataactttcaggcatcagcaaatatgtgaatagcacttttttgggcaaaaggcccagaaatttcactgtacagttctggaagtcaatctgggaggtgagcctgagtattttttcaggctactatagtcaagagaatcaaaagacagccacaattgtcttgctaaacctgagccctgaggatgtcattcagagatgtggcctgcctgttacggccaggagcccactttcagaaccgtccaggacagagagcatattctatcgctaccagactttcaaagagtagaaatccaccctacccttgacctaatggtacaaattatattttacaactcagaattcactgaaaattatcattaattacttacctagatatgtgtatcactttatttaaatgtcagtgttgtctttaaaataattataaaggttaatggtagaaattttggggaaatagagagaagaatctttttcttacactctacattataaacgcattctgctcctattaaatattctcacaaaatatccttttaatggccgatgtgaatgtcatataatttcatatatattgctggaaatttgaattcttcacatttttgttattataaataatgtgatggtctttacctatacactttccctctgactctatagttatctcaacagaacaaattcctaaaagtaaaaatactgggtaaaaagaaataattttgttaaaggttcttagtacatattttcagaattcttaccagagaagttgtataaactcccaccagaagtatgtaataagtataaatactacttaatctttaacaaaattaataaaagtatatctttataacataaaactcttaaagatctctttgatactaaaatcacctctctctcctctcttttacctctttttctctcttcactcattaagtacaagtggatgctctttgagtttatccgtatttgaaagatctagcccatttaggtaaatgtctacccttgagaaaatatacaaacctaatcgaatgtctataatctctatccattttcttctcttgctcatcctaatgctcagctaggaccttcctccagattctatgtttcttaataaagtgcccagtaatttcgtgatgtactgtgggcacatggaatgtcaataaatactaactgacaataagttcttcacagcacaaaggacacacacctctaaattttctgcaagagaatataatgtgtagactgaactgtgtaagctgcccaaccgtgctcttatttttctttactaatttattctcattgttaagcttgttaaaaagcaagcactttttgtatctgagtgggtaataaggattcaccagatattcacatctggaggaaaatggttggggacataaagaaacttcagatttttaaacatagatcttagtaaaaggatacacattttatccaatatatgcaattttatccagtttaactataggctacttaaaataaaatgtcacactagaaattaattagcactccttggcttgttccaccatactgtagttgcagaattttagatttggaatagaccaaaggaaaatgtccatacattttattacagatcataattgaccacaccttttctgaatagttactactctgtgttagtaaacttgggaaatctttttgtttcctctctagggtgagaaaatacttaatataaatatcctagaaacaacattatttaggtgttgaatttgataccgaattctgaaagtgtcatgtaatactgttgagtctaaacattattgttttgctgagttgtacaagtgatgtaaatatgacagttcccagagataggaaagtcagtatcggccagattttctcatctacattcacgctactggttgtcataagcaaatgtaaggccattgatttgattttaccggatcatagagcatataaaggacatattttcaccaacaaactcaaattaaaaaaccgtaaaacttccctttctactacgagaaaaacaataatatcccaagtccaagctttttatggaaaatgtggttctttttgcccatttaagaaagacataccaatcagcatatttctagtgcctgaaataaacctgttagacataaattaaaccttttggacaaatagacatcgtaattaaaccatggaaagataaataaagactggtattataattatttaaactatggcattcaattctactcaatccaaatttatcatcccaaggtaaatgaaagtggtaactcttaacagctctcttagtctgtcttgcttttgaaaccaaaaagcaccctaaaaattgtgactgacctaaaaaggaatacttgtcataccactatttcagttattatcgtatatcattaaacagatgataaatcaataaatggaaactagtattcgtattttgaggtcattgtatgacctaacttacatgattctctcagattctcaaattcagtcactttttggtgacagagaggagaaataggtttggaaaaaaatacaactgcatgtttgctttaaaaactgctatctacgtagaagttgaaattcctttttatgttttaagtggtcagggccagtcacggtagctcactcctggtatcccagcactttgggaggctgaggcaggcaaatcccttgagctcaggaatttgagatcagcctggtcaatatagtgagacctcatctctacaaatatacaaaaattagcttggtgtgttggcatgcgcctgtagtcccagctacttgggaggctgaggtaggaggatcacttgggccgaggtgattgaagctgcagtgagccatgattgtgccactgcgctccagcctcggtgacagagcgagaccttgtctccaaaaataaaaaaaagttttaagtggtcaagccctagttctaggacaggtttgcaatcccataaaaaagatggacgtgaaggtaagaacagttccagtgggccaatgatatccaaaagtttggaagtcagttaaagcacttttttaaaaaaacttttattttaggttcaggggcacatttgtaggtttgttatataagtaaacttgtgtcacaggagtttgttgtatagattattttgtgacccagctgctagtacccaatagttatttttttcttctctctctctctcctcccaccttccaccctcaggtaggccccagtgtgtgttgttcctctctttgtgtccatgtgttctcatcatttagttcccacttataagtgagaacatgcagtatttggttttctgttcctgcattagtttgctaaagataatggactccagctccatccatgttcctgcaaaggacatgatctcattctttttatggccgcatggcattctgtagtgtatatgtaccactttttaaaaaaatcgaatctgctattgatggacatttagactgattctatgtctttgttcttgtgaacagtgctgcaatgaacatatgcattcatgtgtctttatgatagaaggatttatattcctttgggtatatatccagtaatgggattgctgggtcaaatggtagttctgtttttagctctttgtaaacagacaacctacagaatgggagaaagtatttgcaaactatgtatctgacaaaaaaggtctcatatccagcatctataacgaatttaaacaaatttacaatgaagcacttgttaaagtctttaaaaactgggacagagacaagtgagttttcttgttcacttactttccaaaagggccagaagggaaagaagaagaaagaaaaggcccaagaaagagtgctgtcacagagcaatgcagagagtccatttaagcttccaactcctggtctagtccccacgctggacactgacacatattatgcagattactcttttgctgcagcactaagagtactattttatttgttatcagtcagttaagaagctatataggtataaatctttgcaattctaaatgaagaactttaggaggtggagggggtctggaagttatcaggtcaaacctttttctttcttttttttcctttttttgagacagagtcttgctctgtctgcccaggctggagtgcagtggcgccatctcggctcactgcagcctccgcctcctgggttcaagggattctcctgcctcagcctcccgagtagctgggattacaggcatccgccaccatgcccagctaaagtttgtatttttagtagagacggggtttcaccatgttggccaggctggtcttgaactcctgatctcgtgatctacccaccttggcctcccaaagtgctgggattacaggcgtgagccaccacacccggttaaacctttttcatttattgatgagaaaatggagactcaaaatggctacatgttttttacataaaaaatttacaaaagcttgttattgccattatcatcatcctcatgatcatcatattatcactgttagtgtttttgttgttataattaagaggcagtgtacagtagtggctcccagttgaaatctcacacaggcctatgtgacagtttagctccaccatttacttctagtgtgaccttgaacaaccagctttcagtttcctaatcaataaaaaaggtaccaagatagtactgcttctatggaggtaatgtgagtatttgatcggataatgcatgtaaaaattaatagattacttggcatatattaagtagtcaatacatgtttgctgttagtatttgagacatttgaatgctgtaaaagagtactgtatatagaagattcttgaaatgcattttgaatgtcaatgcttatttgatcatgcttatattcttactacagtatcatactatggcagcagatacagccttcattacaggataaataagattttagaaaatttatttccatctcccctttaaggattcaatatgcatactaaatttttgtatttcaatgaaactttttaattatagaaattattgattttagattacttaattcatcaagtctagccaaatgcatatagtaagtacatagttataacagaagaaaactatctctattcttatttaaagaaaatgataatttaaaggacactatgccacatgaatttataaatgaccatcaagacaaaaataagagtaaaaaaatttctcttttgtaaacagaggaaattcaggtataatatttttaaaaacaagagacctggaaaataattttccaccattatgcctgtcaagttcttcatgaaggttttgatgatagtcatatcattttatacaaaaaaatgctgcttttcccctgacaaacactgttatcacaaagctttctaagtcattcttaatgattgaagtttactagcatataaaaatacagtcagtattgtatgttaacaagaactactcctgaatttgcaaagtaaatgccaatttatcagaaataaacctatcaaagaacattacgttgtagaatattgaaagaggttttagaataagagtatgcactgcatgactgatgtccattaaaatagaaactataaaaagacccacatcatttaaagtttgaatataaagagatacattcacccataaatttcctctcaaatttcagctaaataactaaggatttctaaattatatgcagactctccatgaaaaataactagtgcttcaataagattatgaaaataggttaccagtattttatgctttcatgttaaaacacttagcattcctgtcaaaccttactttatcaacttagtatattcccacagatttgtgggtaaattgaatcatcatcatttcagagaagtgttcccttcatttttgattgattttcgattagcagtggcttaacatgtcaggtttaagaggctctgtcccccattctcttttaagcagctaatgatcaatgaaagatttatatgcataaaggaaatatgctatttaaagaaactctgtggtgaataattttatataagaacccttttgtaactgaatgatcacccccataagttttccctgtggtaatgcagatttttacatttttgtaagatgaggttcatcgatatgaaactgcaagttgcatctccaactgatccagaaaaaggatcatccacccattaccatgtgtgacctcccgttgtttattaatggaaacaaatgtcctcattgtgactttctgcctcctctgaggaaatattacattttactcaccagcttcagaatcaacagtatttggttttaatctaattctttgaaaatatattttgtagggtagaatagttaagtaaccagaatatctcatgtccaattatgacaaaatagtttattttcataagggatatgctttgaacgccatcctactaccttatctgccttggttttgttgaaatataccctagtaggataactgcccatggtgtcacttgtttttctataactgtgatgagagttcttatttccaggtttaaaaggaacatcttgtattttgattcttctaaaatttgtatgactctcattttatcattctggcagtcacttctttttatcttaatgtattcatatatgtttaataatttcttttaaatataaaagtatgtacaatgccacttgatttgcagctttatgaatgaggctattaccaaaatgtacttaaacatgtgctccgaaacatgccagatatttacatgagtccaatacatagagtgtccataaggctttaaaacctaagccccatagcaaaacttcatgaagaggcttccttccaattcaccacacacaagttcaacactactttttttttttttttttttttttttttttttgagaaggagtctcgctgtgtcgcccaggctggatgcagtggcgcgatctcggctcaccacaagctccgcctcccgggttcacgccattctcctgcctcagcttcccgagtagctgggactagaggcacccgccaccacgcctggctaattttgtgtgtgtgtgtgtgtgtgtttttagtagacacggggtcccaccatgttagccaggatggtctcgatctcctgacctcgtgatctgcccgcctctgcctcccaaagtcctgggattacaggcgtgagccaccgcgcccggccaacactatttttttagaaatgccaaggatctttatttaattttgtaataaaaatttataaaatctcattataacatatactaattgaattatgaaaggaaaacaatcttgatttaaaaatttttgttttccaaaattaatctgttttaaaataagtcttggcttcatggtcttgtgagaagatacctcccaccgctagatctggtctacaacaagcatgacaaaaagccaggaagttgcttaagagtccaagagagtgaataattttctctcccttccacttctccccagtgaggctaccgactttctcactctctgagtgtttgtttctagtttagtaaaagcagagtacccaccttggacttgcctgttgaagaacttttatagaatggcggctctttgagtaggaaaaaagcaaagcagaatgcattgcttttctggaaaaataaaactgagtgcatcctgtcacatcaagccatcactaggaacaggatacttaacaatacggcaggtcctaggaaaatttgagattattaccacgaatattcagtaagaagccattaccattatgtgaaatagcttagggaaagttcagaaaacaaaatattttttattttctcttcttaaaagaaaaaaatgtaatgtttccgatgaacctgtatttctgatgatgatcatgtcaattatcttggcaactttaagacttcttaattaaatgattaaaagttgttactactttctgtaaatgtacctgtttttgactgaaatatttggggtgcaattagactagttttatgcactctgcttattgtatagcctatttataagtagtatgaatatttctttcagaattacatatcacatacaatattgattaaaagacttaaacaagatattgttcttaggcataaatataatttgttttttaaatcaggttcaccatattcaacatgaatgtaatttgtaatgattattattttaaaaaaaaccctgtctctatttaccataaataatatgttgtcactccaatgctctttattaggacttgctactaattacagagtgagaataaggtttttatgtaatgggagctaaataaaatgagtgaatcttatattagatgaatacatgagatttcagcctcaggagaaattgtgtgtcacagagaacatcggtgactattatgaaagacatgttcagtcaagagggaatcgtactgttgactatcaacagggcagaaagtactggattgtattttctttcagtcactatgtgcatgacctaaaatagagaactgaggcaatatatacataatttagaagggaaataatccagaaattttatttttgtctcaaatagatggctctttcaagcaaaggttaatttggggatttttttttgaggggtcaacttcctatgtctaagcaatttaaacttgaagaatcacaggatttaatacttcatagttagagctctggtcataagtgacaaatcacttaaaagacaggagtggtgctggccttaagaaggattggaataatgctcgactgttctctgtctttcttctctactctttctgcatgtcatcattttgtataggggtggagagtggtgggtctgggtgagtagaggagggcatacagggtgaaggaatacgttgctcagttcttctaaccaggaggaaatgtgggtttggaactttagtgagaacttgaagttccctaaggagaaatcctaattggcctagaatgagatacagatctaaattttggacggatcactatggcattagaggtgaggggcattggctcagtggctgttgtgtgtctctctctcctgtgatgaagcctgtatttttgtgtgagtacgtagatgtggcagttggtgggtgggtggggaggctggtaatggggcttttaacagacaaagataggggaaaaagcaatggttattatggagtccatcttttcatattccatattcaatatttgtttaacatccctggttaatccatctcattaatttagctgtcatctttattatgcctcttcattaacttagtgagggtagaatgacccatcctgattgatgcatttgaatgcagtctctcttgggctgaaaactcttccattgctcttctcccaactaatactgacatcctttcctgtgtatctgtagtgcatacgtctcaactctagacctgcattcatctctctgctgtctctaagcctgcagagtatgttctcttccagccttaaacctaaaccaaatggcagattcttagctgttaaatacatttttaggaaaaaattaatatgctttctagagctagagaatggattataaaatcaacttcacgtaatatgaataagtaaagtgaggccagatgtaatgctataaaggagaatggagaccatgctgaagtggggaaaacattttctacctataaaattttaaatttattgttaataccatcttggccaaataaaacttgtctagtgggtagttttagtccagtggcctgagtgtctgatgtcttgattggtaaatcgagagtttatactacgaaatactgctgcactgtggagccggtaggctctggattcagaatggctatcacgaaatatgaatctgttccatcatattatagattggaacatgacataatatgatttgtaatgtgtttggagtaactaataaaatctcttacccaagaagcaaggagtttagagcagcatagttaattatgaaaggagaatctccccatcaggcgatacaaaaatcatagagttagaatgaaatgggcaaattctctttagcaatctggccccacaaaaaagtagctatgtctattttgtcattacagacttgttaagttaacaaaagtagaaatgtctgttaactctcccagcagacattttcatttactcttctctgcacatttccactggatatatgtttgttcctaaggtcctttactcaaggctaggcattacctaatttacttgtgaaaatgtgccaagaaaaggatcagtgattattcttgcttcattatttaaagcctactttcatgaatgtaatgcagtcatcattcctatgtattgtcatcagagtcgagagttgggacgacagagagtagaaatcctataacaggcattagaatttttagtagataataccaaaaattgaagcagagtcagtatgtcagactctaagtttggcttggtaaaaaatcctctttgtaaattaaaaaaaaaaattaccagactgccagcttaaaaatattatgtgtttccaaatagatgagaaatgtttgaggtgataaatattccaattactctgatttgatcattacacattatatgcatatatcaaaatatcacacatacccctattagtatgtacaattattgcgtattaataaaaaggaaaaacatttgatgcaaatataattcttgtgtatgtgtggtcttaattgatattcttttaaccaagcttactgagatatttatattgagtaaactatatcgtgttcagggtaaaaatgtatatgttatgtgtctgcctgttatctagaagataaaggccactttcttcacagtctgaccccattttgtctttatagtctcatgcactctcctcttaagcccacgccactgaccaggcacccttgaccataccatggacctacataactctatcatttgtacatgctatgcccaccacctgaaatttcctctcctgcctttttcccttgtgcctatctactcaaattttaagaccaacctcaatgtcaccccaatgaactcttccctgactctactcccactaggcagaattaaataccacctctcaattgctagcaaatctctttttcacacctttattagaacatttctctcatcatttttgtacatatttttgtgtgtctatttctcttgttgcatttcggactcttagagcatgtactataatgttttcatctttacatccctgatatgtaggacagtatctgatgcacagaaataaataattcatttagcattcactcagctttaatagtcataaataaaaaccaacatacatatgtcactcttcttttagtagcatatactgcagagtaatggagtaaaccacgctaaaactgttggttttgatttaattgcctggtgtgattgaagattccccttcatggatgagagagacagatagagaaaggcctaggagtctggctagggaagtctagcaataagtcaaatcccgattagacagaggaggaaagatcagatggatattgaaggtcacaacagagcagtaggttgagtttggataaataaataggggttgaaagaacagttatatatcagttcagctagaagactggtcaagggtagagacttttcactggcgtcttgagtttcaggcagatctctaaatttagtaaagtagactccacaatcttagggccctgaatgagaaattggttcgctagttccatttatgactttattactgggcacaaggtctggtcaaatccacataggtggctaggtaggtagataggtagatgaatagatagatagatagcttaacaaacagacgactgtctacaaggagtttatgttataatctcggttaacctctggatgttccttgttccccaagacgccaagacttcctgtctttcctcacagtttcagtcatgaatgtcagctctcgttctaatgagctttttaatcacacagtcgtgatccagtaggtacagctttccttgattagtgatcttaatttatctttgctttgagagtaccttacatctgcaagacatttaagtatgttgtctcatttcatcttttcaacagcctgtgatgtctattttgcctccattttacagataatgatcaaagcttatgtgtggcacttgttgtgacacttctatacattagtgtattgaatgtgattacctgttttgctcctttgttgagttctaattgtgcacaacatgcaatactcccttaaatccataaccttcctgtaatatttaaaatggtctattcttacagactacttgagttctgttttcttccactgttaagagagtctatgtctcatcaagtagaacatctagtaataattccattgaatataaacttgtctttgaaatgtttctgtattatccagttcaggttgctaaaacaaaatgcctttatactattgcttccaaatcttaactattggaaacagtgccgcaacaaacataggagtgtagatatctattacagcataactgggttattattgttaataaaaacattttaaaataacttaaagagtgtaattggattgtttgtaactcaaaggataaatgcttgaggggatggataccctattctccatgatgtgcatatttcacagtgcatgctgtatcaaaacatctcatgtatcctataaatacatacacctactatgtacccacaaaaattttaaaaaactgaaaaatgccttatcctgattgatttataaaccacagaaattaatttctcacagttctggaggatggaagttccaagatcaaggcgccagcagatttggtgcctggccagggttctctgcttcatggatgatgccttctagctgagtcttcccatagtggaggaagcaaagcagctctctaacccctcttttataagggcattaatcccattcacaaaagcagagccctcatcacctccgaaaggcttctaataccttcgtcacctgctgataccatcagcttggtgattaggtttcaatatgtgaattgggtggggggatgaaaatattcagattacagcggtttctcaggtttttggttttgggttttgttttttgtttttctattcagttgcatgtctcttgaatctgcttctgttcatctttgcctcctattttctcattcccattttttttgtacttctgctctttcaagtacattttaagagacacttttcttctttcactgatcttcgagcatgaagttcttttcaaggcacttaggaaaatggaagtacttaggacattcatgaacagaatgtctcgagagctgcaaaagttaacgtgagaaaagctgatagaaaagttgcctagttcatcagagttttactctttaaaaagcagcaagttataatcccttcttaaatagcaagcaaaagcaagtggtctcatttcacttcttgaaatagacaaagtgaaactaataattgacttgtcaatttactacgactattaattccctgcacgcaaagttggacttcgttaatttaggattcacgttttctttctgaatataattatctgactatatacagaaaggtagtttgaagccagctagttattgtttgagcatttaaagttaaaaactatgtagacattagtaaatatccatttagaaaacctgtaacaactggatcaaaattaatcttaactgagaagttaaatttgacttacgatatttttatgacatttacagtgcatcttgctcatggcttgtaaatatatgttaactttaaagaacttgccaggagtggtggctcacgcctgtaatgccagcactttgggaggccgaggtgggcagatcacctgaggtcaggagtttgagagcagcctggccaacatggtgaaaccccatcttgactaaaaatacaaaaattaggcacgcatggtggtgggcacctgtaatcccagctactcgggaggctgagacaggacaatcacttgataccgggatgcagaggctgcagtgagccgagatcgtgccactccactccagcctgggtgacagagcaagcctccatatcaaaaaataaataaatcatgaacttggtaaggtttatgtagaaatagaggtgcttttattatgtaaatgtttgctgtattaacttaggaacataatttgcaatttttcctaaaggctgacatttaccaggtgtgaggtttcataaacactagtatcagaaaaacatttccagttgtgaaaatgattataagaacagaagtattggccaggtgcggtggctcacacctgtaatcccagcactttgggaggccgaggtgggtggatcatgaggtcaggagttcgagaccggcctggccaacatactgaaaccccgtctctactaaaaatacaaaaattagtcaggcatggtggtgggtgcctgtaatcccagctactcaggaggctgaggcaggagaatcacttgaacctgggaggcggaggttgcagtgagccaagatcatgccattgcaccccagcctgggcaatagagtgagactccgtctcaaaaaaaaaaaagaaagaaagaaaagaaaagaagtatagtcacaaggtgagcatgttattttaaacttcaatgacttaaaaaatataagtattgattttaattgcacgatagcataatattgaaaataagagagaaactgactttattctagtctgtgagaacaggttctcagtggggagataagactaagattctcatagtttattgaaataatgatcaattcaattatcaaatgcaggatagcattttgtattcagtttaataatccatcagcttttcaaataacatgttttaattgttttaatattatagattattttcactcttaaagtatcattttccaaataaagaagtatcatgatataagccattgggtagtggtcttgccactgactaattgagaatctcagtggtctgaggattttaatttccaactgtctatggcaatgattcttcactaggaatggacatgataaatacctgtagagcttttacaaaacatatgcacctagtttccttgatcccctgcctccccccacccccctaaagatttatttatttatttatttatttatttatttatttatttagagactgagtctcgctctgtcgcccaggctgcagtgcagtggtgcgatctcagctcactgcaagctccgcctcccgggttcacgccagtctcctgcctcagcctcccgagtagctgggactacaggcgcccgccaccacgcccagctaattttttgtatttttagtacagacggggtttcaccatgttagccaggatggtctcgattctcctgacctcgtgatccgtccacctcggcctcccaaagtgctgggatcacaggcatgagccaccgtgcccagcctaaagtttaatttattacatctggaagggaagctgagcaaggtctgcaaattttgaaaattcagagaaatacacatcaaatctacagtgagatatcacctcactctaattagaatggctactataaaaaaaaaaaacaaaagataacaaatgttggtgaggatatggagaataaacccttccatactgctggtggcaatgtaaattcatacggtcattaggaaaaacagtatggaagttcctccaaaaataaaaaatagaactatgatatgttccaagaatcctactactggatagctatccaaaagaaattgaatcagtaatttgaagagatatctgcacccccatgtttattgcagcgctatccacaatagcctggatatggaatcaacttaaatgttcatcagtggatgattgggtaatgaaaatatgttgtatatacacaatgaaatactattccatcatgaaaagaatgaaattctgtcatttgcagcaacataaatgaacattggggacattgtgttaagtgaaataagccaggcacagaacaacaaacaccgcatgatctcactcacacgtgaaatctaaaaggttgttctcatggaagtagggagtagaatagtgtttaccagaggatggagagggtaggaagatggggaggggtggcgagagattggtcaattgggtacaaagctatagttagattgaaggaataagttctggtggtctgttgcatagtagaatgactagcattaaaaagaatgtatatttcaaaatagctcgaagagaggtttttgagtgttctcataaaaaagaaatgatatttaaagtgatagatatgctaattaccctgatttgattattacacaatttacacatatatggaaacatcatgttgtgtcccataagtatgtctaatcatgtgtgaaccactataggaaaaaaaacctctgacctggtgggtttgatgttttcttagtcattatcatgatctctctatattctagagctctttgctctccatgtgagggagctaacagacctttctgggtgatctcatcagaaaggctgttagtgccaagaaaggaagactttataactcaggcacagagagtcccagtgaggctctgaagatcttttcaagtggaagcttgtatgacaggacactacactggggaatgagggtgggagtgaggtggagaaagaaggcacttctcagagcatagtaaaaatttagcaacaatttgagtcacttaccttactaaaaagttatctttatatctatgttagttttctgtggctggtgtaataaattacttgatggcttaaaacaacagaaatttattctcacagttctggtggccagaagtctgaaattaagggctgaaacccctcaggaggttctaggagagaatctttgcctcttccaaggtctatggctgtctacattatttgtcttgcggccgcaccagtccaacctctgcctgtgatcaacattgcctcctcatcttctctgtttttctttcccttccatctgtctcagctcttcctctgccttttctttaaggtcgcttgtcattgaatttagagcccacttggataattgaaattgatctctttatttcaagaagcttaacttaattatatctgccaagaccctttttccaaataaggtaaaaaattttacagtttctggagttgtaaaacatggttatatcttttgtgggggtgaggcgggcacgattgaacccactatagtatctgtcacatgctctgctacattcacaaaaactgatacttagtaaaagttcatgagattataaacagtgaagtatcaacaagacccctcattcaataattatcagggttgcttctctctctctctctctctctctctctgtgtgtgtctgtgtgtgtgtgtttgtgtgttctgtgttcatgtgtgttgtgctttgtggtcttttttttttttcacttgaagagtattcccatttagcccttgaagttaccaaatggggaagacattaccaaaaactatccattaacataagagttttgtggagcacaataagtaaagcaaagggaaacatccctctaaccctttcccagcaagaaaaaacaagataatcctggtagttccgagaaagcaaagaaagttagctctaactctttgtagtgaattttacagtattcagttgttctcgtacatttgtcaagagttgattcacctgcaatagaaaaggatgtctgtttacaagtggatcaatgattatatctactaatggaaaatggtagattgttcccaaagtcttcacaaataaaatctcggagataatatatctttctccgttagtagacacatcgtagtatctaaccataatgattacaggcataccttttttaaactatgggggcagtcacagtgctcagcattgcaggttttaaccttcatcagcagagtcagatattaaaaagcttatttcacgttgtatgcctgtatcaaaacatctcaggtagcctataaatataacacctactgtgtgttcacaaaaataaaaaataaaagttctcaatgtattaataagaaatcatgcatttatcaagcacttgttcaatgtttgtttgaaagtggtaggtaaataccaaaatgaatgcactgtatgagtttagggatgaagagcttatttcaaaagctcggtcaagcaaggcctaatggtgaaaatgttatgtgaactctaccttaattaaggtgtaggatttaagcagacattgatgaagtattaatagaaagacattgctgaaagaccagcattaggagaggcagagatgacagaacatatgttggcttttggagtgggcaactgttgtagccaactgaagaaattcagccaactgaactgatgaaaaatagtgctggaaaaaatagtgtagacacattacgaatttagatacactttcaatggaatatatcacaatggaatgtgtgtatgtatatacatatatattctgttgaaagtttcaatttcttatacaattaggaaagaaagagagcccaattaataaggtagtctcataatacattgtagaatgaataagaggaagtaggagccagaggtcagagagccaactgggaaactaattgtctaggcaaaaagtaatagagtaggatttgcaaaaggtcagagttgagggaaattgactttcagagaagtataaatcttattgttgtgtagactaatgctaagtaaagttgacagataggagtcaaagaaagtagattttaattatggttgagtgggaggaaggtgatatcaataataagaaaaagaatgttgtaaagaggagcaacatttgtgggaaatatgttgagtcaaactgtggttacacgacgatagtacattctgacaagtctctcccacaactggaaatatgtacagagctttagtgaggtattcgggctggacttgtatttgagagattctcttaaagaagtaacaaaggaagtcagatatttattgatgggaaggataacttactttctcatttgatctcagtattattggaataattaagcatactaattcctgaatttcttattttcctcttgaggacaggaaatgtgttttatttacctctgagtaatcagctgatagattgtcttcaaaaagttcctcttgaattactagagtttaggttgccgtgtttctgagattatcttactttttcaagtttaatggaatttaaaaaaaaatttactatatttactgttgtatcctgaaaacaaaagtatttctatgagttttactgtaatcctattatcatctcactgcttaatctttcaggtttccaaatacttttaaaatttactttaattgtttttaaatgtaatgagatgttattttaaaaactgttgattatttctacaaatgtgtcatgtccattaaaagtcactcattcataagtatatattatcaagttaatgtactagcgagacatcataaattatgcttcatctttctgctgttaattcacattattctccttctatccagggaaagaaggtactatatatacatgttattaaaatatttagaatctttgaataatttaaacaacattttaaataacagaatatggaagaaaatagaaaaaaagttaattgattcaatattttttttcaacaatttcttttaaatatatagacaaacccatacttggcatttatttggaactgtgtctgtttgcatttaaatttttgtgacctgcttaccaattttaggttttgtattgttttcttcttcctttatttatctttccatgctatattgattcctgagtgtttgagggacttccattttccagctcatttaagtgcatttcatcctgctgtgttggtcatcagcaagacacgaaaatggtactgaaatggccacataatgcaatgtgatttgaaacgaaggggaattgcacttgtctgttgggcaaggaatatttatcctgggttgctcgatgtatttagaaagtcaagagttatcaggtatttatttgtaagagtacagagaatcttgaatgctagtgattccaagacatttagatttcaggaaccagttgaattatttaaacaaacaaacaaaaaataagtaacgggaccataataaaggtgccaaatgatgttattaaatgataaagaattaagatctgctattaatgtaatatggaatttctaaaaggagcagtttaaaatccaaaacttggaaggtttctcagaggaagtgctgatcatttgaattcaatacattcaattttatatttgtcttaaaagctcactatagagccgagattgcgccactgcagtccgcagtccggcctgggcgacagagcgagactccgtctcaaaaaaaaaaaaaaaaaaaaaactcactatactgttttctgctgctaccaaattttgcatctaagagcatctgagacatagcatgattgttaatgatcgtgtcctgcctctaagaaacactacaatcataatacgttttgttttctctaccctaaaataaaatacttgagagtgaaaaccaatgcaaatgtgcaatatattttccccatatttgggaatggaatgtcctcactgatatgtgtgtgttttgtatttcatttacaatgaaggtgacacaaagaatttattctcattacagttgtatgtgtatacactgtagaatcatgttgtgaaagccatcttatataaaatataagtttcccctctctttttgcccacagccttaccccactacccagaggtaaacacctgcaactatagctgatgtttggtatttagttccatgcctcaaaatcacatgctgtactaagaacgcatttttctattttttaaaattgatttattgatttaatatgttgacttctcagtactgtagattaagatatagttctctatcaaattcttacccttcctacacaaatatgcatttcctgccttctcattctcccatgtagtaattttggctcccgtgctatctgccagttgtttgcaattatgaaaactctagcaaaagctgagccacttatagtaaatttccatctctttctctctttgatttgctttttgggacctttcctacactttgtcttcctgtcttcttactgaataatttttctaatacgtatttgtaattattaagagttttcatttttctgcatatctctttttctatagcagcctattcttgtcacatggagtcaagagcatctcttctcattctgaaaacattgaagttagttattttgtctgattttgttttgtggggttatttttctctctacataatctttatttttcccaagttcctattgtctgtttggttgcatgtttgagtctccctcatgttcaaggcttcctttgattttttgatggtccttggttgtctactcattaagtagaggtcactaaaaaaagtgcttggtaattcttagcagaatgttgattgtggatcttctggtttggttttctgctgagttgagaaatttctgctgttggtatctttaggtcttttgttttgcactggtcagattcacagagaatagtcctccaatatccagcctgtctttctgcatttgagagatgagcgggaaaaggtttcacatttggcataaaagtgcgtttcagctgcatgtttatgggtctggtgtcctgcagtgcagagactctctttcaacctctcaagagaataaacatattgtccctgtgatgacaaagaagggaaatcaatagctaccttattcataaacagacatttgacagaccctcttatttcctcccaattcttactctaccttccataggcagctggtgtcatcattcactgagcccttctggaggttctgcattggcaatcaagttgattcttagcttcaaccgctgttggattaggattcagctttttcaggcttctaagtgtgttactacttattcattaactttccagcttctaaaattctgctgccgtggtgtccttccttgttttctttgtcattatgggtttgtgcttaatttaaaatcccttcatttatatttccatgtgattttagaagggaaaaaaactctacttctgtgttgaattcactaccattacctgatagcctgcatgtgactttaggaaattggttcctgacattttatcagacaacagcataaaaactaaactgtcaacaagtcttcatagaggatttatgagcttgagcaataattgcaatactctctataagctaaactgacataactctaaatgaaagtgagcagtgtcatgtttgctattgttgatgtgctgtggacaacgtgaatgacagtcagttttaattagcccacggataattgcagtcatgtacctaagtcccattaatggtcactttttaacacctataacatggaagtagtgaaatgattcatttctttttttttttttgaatatggtagagaaggtcaactatgcttttgaggtaggaattattgataggatacttctagttggcttagcattttcatatctttttagcttaactatccattgtgagactaagcttattactgtcatgtaagattcggttaagtagcactattcatatctacaatctaccatgtggagtgatttgtcatcatttaaggaaaacccgtacatcagatataataagcagctattcttctggttaaccttttaatacatattattgggcagcaaaatcaaaacagaatctgttgtgtcatctctttggtacccaggcattttctacacaattgtaacaagactgctctggaaatagctataaatggatcctgctgagatctgctttttctcaattatcttatcctgtcaaacaagggatttttctcctcttcactttctcctccatttataaggatgtaatttcagcttgcaaattcgattttatcctttattgttagagcaagagatttcccagttttgatccagtctccacacttatggagggcccagtgtgaatgcagtatgcatatagatatcaatcagggatagcaggtcattccagccagaaaaactgatgtttttgcgtatatgtatatatgaatgataatatagggtgatggtgcctcagtctacttgtgctgctataataaaataccatagactgggtggcttatgaaccttgaaattttatttcccacagtcctggatgctaggaagtccaagatcaaggcactggtggattcagtgtctgttgagagcctgctttctggctcataaacagtgccttcttgctgtgttcttataaggtagaaggaatgagggatctctctcagggctttattttttataagggaattaattgcattcatcagagttctagccccgtgacctaatcaccttcccaaggctccacctcctaatgccattagctttgggttaagattttgacgtaataattttgggggaacaaacagtcagaccataacagatggatatggaaagagatctttagggacaccgtagttgggatggttatatctacttagaggggctggacaaggctccttcagggagacagtgttgactttgagattcaaaggatgaatataacttctccaggtggagaaatgtacaatgaccaaaaacaatatctgcaaaactcatgagcagggaaaaatcttaagtggttacaatgaagaaatgccttgaaatagaattaatgaaatttcacctttaggtctaactatgacagtatctaacatttactgaggactactcatgtgctaaacacaatgctaagataattatttcatttaaaacaccaactagattataaatcacattttacaaataaggagcttgaggtacagagaggtttcccaaggtcactaattattggagaaaatgagacttgaacccaagaagtatgatggtaagactcatagtattcagtgatatgctaacaacaactgacacaaatagttctttctgtcagctatagttgtactttggtctccagttatataatttgaagatacttgcagtcatagttcaggctgctatagcaaggtaccataggctaggtagcttaaacaacaaacatctatttctcatggttctgggggctagatgtctgagatcaagatgtcagcatgatctgtttcttggagagggccctcgtcctggttatgttctcatttagactttccttggtgcttgcaaggtggcgagagagagagagagagagagagagagagaaacagagagaatcttttatctgctcctctttttaaaaggagaataactctattatgaaagattcatccttacgtcataattacctgccaaaggccccaactccaaatgccaccacactgaggattagcgttacaacatatgaattctgctggtacacaaacattcactcctcagcaatggggtaccgagagcagcatcacatgtgggactgtggttgatgatggtgataaagatactgaaacttatgctattcttattgctaaatcatgaccacactttacattttaatggaaaacttcagaatagatggcaatgtatattttcataataaaaataaaatctcttctggtaaatttaagtacgtattggtcagttgagtagtttatgagatgtctttccctatagatcatagaattttagtgaggccttagaacagggtttctcatcctcggcactactgacattttgtgcttaatgattctttgttgggaggggttatatactataggatatttatcagcatccctggcctctacccactagatgccagtaccagtcccccagttgagccaaccaaatatttctccagacattgccaaatatcccctgtagggcaaaagtcatcccaaaacccaggttgggaaaccacagatttagagaagtctagtataatcccctcaactttacccaaaaagagaattgacgtgctgtaagcaaggtcatacagctaaactgtggcagaattttgattagatctcaggtctcctgagcccaaaatcatatttcacatataacaaactgtggtgtcttccacttaaagcagtgccttcagaacatatgatttaaaaagtacacatatatcatccataacagctcggcagacaggtagaataaatgcaatttgatcagtggaaatgcatggtgcgaaaagttatgatttgtcccaggttgcctacctagcatggaagacatcctgaacacaagacttcagatgacagctctgatgctctttccaatatcgttgcttaccgcagttggtcaacatgagcttggtttgagaaaggagcaacagaaaagtttttggggaacatttctaaatcattgctttcatttccagcactctgaccctatatcttttgtaggcaaaataataacaatcgcctttttttttttaaattggtagagagaaggaagtcataatattcacatagatattagctatttactaacttgtgcctcggcataatttttcttatacttgaatgattagagaataactgtcctcaaaaacataaaatggaaagttacattactttatgttatggatgcctcatctataaagacgtgactaccagtgattcctaaagacttatagagagttataagtgaagtcatattccaaagcctctgctgtttgggatttttttataggtcactgtcatgtagtgatatgaaataaaaatatttaactatccgcctctttccattcatcactgcactgccgcaagtgagggctttatggagataaacgatctggctttgaacacacacctggcaagtcacaatggtaaaatgtcgaccctttctgagaagtgaagtgtaagcagttctgagcagacccaccagctacgatgctgcacatttggttgtttctcttttaaaaataaactcagtctgaaagtttaaattatgtatagtttgtatagtggcttacatacaactgtaagaatgatcaaaggaaaaaaggacaaggtttgtatatctgcatattaatgttttaattttaaaaacaggtagccctaaattaacataagatgtttccacaatgtttttaactgactgaattctgtgggcaaaatgtatgtgtgtgtctgtgtgtgtgtgtttgtgtttgtgtgcttgtggtgtgtactacctgaaacgaaagttggtccaataaaatgaagttaatatctttaaaaatttggaataaattcagaaatgttctatatatactccagacatttaagtaaagtggtatttaaagtcctccttacagttatcaagtctggaactggtggagcagtatgcatctctgaccattacatctaatgaatcaccaagttctattgacaatacatccaaaatatattccaaatctgctcactgctctccttcacagccgacatgagcgcattagccactgtcagcatctcattaggagtaccgaagttgcttcttaattgttctttcacatctacacttgctcccttctgattaatttggcccaaagcaaccagaatgacctttctaaagcgtaatatggaccatggcaccatgctttttaaaatccttcccatgtctttccattgtacttggaataaaatttcaaattctaaacacgaaacataaggtccagtgtgacttgccctctcctcccctcatctttactttcaccaccttctctcatcccatcttttctaagctccaagaacacccctccatgcatcaaacttttcccaactaaagctttcacacatggtctttactatttctggaatgttctttttttttttttttttgagatgaagtcttgctctgttgcccaggctggagtgcagtggtgcggtctcggctcactgcaacctccacctccagggtttaagcgattctcctgcctcagcctcccgagtagctgggattttcccataccttcatatggcaattttttattcagtatgcagttctaagcttaaatatcaaatcctcaatgagtctttccatgatttccccaaagtatcctggttattcgctgtcttagcattctgtttcttttcactgtaaccacagtcatatatgtaactctggaataactttgtgcatggttttgtgcatggtatatacccagtggctagttcagtgctgaggacaaaaggagggaaggagtgaaggaaggaagaacagaaggatagaaggatagaaggaagggagggagggagggaggaaggaaggaaggaaagacagaaggaaggaagttgccagttcttcttcccaaaggcaaccaggattgcaattgcatgccaaaatttaattgttctaatgatttctgaactggttttgcagtgtttgtttgtttcgctttgttattctaaaccttggctttcgtcaacattagaaggaaggaattaagaaaggaagaatagaagttagaagtgggaagttcctgcatttaggattctaattctaaacttatttcttttatttttattagttctccatacagagagtagccctgtatacaacaatcattcctaacttgataactgaacataggccaatagttttcagtcttccatataaagttaaggcaaatattacgtgtacataacagaacctattaaaatagtcaaatctattatgtagcataagattatgtatctgtttatttgatttgactttttaaaaattaattcatcttttttaacaggtaatgctcttgcatggaacataattcaaaaattatgaaaggatttacaatgaaaagtctatgtgccaaccccagctactcagtttttctccacaaaagcaaccaggatttacaattgcatgccaaattttaattttgttttaatgatttctgaactggtttagtagtttgtttgtttttgtttattttgctttgttattttaatcattggcttttgtcaacattggaatagttgccttaatggtaactactattacataactcatgtgagtggaacacgtgtggttataagaattgtccagcatgctggattctattacacagttatttcatttccaaatatttgtctttcttgtaaaacagtcattatcaaatgactttgcttttacagccaaatgaggagacagttcttggatttaaagaactttgttacaatgattactcaagtacttagcagaaaatttttcaagcttttattccaaagactctcttttagaaaccccagccagaaattccaaattttcccagtgcataagtcacatcatggcaaattaggtcttcactttctcttttctgtaaaaagttactaactccctaatcaagactttgttctgacgttttgattggtctggccttttcaagtagattaaatgttattgattttaaaaatagttttcaacagattctttgtgagtggctacttctagactggcctaaagagaaaggatgacttcactcaaaagttcataaaaggagaatactgacagtcagcctttttgttcataagttgatttttaaaaatagaaatatggtaggacaaattgttgaattatttctttttactggaggctgtgggtatagtgatgaatcttcaagttggaagaatcaagaaacaagcattctgttgtccatacttggtatctctttttgtgatcttgtgttattcagttgacccattggtgcctctgttttctcttctttaaaacaagaggcatgaaccagattatctcttagaaactcccaggtttaaaatcctattgaatgaaaaaaaaagaaagaatgaactaaagccaaaaatttttaataagtttgaggcaaaagactggtttgcttttcccttatttgatatgaaatgcacatcatacaattaatattttgatctcactagagtctaatagaaattacagtatcacatcttgtcaaacacagaatcttggcttcacagtaattcagaggtcaattatttatacaaatggagttcaagttatagatttaattttcagaccaaaagtttctcacattaaaacccacttgcttcagttcattttgcagatacgaaatatgttttcttggtattatgaatctcttgttttaccctctgtttcattatgtaatcaatggatgtgaaaaatgaaggtgtcatgaaatgtcagaatctttaaaaaaatcttcaaaattatttaactgctatttaattgaagaagtttttcataggtattgtattaaattatatttatttatatctcatcagagtaacagtattacagctctgccggaagcttatattgaaagagaaatcacataaattctcatgtagcatatttgtaaagaaagaatatgttgacaactttctttttggtgacacgtcaggagttgtgagggattgaactgcctgcaattattgtttaactacatgaaattaccatttaaaaactgtccactaaaaaaataccaaataaatttgtagactcatagcaggagacattatactttattttttaaaatagctgaacttttggtaagacggaaaattccatgatttgccataaatgtataatttatctatagagaataattgtatttggatatagtaataaactctttatggagtgtgctgaatctacaaactttcaggaactttgattacaaggaccatcagagaaaggagaactgaaattttacgttacaaaattgctctacccaaattttcaatcaattgttagaataagttcaatgttgggtcatttttgtattttatgcttcaaagaaaatgaccattcagtgattcatctgggggcagaatatcagagtggttaagaagatggggtctggagccagaccacttggtttcaaaatgtggcagtgtgttttaagaaaattactttaataccttgatgttcaatgcatccatcttgaaaatgttggtagccttcatatttaacttatgggattgttgagaagataaaataggcgaatatgaataaagatggaagacctacaacagtgtcaacatctcaagaaatgttagttgttgctgttgttgtttttattagtattattcaagaggatgtgaaaattgaagttttgtctgatgtgccaataccgtatatgataattgtcatatattcaagagagtatgagactgaatagctgggaggaagcttcaaagtggataactcaaaagaatcttcatgtctttgaagacttcacccactttgagaatataaacgaatctagaatggagaggcagagggggctggccaaatttgttgagaaagagctgctgcagtgtatcccatatccttcaggtggggtgaggcagaccttttacacctgacctccaaagggtggagaagtcagtgggaccactcagagaggttaatgagcagtgtactgatgcctcatttatacctgtgagagttaaagcatgtatgaacaaggggaagagagagaaagagtgagaataaagggccacaaaatgatatccctgagggctagaggaaggcaagaggagtaaaagaaagcatgagtgtttctcacagagtaaatgtgagccacagggaaaaaaagaccatctggagacattttaagaccttcctggccaggcgcggtggctcatgcctgtaatcccagcactttgggaggccgaggtaggcggatcacctgtggtcaggagttcgagaccagcctggccagcatggcgaaaccccagtgctactaaaaatacaaaacctagctgggcgtggtggtgtacacctgtaatcccagctactctggaggctgaggcaagagaatcacttgaacccggggacggaggttgcagtgagccgagattgcgccactgcactccagcctcggcaacagggcgagactctgtcaaaaaaaaaaaaaaaaaccttcctaggaatagactctccaggtaatgtgggtccttagagatgctagttctaaggagacagtgaccatccaaatgggaggctcacacaatcacaggagttgggtgcaagctggggaccaatgacaaacccacagaagtacccagcagtgaaagatttatttgtagacatttgccgttcaccaaccaaataagaatagttttgccattatgtctctttctttactcctccctgcctctgtgttcctaagtgtggatatgacagggcggggaagctggtggtctaggtgacccattataaggtgtatcaaggacaaagggagatctctgagctttgactgacaattgaaatgttcatttgcgtgatcttagactggacactacagtgctacttataccttaaagtctggctggctatagagcatggaatcatgggaatttctgagttttcttcaagtgacatgggcagtttatccccattgactaaaactaatccttaaaaggaaagaagcccaaagttcccataagtttgaaatgcttatgctgttctgctggtttgttacaacaaaagaaaaagcaatcataaactgcatatacagagcacatgaataaatgggaaggatcctggcctaatacagcattactaaactaaatgctcatatgattcagtgcctaggctaccacatgaattaaaaatgaccttatgtaatgaattaatttccaaaataaatagaacaaagagaaaatcatcttagcatcttcttaccttaaatgagtatcggagaggtcaataataagacatgacattgtttccaaattattaaaatgatttgaaaatatatttcataaattgtaattataagtaataataatgtgcaaactctctactggattttatatatacgcactgtgttcaacattttaactattattttctgtcctgtttttgaaagttagatccaaaaatgcagtattgattcagatagaacataccgaaaaatatttattggttgatgatagcactggttcttgcacatggaatatatattttattttattaattattttcatttgtttatttatttattttttgagacagagtctcactctgtctcccaggccagagtgcggtggcgtgatctccgctcactgcaagctccgcctcccgggttcacaccattctcctgccttagcctcccaagtagctgggactacaggcgcccgccaccacgccctgctaattttttgtattttttagtagagacggggtttcaccttgtttgccaggatggtctcgatctcctgacctcatgatctgcctgccttggcctcccaaagtgctgggattacaggcgtgagccaccgcgcccagaatatatattttaatactaagttttgatttatttttgcttgattttaaatgaggcagaaatatggaattcatatacttgcttgtagataaaacatgttccactttaaaaccatgaaacgaagtttactttctttggggatattttaagtgttgaacctagaactctaaatcttgagggtcataaatatcagtcaaaaatattttcattataaataattatcttcagaaatactcttaatatcagactttttaaaaactaacaatgctagttttatggtgtcaaattttgtatttttaattttttttaagggacagggtcttgctcaggttagagtgcagtggcataatcatagcttactgcgacttcaaactcctaggctcaagcgatcctcccacctcagccttccaagtagctattactacaggcacgcactataatacctggctaatttttattttatttttttttggtggagagggagtcttgctatattgcccaggctggtctcaatttcctgtcctcaaggaatcctcctgcctcggcctcccaatgtgctggaattacagatgtgacccacagtgcctagcctgtctttttaatgtcaattatagatatcttaaaagaagtttcctattacattttaataaaatgcattatttattaattagtgcttgagggatacaatattgatattgtctgttggaaggccgactaacatgttaaaagatagtaatagaaaacctatggcagggtgcggtggctcacgcctgtaatcccagcactttgggaggctgagtcaggcagatctcttgaggtcaggagtttgagaccagcctagccaacgtgacaaaaccctgtctttactaaaaatacaagaattagctgggcatggtggcgcgtgactgtaatcccagatactcaggagactgaggcaggagaattgcttgaacccgggagacagaggttgcagtgagccgagatggcgccactgcactccagcctgggtgacagagtgagactccatctcaaaaggaaaagaaaaaaaagaaatagaaaacctattttagaactacagaaatttcacccaggttgaactaaatctagcttacttttccttaatgtactataagagaaattttgttcaaaaaataataggttctcttttattatatattacattgtcttatcttctttgatccaacttttcatataacttaattgcagttaaaccttattgcggttccatgaccatagaattctacctttcaatttttttaatttttttatttttataaatttaggggatagaagtacagttttattacatggatatattgcatagtggtaaagtctgggcttctggtatagccttcagccaaatagtgagcattgtaccctatatagcctccacatattaaattcatcgttcaatattaataaatttactatgaacttgttaatcacttttagaagaaccaatatttaaaaacccaactgtaaagaatgatagaactgtaaagtaataataatgagcaactgtgctttatacactatttcgtgtctattacttctttttttgtttgtttgttttgagacagagtcttgctgtgtcgcccaggctggagtacagtggcacaatcttggctcactgaaacctctgcctcctgggtttgagtgattctcgttcctcagcctcccaagtagccgggattacaggcgcccaccaccacacccaactaatttttgtatttttagtagagatggggcttcaccatgttggccaggctggccttaaactcctgagcgcaagtgttcagcctgccttggcctcccaaagtgttgggattacaggcatgagccaccatgcctattgtctattacttcatttgaccaactttggccctcctcctagccccatatggcaggcattttcataatcccattttacaaatgagcagactaacattcacagtcattacgatactttcccaaagccatgtagctagtggacggtggagcatacactgagactctgttctgcggaaacctgtccataacatcccttccttgctagcaatatatttatagtgagaaaacatggacttgagcttcagatttagtacttgatacctatgtggaattagagccacgtttttaacattaggtcctccccttgtaatatggagatgaaataagaatttctttgggttcttgttaacgaataaacaagttaatgtattttttaaagcactttgtattagtccattttcatgctgctgacaaagacgtaccctaaactggacaatttacaaaagcaaaagatttaaaggacttaaagttccacatggctggtgaggcctcacaatcatggcagaaggcaaggaggagcaagtcacatcttacgtggatggcagcaggcaaggagagagctggtgcagagaaactcccgtttttaaaaccatcggatcttgtgagacccattcagtatcacgagaacagcatgggaaagacccgcccacatgattcagtcatctcccaccgggtccctcccacaacatgtgggaattatgggagctacaagatgagatttggctggggacattgaaccaaatcatatcattctgcccctggcccctcctaaatctcatatattcacattttaaaagcaatcatgccttcctaacagtcccccaaagtcttaactcattccaactttaactcagaagtccacagtccaatgtctcatctgagacaaggcaagtctcttccacctatgagcctgtaaaatcaaaagcaagttagttacttcctggatacagtgggggtacaggcattgggtaaattcagccattccaaatgggggaaattgaccaaaacaaaggggctacaggcctcatgcaagtctgaaatacagcacggcagtcaaatcttaaagccccaaaatgatctcctttgactccatatctcacatccaggtcatgctgatgcaaaagatgggccaaatacttagagccaactgattgtttgacaaacccaacaaaaatatcaagtggggaaaggacaccctatttaacaaatggtgctgggataattggaagccacatgtagaagaatgaaactggatcctcatctctcactttatacaaaaatcaactcaagatggatcaaagacttaagacctgaaaccataaagattctagaagataacaccagaaaaacccttctagacattggcttaggaaaagacttcatgaccatgaacccaaaagcaaatgtaaaaaaaacaaagataaacagatggacttacataaatgaaaaagcttctgcacagcaaaagaaaaaatcagcagagttaacagacaacccgcagagtgggagaaaatcttcacaatctatatatgcaacaaaggactgatatccagaatctgcaaagaactcaaacaaatcagcgagaaaaaaataatcccatcaaaaagtgggctaaggacatgagtagacaattctcaaaggaagatacacaaatggccaacaagcatatggaaaaatgctcaacatcactagttctcagggaaatgcaaattaaaaccacaatgcagtaccatctcactcctgcaggaatgttcataaacaaaaaaataaaaaaaaaatagttgttggcattgatatggtgaaagggaacacttttatgctattggtgggaatgtaaactagtacaaccgctatggaaaacagtgtagagatttcttaaagaaccaaaagtagatcttttgatccagcattctcactactaggtatgtacccagaggaaaataagtaattatatgaaaaaaagatacctgcacatgcatgtttatagcagcacaatttgcagttgcaaaaatatggaaccagcccaaatgcccatcaatcaacaagtggataaagaaaatgtggtatatgtatgctatagaatactactcagctctaaaaaggaatgaaacagtggcatttgtagcaacctggatggaattggaaactattattctaagtgaagtaactcaggaatggaaaaccatacatcctatgttctcattcgtatgtgggaactaagctatgaggacgcaaaggcataagaatgatacattggactttggggactcggagaaagggtgggggttggtgaggaataaaatactacacactgggtacaggatacattgcttcagtgatgggtccaccaaagtgatgggtgactcagaagtcacctctataggatttatgtaaccaaacactacctgttccccagaaacctattgaaataataaaataaaataaaataaaataaaataaatatataacaggaaaaaaaattgctttttttcccagttacaaatatactcacatatattttaaattttctaaattcttcttttcactctgagcttttctatgtaagatttatttttgtgtctagtgtagaaatatactttttattgattttaagtgacaaataataattgtgtatatttttgaactataatgggatgttttgatctatgtatacattgtacaaagagtcactcaagctaataaacatatccatcttttcatcaatttaccatactattgtggcaagaacattaaaaatctattccgtctgccagtttccagtttgaaatacacactacattattaactgtggtcaccgtagagtgcaataaataactaaaacttttcctccaatttaacagaaattttattacctcctgcccccctctgcagcctctggcaaccacctttctactctgtttctataaaatcaactgttttagattctgtgtgtgaggtcgtatagtatttgtctttctgtgaatggcttacttcacttagcataatgtcttccagttcaatctatatagttgcaaatggtagattttttaaaggccgtataatattccattgtgtatatataccacattatctttatccattcatctgttgatggacacttagtttggttccatatgttggctactgtgagtaatgctgaaataaacatgggagtgcagatagctcttcaacatgccaatttcaattccttgggaaatatacccagaagtgggattgttagattatatggtaattatatttttagttttttgataaacctctatactatttccaaaattactgcactagtttacattcctgccaacggtgtacaagggttgtcttttatccacacacttgccaacacttgttatcattcctcttttgataatactcattctaacaggtgtgaggtgttattccattgtggtttcaatttgcattttactagtgattagagatgttgagcatttatttcatgtatctgttggccatttgtatctcttcttttgataaatatttgttcagatcctttgtccatattttaattgggttatttgttttcctgctgttgagttgtttgagttccttatatatttgggatattagcctgttattagatgtatggtttgatgcaatcctatctgtcttgtttttgctttcgttacctgtgcttttgtagtcctatccaagaaatcattgcccagactgatgttgtggtgtttttcccctatgttttctgcaagtagctttagagtttcaggtcttacatttaagccttttgttcattttgagttgagttatgtatatggtgtgacatatacggtgttcagtttcattcttctacatgtggatatccagtttttccaacactattttttttggagaaatcgccatttccccattgtgttttcttagcacctttttgaaaatcaattgttcataaatatatgggtttgtttctgggctttctatcctgttccattggtcgatgtgtctctttttttgttttgttttgttttgttttgtcgggaccatactgttttgattacaatagctctgtaagatattttgaaatcagggagtgtgatgcctccagtgttggtctttttgctcatgtttgcttttgctttttggagtctttgctggttccatatgaattttaggattgctttttctatttctgtgaaaaataacattggaatttcgataagtacaccaaggaatctgtagatcactttgggtagtatggacattttaacaatattaaatcttccaatctatgaacatgtgatatctttccatttatttgtgtattcttcaatttctttcattcatgttttacagttttcagtgtacagatctttcacctctttggtgaatttacttctaagtattttactgtttttattgctattaaatgaaattattaatttctttttcagatagctcattgttactgcatagcaatgcaacagatttttgtatgttgactttataacccacaactttactgaatttaagtatctcgattctaatagattttggtggaatatttctttaaggttttccatatataagatcatgtcatcagcaaacagactatttcacttcttctgttctcatattgatgccttttatttatctctcttggctaattgccccaggtaggattttcagcatcatgttacatacaagtagcaagagttggcatccttgtcttgttcttgatctttgagaataagctttcaattttttatcattaggataatgttagccgtgggtgtgtcatatatggcctttattgtgttgagattcatttcttctatatctactttgttgagtttttttttttaaccatgaaaggatgttgaattttctcaaatgttttttctacatctattgagatgattatatgatttttttgttgttcgttttgttaatatgatatatcacatttattgatttacatgatttttaatttacatatgttgaaccatcctttcatccctgggaaaattcccacttgatcatggtgaagtagtaatacgtctttgtattttatatatatacacacatacatatatgtgtgtgtgtatatatatatatataatatatatataatgttttgttctagaaacttttattgaatagtttatcttttcttcccttatttttgtgacatttttaacacttaagtttccatgtgtggatctgatcttagattactaaatttattttattggtctatttgttcctgtatgtataccttactatatttactaacaaacagttttataaaagaaatttatggaaatcttgttatctgctagataacctcttgtttgttatcttaaatttatgttctattcttgactttgctattaagtgtgaatcttcggatctgtttatcaaaatctgtgaaaattcctactgaaatttattttttaaaaattgattccaatttatagataagtttagagaatcatcacctttatctttataattctgagtctttttatccatgagcatggtgtgtgtgtgtgtgtgtgtgtgtatacacacacacacacacacacagatatatattttcccattatttaggcctctttacatcttttaatattttttaggtttaaacttctcattcagttaatcaggtcctttttttttcttttctttttttttttgagatggagtttcattcttgttgcccaggctggagtgcaatggcgtgatctcagctcaccataacttctgcctcccgggttcaagtgattctcctgtcccagcctcctgagtagctgggattaccgccatgcgccaccagtcccggctaattttgtatttttagtagagacagggtttctctatgttggtcaggctggtcttgaactcccgacctcaagtgatctgcctgcctgggccttccaaagtgctgggattacaggtgtgagccaccgcgcctagccaggtcctcatttcttcatgtgtgaattgaaaataattattttttctctgtatatttacagatataaatttgaagataaaattaaatgatgcttatgaaccaattacataaataataaggttttgtgtttattattttttaaacagaggtatgggtgtattttatgcttaatagtacatcatgattatctagattctatttaattattctctttccccccagtgtaaaagttaggatcttataattatttaaggtaattgttattcttcaacattaagaaaatcattgttgtgtttaatgatgtctggaatgctcagtaaaccatgattttttattaatcttatgcagtctttgattaatgagaaatataaacgatcatttagtcaattatttattatatcacctactaggttgctaagcactgaatcagttttaagatagttgtcttcattcagggaacaaaataaaagatggtaagaagttttgagggcccagtactgatcaatgttcttttaagtttagcagtctacagactttactaaatgtggaagttttaaacattattttattattgctgtttttttggagaaaaaaatgattccaaattttcttcttttttttttttgtggttgtaagtgacgtgaaactataggatttatttttccattggcttcttttaattaaacattttaataacatgtattatccaaaacttgctataccaactatgtaatcacctcttccttctatttttatgaatatactatctgacgactaaggtgatatcagaaaattttcactcaaatgaataaaaaaaagaatgacaatgaattgaatgtatatgcttcagtagataatttataaagaaaatttaatactctaggaatgatgctatacaagctggcgtgtcaaataataaataattttaaaataggacaaggaccttcatacactgaggaatgatataaaaatacaaaaatattttaattgtttaaaataagaacttaaatctaaaggagatacttatgatgtctaaatatgaaattctatactcaggttgaaaaattatattctataaaggcagactgaagtatattaatattgttagcagttagttgatggtgaccgtatgtaagttactgtgttgagttaaatattttatgactatgtagcccatatgaatggaagacatttgagtaaaaagagtatatttcttgtggagtctacattggtgcattgtggtaaaatataagaactactttttaagaggggcattgattaatcaaactgcattctgacataagtaactgggttgataaaaacaatctgaaaactctcacatgaaaatggattgaagggctagaagatattacactgaaaagataaatctggtgcaatggacaaatcagtttgaatacttgagtagttgttatatatgggaccaaattaagttttatttactccagaagaaccactaaactgttaaagggcaggtttcatttcaaacaaatttttttagccaattaaattatctaaatttggtaaagtctcatttgtaattagtagaggagcttcctaatttgagtagaagactgaactaggtaactgtcagccattatttaacaaatatttatgaagtacatacaatatacaaggtgttaaaaaattataaagaaagatcactgatccttaatggtatgtgattatagattttaatctataaaggaaatgtttcttgtagctatttgatacatataaagtttagagtaacttcgtaataattaatacattgcatatatcaaatagtgatcagtgtatactaattatacagttctccaccaagtagggtaggtacagacatgagaagacaagacttgattaaattttaaaaatggattcagtaattggattaatttgtttagagcaaaggattttcttaggtggaaaatgagaaaaatgatctaatgaagttgtgcttcaagagaaacaaagtgaaagagagctggagtcccagtgtgacccctagaccagaagcatcacctgggaatttgttaaaaatgcaaattcctgggtcccactccagacctactgaatcaaaaactcagtgttggcggggtggagtagcaaggtgtggtttaacaagcccttcaggtgactgtgattcatactaaatttgaacagcagtgtagactgctgttgttgtgaagaggagtttacatatgatttgtttagatataatttggaaggcaattcatggtcactgcacatcagtggaaataaaggatgcagatgctatggcttcaagtagtaatatattgactaacttatgtaatgcataactctagagaacattttaaatagcacagtgttgaaacatttgaaacaaatttattgatatagttttttttaagttaagttttacatctaacatttaaaatgatagaactaggtatagctggaaacaatgcctgtttattttcttacacagagaatgaattctttcttcccttaaaacagtgttgggtaatgttccagaaaagtaattacaggccagttagtaaatatacgctgagatagtagaatgccagatagcaacagctatatgtctgccactactggttaatcagctacagaacagactgattttttgacttaatatggcatagggactccattaaggacagaatctgcatcttaattactgaacatatcccccccactgttttcatctgtatttacgtatgttttctttttttgttgtctaatagaagacaatcagggttgtgcacgatttacaaattgcttcttcacctcctgtcttcctcttctattcaataggcttgtcaagctataagagattatgaaatttggggtagttagaaatcacagccaattcaatctcatttccacacaaaccaaagagtaataaattactttattgtagcagcttattgctttgaacctaaattacagaaaaatagcttggaaattccgtaacaaagatgaaatagtctatttgtgtaggcatacttcttacagtttgtgttaactctcagctctagcacattttatatgatatttggatatattggtttggaaggagacagtcatgatctgatggtctttctgattttgtttctctctaaccttaattgctgaacctattaaaaaccccattttaggtttagctgccttagattctaggattattcatgtgctaggtcaggaaaatacagaagctctatgtctggaaatggaagagttgccattgactcaaccttgctgcttatcctcttcttaccttgtatttctgttctgataattcaattcttgccttgtcactgatgatcaggactttccctcatactcaacaattgctctagagctctgctttgattctcagccttctcctctgttcatttcaaaaacagggaattattttcataatcttcaatctttctgtctccccagacacactgaccacatgtctatccaaacaggtatcagatcatcctctttccaggtaatctgatttgattttcctcatatacctcggggcatcctgctttgggatgtgaaggatttgtgtaaacatcttttgttgactgtttgttagaaaatttcttcattgccagctattggtaccctgctcagatgttcttaaccttcaagcacgcctatttttccagctgctaggagttttgggttataactcacagctaccaccatcacaacccctttctctggagtattatcttaggccagtggtcctaaaacattagctttcatctgaatcacctagggggcttattaaaacaaaagactggactcagagtttctgatttagtaagtctagggtggggcaagagaagttgtattcctaacaacttccaaagtgatgctaatgctgttgctctagataacacatttcaagggccattcctctaatctaaataggagcttattattccctgaaggctctttgtcctgtctctcctcagggtagaccacagtgagtgactgattgccacaagcttatacaagttggacctcttacctcaaagtgtaactatctacattgtttcatttgtgtttgaaagctgcctagtgggatcagaattaaagggtcaccatcagtaatgatattctggctaagcattcttttctaccctatcctgcttcttccactctccttctcctgaaagtactctcccaataaattacttaaataaaatctccatctcagaccatacttctaggagacgtgatatgagacttatacctgtggatctatggtttctggtctctttaattcaatctatctattcaataaacttgcattgaatgtctttgaatgtcccagaaagcatatggtatatggaagataattaagatccagtttctttaccaagcaacccaccatttggttcaagggtagataagcaaatgtacaattatagcagcatgattgatactatgctacctcagtgctgataatttgaggtcctgactgctttcatctgagctttggagagtgtcacatgcttgattctctgggacagagtctctgagatggagatttgtggatagaaggtttatggggaatattcttagagataccagtgaggaagtgagggaaacataattgtgcaaatggagaggctgggtgagagctcaggtgaaactgggaggggctctggagatggaatgtcccttcaaatttgtccagaattaaggaaagagatcgatcactagatgcaggctgcccagtaagaggagcataacattggaagaaataactctctttggctgagagatgcttgaagaggatacatacaatacacacaataaaagttggtccctggagagccttgcttgtgatcatctcagtaatatatactggcttcccaccagaaaaccatttatcctattcctcccaacaggaattttaattgagtttgctcttaagcactaaatttctcagatatcccaaatgctaaatgcaagccaaacctgagatttcctgaaaatatatcctgtagacagatgtgagagtgtttcaaaccttattgaaattactctgaggagcaatgcagcaggtaacaaatctgacacacagcaatctttagaataaacatatgcaggcccagagttcagaggctaaagtcaatttaatgagaaagctgtcactattcttttttacatgaattaaacgtattccaagttgcccaagtcacggcctaacagtaaagagtctggctgcagagctgagcatttgttttatgttgttctcagggtcacttaaaaatgaatgtgagttacctggattgaacagaattctatttagtgtattctaatatgtggtgataaaacttgggaacctcagtaaagggaactgatttgaatgtaaaattgtttattttgaagtacatgtatgccaaacactgaaattttctattgatattgaatatctatcaatattcaatattttccattaattctgttgattctatttgctattgaatattgatataacaccatttagtttgtaaagagaaatataaaatcttaatgaataaagggaaaactattgataagtcttcatagagttaattatacactcttaagacattagactcaagtaacttcatacctactgagaataaatgctggaaaaatttacaagttttattttccatatttagtgccagagagccagattacacacacacacacacacacacacacacacacacgaacaagaataaataggttcacatgtttccttgcagtaaagtctgtcctgatgggatggactctgacaatattatgaatgagtatgaaataatagcaaacttggcctctagaaacaatcttccctctgaaatgcgtgttttaaattacctcatggcaaggccagtgacattcaaggattgggaatgaggttagaaaaatggaaatgattctccacttctgggaaggtcttttgcctgattaacgttatgtaaacattttgctgaagaaagaataattctgcactttagccaccaaatcattatagaaaaacaatccagttttatgcctcctgtgctccagtccaagggtcagcaaactatggcccttgagccaaatcctgcttaccacttatttttgtaaatacgtttctattggaacacagctctgctaatttgtttacatattgtctatggctatttttgagctgccatggcatggttgagaagtgcaaccaaaaccatatggcccacaaaacctaaaatatttactatctagccatttacagaaaaattttgctgatccttgctctattgtgttttagttctgtgtatcccaggtttactgataagaattacctggagtgcctttcaaccaacagcttcttgatctcctcctttggagattctgattcggtgaatctgaatgagacccagaaatttctacctttagcaagtactggaactttgggaaataccaagctagttatttgactctccaatattctagcataccattttttatgttcaaaaagtccacattcttttcttcaaattcttcctcatctccccacataaatgcaaggtatggacgaatgtattgtacaggattgtcacggataaggtcggctagaagcagtttgtgataatgattagggtgtatgttgtttgttgagggagtactctcaggagtaaggaagttatagaagcagtataggaaagggcgataaagctacagaatgtgctctcattacacatacaccatggaatactatgcagctataaaaaaggatgggttcatgtccttcgcagggacatggatgaagctggaaaccatcattctcagcaaactatcacaagatcagaaacccaaacaccacatgttctcactcataagtgggagttaaacagtgagaacacatggtcacagggaggggaacatcacacaccggggcctgtttggggggtgggggactaggggagggataacattaggagaaatacctaatgtaggtgacgggttgatgggtgcagctaaccaccagggtacatgtatacctatgtaacaaaactgcatgttccgcacatgtaacccagaagctaaagtattaaaaaaaaaaaaaaaaaaagaatgtgctctcagctggagacatgcttcagtctgatcccatggggacctctgcagcataaattgaaccacagagttgatcctgccttcaggcaagagggctggccttttgagcactctcttcccattgccatcagttagttatttggatgcagggagtccttgaacaggggacagacattagcagcaatcattgaggcacaagtacacctgtggtaaaggcagaggaggggagaagtatagcatctggtgcagaagttatacccccaaatgaatgaaatttagacttggaatgtgccctgaagaaagacctatctacaagagtctttaaaagataattttgaaatatgttttcaagttagtaacccttcggaagtcacaaatatatttgctagaactgatacctatcatctttgaaaagtaagaggaaaatatgtatcagagagaagtgacttttccggttaataatcattgcttgttgatacgtgcttttgactaggtatttagtaagatcttttggttatgtttacctccattaggatgatatgagttccttatgaatttaaatgcatgtgaacatttcagagtcccacctggaatgcgactactgtcagacaatgtattctctctagcccctaacatttcatgatagattcactacagttgtagaagaatccttcaataaaagttatgttatgggaatgtaaaacaaagtttaaccttccataattatgatttactttccaaggaataatcatacctaccactacttgcttatcctcccaacctgcaaggtaggcatcaattacccaatccttacccaaagtcacatgtctagccaatggtggtgtcgaatattctgatgaaagagttctattggccccgctaaagagttgtggggttttttaaatctttaactcaagttgtttcagtgaacctagaactaagactttttcaaccactcccaaattattgatgcttgggttttgcaacaaatgccctctaagctctcaggataagttgggggaggaaaatgaaaacataatagggtaagggttgttctctaactattcccagaccagttctcaccttcaaactgctctctctctctgaaagatgagcaaaaaaaaaaaaaaaaaaaaaaaaatgtgacctcacaaaaggttgtgtgacctcaaaacctgccaagagtcctcagtgcagcccactctgaagacagtggaacaactcaggaaagaaggtagagtattttatagaccctagagtcttatctcatcccattctgctttctgtcttcttgaggcacagttggcttaaccttttcttgaagtgaaaactatgtgaataagaatattaacccccaaacaacttaaaagcacagtcaaccgcttcatcactggtcattagagaaatgcaaatcaaaaccatgagataccatctcacgccagttagaatggcaatcattaaaaagtcaggaaacaacagatgctggagaggatgtggagaaataggaatgcttttacactgttggtgggagtgtaaattagttcaaccattgtggaagacagtgtggcgattcctcaaggatctagaaccagaaataccatttgacccagcaatcccattactgggtatatacccaaaggattataaattattctactataaagacacatgcacatgtatgtttactgcagcactattcacaatagcaaagacttggaaccaacccaaatgtccatcaatgatagactggattaagaaaatgtggcacatatacaccatgaaatactatgcagccataaaaaaggatgagttcatgtcctttgcaggaacatggatgaagctggaaaccatcattctcagcaaactaacacaggaacagaaacccaaacaccgcatgttctcactcataagtgggagttgaacaatgagaacacatggacacagggaggggaacatcacacactggggcctgttatggggtgggggtctaggggaggcatagcactaggagaaatacctaatgtagataacgggttgatgggtgcagcaaactaccatggcacatgtatacctatgtaacaaacctgcacgttctgcacatgtatcctagagcttaaagaagtataataaaaaataaattaaaaaaacaaacaaacagaaaaacagctgacaaaacagaattgcccagcgtaactgtatttttaagttagcagcaaaaatagaattttgattttatgtcatgtatattgggaaaaaggagcaaatgatatgatgtcagttaaaagaaaactagcatagttcaagattttcccatgattctcctatgaacttgaaattccaaaccaaacccagctgagtccaaagccagtagtgctcttatcaactttccatggcaatgtcttacaattctctttaggctagggccaggggaagaatccatggaattgaccacttggcaggacattaccaaggtaggggtggctatagagatttcagccgaaccaccctaggggatgaagcaagaacacaatgaccggggcagctccaggctcacctcctccatgaagcttttccttctctctctaggtagattaggtgactgccttcttggggaaacattaacatgggttagataatatgagctattcctatatggcaacaagctaggtgaggaaaatgaagatacgatgcatctatcccatctctccagcacccaggacagagccactatatcctggcatgctgtagcacagagtagagagccctgcagcatttaggcacattgaacatacttgttgatgatattctgagccctctttcctttaaatcattgttgagtattttctgggtcaactcacaatataaaacccctgtcataaacattcaaaaaacttgataagctaccagaaatgttcaattaaggaacaaaaagaaactgaagagcaacaatggacacctcccctcctgaactccaccagagaacttcagtccatttaaaagatgaagccagttttaatctataatttatgtcaaatttcactcttaagtcacaaggttaatatttttagtagaaaatgttgattataacagaaactcaggtatctcatatgcacatactcacggtatgattaaagataatcaggtacaattttactatgagattggacaatgtttgaagaatatcaatactgttttagtgaaaagcagatcaaagtatgaaattaaaaatatctttagaatagtaatacttaaaagaattcagtaattggaatgcttatccatgttttttaatcactctgttttaaatctgactttcagttgtttcaaaatgacaggttatgttgattaggtaaattatattagcatttatttgtatttaatttctacatttcctgttaccatctttttgcccacttttctattggtatgcaccttcttttttattgtatttatttaaggtatgcaacatggtgttttgatatacatgtacatagtgaaatgatcactatagtcaaccaaattaacatttaccttcccacatagttaccttttttgtggtaaaaagggcatgctcattcttatctttttgattcatataaatgtcttatatgtcacttatattagcactgcaatacaaatggttgttttaaattgatcttctgccttaaaactttacttgaaaaattaattaaaatacttttttcagataaattctgtctttgaatgtctgtttcagaaaggtcatatttatccaagaggagacaaatagccacctacattttctcccagtgctcttaaaattaactgcaatatatctgaatcttttgtggcaagattatctttttccttctgtttttctcaaatgagtaacacatttttaacccaattttgagtgataaatcttttttgcattgttttgagatgctatttatagtatgtaacaaattcttacgtatgcttgatatgcttctagactttctcctattttgacatctctgttcttttttcaacaccacatcaggaccattcttttcgtgattattacctcgatttacattgtgatatctgctgcttcaggcctattcaaactttcttgacgatccttgcacatttaattcctctagactattttggcatgagtctaataatgtcattgggatctttattgagattacattaaaatattttgattaatttaggaacagctggcagttttacaatattaattttccattcagaacatatgctttctctatttttcgaggcttttaaaacatttctcactgtaaattgttatagttttcttaatgcagatcttgcacatttcttataaagtttattcttatgcattttataattttgttactgttgtaagtaagttttttggatcatatttctaatttttattcctgggcatataagaaagctatagctttatgtatacagtgtctattttcagactttttatcagaccggatagaatgaggatcttaccaatttcagtgtgggtataaatagaatattagcacacttgtacattccctatgattttttaaaacagtatttcctttgataatgagttattcctgagaactttacatataactctgcatgtttgttttgttttgttttgttttttgagaaagggtcttgctctatggcccaggctggtgtgcagtggtgcgatctcggctcactgcaacctgtgcctcccgggctcaagtgattctcgtgcctcagcctcccaagtagctgggattacaggcactcgccaccacgcctggcttatttttgtatttttagtagagacggggtttcgccatgttggccaggctggtctcgaactcctggcctcaggtgatctggccaccttggcctcccaaagtgcagggattacaggtgtgagccactgtgcccggcgtctgcatgtctttttgtgaatgatttactttacttcccatctgtggctgatgggacaaaagaaaaattaagagcaatgtgattaatgctaagattgaccaacagtttttagaaaattaaactgcttccacatgagataattcatgttttctagatactttatcttccaacaagtggtaagtaatgaagtagataaacttcgttgtcactatgtttatatttcaagttttctgaatgaggcaggcggtgtaatgtgtatatattattattattgtttttatttttgagacacagtctcgctgtgttgcccaggctggagtacagtggtgtgatctgagctcactgcaacctccagctcctgggttcaaatgattcccctgcctcagtctcccaagtagctgggattacagatgtgcaccaccatgcccagctaagttttgtatttttagtagagatggggtttcaccatgttggccaggctggtctcgaactcctaacctcaggtgatctgcctgcctggggctcccaacgtgctgggattacaggcgtgagccaccatgcctggccaatatgtatatactattaattaatatgaagatattgttatgcttggatgacacccttcctgttgctgaggcaggagttacaaataaaacatagctcttcggtctgctcccagatcctcctcactgtactcttgctcacattttgtccctgacagatgcctaagggccactgaccactccctcaggaaatctctgtagctatacaagcagcaggcatagaaagaaatgaattgtaagctattcttctagcactctaattagacttttcagtctaattgcaggagatgaaattgaggcagatcaaattctcaggatgactagatttgagaatcattacaaagtaatacattgacaattacaaagctagcatgctcctgagagtagaactgaaccttcctcagcctcagagtatcagatgtgaataagaatatctcatcaacttgtttcacatgcttgtccacttgttttaaaggagaaaatgcaaataaatatgctgcaaggcagtctaggtaataattatttacactctagagacagacctggcttcaaatcttgacatgtaccacttattaacagcacgttgaaaaacacatttctttaatacctagagcctccacttctagccagaaaagttaagataattatagaacctactgaatatggttgttttgatgataaatgaaattatgtatgtatgaggtctatcctgacgccttatatatagtaagcatgacataatattatgtactgctactattgtatttgctaaatctccaattgttttaaagtataaaagagtattattattttattaaggacacagagtggtattctgagaggagtgggaatcctcaagagcttttttcctggaaattaattttgaaaagaagcttgatgaaaatcttgcatttagagtgaggaagacagtcaactctgaattacataattatatatatgtactggagacacagttcgttcctatgatataagaagggctgaaaaaaaaagttactcctttatttaatcttaaactgatctggtcttcttcatgagtcctcatccataaggaaattatatatatattccttatccaacagaggaaaaataaattctcattctggcttaatctgatcatttagggcacaatctctcataaaaaagacagcttagtctctctttcaccctccttctactgttacttgttgcaaataagatgatgttcctccattatatgaggtaaaggggatgcttcctaagccctcatggttgcaaggaaaaataagtgcccttgggtatcatgtcccttgttttctgagataatatcccttgttctctagtcactgataagcttgtcagctggtagaacacacgatcggcctcctaactagatcagtgcccaatatcattctctggttcagttagattcttcttaaattggaatgtctccagactcccaagtctctgctgtttcccattcagccctctggcccatggtccatctctggcatcctccactggggcaactagttttgccactgcaggtccaccacaaaccccttagcagtatctagctagaactcaacattcctaaagatgtgtgtgtgtatgagtgtgtatatccatctatatccatatctgtgtctatatactagactgtcaaaaaatttatatggtaacttttgttctacgacagctagggtacattgtgaaagtttcaaagcagagattatgtctcatttatttttagctttccagcacctcacctgatctctgatataagcaatcaatctgtattctcttcatgatgagaaatattctccattctcactgatagcagatttgtgaccactaaacacacacgcagtactggtgtgaacgcacaaactattgaaacaacaagcacgcaacaagcaaggaaattgtcactgctctataatttggtgatgagatatctggttactttcagacaaaagaaaatgtctcataataatagggttttgtatgattcttctctttcttccagaaataaaaaatttagaaacaaaacattgagggacattttaggttaattatgcattttagaagagttccccagatatcatttttgtctaatttatttttcaaattggcatataaaattatatgtatttatcttgtacaacataatgatttaaagcatatatacattttagaatggttaaatccagctaattaacaaatgcattatacctcacatagttatcattttgtggtgataacccttaacaccctggataacttttgattcagtttctgaacttgccatgtaaaattagtatttgtactcaatcagtttcttcagtttggagtatccttatagtgatcctgggcccaaactaaaagtgcatagggaaagtagcatagtctctttccatttgcctctagtcatttttatgtactgatgaacatgtaaatgctgctgtacaaagtacaagacagggatgaagaccctgttctcaaatatttccaggatagggagaggctttaattatattttttaaagattttctaaacagaagaaagaaaaatccccattgagaggggaggcagtggctcatgcctgtactcccagcactttgggagactgaggcaggaggatatcttgagtccaggagtttaggagttcaagaccaccttgggcaacagagtgagatctgatctctatagaaaataaaaataaaaaaagagaagggagtgcatggggaaaaagaaaacaataacaacaacaagaaattcagaagtggtttgatgtgttgaggttaaactgaaacaatgccttcattgcaatgagtgcctttgacgtctgtcaaaggtggtacagtcagtgacaatgactgcattctttctggctttgggttcacagtgctttgcagtgctgtgctattcagaactaaataactgttgtcactgctctataatttggcgatgatatctggttactttcagacaaaagaaaatgtctcataacaatggggttttgtatgattctgctctttcttccagaaatacaaaaaaaagacacatttaagaatttatctctgttcacattgaggaagaaaataagctttaaaaagttttactcctccctccctatagcaatgcttgcctgactttccatcgggggaaatgttactttcagcatattctgtgtgtgaaatagacagtgccagatgcttcaaatggtcataattgtgaaggatatgaaaaaagaggcatcttcctactgcgctttattaaatgtggagggaaaaaaaccctttgggtaaattagcacttggaggatttagcaaaagtgaattaactatgacagggtcccctaacacatctatttgatgatcttgcaagtcttattcccggttacctgggatactactttgctttgggatgccatggggtcattaaaatgtgagacaggttctctggaagagaaaaatcagatgaatcttgacttacagacagtatgtcttcctaaatagtatttcttttgactgaccatacctttcccttgatgctatatttctccctcatgcgctcatctgaacaaagaactgactgcgaatttcagctgccaaaaccaaaggacagttggaaaggctttttacaagcaattggcaagtgtgctctcaaaaactgaatatataggtgctgtttttctcttataaattagtattgaaatctagcctctattatgccatgggaatataaaaaggagaaatgaaggcagaagtatgtggtgactacattaaaaaaatgagtccactattcttattcttcttcttgttatttatttatttatttactttgagatggagtctcgctctgttgcccaggctggagtgcagtggcgcgatctcggctcactgcaagctccgcctcccgggttcacgccattctcctacctcagcctcccgagtagctgggactacaggcgcctgccaccacgcccagctaatttttgtatttttagtagagatggggtttcaccgtgttaaccaggatggtcttgatctcctgacctcatgatccacctgccttggccacccaaagtgctgggattacagacgtgagccaccgcacccagccgagtccactattctttcttttctttacacataattccaaaatcaaaaatagctccgagataccagatgtctttgtggtaactcattcaacccaacttgaatgtatttggtgcctgaaacttatctaacctaccgtgagattatctttatctctctcaatgtgactgttcatatgcttcactgcaaaaatattagtgtgtttgatgacaggggtgttgtagaccccactgggggtgctatagaatctgtgtagtgttacttctataaatctgacaaattctggattttagaacagaaaatattttgttacaagtgaggcactgtgctgctttacagactttatctcactgaagcctcacaacctcccccagacgtggacattgctctgatctctagtttatagatgaaaaatttaaggattcaaaggtgaaataagttgctcagagtcactcttctattatagttacgcactattgcataataaacatcccggaaatatagtgacttgaaacaacatgttattgttaacacacacttctgtggattgactcagctcagctgagtggttctgatatgtggctgctgtcagataggagctggggttggaatcatctgtaggattattggctcacatgcctatacctcagctggaataccttgaggctggtcaagcatgtctctctgcatgtggcctctctgcatggctatattattcctcccaacatggctgcctcagcatagtcagaagcagctcctagactagaacaagtgttccaggaagtggaacctgtcagtctattaaatcctgggctcagaaactggcatggtgtcatgtctacgtttttcgatgggtagaaatagtcagagacatcatatagtcagttatatcccctctgatatctcacaggggatataactccaagtattcatgtaggaatggaggctgctcagcttgtaagtgaacatctgggacttaaatttacatctacctagtgccaacgtccattgacaatgaagtaaaacctacctgtcacccatttttccctctgcatgccaccccgacctggtggcttaatattccattttttttcagtcactttcctataatcttctacctccaccagactgttctgtaaaaaggctattctgatgatgccaaaacgtagacctgtgctttatgtatttgaaggaatgggcagggagtattcttctttcccctctcctctacttacatgacttcagtgatcctgatttcaccctcatttttaaaattttcatcttgataagaaatacctaggaaataacaaacaaggagattcaggtaagaattgatgtgaggaagagaactggggagagcattctggaacattccaactacagtgagcagctttactcctttctccaccttcccattacctccaaactctaacacattcctcctactaaaatgtagtatatttaatgtttccttttttttaaacatttgccccagctcctaacacagtgactgtattaattcccatttctgtctcagaaatgcacgtgtgaaactccataggctggcagatatgctccccagacatgtcacctatgacctgtctctagatctgccctctatccaaacggaaagtggaaaaaaatagcttggtcatgcttgttagctgataaggttttagctttggctatattgagaccttgagctgtttttgcttttgttacttaagctgtgggatctggtcaacttggagacaaatagagaaggccttgagaattgaggttctatactgatttgtgggggaataatcacaatgctgttcagaaggagagttgttgcacttgctgtctttttaggaagaatcaaagcttcactgggatttggctagctggcagtcataattttgaaccctatccccattgggccaaacctatcacatgtgtcaaaatgacatggttctttcaggggacttttgggagtgagatccacagcaggcaactctgctaataaaatccagctcaacagtaacattgcattatttagccttcctcagagacatctggcatttgtcttccatttcctttctgttacaactttaccccctggatgctggagatacaagtaacccttcttgctgtgtcttctcttattctcccaataactaagcaacttatttctatttcttaaataaatctcatggttttctgacttctccaaggtcctcttgtcaagtcaaatgaaaactactgatggccccttccaaaaaaaataagtatcattacctagaatgttcctgaattctggttcattagcacaaggtgaagacatgatgtgtcactttttagggccttatcctcttgtttcagtgatgatgctgtagtagacaagaacattttctaaaagagaattatagtcttcagggccaagaaagtagttaggccagcagtcatgaacactatgctacaaacaccagataagaacttgttgccttgccagtggtagaattgttacaaatctatgtgggagggcctttgggatcttctcatctaattgcctcatttttctattaggagattggtacccaggtaggtaaatccatcttcccacagatatgagatgacacagtaaggctataacccagccctcctgatttctcctagctcagtgactgttctgcaataatgtatttagatcagaattcctttctttgtccatcagcatatcctgagtgttttactctatccccaaattacatacccctgtgatttatacttatgtcacatcaaagctatttttaattttctaggtctcttttaaattttggtacgttggtcaagagacctttccttgatctttctcacttgctaccaacgttttcattcctaccctctgtctttattgaactgttaagcccatgttgtcaggaaaattggcacacctttttggccaacgaattaaaggcaaagggataaagtgggttctgctgatcatcatatagctttccatctagtctcaccaggcctggctgatggaggagatttccacctcagcaaagactgtaactacagcaactagtgagttgtattgtccactttatgctagctggtgaggagatccagccaatgtggaagggtttgtaagtacatacatgtagtcccctgcagaatctatgccagaatcccatagtttgggcatgcgtcaaagacatctgatgtggaggccccctcctcacctgctcagggtctgagagactgtgactctgatctaggtgtctatctggcagtcttaatgagggatcctccaggaagcaaaaatagtgcaaagtaaaagggttgatacccctgcctttgacctttattttcaatctaataaacttacctttctcaggaaaagaggtgagagctggtattttggttttggtaactagggtctggggacaaggagctggtcacgtgctctgacagaaaaactaggatttcaacccccagctgggagctggaggggagttctgtcttcctcacttactaagcatgcttgaaaaacattaagctgaatatcagagcttgattgtcctgcagatgccacccattaagacagcaagggctgaggaaggagcctgagcaagtatagaaaagaacttacctaagagatcttaaagcagaacctggaaacactggaagcaggacataaattccttttgcacagcaaagcgatcttgtgttcctggtcagtagaggctcctttactttccttcagctaatgaaccacaaaaagaagatatatatagtattgacttctgaggccagggaattttgttttctttatttttctaaatttgagtagcatatgcttcaaaacatcagatatttactatcctcaaaatgactggaaaacttagaaggataaggcacaaggaatggcctaaataggcttaaataacaaatcccactaatggagtgatggtatataatggaaagacagtgagacattagtcttctttggaaataacgtgtaagaggattttgttaattctcattacttttccttcacttggcactgtaccccacccccgcacttctaactgttacgatagctagaactaggcaaaatgggacaaagtaattcatctgatcatatctttactcattttcagtccttatctcaaaatttgtgagtgatataaaagtcacgatccattagtggctccatacccttcataatgtgatctccattttcctcgcaatcatcaactcatggcacctccctttgatctatcctttctatgccctaactacgaaattagctaaaaaatggtgtagactttcaacacacagcatgtgctctttccttccacataatgaacatccttgctcttacctggtaactcattacttgtcctatacattccacttgacttgtttctccttctgcaaggattttgtcagtgatgttatcatatttttctgatgcatcttctttatgaatactttttggagaatgtctctgttgctggtctcaggcccagggcagttttacttctctcttaggattggttcgtatttatcttatcaacgcttagtagtgacatctaccagcttttcccttttgcaatggttgccagaactctcagaggcaaatttgtcgcacatttgtaatcaagagtatgaattttcccaaatacatttctggctatatttttacaagctgaactgttctttttctcccctttactttaaaatgtgatatcttatattttatggaacctctttctggagcaaggtggccaaggaaggaaggaagagaaagggagggaggcagaggaagaggatgagaggggagggaaagggaagggagcaatgagaagggaaaggaagagaagaaaatccaaattcaaagcctactttcttcatgagtctgtcacctgaaaaaattaatcactttccctctgagctcccccagtacttggaagaagcctctgttatggctgttatagcacttacatctctgcatgtcaattctttgtcttcttggacttttttccctcctatctgactgcaaattctttaaaacaaggacgacttcttcctttttttagtattcccagcttctggctcagttcctagttcaagtaactgctcaatatatgtttattgagtgaacagtagctgaaaagtagctccaggggtttaaaccaatcacacaagttgatttacttaattggagttctgttcaagatttagcctcattctctgaatcagacttgtgaccttcagaactttatgtgtgactagtcacagtcatatttctcattgtacatgtctccaactgactttcagcaaataacctgcagctttatttaatacaaatcagatcatattaaatataattaaaaatctctccatgaaataggataagatcccattggggcatcacaaaacacaattataccttcatggcatatgctcttttttagcaaatctacttgtgagtattaaagtctgacaatcctttctcaaagttagtatcatcttttaaataataccatataccaaataagaattaagaagtcactgtattatttctatcctggattatttctctaagcagaatcatcaacattgatacataacagggatttatttgagttcaatggcaaatcagttacatcagtataacagttaattatattcattctctttaatagatgatgaaattctacaatatgaacttaattaaaagtatcccagtgagcacaggtatgctcaaagtttctttctgcgcaagttgaaacagatgcgaccactggaagatttgctcacttaggtcttccaggtcattgctagggcaattacctaaaatgtcatttgaagcattaaactaaaaatataatcatctgaagaaattattattgattccgattttctctctgttatttggagaagtaataggcacaggaaaaaagaagacagtattgtgagtaggaaaatagattatcatacagtgtttttcaagttgcaagaaaagaagcatttaataatttcttcagacaggaacaaatcatcatttaaataaagggacaaacaaacatgatttaaccttcaacacagatatgtgttacatacacatgcattcacacacataaacacaggcacttgtgggttagagctctctctggttaaattataatgtcaccgtagtcactaatcatgaccagacaccaggacaggacgcggtacagagcaatccacactccagctccccaacttgccagcaggctgctttgcagtgtttcaggaaagaagaagaaaatgagttgacatctgcaagagataatgtctggaaattcacttctacatctagtaaataactgccattctttccaaagatgcagaatttcgttgataagctatctcatcagtgacttaaccatttggaaacatctcccttcaacttactgttccgtgttctcaaaataatagtttcagcaagatcaggggaagctacccctctcctttttttcccccttcccttgctttcagcaccatcaaaatctggagagctgaatagagattacaatttgtgaaggggaaacctaaggttgtatgagagatatgaaccccaccccccaattcccaggggaaagcacctgtcttgaactttgcacaaggatctgccactgagtttcatccttattttctcttcttgctctgtattcctcatagttgaatcatttgtagtgaatattttttctaaggcatctgtatttgttttctattgccattatagtaacttaccacaaacttcacaacttaaaatattccaatttattattttataattctgaaggtcaaaagtctggaatcgaactccctaagctaaaatcaaggtattggcagggctgcatccctttctggaggctccaggggagaattggtttctttgccttttccagcttctagaggctgcctacattccttggctcatggtctcttcctccatcttcaaagctggcaatgtctacttgtgtgtttctcatgctgcatctctctgacactgactctcctgtctgtttttcttacatggacctctacaactatattgagcccacctagataattcaggataatctctttattttagggtcagctgatagcaatctcaattccatctgctatcttaattaccccttgccatctaatttaacatattcagattctggggatgtggatatctttgggggaccattattctacctaccataacatctttctggaagcctcagcttctactcaaacaagctgaccccaagctaggggccacatctcttctttgtactcatgcatttttttcagttgaagttttttcaattggaataagttccagactcattctgtccggtgtgagagtaggtagcagcatttcaagaggctaagatgcttctgtcatcccaagctttgcagagaaagggttgatggggcacagtatgtttgagattttttttttcctagcctaagaaccaaattggagatcttatttatagatattccaccaatatgtctttattttcttcacatatttttggctagtaagtgttggaatcatcatcatttacatatttcccccaatggaaaatcagttactggaaacagagacaacaaacagatggccattaggccagctgtgttgtgaataaaaacagagtagaactaagttacaaagacatggaagacagaatagacttggttctggccgttagccaggttaaattggtatgtatgtggcaactgtgctgcaaaaccaatgaaaccattatgatcagctagaccacaaagagaaagaaaacctatgagaacactgaagttgtccacaaagaagcagattctaatatgaagattgtgcatcctaaaggttatgcaagataacccattggggtgtgaaacaaactgtaagcatttttatacccatatctctatttaaaataagaacttcaactttaccaatatttaaaatacaagccaggcttgttgtcacatgtctgtaatgccagctactcaggaagctgaggcaggaggatgtcttgagcccaggatttcaagaccagcctgggcaacatagcaagaaccctgtctcaaaaaaatacagtttgacactgccacactcattggctttgtacttcagccattcacatatcacacatgtgtattaaagaatttgggctgggcgcagtggctcacacctgtaatcccggaactctgggaggccgaagcgggcagatcacctgaggtcaggagtttcagaccagcctggccaacatggtgaaaccccatgtctactaagaatacaaaaattagccgggcgttgtggtgcatgcctgtagtcccagctacttgggaggctgagggaggagaatggcttgaacccgggaggcagaggttacagtgagccgagatcgtgccagtgcactccagcctgggcaacagagactccgtctcaagaaaaaaagaacttgtttgtgactggggtatctttggttcatatgcagtcaccttaatgtggctaattgcaatactcatgaaattgctaagtagactgattattatattatctagttttaactaaattgacccttacaaaatggacaagtgcttaaaaaatatgcacgtatcttaaagattctataagaaactgcataagaagataaaactaagatgggcccgggtaagcatgaagcaaaaggaagaaacagtattcccccaaccaccagtgtaatctcttcagtcacagaaaaatgcccagtgtgatcaaatcggacacattcaattttgagcacaaaaatatttttgtattttaaatgcatacagtaaaaataaaaatcatgttatattaatacttgtttcatcttccgctctgtttaaatttttatttagtgcatattttaagatgtttgtaatagattagtacaatagtccatgcttgtactttatattctgagggtgtatacacatattttgagggtaggtattcaaatttcttttatggataagggtacacaatcaagatggtttgtagaccattgctctagaggatagagcttttggagggaggcaacaaattccaaaggaaaggtttggcatggaaaaacacttaaaagctcactgagagaagggtgtatcagggaactctagtgtaggtcataggacttgctacactaagttgcaaatttgtccaaatctgacattgccaggaagctaagtcttgcactaatctttgtgtagtacttttatcctataatagggtccatgacatattagataaagaaaagaaaataaaccataagggtctcagtgagatcttcaaaattttacacttctactttgtttttaatgcttagtaaaagaactgctgaaaaagtcattaaaaaatgagtattttgtctttaaccaagagccgggaagtatctcagaaacatatttcaacattaaaatatcaaataatcaatttttataagaagtgcatttaattagcaacttggctatagctagcacacagtgagttaatctaataatcagtgactctctggacagagtcatcttaaattcagctattcttttatcgatttaagaaatgtaataatatgcattttatagcaaatggctagaaaatttcagctacagaatacttcattctatgaagcctgattattttatggcttagaagatgttcataacttctgttccaacatgatacagaagcatccttcagaatgttatctttaagatcacagaagttaagagatttaaatttcaaagtgaatattatccattttctgttcttttttagcctacttctaggcaagccctctgatgccctcatcgtttgtttaaagtttctctttcttccaggctactttgcgaatcaattccagatcacagaggagagaaaaccttattccttttttccaccccaagctcaccttcctagacaagatttttatctacattaaatacattcgctaacccaggatagtgacctacccatagcagtggcttctgtggagctcagcagaacatagagaagtcccacaatgcttgattaaagccatcaggaaagcctgaggtaattctaaaagatcccactctgtggtacaaaatggccctagaagccaatcttctgactacttgtcattttatttcatttcatttcattttttcttttcttttcttttttttttttttttttgattcagggtctcactctgtcaggctggagtgtatggtgtgatctcggctcactgcagcctcgatttcctgggcacaagcaatcttcccacctcagcctactgagtagctgggctacaggcgagtgccaccagctaattttttgtattttttgtagaaatggggtttcactgtgttgcccaggctggtctcgaactcctgggcttaagtgatctgcctgcttcggcctcccgaggtgctgagattacaagtgtgagccaccacctggccttgtcattttgttaccgttaacactttcctctaggtctggttcccaatgcgcagaatccggggaatttgaacagggctctcttggagagttgtttcattctatgtgctgggataaaaacaaattatttttcctgctaggaatgcactaaagatccctccactgtatcttccaggaggttcatattagtatttgctttagggataatgttttggattgcaccacagagcaaagtttttggtcagacaatctaatgggactaataacagccgacctgaacattgacaattcttgcacattatcccattccatcctcacagatcagagaaacccaattaggtaacatttccccacttcatagaccagggaaggaaatttctgagaggttaattgatgtgctgaaaggcacataaagtgcccggctcagtcccacgtctggctctagattcctttttagttcttctgtattatgctgtctcttctaaatggattattaggttggtaatgttattcttagtcattctgcccaaataatgaataacagattatacatttaagatgttaaaatgtatcataattttattataactgaaaatgttcagaatttttttaaataataattttggggaaaagaaaacttccttatacattgtttcctcagtatttttttcattaggtattttttccatttggctgtggcaatccttgagattgattctcactgtcagggtcataactctctctctttcacccagcggtaaccatggaaacatatgtataacacgtcctgcttcttttaatatgattattcatgagttgccataaaaatataaagtgtatttgtttgcatatttaattgttaaaataacacaagtatttgcttttaaaatacctactcatagctctgtggtcatgtatacataaagtaccaaccattcttaaatcctaggattaagaagtgacatgttgcaaatttagagtaccttgctcttcaccagttgtatagcaaaagagttttagtcagtttagaagtaccatgggtccaccgcgtggtggctcgcacgtgtaatcccagcactttgggaggctgaggcaggtggattgcctgaggtcaggagtttgagagcagcctggtcaacacagtgaaaccctatctctactaaaaatacaaaaaattagctgggcatggtggtaggcgcctgtaatcccagctactagggaggctgaggcaggagaatcgcttgaacctgggaggtggaggttgcagcaagccgagatcgcgccattacactccaggttgcagtgagccaagattgcaccattgcactccagcctaggcaacaagagtgaaactccatctcaaaacaacaaaaaaacaaaaaaacagaaaaaaaaaaaaaaaaaaagaagcagcagcagcagcagcagtaccattggtcgaattagggttcctgtcccatttttctgcatacatttaaagtctaatgtgatatagtaagtactttctcctttgaagatcagctataatctcagaacttaatatttcacttgtatagaagttactcttaaatcagattctatgacccagacagccatccagaattttagttcgtcatctctagcttcctaataaaaatatccaagtggatgtcccactaccccttccaattcaatttgcctaaaaccaaacttgttatctttccttcagggttcaagtcctttcagaaatttcttaattcaatctccaatcccatcattctcttagttactcaggcttaaacttttgttatcctacggcattttctttctctcttctttcacgtcctatatcctataaattattcttagcttctactagcctttctatttccactgccacacttgttacattgtgctgagactaccctacagtgctttaacaagtcttctcccccagctctcatctctttgtatctgccttccagtctactccaaggtcgaactgtctaactcaacattttgcatatgaccctcaccccctcacgacaaccatttcttctaaattaaattgatgtataacaccattcaaaagttatttctttcagcttcaaaacaatcactccagtatatacattacttgccaacatgatgtgaggtgaaccacatttcttgcccacacgctgttctcatttctgttctagttcctcacttatgacttgtaaattgaaagcacctagatttctgttgttattctggatgagtaatggcaggacaaccctaaatcccaagtatttctgtggctcttttaaggaaaagaaatatacaaaaatagtctaaaggaagaaaaatataaatattctaaacattagtcttatatctgtgttacattgccattatatcagttttgcttgaaataagactgtggagattagatattagttttaatttatgacatttggcaattgtaaacaatttgtgttactttattcttttagaatctgtgtagttttccaaaattaaaattaaaattccatttctagccatagaggagtcttcttagttctatttgagtcaacaatcatttttaaagttttaatttgaaaattaaggacagatccaactaggattgtgagtccagcagacatactgtgtgagcacacagctgtggcatatctgtggaacggataagggtggcatattttggcacttgtggaacttattcccatcattttaaacaatgcttggtaggtttatatcaacagatttattttcccttcagctattacgagagtaaagcagagacctaaggtctggcatatgaatcttacaaatgagggatttttaactaggagcgactctgaaagcttcttacattcttgggacagtctgcagtcatagattgaatgagaaaagcctcatattttggctgggtgcggtggctcacacctgtaatcccagcactttgggaggtcgaggtgggcggatcatctcaggtcaggagttctagaccatcctggccaacgtggcgaaatctcgtctctactaaaaatacaaaaattagccgggcatggtggtatgtgcctgtaagtaatcccagctacttgggaggctgaggcaggagaatcgcctgaacctgggagatgaaggttgcagtaggctgagatcactccactgcactccagcctgggcaatagagcgagactccgtcaaaaaaaaaaaagaaaaaaaaaaaaaaaaaaaagaaaagccccatgtcttttcattgaccatatacgatctcttaaccagcacagcattgatgcatttcagccatctcacaaaacttcccttttatcattctgaaatgattttatctttcccaagagactgatagacaaagcagctttgtatactcacgtcctggttattgtgcattattaggaaacagataggaaagctaccctcatacagaggctatgtaaatattatttggggaagaggaaaaacacatatgggtgctaagaagataagacagtgcctctgaccgttctatttgatgtttcttaaacctgcattgttatgaaaactcaggtaaatgaatttgtaatgactactgaaaatgaaacaggagtatacttgaataagtattgacatttttttttcaggtcatttactttaagactcacaaagaacatattagctaatagaattcatggccaaaccatgatgtaaatggagctaaggtcagaattagattccttagggagctgaagaaaaaacacggctatgaccctaaaaccaatctgctgactgttttctgctgactcttttctgatgcaaagtaaatggtgggaaaaaaaaaactgatactaaaaacaaacaaataaacaaaaaaacctctaactatccaaccacctgtgcaatacaatagctttctataaaataaaacagaatggaaaaaaaatctcaaaatcatgagttgaaccaatgaaacatacgggttggttcagcattgcaaccagatgtcatcttaataaaaaccaacactattagctctttgatgattaataatagtaaataccattatcacactcaaatatgactctttaggctgggttactaatatatacaatcaacctgcatttttcccgtctttccggatttgacaggaagagtggctgtggcatggaggaagattaaaagtctaagagaacctcggatttagattctagttgcggccctgccctttcttagttgtgtgaccttgagaaaatcagctaacctctctgaatcctatcccttcacttgaaagtgtgttaaaatggcacttatacatgataattgtataaatacgtttatatatggcatatataagtaatacatatgtaatatgacagtattgaagttaatataaactaatatgatataatgtgtttatatactatttacaaattatatattaatataatgtatttatattaacataaatacatgtatattagtttaaattatatatgaaaatcttataattaaaatttttacatataattattaatatatcataaatttctatattatatataataaatttatatataaatcatatctatacacacaatgctttgtcatgtggggtcataaaagagtactgcaatcattattatgtcttcggttaactttacaatgaaaagcttcttaatcaatattaaactacgggcaaatataatgctgctgccttctaatgtaatttactttaggaaaagcaattgatgagataaaaggtctttctcttttttcatttttatttttttgagacagagcctcgctctgttgccaggctggagtgcagtggcacgatctcagctcactgcaacctccagttctctagttcaagcgattctcctcctcagcctcccgagtagctgggattacaggcacacaccaccatgcccagctaacttttgtatttttagtacagacggggtttcaccatgttggccagaatggtctcaatctcctgacctcgtgatctgtctgccttggcctcccaaagtgctaggattacaggcgtgagccaccgcacccggccaaggtctttctctttttaactttgtttgcaatacctagcttgccttcatgctgttatattaggttagcattaattttccattattggagcagattgcctacaagcacacacatacaaatagtacactgaggaggaaggagccagtgctgaagttctttttctgaaacgtaatagagcttttctcattactgcaaatacatgaatgaatgaacaacattgcaagcacagacgttgcatacattctctcatcaagcagcgccatcactgccttagtactttttgttgttgttcagcattattgatttttccaacaatcgagtttgtttgcaataaactgaactggagcataaccttcactaattagaaaaaatgtatgggtattagcttaaggaagcaataacacttcttgtacgttttctatcgaaactcagggtgatgctttgtaggagtgctattgtttcttttcccccttgtgacaatgttgttaagtatgatgcaaaaaagtccaaagaccttttaaataatttgcatccattctagaaggaagaagaactacaaaggccaggtgtgaatggatatgaaaatagcaacttagaatagaaatatctgccattactctctctgcatacctctaagcctttgtccctatttacaattgtttttatattctggtccactttgaaagtgaacaccttaaggatctttgttttaactataaaatttagaaaatattccttgattcatatttatatttgctgggtaattatcatttataaaatcatagttgaactaagaagctagaaaaaactacatgtgtgattaactgtttagtttttcaccatttctggtcaggctgtttgaattggccaatgcagatttcttcatcccagcaaagcttaatcatagaagtaatttcaattatataataaataaaagctgctttgcctcagcatattcagtgattaaaaatgagtcgttttttaaaattttcaaatctgacagtatttcttgaaagaaataatttgtgatggaaataaactgaaaatgaggaatacaatggtcattgaggtgcaaaccaatgcaacagaataaagttaacatgaaatttgaaattattgcccagaaatcaaagtaactataaaaatatagctgttattagggaaatctctagtaggaaaagaaagccagaaattatcacattagcattaccatgggatgtcattctagttcttaaatagaactaaagacgagagcatcgtgactctaccattcatatgaaggagactaaatagacaatgatcttgaatccatttccttttaaaaatcttaacagcatagggtaagtatttggtgatggattcttggctgcagaaaattcctcatgataaacagggtgctatcattaaataacacacatgctaaatgctgggaatacattaattcctccaagtccaattccctgtaagtcatcttattctctaaaaatcattgtcataaagggaattctgtgtgtgacatctgagagtaagcatgtttagaagtgtctcaagagtacctgacagtaataaaatcaggaaggtaagacaagaattatccagtctttgcagggtcaaaaatgacccttctctttattccttaagttttttgtgtttttttttttttttttttttttttttttggtgagatacagtttagctcttcttgcccaggctggagtgcaatggtgcggtcttggctcactgcaacctccacctcctgggttcaagcaattcttcggtcccagcctctcaagtagctgggattataggcgtccgccaacatgcccggctcatttttgtatttttagtagagatggggtttcaccatgttagccaggctggtctcaaactcctgaccgcaggtgatccacccacctcggcctcccaaagtactaggattacgggcatgagccaacatgcccagccctattctttaatttttaagtagctttggccttcactagcattactacagtcctatatgtaaaagtatactgctgatgaggaaaatatacctcatttaaaatgtgtgctttaaagtcgagtctctgctatctaccataccaatgtaggttttggtcactatcaagttattttcgttctcagcaagtaaaactgccatgttcttcatgatttttttctatgcatacacagtcattgctaagataaacattatttttagacatcaaaattcctagcttattattttacatcatattagtgcaattgtcaagagacaattttatatttcttaattcactttttctctttgtaatctgagttccccaaataagagaaatattaataagggtggcatattttggcacttgtggaattaactagcaatatgtaaattcctaaatagcatactgttaaaatgcttctattcttcaaactctaataatttgctaagaaattatgataataaattttaagaatttttggctaagtgcagaaaaatctgttgaattattaatacattagcaaaatgtatcatttagggaaataattttattgtaaggaaagaacttagaaatttgataataagcataatttaatgaataattttctgaatgagtcatttctttgcaataaaaagaatttttctctctacatatgtgtggagcaagtttctgtaaaggaatccaaaacttgtaaggaagggaagccaaagaattaccaaaaaatattcctgggtgttttgaggtttcataagatatttgataacatattgaatgactctctttgtgaaacatttagtagcagacagtgcaggaaaaagctcattcttttttttttttcttcgcgacaaattcttactctgtcacccagactggagtgcagtggcgcgatctcagctcactgcaacctctgactcctgggttcaagtgattctcatgcctcagcctcccaagtagcagggattacaggcatgtgccaccatgcctggctaatttttgtatttttagtagagacagggttttgccctgttggccaggctggtcttgaactactggcctcaagtgatccacccgtcttggccttccaaagtgctggaattacaggcgtgatccgctgcacccagctgaaagctcattctttactaatcatgaaaccctatattaaaaaaaacaaaacaataaactattaggctggtcttttccagtgatatagccaaagcaccatgccagcaagtgaaacataataggccctcaataaataattgttgaaatagccatatgatcagacttcacacacaaaggctgaactgagttgaggtaattcaggatagaacccactggataatcaagcacataatattggctttaattatgtagctgtttcagaattgagaggtgatgaagggactcaaacagcttgatgctctggctactgggctgtttggatggctatgtgctctttgctcttactccattgtgaatttctgaagccaggacagccttaattagatgtgagtctgatatgataaatatgttgctatggtgaatatgaatgtttcatacaacaatatttcatgccaattaacagtaaattccaaatactttgccaataaaattgaaaataccattattccattggcctgtccatgatggcataaataatgcatatttgtttatttatcaagagggctcttattgaacaccctgagctttctaacagttatctcccttgtgcagtgtgccagctcattaggaagactaaagtcacagtggagtcatcctgaaatgacttcaacacaaattccatgtaaaaagatttttggagagccatctgtcccggggtctaggttatcttttggaaattggaactaaatggatgaaaagtatagaaatgctttggtcttccaaatactttcttaatcacctctaattgtaaaaagaggaaaaagtggctttaagaaaaaatagcaaattaaattaattcataagctattttgtatgatacaggagacagacatttataaaagtaattgtgcttagttatcttattgcaagccttcatctccacatttgacttcactggcaaatgcggcaacttacaaaacaaatcaggccatttcaacgctagtactacagagcttgtttttctcccccaatcttaaagagacttcatggatattttaatgttagattttacaatttaacatattaagatatgattactaaagactaattcttgtctctgctacctccatgatttcattactgtcatgtgccgttgggacgcttataaagccagaaacaactgtagcagaatgtgtagattacatgccattagtttcactgttcataatgccgagcatattccagagtatgtgctgaatgcctccaaccttcatgaagatatcctttttccttttttccataaaaagacatcattgatggcaactagtataatggacagatcattcaaaaagcacatttgatcatcaaacattttccaggtaccaaaaactttctggaaacacacaatagaatttaaacctagtaagaaggctggatgtgaacatattgaactctaagccaataaaatgtacaataatagaggtatgcaattagtatatggagacacagttgatgatgccattaatttttctttgggaggtaataattataacatctaatcttaactgagtaattactgtgggtcacattctgctttaagtgctttaaatgtactaacagagtgagagggaatggatattatttccatgtttttagactctaagatataatgcatcttatccaaagccatggggctagttggcagtggagctaacattttaactcgggaaatatgggtccaaaacctaggtttttggcccccaggccatactgcctttctgttttagagtcatctaagaaaagtctggagacaaattgatatttttgttaaaatctaaaatatgaagatgacttcatcatttaaagaaagagtaggaagagaatttaaacaaaggacatatagtgagcaaaattaggaagaaatatgggtccaaaacctaggtttttggcccccaggccatactgcctttctgttttagagtcatctaaaaaaaagtcatctaagaaaagtctggagacagattgatatttttgttaaaatctaaaatatgaagatgacttcatcatttaaagaaagaatagaaagagaatttaaacaaaggacatatagtgagcaaaatgaggaagaaatgaaagggagaataaattgatgggaagttgcccaaagtttgagttgctaaattggagggcatgcaggaagcagcatgggaatgaaattgtaaagggagatggagcccagactaggagtcaccttgtaggccatgaaataggatttgggcctgttctgtgggatcccttaggggatattgttatactcactcttaacattatactgactccctagccaggtcaaagtacaatttaagctgccaatgaaatatattggctttaaatttttgtcaccatttttaaagtgtagtgtggaactgaaacattatataaacattgtatagacaaaagaaaccatctattctaaatattcttaagctgtttgaataatgattggtctaaatgtattcctttcacataaattatataaactccctttgaaatgatgtatgagttaaataagcaatttttatgttaaaaagttcagtaattttaaaaatgaaaatgctcttactgaagcctccaaatcatgcatactatatacaatcttttatgttgtaaatgtccatgataaaagaaaacaaacaaaacaagacatcagcaccaccaccaataaaatttcaatcagaagggatcacttggtttgaaactttatgcagctctcagatagccagactttctttgtcaaaaacattcaatacaatgtttaggaagtgtcgtgtttaacagaaaacatcatgtgctaatattaatttggaaaattctatgtggtggctgacaccctacagtgttccagtctcttggaagctattcgggaatagtgagtgttccttctaactgttttatgtgggggtatgtggaatcttctaatctccaaagccactaggcttctatcctgactcttatttcctgatatatggaccctcttcttaactctggagtgttggactttctcttttctgcccttcactggtggcttggtttagttttctggtaactgcatttcttcctgagcacatccagaatcttctcagaggaggcaatcattccattctttccttgtgacacctcaattctccatctccttacccaaagagcctcctttatgtgtcactttccctttgaaattatcttttctttcttagaaaacttttcgtttctattttaagaaaagctgggtaacgtaagaacatgaaacattaagaggcagatggtaaattgattagacataagatgcttcgtatttgtatcctctgtcctgttttccactttttcttcagaaagtagtccgtgactttgtattcatagctgtttttcactttacatatcaagaaccaatgtttgggaaacaaataattgtgagtaagtggttatattgagttgcatatcagaagatatttaattttataggttaaatttataatatgaattgctatggtataattttgagaaaaaaaatcatttttagtcattacaaatatttattaatggccacactaggaaacaaagattatgagcctcatataggatacattttttgaacttgcaaaggaatacaccatatttcattaggtcagtaggtctttccctccttaggtattgatacgcctacaagtgtaatgacgtggcatttataatttggtaaaaataattaaagttcatttttgtgaacaacttagtttttaaccaattagaatctacttagatacattctataattacatcaccctaagatatttacaatctgatcaatgctatttttcatgaggaagagtgatagaattagagccacagtctagctgatgtaattatagccatggaacgaaacatatgtgcctgccatttatctcaggtatctcattgaaaaaaaggatgagaaaagctgatccagagtaggtcactaagcatcatccataaattgagaattggttctcaaacaataactttgaatcagcagaaatccagtgtttgctaaaagctatacatgaagagttaaagtagttgatcccctcaactctagtctctgcttatttttatattaaaagtcaaatgcttgctttgttctgaaattaatatacatatacacacatatatacatatatatatacacatatgaaatataacatgaatatgtggattatatcagagcaagtcatcatctaaaactagattctagctaatatttcagcaaatatgggctaaaaacctatgtggccacaaaatattgatacagctgtgaataaattaggtataattccttctaaaattttcagtctacagtggagacagccattaaataaattatcatgtactaaccaaaataaataactgcttatcattactgaatttctgatgttcttgcaaaaacaatttgaaaaactatatgtataaatttactactgaatatggtagtcatcctttaaaagacaatttaatggcttcttggccttttggctaagatcaagtatagtatctgttcttatccatttaaaagacaatctaccataatacctgaggaagaacatatattttataataacataaatataatacgtgttctcaaataaaaattaagccttctaacaagtgattttacttttaggcacgtaacttcaaaaatatggaaaaatggacgctgggtgtggtggcccaaacctataatcccagtgttttgggaggccgaggtgggaagatcacttgaggccaggagtttgagaccagcctgggtaacatagtgagaccccatctctaccaaattattttttaattagctgggtgtggtggttcacacctgtagtcctatctacctgggaggctaaggcaggtggatcacttgaacccaggaatttcaggttgtagtgagctgtgatcacacagctgtgctccagcctggacaacagagtgagaccttgtctctcaaaaaaacatgaaaaaatgtaactacctatatctatatatcatatatatgtgtgtgtatatatatacacacacatatatatatgataatatgtaactacctatatctatctattttatatatatatatgtatatatatgtgtgtatgtatatatatatatatatatatatacacacatatatatattaggtcccacagatgtacaaatttttaatgtacttttattgtaaataaacactgctggatttatatatcaaaaatattgctgattaagacttgatggcccgggcgcaggggctcacacctgtaatcccagcactttgggaggccgaggcaggtgggtcacaaggtcaggagatcgagaacatcctggccaacatggtgaaaccctgtctctactaaaaatacaaaaattagtcaggcgttgcggcatgcgcctgtagtcccagctactcaggaggctgaggcaggagaatcgcttgaacccaggaggcggaggttgcagtgagccgagattgcgccactgcactccagcctgggcgacaaatcgagactttgtctcaaaaaaaaaaaaaaaaaaagacttgatagacattagaaagttaactgagggaagtcatcaaatccacttccttaaataggtaagattctccttcgatggtgctaattcctttgagaatacttgaatgaaaggagatgagcgttcatgtattatttgaatactgaatcaatgctttcctgagtaaccttggtgatatggtccttccacatctgagagtttattttgcatccccagatattctaccttcattgcaatttttcctccaattggtttagaaatggtacagaggaaagttagtaaaagtaatcactctaaaagtgagtcatttattcttttatcctatgtaagtaaaagaactgaaaatcaagcagttagctttaccctgtggtctcaaacatatgagttaaaagacataataaaaactatcaatgtgtccaatatatttgtccttagcatcattaatctattccttgtaaggttggagtttataaaatgagactccataaagagagagatacctagtctaaatcaaagtgtgtgcgttatgacatagtagaatatattgataagttaactgaaatcaggtaattgcgggtagattggcttaacatgtccaaaacattctgtgtaagttaaatgactggtaagtaaaatggtgggactcatgaaagttaatttaattatatcagtcaaaaatacataaaataatttcaatactgttacaacctcactctagtaggtgtttctcagaggcacttgcttcattgtttatttgtcatcattcctaataaacatatatttgagttcatgtcatctaaaaataaatggcctaccctacagagacatggaaaactgatgtaggcatacactcacccaacatttaatgacctgaatccatctcaatgacttccttttctattcaaataaccagtttggaatttgatttactaaaattaacttttgtggtattgtttcaacaaaggacagccttttgtgtgacaacctataatatttagctactaaaagacctaccatatttctctcccactgagaattatttgttatctaatatcacttatagacttcatgtaaatcaaataattatttctggctctgcatggtgtaaggatgattaaaaacttgtcaagctatcagaagaataaggccacttcccagcatggaatgacattatttattctaggtccaatgattggtaccagaactgacccttaataataatatttatgacatgggggtgggaggggagaaaccatttagaatgattagtcttatcacaatcctaaggcattagaattttcaaaagtgctgaaataattgtgcaactttaaggaaatgtataagaaggtagctaaattatcactgaagttagtgaacactatgcagtgctaatcatgtatggcttctcaaaagcatttaacactcttgacaactgtcctcttgagatgctgtacctacttccctctctgttcttcaactttttctctattcatttgctgtctctttggctgtttctctgtattttgttcctccattacatatttgaatcctgtgatttgtcatgcattatctttgcttttcattttatgtgctgttctggaaaattctactccttcaagtgcgtttactgcttttcatatattctttaggcaagatctttttcttgaccttcaggcccatatcagcacaccaggagaaatctcccactgataactcagattcatcctggataaattgatctcattatctgtcattcaaaactggcttttcataatatatggctccaaaattcttatagtcatgtagcaaaattcctgggagttattctccctcacagtcccatccattaaaatctgataagtgaactgaaatgctactcaaaactctattctgggtcttctttccccactaccctgactcatgttcccattacctgtccattatcaccattccaaaagactctctgcctgaattcttgcacatctataatccagcttcccaagtgtgtttttttaatacacagaaacgattagccgcaacagcctttaacaatacaagactgcctgaagtccaaacatactaacttgacataagtatcctttgtggtcatatgttgagcctcctttccagcctcctttagcttggtcacctttgtgctctaagtttcagctatactatgctaccaaggcatagcaggatgtttcacacctatatgcatgagcatgatgtgtatgtgcatggacacatatgttttacacaattctcactgcttataaaacacactgcatcagctgtctattgttacgtaacaaattagcacacatttaatggcttaaaacaatacacatttattatttcacaatttctgtaggttagaaacctgggcatggccatgctgggtcctttgcttcacagtgtctcatagatggcaataaaggtgtcagtcaggactacagtctcatctgagggctcaaccggggaaggatctgcttctatattcactcagtggttgttggcagaatttagtttctcaaggccttaattcctaactaggtgttggccagaggcctttttcagttccttactacaagggcttctctataggcagctgcctcataagtatggcagctgcttcaccaaagccaacagtgaagagagtcttttagcaagatgaagttcacaatcttacataacctaatcactacagtgatattccatcatctttgacattttctattttgtaggcaactaggtttagcccactctgaacaagttggaattacacaaagatgcaactattaggaggctgggattatgaggagccatttcagaatcgaccacacccaccaaccccaccttcctttacccccatcaacctgacaacacctgctcaaattattgaagactcatgtgacttaccaagacctcagtttttcaatatttcccaacaaacccaccatgaagttggttactcctttcttcatactcccagtacacctccaatattatttttcaattattgtttacatagttttctctcccgtcaatactttgagaacaaaaaatgtagtgtgttattttctactctctggtaagatcagtccaaagaaagtgctcattaaatgttgaataataattgtttaaagtaaataaaaccacagatattaaatacataaaattatctggaaacaggtaattaccccagggataattgacagctaacgatgtgcttaacatctgaatgtatcatttactttagttagagtacacatggtaatcttttgtgagtgacatcacaaagtgacagattcggatgtctctattatttttaaattctttcaaatgagaaacaactataaaatgaaatgcgatgtggataatatagtatagtggttaagatcactggctttagcatcagtcaatgggatcaaatcccacttctaccacttattaactgtatggttttggacaagttactttaacctctctgttcctttctttactggtctgtgaaatggggtctgaaattgcacctacctcatagggctgttataaagattaaatacaattatttatggaaagcagttaataaagacctagtgtgtatttgactctcagtaaatgtcaatcattattatctcctagtatactgaaatagaaagatgtccataatatgaaacttggagagatgtatgtaagttgttaattatctttaatatatacatagatatatacagttaattcatctatatgtttgtatatgggaaaattgggaagtatacacagatttttaataatgattatttccaggaattagggaagaggtgagggtggataactttatttttttattttgcagattattgtattatttgaattattctaaataagcatatatcacctttctcttttttttgagacggagtttcactcttgtctcccatactggggtgcagtggtactatcttggctcactggaacctctgcctcccaggttcaagcgattctcctgtctcagcctcccgagtagctgggattacaggcgcccaccaccatgccagacttatttttgtagttttaatagagacggggtttcaccatgttggccaggctggtctcgaactcccgacctcaggtgatccacccatctcggcctcccaaagtgccgggattacaggcatgagccaccatgcccggtcgcatatatcacttttataatctgttatggattggatatattcgtccaaaaagatatgttgaaatcctaaccccagaatgttactttctttggaaataaggacattagagacataattagttaaggtgaggttatgctggtgtagggtgggccctaattcagtatgattagtgtccttataagaagagacatctagacacataggagagaacaccactgggtaatgaagccagtgattgagtgctgcagctgcaagccaaggaatgccaaggattgctgacagagcaccagaagctaagaagaggcaaggaaggattcccctacatgtttcaaagggatcgtggttccgccaacaccttgatttggactcctaacctccagaactatgagccaatacatgtctgttgttttaagccacttagtttgtggttctttgctactgcaggcccagaaaactaacagatagccaaaataaattaattaatatttttaagtatatacaaaaaagaagagaaaagacaggcagttgcatagctcataaaattataatctcttgaagttgaagcttcaggttcattttgactcttacctctccggccatgccaatagaattattagtttttgacatcccagccaaatatttgacaagcagttcataaactaatgggaagtgctaagaaatataatatggagctatttctttctattctgttcctccatgaaatttcttctatccaatttccaatcatgcaaatcgtatcaagaaggcaagtgatccaagggttaagcaacatttgattggctgctgtgactgcatgtatctaaagagaaatagaaagcaatttgactacggtatgtgactcaagtgatatgtgttttagataagtaattagaaacaaaacaaaaagtcaattagtttctagcctgtccttcaactgtttaaaatattatagcaataaaactaatggagagttttttcctaactacatcaaagttattaaaatgtagagtcaattagaaaaaaaatataagaatgtacattcataattgttgaatactaacaactcatatcaaatggacaaactgtttgacaccaatatatgtgggaaaggtcagggcttctaaagaaatgtttctttaatgatgaaactttccaattttaattttttttaattagcatcttatagacggaggaagaagagggtcaaaaacaaagaactttttcttgtcttaatatgtatagccatggaagatggcagaagggagtgaaaaaattcaatcaatcatttttataaataaaacaaatggagaaagcagtggaaccagtaaccccaataatggatcctatattattatttattttatttgcctatctctttcacagatatctagctattcatcaagtagacattccctccaaggcacaaagaaacactgaagttttaatctaccattgtttaattctttcttctggcagaaatacttgtgttcataagaaactttccaaattaattaaacttgtttaaggttgatactggccagagactttcctgtcttccaatttaagagattttgatgaacatatgagaattacattacaaaatatggcaagacggggaaagaaaatagaagaggtgaaagaaaggagagggaatgaaaggaggaagaaagaagaaagaaaactgaaaatggaaatacaggccagacgcagtggctcacgcctgtaatcccagcactttgggaagctgaggcaggtggatcacctgcggtcaggaatttgagaccagcctgaccaacatggtgaaacccccgtctctactaaaaaattacaaaaattatgcgagtatggtggtatgtgcccataatccgagctacttgggaggctgaggcaggagaattgcttgagccctggaggcggaggttgcagtgagccgagatcacgccattgcactccagcctgtgcaacaagagcaaaactcttctcaaaaaaaaaaaaataataataataatacaaattttctctcattcatttcacaaatgtcaagtattggccattattcctaatgtaaaaaacaaaacaaaacaaaaaaacaaaacaaacaaacaaaaaatacccaccgtgtttcacattgttctgaagtagttactgttggttattattgagagtgcaaaccacccatgcttcctcttgggctaatgcagaggttaaacagcctgagaattacctgcaccatggaaatgtattctggggttaataagaacaaagtgtccatctttgagttattttaacaactaaaccctagagaccagagataaactaaaggagaataaagaaatataattacattggacagtaatgtcatgaagagttaattaattaggattcaatgagtcataacttattttgaagatgtggcattttagaaaaccacctagcttcattcatattaccctcagacattaaaggtgtaattgttgtcattagcattttaattggtcctgtaatttaatggttatacacgtggttgttgtaaggtcttttaagctgttgggattttaatatttgacatgtagcttgaaaaaataattatgacatttcccagatctgaggttggcctttgcagttaatgacaacactgcgttttcaaaatggttattattgatagtacaaatactcaaatggcctacagagctaccttcatctgtaccatagttcttttttttggagatcactgggattatctaatcagaccaacactgccaccatatttaagcagtatgtaatgtatggtagatatattgcaaaatgccaaaagaaaagcacttgtagtagtttctacttggaaaacagtattgttactaaaagttatggcagaaataatattttattaactgtaggccttgattgtcttgattgcaaatgctaggtactatattatgcacacagcttgaaatgtatgtggcacaatgaataaaagcttactttcctaaaatataaaatgattgaggaatttgatgatcacatttaaatattttcaaaaagggttattttctacccagcagtagaataattgatagataattacaaaagaggctatgccaaaattattgctaggccctttatattgagacaatggtctttatatagtgtttgatgagaaatctatcatttcccttggggtaatggccagttatttaccaccgtaacaacttaaatgactctgtttctagacttctagttaggggcacttcttaaatcttgaaaatggggcaaagcataaatttctaagatttacttggttgtcttcacccttagtacatggggtgagtttcagcttacaaacctggcctctcctctgaaactagcaaggaagaaccaagtgtcacaatatagcaggagctcttaatccgtctgcacaatcattgcgagatggggagtggataggcttcccagtcagtgcctctgatttgattggtccagatctggggtgtggacaatttcttataaagctctcaaggtgattctaatatgcatccagggctgagaaccacttcattagtgattattagatcggttctcaaaatacagcctaacattgatggactctgtcgatggcaatatcctggttgtgatatcgtagtatggttttgcaagaggttaccaccagaaacaattgggtaaagggtacgtggaatagactctgtctgtattatctcctagaactgcatgcaattctacagttatttcaaaataaaaaagtttaacttatttgttaatagtctgccagtgaactccattaaacttacttgtgactcttaaaagatgcagacttttgggccccatcacaggtctagcaaatcggaatacctgtgggtatgtcctggaatctacatttttaaacaagctcaccaggtgattttgctgaaacactgatttagctacttacatgtttaggttttgagtaatactgggcacctggacagtcctaggtaagtgagaattaggcaaactggcacactaagttccctgccctattcagtattctgctattcctgctacacttgtcttaaaaaaataggatttcatataccaaggtgttatgatgatactaaggcacactaatgcataaaaataatatataatgaattattcagtcattcaacaatttttttattgagtacctattatgtgccaggtacagttctaagcattgcttttaagaatgagtataagaataacatttgtaagcctatcacctcaggcattctgatagtacgtggatttcttatttaagcttcacaaccaccctgatgtaggttcttttattctcccctctttgcacaagaaaacactgaaacaagctgttttatgtacattgctaaggatctagaagtaaaaactttgaatctgaaatcagatttcgactgtttctttatggtaaaatatacataacataaagtttacctttttaactatttgaagtgtacagttcagtgacattaaataccttcacacactgtgcaaccatcaccaccatcaatctctaaaacttctccatctttccaaacagaaatccagtacctattatacaatatcaggggctgtttttattatacagtatatgacacccccccaccaaagaaacctttaattgtagaactttatacaaaaggtaaagaaaacaatttgggagaaaagcctctcgccagcatttcttcaatcacacaacatattatagaaaagctgctgtgtgtaagatcagccttgatctggctgtatttttattgaatctaaaaaaaagtaattatcagaactattgttataacttaacccatttgtgctgcaattgcttctcatttgtgaaatagacactaataaggcatactaatggaatctttagtgtgagtatttattaaatcactaatgtatgtgaaacacttagaacattgcctggcatttcctcagtccacccacccaatcccacccacacacagtcaaaagttagttcttatttccccgattgtcaattttgtatatatcacttgatgcacatcattttcccacatctttgtcactgattgttagttttatctagttcagtagcaagcacaatatctaacaacctgaatttatttttattgtaatcatttcaaagaaattagagtcaaatgtcctcaactgtatgtctccagtaatttcacttagaaagtttttcaggcactgaattcgttcttgagaatagagtagcattcccctgtctgtaatatttgagcagaaaggacattgcttccatgaagccttgtttctgttcttcttctgtttgttagaaaatactctgttgatggcaaattcgtgagcaatctaaatatataattaattagaagaacaaattgaaattgaccaaatctctcagagctttgaacaaaaggactcttcaaatggtcaaaacaattacttagaatttaagcgttcattgaaatgcgagacagtgtgcggtagagatacaaaagagaaaccaggctcccatgatattgtaaatgctaaccctgctccttaagcaaacaaaagtctctttctattgtcagtagctgtcttctaggacaaatagtttggtattttataaaagggagaaaaacttatcaaaaacattccatgaaatgtacctcttttgaaaaattactccttgaatttgagttaaagaattctttagaagccaaactgctgagatgatttatctgcacaaaagaaaactactgttcaagaagcatatttgaagaatatgtcattgcaaatcaaagattcttttaaaaataagtctcaaaaggaagagagggagagagggagaaagagaaagagagagaaatatataattaaagtcataggtaatttaagtttggaaatgaacattcattcactactttgttatattgtcatatggtggtaaacaaaacaaagcaataattttgtctgattttcttcgctaagaaatggaaccatttatgaagcttagcaactgatgcgaattttgctttgatggtaattatgtaacagagtggcaggggtttcacttccagataaagatggacaatgaaggtcaatttctatcctgtcgttttgaatattcagtgccagcacaatttaattgggatcaggtaattgctcagaaggctacactgagcccactatcatccctcagtgtcgctcctgcacacctacttatcctgatgttgtttgtcaaaaactgtcacaaggaatgtgtctcactgagaaaaataacctgtttgtcattgctcagagcttcaagaccatactctaaagtgataagaaaaagttttttgttttttttttttttgagcaaaactgtcttgtctctgaactgattaaattggtccatcatggtaatataagggaacattttaatgaaataaattatttatgggagttcagtgatatttgctctcctagctcttgtgcgatagtatcaagtgtacctcttactctcttttggcattgaaggatattatattagtcttgaatatcttttgcaaaatattataaattatgcaagtaataaatgtaaacattgttttaagaactagagtattgtgaataaattgctaaaaatttatcttgtgatttttctcattggcattagagagaagcagaaatttagaaactaattcgtatataatgtgtgtttgtataataaaaggaaactatgtgctcaggaacagtctgatgtcctcagaatgaaaatactcatagtaacagtaacatacatatatgtaatgtgatttataaggattgcaacattaaatgtttgtttgaattggcactagtaaattttaattaccacctatgacttctgacttctgtctattgatacgaggactaaaaggatagttaatgttattattagtattaataaaagtaatgtaagtttagtataagatttctaatctgttcaccatagacaatgaaccaaagaggaactactttgtgctacatttttatctgtctcagggcataggttcaagacaagacaatttctagttttgtaaaatgaaagcagtgatacagaagacacctatttcattccctcagattaatagtatataatactatatattatatactttacacaaatgttagaataaaaatgaagaaatatttaaaatgataggctcactactatatttaatagcattaatcctcaaaggcagtatttaatacattaatttcttaatatgcgtgcattgtgaatacatgagaaaaaggaaaaaaattctttaaatgagttcctgcaattaatatcatcaaatgatgtaaattacagttttaaaacaaaaaagcccttaaagcgtgctatgaataaagtaggaaacaaattaaattttaatctttattattattaaaataatctttgcattgttctttttctacttgaagtttcagtggttttcattgatagtcataaactggagagaaacttgtgcccacctatgatactccagaggcacaagacgccaaggcttactgtcttccagcattgcttccattttatgtctggaggagataagatatgggtgtagctgtgaaggagaattggatatgcagacgattgctttatctttatctctgaatgatggacacccaagcagttttaagggagggcctttactggctctcatttgccttgtttttattaggagacagcctctctgggttgcaataggttgcaagttataaaattcaaatgactctggatgagatgctacctttcttaacttaatttgaattgttcatatcaggagtcctttttaaggatcagtcaataggggaacaataagacagtctatgaatcttcagcatgggttacagctggaggacataaaaaaggaggttggaagcactggacacactttaaaaaaatcttgtctgggttgaaaaatgcattttctttgtctaagtcacatgttgtattccatatttagctgtagtgttgaaataataggaaaaacactgtgtcttggcaggtaggcccctgctctgagctggacccaatggtcagagcacatttttgtttaacattcagagggctgtcaagatgaggaagtccattttatgggttttctaccatgaatttgctcttcctggccaactccgctcatgcctgtgaaaagaactcaccagcgtactggagaatgagatactaaactaggacaagagccgctgctgaaaagctcatggctgatatcaactggaaactaattcaaatgactcttacaataaaccagttctccactcactcaaagtgacagtgaagtgaaggaaatcatcctttgtgtttcctttgtttcatgcaatagtttgtgtggttaattcattatagtctttgttctcaagcgaaataaaacagtcaggtgaaagaagagttttcttccttgactttaaagtggatttccttttataacaggtaaaactcagctttcaattgtttttagttctgaagttaatagcagtagttctaggctttttttttttttttttttaaatcaatggcttgttaattgtcatcccagttatttacatgtgactatagagactgcattctcccagctgccaggccgccagggctttgccactggtataatttataacacgactaattaaaatgaatttgcttgcaataaggttctgtgtgctatttgtgggagaggagttattaaaattttcagtacagtaatagtaaacttgaatgcaaagtaataataatcatacatttttaattacatgtttaatacccatttggctaatgtagaactattctgaaaattacttgggatcagcacaatgtctttttgtgcttagtagtatccaaagacatccttctgaatgggcttagcaatatgcactgtcatcaagatacagctgtttgatgacagacacacagtgtgttcctatgatactttgcacaagatcagctatgacaaatacaagttcattttgcttattgcaggcaaataatgtcctttgcaggaacttggatggagccagaggccattattctaagtgaaatacctcaggagtggaaaaccaaataccatatgttctcacttacaagtgggaactaagctatgggtacacaaacgcatatagagtaatggactctggcgactcatactacatattgagtacaatgtacactacttgggtgatgggtgcactaaaatctcagaatttgccactgtgtcattcatccatgtgaaaccagaaaccacctgtacctcaaaagctgtcgaactaaaaaaatataaatttttaaaaatgattcccggctgggcgcggtggctcacgactgtaatcccagcactttgggaggccgaggtggacggatcatggggtcaagagattgagaccatcctggccaacatggtgaaaccccgtctctactaaaatacaaaaattagccgggcatggtggcacacacctgtaatcccagctactcgggaggctgaggcaggagaattgcttgaacccaggaggcggaggttgcagtgagccaatatcatgcctttgcactccagcctgggagacagagtgagactccgtctcaaaaaaaaaaaaaaaatatatatatatatatatatagatagatagatagatagatagatatttttatatatatatccaaatatatatatatttatatatccaaatatatatatatttatatgtccaaatatatatatatttatatatccaaatatatatatatatttatatatatatgagatttccattttccaccaactttcttttgaaaaatttcaagcaagactagtacaaagaacatccatatgtcctccacccaaatttatcaatttcttacatttgctcacttgctcactctccctccatcccctttctcattatatatattatatattaatatataatatataaatataaagtatatattaatatataatatataatatatgatataaacaaattacataatatataattataatgtataaattatataatgtattataattatataaatataaattatataatgtgttatatataatttttatatatctggctgaatcacttgaaagttatttgcaagatgtcatgatactttacttctaaatgcttcatcatatatcttctaagggcaaaatattctcttacatagtcacaacataattatcccatccaggaaatttatggtactgttatctaatacacagtccgtattcacattctttacagttgttcctcactctccactttgctccaggatttaatcaagagccatacaatacattccgatgacatgtccatttgatctttaatctaaaaaagagttttcagcctttgttgatatttatattctttatgttcttcaaggattgctcccagttgtaaatagtttctgatgtttgtttgtttgcttgttttctaagtcaactcctgaagaagcatgtatttatacacaactaatcttgaatgaagaatggtcgttgttaaggacttgatattagcaaactgtattcccaagctctttgctattttacccataatactgcaagacattttctccgactcatttggaaggtgtttccatttgtatctggcaagctattctcttagttcttaataataccgtcattgaagatcttctagtatgtagaaaagtataaagtgctattagtattccaaaggaaagtataatctaaatggtgaaaggaaatagaaacatgggcaaaatcaatacagctgaataaagtttaaagatgcagaatatgttacaaggcaggttagcattaattgctaaccaagtgatatagaacataagtctatattatctgtaatttacatagctattgattttcataaggataaggcaataccacttgtctaaaatggaaaagaattatgttgatgttagaaataatcatttacataagcgtacatgtgatttcaaggacaataagctaatgatggctcataaatatgcatatttttcattgatcaaaactgcgcagtaaacttctggtatctgatcttgtaaattgttacacaacattaaggtaattaagaagagaattaaggcaaataagactgcctttaaaacatacctttgcatggttcttcatcttgaattcgataatcacaaatgtgacaaatctctgtgctaagtttattcagtttaacagttgtaaattaaaaaaaaaatcctccattatgtttatcaagtcttccaagcttttattcaccatttttaaattatgtatttatttgtacaccatttaaaaaaattatatttttctacttcatgaccccagccaaatagcatacaatgtttaactccttacaaatcatacttatttctttatagtatattgacaagttttgtgatagatcttcttttagaattcaataacctaagaattaaaaactattttagagttagtgattctaacttcatgaatcttctgattaataagcttcctcaaatgcattttaagcagaaagaaaattgctgaatataaactaaaactgctcagagaaatgctttttattatgcactttcaaatgaaagtgaatgcacaatgagcccagtcctctctttagtgttcagtacacagctcagggctgtgtattaacccagtgccctctcctttctagctatgcaattagtattgattgactgatagatagcacacttgatgttggtggtcactgaggtacgtacacctctgtacaatgcccgccaggccattgtgtgtgcctggtacgttactgaggaataacaaaacaactggtgagtttttaatcaactgtacatggaatacaaaatgtggtctgtcttcctgtgtctagctacttttacttcgcggttttattttcccagtgatgtgtacactttagatttttttcccagacataagagaaaatgtatattgtattctacttgctgttttaagctttctcttaaaaagtctatacattatatttgtgttatttaacaggcccccatacatagcacttggtatgtttaaaacacctcatttgatgctttataaatatgagttaatttgaaggaaatcatgagcaaaatctcatgcacatttcttttgtgtatgaaatttagtggaggatgtttttgtctacatatcagcttgcaggacttctgctcaggccgcatcatcttttataatacacatgaggtccaatatggcctccttccaatctatctgctgggacaggaaaaggaagctctaaatatctcagcagtaactcccccattccctcattgccccagcccctagaaaccactaatctgttttctgtctataactttgcccattccatatatttcatagaaatgcagtcataccatatgtgaccttttgtgcctgacttctttcacattgatgttttcaagattcagccacattgtaggaattattttatttctttttattactgtataatattccattatattccacattttatttatccatttaccaattgataaacatgtggggttgtttctgctttggtgctattatgaataatgctgctatgaaaattcatgtacatgtttttgtatggatatgttttcaatgttcttggttatatacctacaagtggaattgatgagtcatatttttgagggactgccaaacagttttttttttttttttttttttttttttttttttgtgatggagtctcactctgttgcccaggctggagtgtagtggtgcaatctcgactcactgcaacttctgcctcccgggttccagcgattctcctgcctcagcctcccgagtagctggaattataggcgcccgccaccatgcctggctaattttttttttttttttttttttttgagatggagccttgctctgtcatccaggctggagtgcagtggcgtgatctcggctcactgcaacctgcacctcccgggttcaaccaattctccttcctcagcctcctgagtaactgggattagaggcacgggccaccatgcccagctaatttttgtatttttagtagagtcggcgtttcaccatgttgatcaggctggtctcgaactcctgacctcgtgatccgcctgtcttggcctcccaaagtgctgggattacaggcgtgagacaccatgcctggccgccaaacagtttttcaaagtggctggacattttaccttcccaataaatatgctttcatatttgaactgactgataaaatttcaacatacaaagcatataggaatttttacttcaagttacatctgaaatggttggctatatttaaaagtagatattctgtttttaacaataaaacataatatcttgcttttctatatgactgacattattatgctagatgacaactacataattattggcaaagcacaatttgtagaattacaggaataaaactgatggaagcatgtagcatttcattcttccaaagcccagaatggaaccaaatagcagattagttgcaatattgaggttgaaactcaagttcggtgcatgtctatttcctcctcctttcttccattcccatatcaaaataaaagaaaacaaacaaaatgctttttttttaataacttgtttttcagtgtaaggaaaaaatggtacagtgtgaaagctaaagtacatactagctgagaaaacctgacatgagactcattttttaaagtataaacctgtatagtagataacatttcttgaatgctcgctatgtgccagacacaatcataagctctttcaaggattaacaacacaaggctatgaggttggtattattgttctccatattgtacagatgaggaaataaaggcacatagaggcttagtgtcagagctaataaatgacagaggtggagttcaaacctaggcaggttagctccagaatctgtgttttagctgccattctgtgctgctaaagagcgtctgttaccaccattatcctactagcaactttaaatgcattcatgtaatcattggaaacttcacatgctatagtaatttttatgcagaatttcagtaaaatatctctaacatacaacttccagattcaaatttgcagatctaccattgttatctaaagggtgttttgattgatttgtatcttattttgtgggacagcaggattcagtgagaatttccacagggtggaatcagtattgagtgccctatggaagtgttaactccattccaatatccatagttcaagcaaattgttgtttcctgtgaatgttcttcaggctgttactatatgtgcctgtcatgtcattccatgaaaaaataatgctggccttgtagtttctacaaactttactactatgagtgtcacctctgagtttgaaatatttgaagcaggagactctataagttttcagagataaaattgtgtccagaaaaatatgtccccctttgattgacgtgggtgagcatgactgtgtatcatagattatagtattccgttcactcagtttcctttcaacaatgtctcatatatttcaaaggaaaatgttgccatgtcactttagatttaaaaggttgcagtgaatgatgttttcttaaataaaagggaggaaaaagtaattgtcatgttttgtagatttaagccctgtcattgccaaaatatctgcacgtgaaatcagtagatagaatttttggtagggcttctctgttgtctgaattcccattactggaaggaaagtatgagaaaaataaaatgaatgtctcatttttcacatgttcttcagtagtttggggtcactgtttggaaaatcttaagaaactgtgatggcttgaataagtagtagagagtcaatcactttaacctgtgctatttatctattttcttctaccatcaattcccactatatctttaagagaaaaatgcagcacagaatttctgacatagaccatgttgaagtaccatttttccccatccttgaaatctcaactcttccttaaaaagtgtcaagaaccaggtatggtggctgtgttagtttgttctcacactgctaataaagacatacccaagactgggtaatttataatggaaagagctttaattgactcacagttccacgtgcctggggaggcctcacaatcgtggctgaaggcaaggaggagcaagaggacgtcttacatggcagcaggcaagagagagtatgtgcaggggaactcccctttataaaaccatcagatctcatgagacttactcactatcacaagaacagcatgggagagacccgcctccatgattcagttgcctcccaccaggtccctcccacaacacaggggaattatgggagctacgattcgagatttgggtggagacacacccaaaccgtattagtggcgcacacctgtactcgggagactgaggcaggaggatccattgagtccaggagctcgaggctgtagtgagccctgattgcaccactgcactctagcctgggtgacattgtgagaccctgtttcttaaaaaaaaaaaaaaaagtcaaatagattcattctcaattttattatgtaagtattaggatgagatatttatagtatgatagaatctgaccaaagagtatctgttcagccataaagggagtatgtaataatattgtacgttagtgataatatcaccatcaaaaattatttctcagttttcctttgagtgtacatctgtaaatgtgtatgtttgtgtgcgtggcaagatttgcagatgccaaagtcctataagtgtccttcttcccatctttttatttgaacttctgagggtctgcggtgaaaggcaataaaagcccttaacttcattactgtactttatactaaattcaaacaatattgctttatttattttaattcacgtttagatttgcattatattttgtacaagacaatgggtagaacctaatttccagttttcactggagcagagggtggaaaggaatcagcagtaaaagtgagtcctgattagtttcccctcctcttgctttagcctttgataagtaagcgccttctactttcatttccaacagcgtttaccatagaaataatacagtgctcttctccatttgctgtggagccctgtggttcattgttattatttcctcaggaatccctttaaaggtatcctgcaataatgctataatctcagagtagctttaccccttgccacctatataatgatcatttctagttaaaaaaaaatcatgtggaagagagttgataatattacaaggagaagacaattttcctgctcaaaatgtgagaatttgaaataatagatgtggagagaaatttaagtaaatatacaattaactcttaacctacaacttcactgaaattctgaggaaatattccaaggctgcataaagtgaatgaagagtttcctaccaaatatttctccctcagtacctaagtaattgtttcttttctgaatcagttgcatacacagaagtagaggtggcactaaagataaagatgcttcgaccttgttctcaccactttttttcctgttggtttccagcagtgtcatgggctttcattacttattcaagaactggctgtgctgaacttccattgctactctgcctgtacccacatatttctgtagcttggaaatttgtctttgagtttatatagtgaggatcttttatctgtcactgtgcggtagctttagcataactgcatttagatttagagattaaggcttataacttaattatgaatccaactacatacgaaagagtttaatttaaatttaatattttgattcagcacagctcaactcatgtgttcttgttaaattgtctctcattgaatttttccttgtcattaccttggacatcagtgcttttccagaattgcaggctgtagcaaaataacaacgcagacttgacttctgtctgagctaatcttcagaaagggcacaggctaatggtgacgtagacatctttacagtttgtctgtaaatgtgttgggtgggtgtgtatgtgtgtgtgtgtgtgttcatgtgcatacacagacatatacacatgaatgtgtcttgctatgctaaggcctgaacaaataaaaataatgtcaaataaatatatttacaaagcctaatctgaaatgataaagtagatgaaatttgagaaggaacatttgtggtctcccaattttatgcctcatgcacatgtaactctatatacatatatagagggaacactattcacacaacacatacaaatatacatgtaacacttataacagtgtagttatgtaagtgtttagatatgagaaactactatttataggaatccttcagcagtatctttcttgcctcctcttcctgctcttcctcctacttctcttcctccttcctctccgccacccccctccccacccccgcataaaaagggaatggtttagtcaggtaaataactaaaaattgttatttttttaaataggctttataaaggtgattttatcccagaaagaagtgtacttacacggctatgggggactgatctatgcatataaagcttttcattatcagtgggaaatttccatttgtaattatgtccatcacaacatcagcagcaagagcatatataatgtttcaaaggttagttaaggagtgtttgtgcattttgtatataattagacaaagaagtaattaatatagacttggataacttgcttgcataaacaacattaaagcaacaataatgaacactttaaaatatacacgaatatcatgttaacgtatcaattgccctacttctacctttccctagttcaaatcctaatttaaataatatttcagtgaatataatttttatacgtaaaatttcttcaatatacaaagaattgtttgttataaatttcagtgtcagaaactttaaactagaaatgcattcccatcgaaatagcgtagttaaaccttctctaccaagtactagtgagatgtttgtgtcgagaagacacagaggctgtgttggggtctgtctgcaaactaacattacacagggtagcttcatttggatgtatttttaaattagatccccactgatggtttcctttgaaataaaatgtttctcttattttaaaatgcttgaaaatcaacattataattgatggttaaatttccagtttaagcatacttttccttgttgtactacacatgaagtactgtgctttggcaatgaaaataatagaaaatgtgccataaaagtaattgaaacctaaacagaattgctgagtgggatttttgtttcatgtcttgagcatgttgcttaaggaaagcagatctaattagggaaagacaggaggcagatacaaagactttggtgggaattgtgagcagagaattggggcattttcaagggctatgagcttgagagagtcgttatatccgatttcactttccatttcctagttgttacttttgctacacctacacttattaatcatcattggggttgtttgggagcttacaagtgagttgaagagctgggtaaagaatagaaatttcctctgagttattagaggagcaaagaaggaaaaaaacaaaagatgggagatgggagaatggtgtgcttttgtgtgttaatgtgcctggggttgaagtagttacttgtgagaagcaaaaggggacaatagatcatatgctattgctcatccttttgtggaagaaacccatcaggtatccattcactcactatttactgaacagaacacattgtaagagcacagtgtattaggcgaagggaggtcactggtgaacaagagcttcctggagctttcagtctactggtatcacaagcatagaccaaagaagcacatatcataagtgctaaaagaggtagagcacagaatgagacctcatgataagggcacttattataatagtcctagatctgagggaacacttctctgagaaaataatgtttgagctgacacctgaatgctgaatgggagttaatttatgtgccgagagatgggaatagttcctgacagaggaattagcaaatattaagctgaggagtttgtgttgtattttataaatataaattaggacctactcttccttttgtctttccttattagtgtgataaaatcatcctcctagttacaaagccaaggactctgacagtaatttttgaccctactttctctgccaccttgcacccccgttacctttactctaataacatccttttgctcaataatttttttctctttctatctctaaatctcttctcctacactcaaccctcaatttaattcaggtctgagccacgtattgctgaactcacagctttctcacttccgctagaattgactttcagaagcatttgatcatgacattttcagtgtaaacctattcagtgacacagccctgcctgtagaataagacgcgtcagctttacatgttctcttgatatgatctggacccctcatctcctaccactttccctgtattcttgccacatgcacctccttgttctcttgaatatagcaggcacttagggccctgagtctctaaacatgccagcgtgccctcccttccctaatcatcagtcacaatttgtatcctctagcctgttgctttccagttatcatactcagaattaattttgcctccttccttgtaatcgtattacttttacctgcctctcccccttttcagcatttactttataactctgtcctatattgtagtgtcataaatcattgctctaactagagtttaagttcagtgaggtccaagaatttgtcttatttatttttatattttatgcttttatcattttccacagttggaaataaaaatttatagtcagacttttagcagcttcctggaactgaggcaatgcaggctggggcagagaagaaagttaaaggatacttggagaaacctgaagaaagtaatttagactattttatggtttatagtctctttttgatcagctgtgggtgccctcacaatattggttgttgagaatgatttgacagaagttatcaaaataaggagattcaaacttagtctatatgagaccaaatactcacattttaaacaatagacatttttagtaatgacatttaagctcctagatagctggatacagagccaatgttattgcatataattcaccaattcaacaaatatcagttgatgactcaccgggatcaggtacagttaaaacttgctctccactttggtcatacttgctttaattcattgctaattgagtcttaaggctcaagcagtgggtcttataaattcactggtctttattgttgaatccttctctaattttggcagtaatcacgcatgtcaatcttgcaatgaggagctatcggattttcaacctttacattcaagctcttgttttttcctgaactggctctttgtacaaataaaaacacactggcaaaataataaatgagaatccttttggacttttcagccaacaataaaatattttttataaaaatggaagtgcacaaaatggcagccatctgttgtttaaaaacaacagaactgtatttaagtcaattattgtgtaaggtctgtgccttgaaagcaagggcaaaatggtttatgttcatctcaatgggagaagattttgtgtgcttctttgtcattgtctatgttgatgtgagactggataactattactaactgaaaatagttaatcatatttaatcatggatgaggttgattgaaaaaatgtcatttttatttatgaactcacatggacatgtctaattggacaattctgattttctctctttattttgagtagctttaaatccagacatactagcctagcaaatccataaagaatctgtcatcatggaaattgctaacagagcctgaactttttcctctttccccccactcaaagtttgaaacataggcagattaatagagataacaattagaataatggtaagaagtttttttttcaaatgaagtacatcctaatgagagttaggtttttgctaaaaagtgtttttcttgatattcaataaaattgatataaataaattgtattgttaattttaatctttttttacttggtaaaaatgctttctatgtcagtcatctatattatgccaattcttgcttcattttcaatgtttattagagggattttataaattaatcttgttttcatttatactattgtataaatagttttcatttatactattgtataaataatagtattcatttatacgatatatattgtataaatagttttcttttatactattgcattttatgagtgaaatatacaatatatattctttggaagacatatcaatatcactattgcaacagatatttttccagaggttaacaagctatggctcacttacacatttcgcttaatctacattgtagtttgaaaacacacagatgtgaacatattaccaatattttgccaatataagagtccacatttctgtcttcttttataaagtatatgaggcaaacacaacatatccagactaggatgtagactgtaatttcaaaatatctaaaataggggagtgccgggggaaaatacgtcattttgaaaagatggctgtgttctctgtgtttatagttgaaactataaacctatttctacctggatgaggggtttataagggcaacattactaattttgagtctccacctctacaatgttagctccatgagcgcaggtattgggtacagctgaatcctccaatctaccgcagtccctgcctggcacataagtgatcaacaaatattttgttaaatgaataaatgaacaccctgtctctttttctttcacctaatcctggtatgtctttgctccaatcctctgccacccagggctactattttattagttgatgccagaaaactctccaatgagaatgtcccatgttcttcactgtcataccttttttagactctttgctatcatgccttaactaccaacagcaaagaagccaaaaattcagacactgagatgtggttcagccagaaatatttacaaatgtagaagtgagaatactaagccaaataacatttctcataataaaatgtagactgtaggataatattaaaacttcaaattgtacaggagagataatttgggggaaagagtgtagcactaagccagtgcttctcaaacttaaaggttcacatgaatcacttgggggtctttttaaaatgcaaatttgtatttggtagatctagaatggatcctgagaatttgcatttataagctctcagatgatgctgatgctgctgatatatggaccacactttgagtacctcgatattaagcaactgtaaactatttgtttgaaaacagccatgatttgaagctatacatgataaaatcgatgggcatttatcaacctgctgaaaaaacttagatgtctacaaatgtccaaatgggagagatacttggagtaagaactttgtagtggtagaatggcagggacctgagatatctgttgcttcaatttacaaactgggattctggaccccaaagatactcaatgacttacataagaacccacagctatgttgatgctgcacccaattggaaccaacgtttatttattcccagacccatgctctttaaaagagatcatgcacatggacataaagaaggaaacaataaacatcaggacctatttgagaggggagggagggaggagaatgaggatcaataaactgcctataggctactatacatattacctaggtgatgaaataacctgtacacccaactcccgtgacacgcaatttaaccatataacaaacctgcccatgtacgccctgaacctaaaataaaagttggagtgaaaaaataataaaaaaataaaacagatcatgctgcctcttggctattgaagttatagtagaattccttcaataaaacacttaggaagttgttgtactataaaatatacttaatttcacttaatattgagtgcttcactaaagtcagtcaaaatgaaaggaagtaatgcattcgcttctcatgagttgcatttcttgtgggtaacatatattaattttattataatttatcttcattagctattgaaaataatgctaaagacatttagaatgccttttagcgggcattactgaatattagatgatgaacagctttgttggaatagtttgtttagttcctaggagaaagtttgatttgacgactaagtaaaaaatttaggggaaaaaagcaacaaaaaagtacccaaaatcaatatcactacgtttgctgacgaagggtgtatttttagctacactgattttttaatttaaaaaaaatctacacggatccccctcaactccaatgtcaagtaagctcaactgacattatcgaaaccatcttcctttttattatcaaaaccatcttcctttttactgtgcatgtgtgtatgtaagtgcaagtgttacaaattcttaaaagaagataaaagaatgatttttcctcattatggtgtaaaacaaaattaaaaattgaaattatctaatctgcataaattagacactttatattacattggcagttttatcatatttgaaacattttgttggtctcaagatttaattagattatgtcaccaaatcagagaccacaaatatccatgggagcttaatagaactttttggattttcatgggatgaaaacagtattttcatgaggcgcagaattcatcatcagcttctcacctccattctaccctcagccttctatttccctgacccacattagtgttatgagagcaacaaatggacgtttcttccaacacaggttgtaagaaagtgctgctatcatgtgaggagtataaagggaaaatcaggcagcataatagctgagctaattaggctcagaccattaaagatcttataacggttatattattgttgttgttaatatcacctgagtattgcctcacagattacagaatgcctcctcatacattattttatatcacagattataaaaggctagcattataaataataatcatattaaagagtgttattttaatattacatgagacattgattttcagtgatgccatgtgtttccatagtgactatgataattaattgctataaaatcacaaacagtatttccttttgagagttgacaacagatgctggcattttaacaaagagtatattaaataatccacagcatgcccagaaaattgaaatgattaccatgaattaaaaaaacccacaaaactcataacaatgcttggtgatacctagaatattctggttatctgtaagttttcaagaaggccaagcaggcctctgtcactgttctttacctgccaatcacaccgataacttctatgagacatttctgtctttgagctaatcatcctctttttaacagcatacgcattccaacaggcatggaaactataatgtattaagccattttatctgcaattctcacttgttgtgatttagtttaatctgttttctttggttccaagtataagccaaaatcaggacacagagaaggggcatcttgttaataaggaaagaggatgaaatggcagaaaagtagtgactccccaggtgcaaataggggaatatcaagatgtgtcaagaaatgaataggcagcccaaaagccagatttgtatggaaccttttctgcctttgtgcctgaataataaccataattcctaaataaatcatatgactacagttgaacagtggtaacttttgtgtgtagaatgctgaacttctaaattatttttatactcttcgtcaaatgcactttaaaattaaatagttgttataatatagtatgccagcaaatcccagattgtcttgcagagtgactcagaactcttgaaaggtcactactttcgaacttcaacatccttaaaatcacttgaaaactgactgctgctggtgtatgtgacttgaaaatatattttgttgagaatatacaatgtttcttgttctgtgtcaattggctacccacattcaaacatttggagacctcccataagcatccatttttcttttaaaaaactgaagatctagcagtattgggtccacgttctgttccagctaagtatcactacctcctttggaagggatttttcctttccagtctcccaggtcttggtaaacctctatcttccttgaatacaatagatctggcacctattggcattcagtgtagaagaaatggcattcctataatttgatcaatgcactgattgattggttgttttagaaagagctgaatgaaacatttcagtttcgttgttgatccatatctatctgtctgtctgtctgtctgtctgtctatctatctatctatctatctatctatctatctatctatctatgtacctacctacctacctacctatataggtaggggaggagagagagagaggcggaacataaatcatggtgtaagttacacttttaaaaaatggaccaatttaccattgtacaattgtaaagactgcgttgaagcaattttaaggataattcagaacatatttttctaagtaaagttctatgtcttatgagagtagaaagcaatgaagaaatatacatacattttgcgtaacctagtggcccttaatgtataaatattgcatgtttaagtgaagagtcatccatcaagaatctaatctataccagaagtatacacttcctcttttatactttgtactaaagatataaatatgacgtgttccctagttctctatccattacagagtctggtggataaaaattaaaaatataatcttaattaaaatggaaggggatgaaggctataagacagtcaggtacacacatactatatggaaaaactgggcagaagtaattctgtctcatatagtctgggaaggtcccatagaagtggtcatttagctgattcttggaaaaataagtagtaatttatctagcaaaggatataggaaaaagcattataatgagaggaaatggcataagcaaagaccttgacatgtgaaagttgattttatatctataaagatctctgactgaggaatattgttggaaatgggggatagtgaaggcagatatatgtggaagataaaatgggttgatcgtgacattttttttttttttttttttttttttttttttttgagacggagtctcactctgtcgcccaggctggagtgcagtggcgggatctcggctcactgcaagctccgcctcccgggttcacgccattctcctgcctcagcctcccaagtagctgggactacaggcgcctgccactacgcccggctaattttttgtatttttagtagagatggggtttcaccgttttagccgggatggtctcgatctcctgacctcgtgatccgcccgcctcggcctcccaaagtgctgggattacaggcgtgagccaccgcgcccggccgatcgtgacattttaaagagctttcttttccttttcaaagagcttgggcattttattatagacaataggaagtagaaagtggttttacgggaggctatgaaatgatccaaaaggcaactctggctgtagagcagagtcctgattagaggagggaacaaatgaagtcagggagtttattaggaggctttaggaattggccagcgggagaggctgtgagtaagaacgaaagtgattggcaatgggaaggaatcagaagataaataactgaaagatattactgatgaagaaactttccggattggatgtgggcactcagaggatgagatgagttggaggtcggtagtctgggaaaaagtgaagaaatcatgccaaaatcaaaatcataatgtctagaaagggaagtattttccgcagcatggataacagtccctgggtaatgtataaattctctgtcataaaatactatctcccacaaatgttaattaagtatttgaaccaaaagttatttggcattaattgtgatcactgctattattgttattgttgatattatgagaagtagtatttagaaaatgtgagcaatctcatgctgtatatgcacactaggaataatgctaaaatagaaaccaaactaaacaaaaataagtaagaacaaaactccgatttaattcaagaaacatgcagattcatttttgcttggattttctttgttattctaaagaatcatgaaccaatttttttttaagtcctaactattgctatcctggagaacacttcaactacatagagtaaccatttacagaatacagttgaagtctacagctgctctggaggataaatgcctatttcttttaaacgttggctgaggccctctcgaattatatacctcacatgtgctgtatttacatcagaccaccccaaacatgctttccaaattaggttaaaatctgtgtcaccattttcatgtaacatagaaacttaattttatttatagagattttattcattttatcacatagttactatttgccttcctggtttatgattccagtttctttggaattccacttttatgtgactaagtaccctatgtgtttaactctactagatatcccatcactaaaatacaaccataccttgggattattcagttctttggtaccccactatacctcccattaggtgagtttctaatgcaagatactgaccatagtatgatgcattctgaaattgccttggctattcatacacaggtatatgtcttatatttgaaatgtaatagcattttgtatgttataagcatgctaatttgggggcctatttattgtaggagtagcaaaaaataagattgtacttttgaagactatatgtggatacatagtatcatgaatggctgctctattttgtcaaattcagaattaaaataagatttaaataaaaatagaggccttttcagtttatggattttcttattatcttaaaaaaaaaaaacatgatagtgaggtttccagctgagaggaatggttggaaaaacattttgttccagttagttaattcttccctacatgtgctctattcatcgtatccattttaaaagcaaatgaaccatctctatctcctcttgcatttgtggcaaactcttgctgtgccaatttcagattacatgcatcttaggaagaataagatgttctaatcttgattataattttaagttaaaagaataaaattagttcaatactaagacattgatacgttgcagtagtcagactgtcattacctcttttgacaaaatagaaaaacatgtctatacacaggataataagttcctgcattaaaatgcataatactataaatgctactagatttcaacgcaatcaagaaatcagtttatggaagctgaaatttgttaataaatatgctgctacttgagagtttaaccattttgcaaataattatagcaaacttccaacgaaattattttcattatgaatggagatactttccaaatgaggatataagaatagataataaacacatgaaaagatgctcagcaccattcttcatcagggaaatgtaaattaaaaccacaatgaaaaactattatacacatgttagaaaggctaaaatctgaaagactggtcataccaagtgttgtaaggatatggagcaagtagaacacataagcattgctgttggaaatgaaaaatagcataatcacattagaaaatgcttgatagttttttaataaagtttgatagtttttaaaaatataggtcatggacaaatagatgtatgctttacagatgctttatacatctatttacccataacccatagccaacattgtaatcccagatgtgtatcccagagaaataaaaatgtatgtcaacacaaaagacttgttagtgaatattcatggcagctatattcataatattccccaactcgaaatgaataaaacgtgcatcaataggtgaatggatagtggtccaaccatacaacggaacacaatttagcaataaaaagcaacaaactacagatatacataagactatggatgaatttcaaaccattctcttgaacaaaaaggccagacatagaagtacatacacattaatatgaagaccaagctctggtgacagaaaacagaccagtcatcgtctgctcatgggggaatcttctgagataaggggaatattttataccttgtagcttagaagaaatgttatagagccccaaacctgaacatggagaagtttaattttgaattatgagacaatctaagcattcaggcttcagagattttttttaaaaaggcgggcgggggggtggggggaggccacagtgtgggaacattggaaagttaggactagaagtctcttgtgaaaatagaaacaggaatgaatggaaaagcattcattcataccgtcaacaaccgaatagttgttagagtacaaatgatgagccagactgttccaggcattgagggtacagatgaagtacctggcctcatcgaacgtacacttacttagttgctgagacatacagtacacaatgtcaagtaaacatgatgaacacagatcagtaatataaaggaaataagagcacccagacaggaaggatggcacagatccatttttagagaaaccctggggaagggtgtaccaggtagaagaaagagtgaatgcaaaagacagagggtgacagagggtgacagagagctcactctgcttcagatttgtatgataagtgtggaaagcctacagaggcctgtttctgttggagcttgaaggctaccatatggtgtttgcattttaaccaaaataaaatggaaagctattgtggagtttcaagttcgagagttgcattatttatctgtgccttaaaaagatctcttttgtttaatgtgtggattgagggagggagagaggaagaagaagtagcaaataagctcgtaaagtctaataaaaagaaagcagggaggcaagttagggagttattgcaatgtgctggatagcaaatcagggtatcttgactcatcgaggtggcagtagggataaagggaagtggacagtttcaaaatacattttggaggtagacgtggaaggacttactaacaaataagatgtggaggaatgagtgaaacagacaaatcgaggagatccatgggtcttgcctgagattcttgccatttacaaagatggcaaggtctgggtgtataaggcagggatcgggtgaagagagactgtttacaaaggtgcagaaagtgtataaggagaacagcagtgatagtgatgtactcccaggcaagtaccaatgaggggtcattactatccttagaaaataagtagcaaggaaaatgaaccattagggtacttgtacggagaagccttctcctaggagatgaggtcttcagtagaggaacgcagcaagcccacagaaacctgggagaggagcctttgttcttatagctggggaacattctcattgaccaaacccaaccagaacctggagagacagggtgaatgaggggtggtgggaaatggaggatgagggggctggagtacttagagcaaatgagagtaaaactataagggcaaagcaagagacctggcacaatgcccatattctgaattctgtataatttaaaagttcagtaaacttttcctaacaatctaaattacagccaacaacatacaaattttgcaacaacatagaaacttttgttgccaagaagactaatttggaaggctttgctagttctatattagtaatgtgttattttttgaatacctagtagaggaagccagtcccctgaaaagtgtccttgtaagtagtcattatttagttaagaaataacccaccaggaaaaaaggaaagagaaattatgagatgcacaaaacctgaagacaactttagtgttatagaagatcttgagagtactagacagatggaagtggagaatgcatccgtttctttaccattaagaccttgcctaggtgtttttgacattttgagctgagataagagagtcgggttttattccatatgcttaaagtctttactaggtttgtcagtataacttaatgtttttagttaccacatgtcattctgttactacattttgctagaattgcctaacataaacagtatccttatgtttcataatacaagctattcaagggtcatattggctaatacaaactgtttagaaagtttgttttgccagaagtcactattgtcaaagcactgattttaatttttggtgatacccccatttaaaacagatatttaatgcttgcccagtatttgttgctcaatgatactttattgtctgttgctatgcactgattgattactgacagacagtaagtgcattggaagaaaccatgatttaaattgtgtgtgtgtgtgtgtatgtatgtgaatgtataaattattcagtgaagcaatagaatctgcatttattcagaaacaaagaacattcattgattccacaaagatttattgagtgactactatgtaccaggcactcttttagggacgtgtgctacgtcagtgaacaaaagagacctagattctcgtgcttgtagatataatattctagtaaggaaacacagacaacaaataatacatataataaaaataaatcatagtatgttagaaggtgatatatgctaagaaaaaaatacaacatgcacaaaatgaagcaatattcatcaaggtcatgaagcaacattatctgcactctaatctgatctccttgaattcataatggaagctgttgccgttttcatatacatcaattcttttttccctttcattttgtgataattgtacatatgtatggggtacagagtgatattttgatacacatataaaatgtgtaatgaccaagtcagtgtcatccatcaccttgagtatttatcacttctttgtgttatgaacattcaaaatattctcttctagctttttgaaaatatacattcaattatttgtaatcatattcattctacagtgctatagaacagtagaactttttcttactatatagctataaatttgtatttgttaatcaacctctacctatccatacgtcaatacttaaatggtcaaaccaaaatctttatcagaaatcactggtactttcatggttggtatgttaaagtttggatcactaaataaatttagagtaataggctgatcctaaaatttcattgataaacttgtcataattaactgtatttatgacaaagaaagcaaaacagaataatttagataattttataataaactagttcaggatatgtttatcctagctatatattggtgcatcatttgtcttactacatttgcatatgcttaaggcactgaatctggaacacaaaggaaataaatgcgcattgttcgttttttaagaaattctattcacatgggttttaatccacagagatgcctccttttagtcttgaatgcaaaaagaaattatcttttgagtgcgtgtgttagctttgaaaaaatacattcacatgagatttaattcaccttaaagtttcttttctattaaatctcatgaggaattgctgaaggaaagtttcatgatgccaagtcactaagcaaagttctccaatatgacagttgttagaaatgtgaacctagtgcagttgtccccttaagctatgggcaaaattcccagttttgaaccctgaactcattcagccaaaaaatctatattatgctagtgtctattacatgtgacttccttttgaccagctttttctatgtttagactctcacttttattccaaagtacactggaaaatagaaaaaaatcggataattctgttctgggtgatcagtaactttggaaaaattcaatttgtttgttttttttctggcaagagtttgaagtaaaacaagtttcttttcaacacattgaaacaacctattttctccagagcaatagagtttgcatctgatatcagataagtgattcttgtaatttgtctaggctttcaacaaactggtgaaaaaaaaatctcctttcatttactttccatctttcttcatgagtttcttttttttttttttttttatctcaaagtgttcttagagattgggggttgactatctagctcataataagaatctaacagaaaacataccattaagcatttgagcttctcagatcaaaatcaatatttaagaccaaaataatattatgcaagcttttctgatcataaaaagaaagatcgttagtcactttggacagaatgatgatatctttagtcattgaattaaaattcataagtgtaatcctcctgatgaatttttctctgtctggtatttttctatcaggtttataactcatgaggctaaagcaaattagtgtcaacgttttatcatgaccatttactcggtgcctttctgtttctttacgaaaataaagttgctttttaatgttttggtaaatttatataatttctttggaaacatcaccactaggatttaccatgaattacagcaatatacttagtgctgcttagaaaatatttcatccctttccctgttttttgtgtaggtttatgtccttttaatttctgtttaattccccttatttaaagcctaagtctcaaatattcatgattcttattgcgaactataaaatatgtgcttaatgccattatccttttaaaatcatcttgaatctttatagtttaatcacacatcttgcctgtaactaaatttaaaactctctggtaaaacaaaatgcctaaacatcttgtataatgatatgcctttttagcaatggttacacttctggctttataaaactatattacttagctttttaagttacatatgtccattatatgtatctaataaaattaaaccggattttagatattgaacatttttaaagccaacaaccttggtgctatccttggtttttcctctcctactgcctctgatatctaatccatcaattcctattagttttatctcaaaattgaccctgtctctgtccataagtcttctgtcagcctctttattgcaagcttccccactggtctctcattcattctccacacagcagcgaaagccactactttacagtaaatggtgtgaatcattcttctgcttaaaactgctcaatgacttcctggaatcaagtccaaactccttatcatggccgcctaaggccagtatatataactggaccttgcttctttctctgatctcatgtcctgccacttccctttcgggtcgcgtaccaagctcattttcatcttggaaccttgactcttggtcatctctctctactccaaagctctttctctgcatcatggtttctgccttctcatctctaaggtctcggatgccacctccctaaagaaaccatcttgcccgatgtagccccaagtcaatctctcttaaatctctctattctatttattttataccagggagcgccatctgaattacttgtttatttatttgtttgcttctccacctcccccaaccccattacaagtttcaaaagagctcctatctgactcagtgcaatatccaacatcctaagttggatcctggtgtataattcatgctgtttacagatttactgaatgatagtatattaatatgtcaagattcatggcaggtatcaaaaaattaatttattgaagcattcagtctcaaacattttcttttttttctttttatctttttttttttttcagatagagttttgctcttgttgcccaggctggagtgcaatggcgtgatctcggctcactgcaacctctagctcagagttcaagtgattctcctgcctcagcctcccgaggagctgggattacaggcatgaaccaccatgcctggctaattttttgtatttttagtagatatggggtttcaccatgttggtcaggctggtctcgacctcctgacttcaggtgatccacccgccttggcctcccaaagtgctgggattacaggagtgagccaccatgcccagccttcttttttttttttttttttcttttgaggtgagtctcgctctgtctcccaggctggagtgcagtgttgtgatctgagctcactgcaacctctgcctcccaggttcaagcagttcttctgcctcagcctcccaagtaggtgggactacaggcacgcaccaatacgctcagctaatttttgtatttttttgtagagatggggtttcaccatgttggccaggcttgtcttgaactcctggctcaagtgatttgccctcctcggcctcccaaagtgctgagattacaggtgtgagccaccgtgcccagccatgtctcaaacattttcatcttgtgaagctatttaagtttcctgaaaatcacctcactcttcttgtactcctcttccttaaaaccaacccaatggtctcaggcttttctgctcattcaagtcacatttcctcccagtaaacttaattttggtaaaatattcaacagttcaggagagatacataaatcatgcttgaactgccttgcaaatagcaaaggaactgactggccatgtgctatgatttcaagggttttgggaagcatctacctccaactactggtcctcactgagtcttgaaatcccacatttagagttttaatttcttttttttaaattaaacaacagaaatttattttctcacaattatggtggttggaagttcaagatcacagtgttggcagggttggcttcttctgactgctgtcctcattagaattttatttaagttttgactcatgttaagatagaaatactctcggaatgattaatgctttaaacttgtccagccacttagatgtaaggtctgaggatcttaaaaggtattttgggaaggaaaaaagagcaaacgtcagaataccaggaatctaaaatacaggcagaagagccacctggagggtggggaccattcggaaatcctgatctgcttgtaaggccggtgttagtctaacctatagcattctggttcttttctggctcggctcctactgtaaatttaaacatcccatttaatcattatgcaaaaaaaaattaagagatttagctgggtgatctctaaacaattctagatcagtgattctatactccataattttattcacaatcaaccctttctactactcacagatgctagaaaatattagaaagcagatgtaattaaatgttcacaccacaaaaatgagaactatgtgaggtaaggcatttgttaactagttagattgacccttgcacaatgtatatatacttcaaaacatcatgttataaacaattaaaacataattttaaaaagccagtatgatttctacaaatacaataacatgggaccaaacagcaacagacctcgagttcaccacatattttatatatttataatttcacatatactcacagtgtttcattccacatctattcccaaacttgaatgcatgtgcatgcacaaacaacatatacatcacctccttcactgagaaattacagcaccattatttattcaaaggcactaactctgacaagagtgaaacagaaggtacttctctattatatagtgtctattttctgattttctttgttatatttcattgtatttattaatattaggttaagcaagaatgtacaaagccatagcaggttgggaaggttatcaagagaccacctattctttttcttcaattcaatctcttttcagattaatcattcttggctattctgttttttaagtaatttactttttcttttcacttactcacctaattaatctattaacagagtgtcaacaattgctgtttcactaaaccagtaaaagacaactgctttggtgataatgttttattttcaagcaggtcatgattatacttatcacattattacacttactacatttattacttatcatatttattgcaataatcattatcacaaaaatgatccattgattctaactctcaggaggcactcaataaatatttagtcaatgagtgaataaatgcaatattggaattaaaacatactctcaacatttcaaccaaatgctttattacaaagcatgggggaaggaagcatagggttggactttgtgcactgaaacagttatatattttccgtagcactaaatctttttctcattaaaatgcatataatgtgcagctattgctccaggaggacctgctgtatcctgttaaaattaccgtcaccaatctgtggattagctaacagtaggggaggatatggctgatgtttgtctgtgtgtgtgtattttgatgattgaagaaaagaagtaatggggattaacattctgcttttacaagtataattgtaagtttaacacagggacaactttatttttagtgtaatacatctgtgaattatgaattatgatatgttcaggtcatgcttttttgcattcattttttacttttatggagttggagtaaactaacccaatctatgaatgaaattcaaaactgtacttgaaaatgaaggaaaacggcattatttttcaaatattgagtataaattatcacaacttcgttaaaaaaaaagatactttagaagtatacttaacttagtctattacttctccaaatagatgttttaaatgttttaagcatctgctgtaaaaattaacctaggccaatttggatattcagcaattatcacgttattagagcaaagtttggtagaattctacaattagagacaggtggatgattcatggcaaccttttctccataatcttgctaccaggtggtatgctaaaattaaagcaagcctgagattaaatagaccaaattctgtcaaatgtaccaacatttagtcgcaaatagggcacaaaagcagttattgaacttaagccttcaagttctcagtctcaatctgtaggaacttccacaaatacccttccaagagaggttcattatgaggaagatcagccagccttctgagttacatcagggacagaatcttccattaaatcgaatagagggtagaccaaagggagtttagacctagacctagtgtacttacctgatggtattagacttctagccttgatgagtcttatgcctcattcatgataaggctcataaaatctatatagcaactgaacattttgaacaccactcatttcatcaacaagtaatgatttcaagcatgccttttgtgaattaatgaaacctctctgtagattttgataatgatacttgaaattcttgggtggcatttttagagtacagattctggattagggaacataaaattctaaccaccttaggagtaggaatcaaagttaatatacagatacgtaacttacagtgaagtattttaaagtaaattagcacatctgttgcacaatagctttccggataggtttgaactataatgttacatccacattacggagatattaattgaaataagtaatacttcatagatatcctatacatgttatatatctatatctaaatcatctatatctatctattacatatttatcacctatttacctatctctatacacatatcattgtaggagtagaaatcacagaaaatgagatcatttgaaccaatggcctggtttgtgtcatttaaataatcttaaatttcaaccatataaactctcagatactcaaataatgcaaattctgcaggtatctggagtaatcgcttccaacattttttgtttttgagacagggtctcactctgtcacccaggctggagtgtagtggcacaatctcggctcactgtagactcaacctcctgggctcaagtgatcctcccacctcagcctcctgagtaactgagactacaggcacgtgcctccacacccagctaatttttgtatttttagtaaagacgggtttgtgctgtgttgcccaggctggtctcgaactcctggactcaagcgatccacctgcctcagcctcccagagtgctgggattttaggcatgagccgctggggctggcttctttcaacttttaactctgttgactgcatataactttttcatatttaagaaatgtgttggttgttgaagaagaccaagtctgaactcaaactgggttcttagaaagctttgaaaggaaaacagggacaaattaagtgtctgcctctgcccaaaggggaagtccctaaaagagaaaagtttaaagacatcaagaatagttctgatgcttgcctaaaagttaagtctagaagtagagtaataagtaaagtttcttggaaccttttcaatccagctagagagatacattatgaccactgataatggtgtgctttctacctctcagtttaccctttgtaaataactcaaatggtttgctttgaactggcatatttatttattttccctctgggaaaccacctctactcatattcccgaataaactgttttcctataatcagctatgtatgaaggctttagatatcaacagaactttccataatatctcttttaaggtgaaaggttcagaataaatctacctaagattaaatgctccttaggtggaaccactgagcctcatgctacctacatgcctatgacaaacaaatttttatttcatatgcatactctgctgaacaatgacttatatatccaaatacctactagaaatctactcctgaaaatccagcagacaattcaaccacaacattcaaagcaaaaataatggtttcttgcccagcccattcttccccatctcaattaatgtttgcaacacacccactgtgactcaagccagatacctaagagtcattctctatttctctccagcccttatacccaacagccaatctatcatcatttcttgtgagttctacctctgcagctattcttccagtgcaagcctccatcacctctcacctagaatgttgtatttgttatattttaggcctcctttctttctactctagctctgtttctttggtcaacacagcaaatgaatgataattaaaagaaaatgaaaggatcatatcacttccttatttaaaactctcttttagcttctgtctaaacatggaaggatcaaaatccctactaatgccctgcaaatcctgcatctccaatctcagtttctcacatcccatcaatttcctgttcactctggccacacagtctttcctcttgtttcaaatggaaaattgacatagcccaggcttaggagctttgcactcactgttgcctctgcctggaaaactctggcctctgagagtcacctgtgtggttccttgatatccaggtctcagctcaacttttacactactgtgagaacatccttaccaccttttcttaagtagctcagcaatgcccccaggcaggcactctctgcatccttaccaaccttctattttccaggggattttttactaagtaaaagtttcttgtttatttagttgtttggttactgtccttctactctaattataatgtaaattccctaaagtcaaagattttgcttctcttccgttgtactctacttgccttggcacatggcaggagcccaatgtgtttcataaggaaattaagattcctacctggtaaggttattctttcaagaaaaggagaatccaagtgacctttttccaaagtggttgaggtccttggtatcttgctgacttggcagaactgttctgagagcctcagaaattgaaccacgttatttaaattcaactctgaatgtaaagagtcaccaaggggccactaggatgaatcccagcatctctcatttcctcaggccccctcatccttctgtttgttaaatcaatgctggaggaagatgggtggcatcacattcaatgacaaggatgccctgtgataatttgcatcatctccaaagaggattaaaaggggctgggtgcggtggctcacacctgtaatcccagcactttgggaggccaaggtgggcagatcacttgaggtcaggagttcgagactagcctggccaacatggtgaaaccctgtctctaccaaaaacccaaaaattagccagtcgcggtggcacacacctgtaatcccagcttcttgggaggctgaggcaggagaatcacttgaacctgggaagcggaggttgtggggagctgaaatcgtgccactgcactccagcctgggcaacacagcgagactccatctcaaaaacaaaacaaaacaaaacaaaaaccaaagaggactgaaagggatttattaaatctcagcgccccaagccagtggttctcaaagtgtggtccctgggccaggagcatcaacacaactaaagaactttgttagagacacagattatcggggggctcagccctgacttggagtatcagaaactttaaacctgtttgaacaagctcttgctaaaatatgagaactaccatgctaagacaacagtgccaaccttgattgcaccttatgattacctgccaagcttttaaaatttatcaggcctgagcccctctgctacaagttcttagtcggtctgccgtgagtgagatctctgtattatttaatttctactaagtgatgctgatggagctccaaagtttagagtcattgccccagtgtgggagcagggtaacttcaggtttatccaggtactttgtagattttcatcctgaaaagaaatataatttggaattcaaacatggcttgcctctcggttttatagtaggagagaagggaaatgacttggcctaaaacacagcatatggttctaaatgctagtgttgtatagcctcatccaaagcatcaactcatagagaagtacattaaagcagtgtaatgttcaaaaccaagttccatagtaagcatctgctataatagaatgacttattccagaagggaagtttcatttcaggagagcttatcatgacatcaaatatgttttgagttaatgaaaatgcaggaagcaccaagttaatagggcaattttaaaccataaagcctaatttaactgcgctaagaatgacaatataatgctctgcacaaaaggaagtttcacaacctgattgatcaaatggagaattactaggatgctggatcgcatcttccttgaagaagctaagttgactaggagaggcagacttccttagaatgcagttatgtacttcttaattaaacaaagaatgattaaaaagagattttgctttataaggccacagaacagcttgtttgataaaattgttataagcctccagactttcatttctactttaatattgattccattttcagaaatagttaagtagaagttattcaggttcttctttatatatttgcttttttagttgttgttagacgtaagataaatttgaaatgtcaggaaggagaatgtttattttcacaataaaaagcttactctgtgtaatattgaaactatccattctgatataagataatgttttattttggctgcttaatttcaaattgaattatttaatagaacaattaaaagtcaatacaaatgaaacagctacttgtttttctcagtttatggatgttttataaagtgtaaaagcagctgtttcgttatacttttcttgaattgaatagccataagagctttcttaaaatcatatttgatccatagctctttcttttatagcttcttctatataatttacttctaagtaacatttcctttacatataaaaattgattattactgtcttgtgttaagaacttttcctgggtctccttaattcatcagaatgccaatattacgattagcaaaaccaattaggccatttatcgcagagaatattggaaatgtgctatatgcaaagcattgttttacaagtagttcaacattctaattttgaaattagactaagagcataatacatttagaaaatgtggatagttaagtttaaatttaaaataataaaaagtcaagaatattacaattttacttcctcagtcacactaggcacatttcctagactcaataggtgcacgtggctagtggctaccatagtggacagtgaagatacagaacatgactatcatcacagaaagttttgttgggcaggcagtgctgtataggctagttagtgaggaaatacatttttaaaaagcattgttccctggggcattacaggataaatttaagaattctgtttcataaggaaatattatgccacacatggagtctttcttaaaataactgaccctctagaagaggaggcctaagtgtacaacctgttcatttcctatcggagttggttgcctggaaatgttgtacatctcagtttcatagcaaggtcataaatgttttgtaggccgtatcctctgttctatctactatccccacagcacaaagaaataattatgtgcatagagtggacacccaatgaatctttactaaaagcaccaaagtaatatgaggcaaggagatactacacagatttcaacctttgaacttgaacagtagtttgtaactcctggcccagtctagtactagattgtagggtcctgatgaacaactgtaggccaggatctccctctgtttcaggtgccttgtggtaaaatcacatgaccactgaaccctcaaccactccctgaactagatgctaccaacaccaacacagaacccctttccccataattccttccttatccctggtccaggaccagccaacctgaacatagactgacaagcttctcatgattcaattatctaacttaagttaccatatgacttccttcaacaaaagttacccattttaaaatctctgtttctttctgtattataggagactcatatcccaaatacacacacacacacacacacatgcagacacacacacaaacacacacatttatatatatgcagaaaagcaatgataaaatctctcctgccaaattagcaatatagttttgtttcaaaatatttatgcataaatttcataaggtattctgacttttaatttgaaatttaattcaataaagattacattagtcagaaaaaactcatctttggccaggcgcagtggctcacgcctgtaatcccagcactttgggagaccgaggtgggcggatcacctgacgtcaggagttcgagaccagcctgaccaacatggagaaaccccgtctctactaaaaatacaaaaaaaaaaaaaaaaaaaattagccaggcgtggtggtgcatgcctgtaatcccagctactcgggaggctgaggcaggagaattgcttgaacctgggaggcggaggttgtggtgagccaagatggcaccgttgcactccagcctgggcaacaagagcgaaactccgtctcaaaaaaaaaaaaaaaaaaaaaaaaaaaaaaaaaactctccgtctcaaaaaaaaaaaaaaaaaaaaaaaaaaaaaaaaaaactcatcttttaatgttagtttataatttaaagacacaaaaacagcttcgtttctagattcaagcaaggcatgtatttccaaaatatctcttcatgattgccccaaatactggatctcctttcctgttggactgtatgtatctaaaatgtacagagattattgaaaaataagttaggatagggactattaacacaattttgttctgaaaatcttcccttaatacatcacatgggtttttgaggcagatgtttggagggcatgatttttagggcagaaccagcacaagttgcaagcaatgcctggacacctgttgagcccttctgtgccatctgcttaaagggaagtacacataaccttaaaatcgttgctgcttttggaggtcattttatcaggattgagactacatcccccacaacccacaggacttaaaaagagagagatttatctcagaagggcattgtctctaagtgtgatcttcatttttatgagctgagcttgaagtccctgacatttagaaatgatagtgtgttgatgtgaggttctttcgaataatccttctaagttttatcagctttgcaaaatgttactaagtgctagcatttagtttgtgaaatgttttaactattgagaaggtgatgttggtcagtccttaactaagatcgatcaaagtaagttcagtaggtgactgttttacaagtggcatggtggtggtgttcctcaaaggttttggagagatacaaaaggactctctagttgtggttttaagttatatactcagttttatatcctgttaaagtttttataccatattttaaaattgctgtttggaattacaggaaatgtttaattcacaaatcatttatagttacaggaaatataattctattattgatataatgaattgaatggtttttaatacatcgtagttttaaacacttaaatattcacgagtaatatttgggaactttaagaatagcatccaaaaggtctacgtgttcatgtgtatgtctgtgtttgatttggtgggggccattggccaaagtttgatcccactcatttgaacagcttgctcagtatgtgcatcattggggaaaaaaatcggcatggagcgttcggtagctagcctctagtagaattatcagaggaaaactgtgatggtgaaactgagaatttgaaaagccagattgatgttttccaagcttgatttttagatgagaaagtaaaagagtattttgatttaacatttgaaattataatattagtagcaataaaatataccagtgcttctcaaattatctgaggtggcagaccaggtttttaaaaatttcattttgctttaattttcaatctctcaaggaccaatactttggtaaaataccataaatatcaataactagaaacaacgatgttaccaaaaaaaagacatacaaaaatacaagccagggcttttaatattttttttcatttaacagatattatcaaattgctgtgaaatttactaaatgttcactctcagtttctatacttttattgtagaacaacaaaaggaatttgttaactggctgtgctctgtaggctttttaagtagaattgctctatgtcactgtgcattaaattttgtgtttggatgtatcctaagcaagctatgaggtctctgaggaaaaaattatatatatatatatatatatatatatatatatatgtgtgtgtgtatatatatatatatatatgtgtgtatatatatgtatacatatatgtatacatatatgtgtatatacgtgtacatatgtatacatatatgtatatatgtatacatatatatgtgtatatatgtgtacatatatacatatatgtgtacatatgtatgcatatatgtatacatgtgtacatatatacatacatgtgtacatatatatgtatgcatatatacatatgtgtacatatacatgtatgcatatatacatatatgtgtacatatatatgtatgcatgtatacatatatgtgtatatgtatacatgtatacatatatgtatatatgtgtatacatgtatgcatatatgtatatatgtgtatacatgcatacacatatgcatacatatatgtatatatgtatacatatacacacatgtatatatgtatacatatacacacatgtatatatgtatacatatacacacatgtatatatgtatacatatacacacatgtatatatgtatacatatacacacatgtatatatgtatacatgtatacacatatgtatatatgtatacatgtatacacatatgtatatatgtatacatgtatacacatatgtatatatgtgtatatgtgtatatgtgtatatatgtatacatctatgtatatatgtgtgtatatatgtatatatgtatacatatatgtatacatctatgtatacatatgtgtatatatgtatatatgtatatatgtatacatatatgtatatgtgtgtatatatgtatatatgtatacatatatgtatccatatatgtgtgtgtatatatacacgtgtgtatatatgtatatatgtgtatatatatacacgcgtgtatatatatacacacacacaatttatgtgcatgaattgtgtgtttttattttgattataacttttaaaaagtcatacaagtgtattctgcatcacttgactgaccaaaatgtacacttgcataacataagtgctcaagtttgtgtttatgtttacaatgaagtcaacaacaagtagcattactttaaatgtcagggtctgataaataaagaccagaggaagctaaagaaagaacatgatactttgaacaatcctctctattaaatgggaaaattgggctttagatctgagtgttttaatttctactttaatatgcttgattatagttttaagatgaatgcataccagaaatgaattgatttatataaatctttcattttaaagcagattttatcattttacaatgtgtgagaaaagaataaaatcagacccttgattgacactgttctttcaatcagtttatgaaacattttcctctgtgtctaccacttttatttgcataattaaaaattttaatgctaaatcagaaaccaaaaatggaatgtgcataaaatccccttggactatgagtttggagagttggcattttttctggcgtgatctgctataggcttactgttacttagggcccggagaggtgggtcagggaaaacattaaatgtattcagggtatgatccatattctatttttaagttttatgctgtttattttgagggaagagatactgatatagtttggctgtgtccccacccaaatcccaccttgaattgtaataatcctcacctgtcaagggtggggccaggtggagataactgaatcatgggggcagtttcctccattctgtttttgtggtagtgagtaagtctcttgaaatctgatgattttataaatgggagttcccctgcacaagttctcttgcttgctgccctgtaagacatacccttgctctttttctgccttccaccatgattgtgaggcctcctcagccatgtggaagtgtgagtccattaaacctctttcctttataaattacccagtcttgtgtatgtctttattagcagcatgagaacagactaatacagatacaaacatgtaaagtgcagaataaggtcctatatgtcaatgggccaacttgtgtgttttgtaattaaatatactagtttagagaaaaggaagctcaagctcaacatgaactggattcatcagtggtggtctcaccgaggaacatgaccaaacttcagtataaattgtgtttacatctcttcttaaaaaaataattaaatacatgttattattgtttgaaaagttatttaatactgagcatctacacattaatcatgatgaaaaaataatattaaacttttgtatgtcctgctagcttaggaagaatgacactgacaattatttcccttaaccattgtggtaagccaagtattagttcatagcaaatatttcatttgtagatttcagtttttttcactatttctacttttcatacaatatcattcttcaaatgataaaatagtacttagtgaaggatttgggagcatgttaaagttatttagcattaattgcagcattacactgggacacatgtacttctatttctgtaacatatcactcatcatttcactcagataaaggaaatattaaacattttatcagatggggaattcctggggtcacactgtagcagatgagttgggattggtataccttctccaagcttcctattagttacacacgcacacacacacacacatgcacgcacacacacacacactccagtttggaatctgtctagccaagaccacagtgcaagatgttaaaagcactccacttgctttgggcatatgccaggcctgaatgagtctcttaccattgggaaaacgatctatatttaaatttttctagatactatctattaaaattattctatattaccaaagaatggaaatattttccggaaagttcagagtagcaacatattccttaagcatgtttccacttcaaaagataaaaagtttagaagacatctccatgtcctcaaaaagaagtaagaaaacattataattattgattaaaagctgggagccctagaaagaaaccttggagatgaatgacaaggatacaaaaggatttgtcaaaatgagaaaagaagacaaggaaactcaagtacagctagcgatataaaagctgcattgaagtctattatagtcttatatgacagaaaaaggtgaagaaaattgtatataagtaaggaagaaatgtttatagatgaaaaattatatatatataaaatctatagattatatataatatatacaggaagagagagagagagggatggaggcagggagggagggagagaaatagagaatgagaatgtgatgaagggcagagaatagggatcagaaatacagctgattcagttgaaggaaccagaaaatgggagggggcaatatatttgaataaaataattacaaatatgtaataaggataaaaacataagtctttttctgttgctcttgctctatgtacatgtgagcacacgggcacacgtgcgtgcacgcgtgcacacacacacacttagaaagttgaaggctttgtagttaagtagggaatttgtagtatgtagggaatttcaaccttgattcagagtgacaggcaaagatttcaaatggaggtatatgtgtattcttcaatgggaggataaattgaaaacataagtaaggcataaaatgtatctaaaaaattttaaccttactaaattccaatgaaatccaattatgattttcttcctaaacttgacaaagttattcctaagtgcatctgaaaaatatagcaaagaatatgattataattttaaagtaatataggaggacttgccataccagataatattgtcatgggtcaatcatagtctttaaaacaatatagtactaacttcaggtgagcagacaagccaagggacataacagatggccctgaaattgactttatcatataaaaagactagtatttaattttttaaagtatcattaaccagtagggaaataaccatctaaagaatatatatctattagccatttacatatataaccaattaaatatataggtttgactatgtgtctccactcaaatttcatgaggagtcgtaatctccagtgttggaggtggggactggtgggaggtgattggatcgtgggggtggagttctcacaagatctggttgtttacaagtgtgtggcacctcctcctgcacttactcttcctcctgctctgaccatgtaagatgtgcctgcttcccctttgccttctgccatgatagaaagtttcctgaggcctccccagaagcagtcatgcatactgtatagccttcaggaccgtgagccaattaaacctctttactttataaattacccagtctccggtatttatagcagtgcaagaatggcctaatacaatatgtaactatttaaatatatacaaaatcattcaaatatgtatagaaccatttaaatacatatattaaattatatatatataatttttcaatttcacgtaatctagagagtttatattaaaattgaaacatgacaaatgagaaagctattggttaataaatctctagataaagcagaacttttcaagaatttttatttaaaaatgaaagggaaacactgggcatggtggctcacgcctgtaatcccagcactttgggaggctgagacgggcaaatcacctgaggtcaggagattgaaaccagcctggtgaacatggtaaaaccccgtctctcctaaaaaagtaaaaattagccgggcatggtggcatgcacctgtaatcccagctacttggaaagctgaggcagaagagcctcttgaacccgggaggtggaggttgcaatgagccaagattgcgccactgcactccagcctgggcgacagagcaagactctgtctctcaagacaaaaaaaaaaaaaaaaaaaaaaaaaaaatgaaagggaggatccttacaaaaggaaagatgattttgatgcattaaatagaaaacatttttaacaacagcaaaataaataagataaaaagattattggctaattaggtaaaataccttcaacaggtgtgatgcaatttgatttctgatacatgaattcttcaagtcagtttttataaagtagcaaagcgcatgattatgcaattaaataaataataagaacacataaaatagcaaagaaacatatgaaaacatactgaacatcatgagtaattggtaatcaaagaaatgctaaagtaataagatacaatctttcacctgataattttgtcaaaaatattaggtaaaatagtcaccctcatacactgctagtcagaataaactgtttttgcaggacagtttggtaatagctatagggaatcttaggtttaataatttgtaatcttgatctaacaactcaaattctgggagtacatccttaagaaaataattagacttttacaaagatttatataacaagaggtttatcactttgatatttatagtagcaaaaaaattaatttaccaaaatcataaacagtaaagtagttatctatgaccattcaatgaaaaactggcaacccttaaaaatatgcttaatggtaattttttttaagtaagtgaactaatcctgttttttggatttggattgtcttttaaataaggtcttacatataatcttaatctaacacatctaaccacattgtattaaagtaaatgtttccaataataccaatgttttaaaatttatagagttgcaataaggttcagtatgtttgttattaatttccatcaccgctccatgtgtgcttggaaaggttttgtattctgaaattgttgggtacataagatcaagtttcttcattgtgtttctcaaatcttatgtatggtacttattaattttaattttttgcctgttttatctatcagtttgtaagaagagtgttgaaaagctacaactaaggtggtttatttgtatatttctcttcatattctgtcaaatattaatttatacattttaacatatatattatgttcttaagtgaatgattacattttcttggaatatatcttcagtacacctttctggtaaagtgaaactcttacaattatgtggtgactctctatctccaatactactcagtctttaaagtctatttcatgttttattaatatggttaaaccagctttgtttgtattttctatatataaatatttttatatgccagcctgtatagttttaattgaggtgtgcctcttataaatccatttaactggatttgatatttgctttgttcctgtatgacagtctttgcttttcaactggaacttttagttaatttttaattgtaatgactagtgtctgtaatcatgcctaccatattctgctcctgcttttttttttttctttttttttggggggtggggggatacagtttctctcttgtcacccaggctggagtgcaatgttgaaatctcagctcactgcaacctctgcctcccgggttcaagcgattctccagccttgcctcctgagtaactgggattacaggcgctcgccaccatgccaagctaattttttgcatttttttttttttttagtggagacggggtttcaccatgttagccaggatggtctcgatctcctgacctcatgatccgccctcagcctcccaaagtgctgggattacaggcgtgagccaccgtgcccggccgagtttgaacgtttttatacttgatctctattcttttcatgatcctgcagaaaatttgcacatatgcttaacttacgaaatctacttttagctatatctttactcgccttcagaacaatgtaagtacgtaggagactttattcctgtttctctgtattttagtcatctttttttttctaattcacaaacgggacgttatcatcatttctttatgcagtcaatatttgtttaatgtaagccccatgaaggcaagaagtttttattgtggtggttgttcaatgttatactccaaacacataaaacagatcctacacatagttattatgcctagataattattaaataggttgattaaatatacccaagtcgttaacttttttttttttttttgctcatcataccttcctgcatccctctgtgttagttttccttctgcctaaaaagtaattgtttataatttccttcagtaagggtgtgttggtaccaaatactctctgtttatttgttgcctgaaatgttcatattttgctttcattcttgaataatactttgatggttatttagttctaaatttttttaagcagagtgtagtattattccacagatctttacattcattgctgcctgtaagaatttggttgttagttttattgttatgctcttgaaggtactctgtcttttctctcttattttaaaagttttctctttgtgtttaattacatatgatttcactatacatacatagcagcacatttccttttatgtattatttatttatttatttttattttattttatttcattttgagacagtgtctccctctgtcacccaggctggagtgcagtggggagatctcagctcactgcaccctccacctcccaggttcaagcaattctctgcctcagcctcccgagtagctgggattacaggtgtccaccaccacgcctggttaattttttgtatttttagtagagacggggtttcaccatgttggccaggctggtctcgaactcctgacctcgtgatccatcacctcggcctcccaaagtgctgggattacaggggtgagccaccgtacccagcccacatttccttttatttatcctttttcagattcattagtgttcatgaatctggaaatgtctttcactagttctggaaaattcttgcctattattgtttccaatattatgtcagcctcattctctttctcctcttctcatggaattccacttagaaataagatatattttcttattctatcctccatatctccaaccctagtctatattttccttctctttgatttgttcctgcattgtggaccatatctttagatcactgattgtttcttaggtgtttctaatcagctgttaaaatagccatttgttcttatattcaataattatatttttctttctaagacttatagagttttttatttccaagtctgcttaacaattttacatagtcttttgtttcttagtcacataataaaccccttcttttacttcttaaaaataaaaggtacttttaaaacatgcttactttataattaatttcgaatgatttaaatatcccaagactttgttagaatctgctgtctatattctctacttgttcccactcctgcttgtttgcttccttccttccctcctttctcctttctctctttctttgtagtatgctgcacagttaggaaatacagtctaacgtatagtgacaaaagaggggggtcagtgattctcctgttatatgaggtatggggtaagaggaacagagagaagtagaaagaagggtggatatattagcagagttctctagagggacagaactaataggatagatgtaaatatataaaggggagtttattaagtaatattaactcacacaatcacagggtcccacagtaggctatctgcaagctgaggaacaaggaagccagtagaacttggagttcaatgttcgagggcaggaagcatccagcacaggagaaggatgtgggctgggagactaagtcagtctagccttttcacgttttttttttttttctgcctgctttatatttgctggcagctgattagattgtgcccaccggtattaagagtgggtctgccttccctagcccactgactcaaatgttaatctcctttgacaacaccctcacagacacactcaggatcaatatcgcatccttcagtccaatcaagttgacactcagtattaaccatcacaatgggattaccaaagagcacaagaaaacttttggaggtgatgtgcatgtttctgatcttgattatgatgatggtttaacagctgtatacctatttgaaaacttaccaaattatacactttatgcagttaattgtatgttaattatacctcaataaacttgtttttcaaacattggacacatagataaccaaaatctttataattgttagtcttctacatggaaaattcatttataatttcactttcattttttcacttttctgcatgttggtaaaagcacaccctttaacacaggaatttcatttttcagaatctattctcaccaagtcaccagatgaacaatagatcatctacacagttataaatgacaatattgataagaaaaatgtgataagaagaaacgcttagaagcaacttaaatgttgtacagtaaaagtttgatagacagattgtgaaatatatatgctagaatataaaacagtcaacattatctggagaggactttatgatttaaaatgtttcagtcaacaaaatagcacaaaacttttagttgtttacactgtggtaataatttcataaagattcgaagagaatgaaataaggtaagccaaatgattaatgactgttactttggaaaagtagagttgtggataatttttatttccttttttatgcttttcttcatactccaaattctctaccatgaatatgcattacttttctcatcacatttttttgaaaatgactaaaaggaactctcccaaataattttccttttatctttcaacgaaatggcttttaaaagaatcctctcatagaggatttgaagcacgtcaagaaaattgttcagaacggctgagagtcttatggtgaatgtgacaaggttatagtccaagttttgacatgttcatcattaacgttctgctggtccctagcctgtctcagtggatggagatgaattcattagagatgagtaaataaaaaagtgattttctctctaaattaatataacgacacacttttatgatgaattttctaaatcatttcaggttataccttcctctctgtgagttcaattatctttgtcataaaaagcttcttttccatagacaagctttacccatttttcatagcctaatttaactgtaaagctgttaacatcctaatttaagctgatgataaatagtcttttaaccgatttgaaatttttgaaattaggtggtataatattcatagatataaccttaccaattgtgaggtgaaaaaaaattcaaagcataaatatggctttaaccttgaaacctgacaggcgtttgaataggaaagagatgagccatttcctgtatttaaatttctctagactccccgtgccctgtgtgccaccattttgattaatccttcttaaaacttatcttctattaaatgtgtgaaaaacatatgtttctcattgttaacatctcaatgttttactcaagaattggataatctgaggaagtttcattaataaaggaaaatatatatccgggaaatattatgtatgtatgtatgtatttcacacctttctctttgtaggttatcaaaatagtgtgaaaaattagaattaggcttagaacaacactatcttttactctaaagctctctagaaaaggtccctaaaattaatcaaaaatgggcactatgtcttctgttttaaataaataccttaataccttacaatacctcttttacaatgatgtcatcttcttactagccaaatgccaagattctgatgtaagagagtaaataacttgtgaaacaaagtaagagaatctaaaaaaaaatcagtttgcttggggctttatttgtatcattattttctagcattttaccaattcatttgtgtttcaatcatccatgatgcattttcttaatgctggctgctttcattttttattttttaatttttaaaataatttcaacttttattttagatttgggggtacatgtgcagatgtgttacatgggaatactgcatgatgctgaggtttggggtatgattgaacccatcacccaggtagtgagcatagtacccaatacgtagtttttcagactttaccccccttcccccgccctgcatctggtaatctgcagtgtctgttgctctcatatttatatctatatgtactcaatttttagctcccaattataagtgagatcatgcagtatttggttttctgttcctgtattaattttcttaggataatggcctccagctacatgcatgttgcttcaaagaatgattttgttcttatttatggctgtgtagtattccatggtgtgtatgcaccacattttctttatccaatccacccattgatgggaagctaggttgattccatgtctttaccattgttaatagtcctgtgatgaacatacaagtgcaggagtctttttggtagaatgatttattttcctttgggcatatacccagtaatgagatttctgggttgaatggtagttctgtcttaagttatttgacaaatcaccaaactgctttccacattacctgacctaatttactttcccacaaacagtatataagcattcccttgtctctgtagccttaccttttgttttttgactttttaataaagccaatctgactggtgtgaagtggtacctccttgtggttttgatttgcatttctctgatgactagtgttgtgatgcattttttcctgtttcttggctgcacatacgtcttcttttgagagtgtctgttcttatcttttgcccgtttttaatggggtaatatgttttgtgtctattcaattgtttaagttccttatagattctggatattaggcctttgtcagatgcatagtttgcagatattttttcccattctgtaggttgtctgagtactctgttgatagtttcttatgctgtgcaggagcttagtttgattagatcccacttgtcaatttttggttttgttgcaattgctttagaggacttagccaaaaattctttgccaaggccaacgttgaaaagggttatttcctaggttttcttctgggactctaatggtttgagaacttacatttaaatatttaatcctttttcagttaatttttctatatggtgaaaagtagggatccagtttcattcttctgtgtatggatggccagttattccaacaccatttattgaatagggaggcctttcctcattgtttaattttgtcgactttgttgaagatcagatggttgtagggtgtgtggctttatttctgggttatccattctgttccattggtctatgtgtctgttctcgtaccagtactgtgccatttttgttattgtagccttatagtttaaagttgggtaatgtgatacctccagctttgttctttttgcttagaaccgctttggctatttgggctcatttttggttctgtataaattttagaatagtttttttttcctaatcctgtgaaaaatgatgttgatagtttggcaggaataacgctgaatctataaattgctttgggcagtacaaccattttaacagtattgattcttccaatccatgatcatgaaatgtttttccatgtgtttgtgtgatttatgatgtatttcagcagtgttttgtagttgtccttgtagagatctttcatccccttggttaggtgtattcctacatattttatttttgtatgactattgtaaatgggattgcattcttgatatggctctcagcttgaatgctattggtatatagaagtgctattaatttttatatattgattttgtatcctgaaactttaatgaaatcatttatcagttctaaaaggtttttgatagagtctctagggttttctgggtatagaattgtattattggtgaagagagataatgtgacttcttgtttttctatttggatgcctcttatttctttctcttgcctgattgttctggctgagaattcagtattatgttgaataagggtggtgagagtgggcattcttgtcttgttcctgttcttaggatatatgcttccagcttttgcctgttaagtatggtgttggctgtgggtttgtcatagatggctcttatttttagttatgttccctagatgcctagtttgttgaggctttttataattttataaaatccctttgtataagggatgttgggtttcagcaaaagccttttctgtgtctattgaaatgatcatatagtttttgtttttaattttgtttatgtggcaaattgcattgattgatttgtgtatgttgaaccaagcttgcattccagaaataaagcctactaaatacctatatcaagaggttatacaaatctcaaattaatgatctaacatcacacctagagggactagaaaaacaaaaacagtctaaccccaaaggtagcagaagaaaagaaataattaaaatcatagcagaagtgaacaagatagggaatcaaaaattcatacaaaagatcaacaaaatgaaagatgattgtctgaacggataaacaagataaatagactactagttagatcaacaaagaaaaacagagagaagatccaagtaagcccaatcagatattacaaaggtgacattataacaaatcccacagaaatacaaaagatcctcagagactattatgaacacctctatgcacagaaactagaaaatctagaggaaatgcataaattcctggaaacacacaatctcccaagattgaaccaggaagaaatgaaaaccctaaacagagtaatattgagttctgaattgaagcagtaataaaaaacctaccaatgaaaaaaagccctgggccaaatggatttgcagccaaattctaccagaagtacaaagaagagctgctaccatttctactgaaactattccaaaaaaaaaaattgaggagtagggactctccctaactcattctatgaaaccagcataattctgacaccagaatctggtgaagacacaacaaaaaaagaagactataggccaatatctctgatgaacatagatgcaaaaatccaagaaaatacaagcaaactgaatccagcagcacatcaaaaagttaattctccatgaccactctttaaaaatgatatttaatgtgcctcattttccttcctccccccccactgaaatttgcttctatttcatcattcctgttgcatctaacactgagcaagtatcttaggaaacaatacaattttgtaaaagatgttctgcagtagcctctatgtaaatatcgtttatccctctgtcttattaccaagataatggatgtgctttttagctctctctgttatatatatcctctactttatgtgtgtgtatatatatatatatatatctcctctgctctctctcctttagctctaggtttcaatattcattcccaatatagcaggcaaacttttactttgagaaacttaaaactctaatcagacatttcaattcctacatgccatctcaagcctaatttgggaactgtgggagcataataacgcattgtctatttcttcctttctacttttgtacaatagcttttgacttggagggagtttacttctacttgctgcacaattatcccaacatccagctcaatttcaaaggtccatttagctgctttggtggtacactttgacagcctattggccttgtagattttaatgcattttgcattatttatctcagttttccaagtatagtttttctgttgaatttctactcgttaaccaattttctggaaatgtttcccaattgatctgcattgcacctgtagcttattttttttttggttttggcaaaactcagctgaaaggtgtatgaagtacaatgtgatttcttagcacattgatggtactaagttggctctaaatgtgctgatgcatatagtacacttctgcaatgatgtctctctgggaaaccccatttaacttgagttacaataagcaaagataacagcaaagctctcagtactctttgagacaaaggtctcatacaattcattaaaattaagatgattctggctgcaagttatagaaacccagattccgattgattaaaataagaagggatgaatggtctcacttgacaggaagttcagatatgggatgggcttcaaggaatgctcatttagcaatgtcatcaagggtccaggtgtttttctcttcctctgctctgtaattcttagtatcattctatgtgtggtagaaagatggcttacagcagtcccaggcatcatatctatatccaggagacaaaggtaacctattttttcttatgaatatctcatatgagcaaggagatgtccctgtagtccaagatgacttcttattacgctttataggtcaaagtagtgtcacacgctggttctagagtaaaccatgagcaatattcctcttaaaatgatcaggccctccataaaagtgggatgagttctgtttttactgggacatatggatatctggacttgggaggatatctgatcaaaattggagttctaatagtacaataaaagtaaagaaatgaatgttggttgggaaacaatgtccaggttgtgtcatcatcattgaacagtggaaaaaaatgcagagggcagtgagagcccctgtggcccactggctgtgaccagcatgggtttctaaagcactggtgaaggataaaagaagaggacaataagaatgcctatattttggcccgaggcgaaaataatgaatagaattccttagtgggcagatactgtagtttggcccactcaacacccctttcatccctcttctatagagattggaaaggaaagtttttgatttcacagcctctcttgcagcttggcttaatcaaaagcagaatgctggccaatgagatttaggaaaaatttatcaggctgcatttgctgaataaatgtcaaatttgtatttggaagcacgatatctttcttgaaataaggaagataagaagtcacttattaaggacgttggagtaggaagtaagctgtgctctcagtggcatcactgagatgccatttgagtcttggactatatactctcaaaggtctggtcatgtgagaagacgtaaactatagcagtagctgaaagcaatgctatcaaatatagagtgctcaagttagttacataagtttactcatataatattccaattaacttagccttttaattgtttcccaaaggccaaatcagaaaaacttctcaaacagtatatatcacaaatatcttaactagtgcgaacccagaatccacctaatcacactcccagtgccttagcagagacaaccgtggctaattcttcaaggcgtcatttatatggataaatgttacatccacaactcatatctgaaccaaggcaggtttcataaatcagaagtctagtttgagcccccacgtcagccttattataacattcaacgtaacaaaggacggtgtgttataccttatgtaaactgacctttaaattggcctgaaaatattcacatgcatgaatggggctgtattacagcaatgacattgaaaattatattaaagacactttatttagcagcaaatttaatataacatttgaactgctaaaagtcaagtaggaagtagagagtactttcttcatttatttgatgaaaaaaaagcacagactgctttaaaaatataacttttgactacatacaaccagatgaaaaaagacgttaactagagggaaatttgtttcatacccataaatagaaactaacttaaaatgtaccatggtgggggggaaattagttgagaattacaaaatcctcaactgctttaataccacagcttcattccatttgcctctcaactattcctgctggggcttctgctatagtttattaacaagtatcagtgtttccattaccttagaaaaacaaaaccaacaatcatttttcaaaagacattcaaattgtcagtatgtaattattgctaatattaagaattcagtatgttaccacatacaacgcacataccaactatctactcattgagataaacttatatttccgaaatgaaaaaaaagccattataattaagactcaagaaaacttttccagtataaatatactcttaattaaagttgagataaagatatatctgtgagatagtttaccaaaatatttatgttaaacatcaggctctactatatttaagagtgggtttccatcaaaatacctcataattatctagttgcctgcatgtacaacagaaatacaagaactgaactggatgagtacaaaagggctttcaaatgtgtccactaatacagttaaaagaatataagctgctacatgtataaatacaatattatataagtatattatataaacattattttcattttatcttctaacagctttataatctaagtgttatataagtattttatatttatatgatatatacttataaatatatatcaacacttatataaatttatatatacttatataaatatagtataagctactacatgtataatatactgcatgtataaatataatataaaccatatacatggtatacagtttattctcctaagtaacaccaaccattaactttgtagtatatcatatgaaagagatgatatggttaggattcaataatatacagaggtatttgtcactaatagatgtagtcaaaaatcaaagacaataatgctaacattttttatattactgtttttagcagtggaatattttctttaagccacaggttacaaggcagtccaatgtagaacaaagataaaaacagctgcgggttgaagcagagctgactattcagccatggggagcttctcagaaacattagaatcctttatagggtctcaaagagacttgggacctaagtgttttctcctatgtcctaataattatacctattttagcccccctctggggacattttaagtgaccaagaattgttaagaggaaaatgggaaggattctgagctccaaactacatttcatgctggccctcccatcctcctaggacatctgattatttgtataaaggagatgtattagaagtccttggaattttctaattagaagttccagctctgattacttggagtttgagtaatttttcaagtaagtattagagtcaaggcttggacccagatatgactataaaactcatacttttaactaatttttatgtagttttccactgatacactagtggcattctcagccaactaattaagttttctctgctgaatgttttgaattctttgtcttgggtaatctctccctttaaaatgtaaggttgaacctgtagagctccatattgtcacttaattatgacaacatagatgagaaaagtacaaagctttgatgtgtctttggtggagattatatgacatattgaagttttgtgagatggctcagaaagttcagtaatagctgacgttgaaaagaatcaactcttatttatgcaggtgaataataatgtgactaatctggtattgcccattagtaattgatcatttctctctgacttgggaactatcgcctgtaatcccagcattttgggaggccgaggcaggcggatcacgaggtcaggagattgagactaccctggctaacatggtgaaaccccgtctctactaaaaaatacaaaaaattagccgggtgtggtggtgggcacctgtagtcccagctactcgggaggctgaggcaggagaatggcgtgaccccaggaggtggagcttgcagtgagccaagatcacaccactgccctccagcctgggtgacagagcgagactctgtctcaaaaataaaaaataaaataaaaataaaataaaacaacaacaacaaaaaggaaacagattttgaagttacatccttactgaaaactttgttttattttcttcaggtcacttacaagaaaccacttactcataatgaatttcaattatggcatgacctatgtcattatcctgggatttaagggtctagatttaggctgtttttattcacatggctagaactgtatctatttagaaaattaatttaactttaatgtatcaagactattttatatagcattgatgattttctacttcaaaagggaaagctttaagatccaaagacattgatttccaaactgggacaggcataatcctgaaccttaatcattttattcttagtgcttcagctttctattgaattttagtgaaagataacatggctctggacaaactttcgtctcttggagagagcaagttgacacagatctgaagtattttgtacatttgttgaatatgccacccagtcttccacaatgtgggagtgcaacatttaagtatcaaaatgaagcgaagttatcttggtgaccttctgacttctagcttataaaccattcatatggaagccagaaaatacagtcaaagatttaattttccaattgatcttgtatttagcatcatttagaataacaatctggatacttaatctagttttttttttaaatttcaatcagtttgtttgaaatcatgtaaacaaacaaagcctatattgtgaagaaaatacatttaattattaccgcctctaaataaatctagtttaaaacacatgtggtgaatatttgcagaaaagtgcatttaacaagtatgtggcattgtaatattaaagaactaatggaactaacggtgaagatttactaggcataaattatagaagcagataatgaggttattaaaataatatgtatctgtaatttttatataaaagactttaaacatttttttgaacttcttttttgtgtgtttacagatatacactttttttttttgcatgttttggtctacataggcagcatttagatatgctgaaggtagtctagtaaagtcttctgcctgagtaggatattttattaatttaaattacagtataatgttttaaataagaatgtatgtttttgtaagtgagatgggccactcactcatggaatcgacatatatttgttcagtaccaacaggatgctgacatggtgccagacagtgagaaggcaaggattgggttttattcaacgtggcagcctctatagtgtttaaaacattgctttaaaagctgttggtattctgtaaatacttgttgaaataatgaaaaaagaaaggtcctcgactttggagaattaaatatgcaggtaataacaatgtgatactacagtagaaggatggttcctatatttatatagctcagaagaacttatagtggaaggaatggaaagtttccacagaggagaaagatgaggaatttgatatgataataggaaatggtgtggccaaaggcacagcttcagaaaagaataaagtagccatatgtgaagaataaagtgtaaatcaatttaattggacatagtctccaatgtaaaggaaataaacttgggaagattgtgcatgttcttgaatgtggactagggaagtttgatctttgtttgggaggcactggaggcttttgggcatatgcatgataagattaaaggtccttcctgaagattaatctagccgcagtgtgtaagatgggttgtcacaatgggagataaaaatggggaaatccactatgagatgaatttaattggtcacatggaaggtaataaataatagcctgagcagccagatagtgttcctgtatttgagactgacctcgtttttccaagatgcttcaaactgtgagatatttccagaagtctcaagtgtgaaataatcagtgttactctaaaataacattatgcaaagctacctcacttttctggaaatcaggcatccaaaagtgttaaaacactggaacacagatacaaatctgaacttcttgttgagaagactagactattcactttgcggaaactgaaagcatgtatatcttgtttttgtttcattgccagcaccagtgccttgaagagtgaaaactgaagttaggcaattcatgtataagactttctataaaataattagtttctaaagggtcaattcttagaagtacattttagctttctgaaagacatatttccagggtagaactaattcttaaataatgatgaatattgaggtgtcataatttcatatttatggaaacattgtctctccttgtgtataacttaacatgtaatttgagatttaaaaatgaaggaatttgatttcatttgctgttatttaagctccctatgtctgtttaaattttgctctgaagaacagctgctctaaagtacagccaatatttcttcctttgggatagctagttccactgaaaattttgatatcgtcaaaatgtgctgtatgtgtgtctatgtgtagccaatctccctttctcacatccccggatacccatgtccttatgcctgccactggttctcaaactttaaagtacataaatatcaccagaaacaattatttaaactatatgttcctagccctacagtccctggagattcagattccataggcatggggaagcctgagactgttttgataagctccactaggcaattctaatgcatgacttccagagatcataccttaagtggctgtaacttaagctctctctgccttacttgcatcagatgtcatgttcctgactttaagtagcagttattatttaatttaattaatgaataaagtcaaacaatgtggatgtctagaaaatctcctctactgaaagagcctgaaatagggtgtgttgccttactagagtctgatcggtagtagcgtcatcccacattgagagctgcagtttcatgctctcaatcctgagatgttttacagcagggtaaatgatctaatttatagtatgtgctgagatatttctaaagaaagcttgtgtccgagggtagaatgttttatgtgtttaattacacttgagttccaatccaattcgaagccatgtctacaaaggctggcgtttagtcagctaaacatttgaaagcttctttgttcctaagggggaaagcacaagactaatttttctaacaagtaattgcaggtgcaagttatgtttgcaatcttaaaaaaggaagtgtctcagtgaaggggaaattaaatgagagggttaaacgcatgacctagaaaggatgtttgaatcacttgtgtttttccatcttgtacaaaaatccatctttcctatgagatagggctaatttaccagttgtgttccttttaatatgaggaagttgggggctggagggagaaaaaggtaggaagaaattagccaaacacaatcaccagaacatgttttttttttttttaagccaggagggagaaggtgaagatctacacaataaaggagtaaataaaaacacttgtaggggaaaaaaaataatggagtgttttctcatccactaaaacagtaaaattccatctttaggtttttctttgttcagttctctttggaaggaactttctcagctgaaattttatttgctgtttttgtgtcatttttgtcatcagaaaatatttccaagttaagcaatcttacaaagaagtatctcaggactatcaacattagtgagccgggtaccctgaagtgaggtactctttcctcacttcatagtgtggccaccatagccattcttgcctttcttcagtttgctgtctatcggtgtccatcagaaataccttgttggcaaaaatgtcttccctgcccatcttatttggtctattaatgatttcataaacttcaatatgaatctttatgagacctcctactccaaactggaagctctaatcccttttgcctctcctcctttggcaaccagttcctctctttgatgtccctagtttcctttctctagatttcttccagttccatcatgctttccagatatatctccaccaaaaccacctccaaaaagctaaattcttattggctgccgcagctcaacagcggatgctctggtgaaataagcataacaacaatagttgctttgtatgtagcagggatcagcacagttttcctgtaaagaactggataataagtagtttaggctttgtggaccatgtggttttgatcacaactattcaatggtaccagacaatacttaagcaaatatatgtgtaacttattcaaataaaacttttctttgtagaccttagaatcatttcatataattttcacatgccataaactattatccttcttaagattttaaaaatcattttaaaatctaaaaataatttttgtctcacaagctgtacagaaacaaaacaggccagatttggactgctgaatgtagttcgccgactcgggttgagagttttttgttttcacggtgtccctacctatcatctcatctaattctcccccacagtcttgtgagaaagttaataccgctgccattttataaatgtggaagttgagacttggaaaatgtgactgtcttgcccaaagaaagagaactaataacctgtgtttctggaacctaatcctacattgtcatgcgtccaatcctgtgttcttacctccataacacacttcatgctagtgttatatctatgcctgactgacacagttcaaatctccaaaccaaccaaattccattgaggtggccatttctataaaagctgtcctttggaaaaaaaatttatccaaaacatcaggactcaagagtgtaacagaaggagggcttgttaaaccatcagctgctggacataaccccaagaatttctaattcagtggttttggggtgggggccaaaaatttgcttttcattttttaaagttagataaaattcacacaccataaagtttactatttaaagtgttcaattatttatagagttgtgcaagcatcatccattattatctaattccagaacatttgtatcgccacacaaggaaaccctgtacctatttgtggtcacttcctattctcccctccccacctccagcccctggcaaccactgattgactttttatgtctatagatttgactaccctgaacacttcatagaaaaggtatcgtacatgtggttttttgtgtctagcttccttcacttagcataaggttttcaagattattctcattttagtatgcatcagtacctcattcctttttatggatgactaatgttccattgtatggatatactacattttgtttattcattcattaattgatgaatatttgtgttatttcagtggtttggtttttgtgaataatgtctccatgaacatgttttcaattcctttggctatctacctaggagtgaagttgctgagtcatacggtatctctatgttcaactttttgaggaactgccaaactgttttccaaaaccagctgcattatcttacattcccatcaacactgtatgagttccaatttttccacattctcgtcaacacttgttattgtctgtctttttgactactgtcattctagtgggtatggaatagcaactcactgtggttttgattcgcatgtccttaatgactactgatgttgaacgtagttttgcgggttggttgagaatctgtatttgtaacaagctcccaggagatgctgatgctacttgttcctggaccacactttgagaaccactgatctaaaaattaccacttactcctagcaaatagaatatgctgtgtataattgtttttgtaatcatagtcattatggagctgtactttagacattgaatataaaggaagaacttattccacaagatttatcgagaacctgaaaagtgcaaggcactgttataggcatcaggaaataaattttttaacaacagatacaaagtgagagtttacattcaggtgcgtgaagatagacaatagatgataagtgagcacctaacctttcaagtggtgatacatgctatgaacaaaaatgagagagggtgtggctctagagaggggacagtggggaaaggtaaggtgaccagagaaggcctctctgatgaggtgttgtttgatcagggatttggaggcagtgagaaagcaagacctgcagatttaatgcacaagaaggtaaaagcacagtctttgggaccaggccaagctcaatacttagggctggccctccactcgtcctttgacctaaaacaaattacttaaccactctgtgtctcagattcctaatctattcaatgggaataatagtatttccctcataggattgttatgaagattaaatgaggtagtatatgtaaagcatttagagagatgtgtggcacatagtgttacataagacgcggatatatatgaggctaagaaagctaaaactttagtccctctcacttacatgggcctcttctgtggccttctattaaatattgtatacaaagtaccatattcttttctagaaagagagcctccaagttgtctaagctgtaggccctacatagcctagacctgtacctgatattaactgctatttattcatctctgggataaatgattccagacaaagggagcaggagtgtaaaggcccaaaggctgggagaacatcaggaagacattgtaactggacaaaagtcagggaggcacaaagggagaggataaggtgagaccaaaagggacagtacttgggggatgggaatcgtaggcatagagcaggtcttggtaaaatactttgtaattgtgaattagattaggagacactggagagttctgagaagagagtcatgaactgctttgcattttaataggatcattttggctgacctttagagactagatgattaagaaggcaaaattagaaggtggaaaactcatggagaagcagtaatctacagatgagataatggtaccaaggactaaggtagagatggtacgatattgatagtttatgtatatattttgataatggaacagacagaacttgttgatgaatcatatgtgggattgagagaactgttaaggatgattgaaagatttggtgtctgaggaactgacaagtgaggatcaggactggatgtacatgtgcagtggaaattaagagtttgatgttgaacatgttagttttgagatgcctattttatctgtaagattctattttatttctatgatatatagccctgatggacattttttggaatctctacagttagactattttatagttatatgcccatcataaaattctatgcagaatgtaccatatggacttttggtgctataacacagatgacttttatggaaaatcagacaaggtaggtcagagaatttctttatggccagctccaagacaggaaggtggggagagattagagtcctgccggggggaaaaaaagaggaggtgaaaagagggtacgagaaggtcagaaggagagattttttctgaagtctgcttctgaggcctgcagcaccccaacattataaccaaagatggtcttttatctttattgctctgaagcacttccaaagctgcttcaggaaccaagggcaaatggccaaatattttaacaaaaggtatgcttattgttttaaacacttaggaaatgacaagagttatgagccaggaaccatggacaaaaacctacacacacacacacacacacacacacacacacacacacacacacacacacacacacaatgttattacaccctccatggaactatgatggttctgtcctttttatgttacatgacatggaaggtttccatttaaactgtattatctaactagtagataatgctagcaatattagtaaaattattgtgttctctgactgtaaggacttgaggacatgtttcctcatcttcataaactactgcctgcccctatgcttgactatggtaggtgctaaagatgttacatgaatgaaagttacaataatctgtacaagaatgaggtctttcttttgggtattttatttttgtttagaagggatcttatactcattaggcactgactatccataacagcttaatactggacagtgtagtcaaaacacatgactacaagttccaagtccaccaatttttggctttattaatttgacaagtcactaattatctgagcattacttataaaatggaattagtggtattttttctattttacagtgttatacttaggattggataagataatatacagaaaaacatgatctacaaagtaccaaaaattatattaatattttgatctaatctagaaaaattttgattgatagtgtctactgcttaatctgagaataacataccttgctatagtttccaaacacttttcatagaggatgtaaaatggattttcaaaaattacatttcctcaatataaattacaatggtttgatcacttaacatcaactctcattaaaatatgattctctttgtaggctgaattagctctcttttgagattcatatgtagaaaataaccaagtataaaaaggcttgctgcaaatgtcctctgatatttgattttgagtttgacatttcaattcaattattctgaatttaaggtgtcttaaatcattgaatacattttgcggataatatgtccctgtacccttgcatatttttcataacctcttatacattagccaaaattagaaaaagaaataatcctcttccctgccttaagctaaactagaatagttggcacatttaaacaacaaatgatgagaaaaaaatgacattgataaaagtttcactgagtcatcatgaatctcattgggtgagcaattctattgagggagcatatatgaattttcatatactttaacactttaattgtgctaatattttaagtaatatttgttctttaaatatattttcttatttttctgtcatttaccaagtatagattcatcatttaccaattctgactcttttttttttttttttgagacaagagtttcattcttgttgcccaggctggagtgcaatggggcaatctcagctcactgcaacctccgcctcctgggttcaagcgattctcctgcctcagcctcccaagtagctgggattacaggcacccgccaccacgcctggctgatttttttgtatttgttagtacagacggggtttcaccatgttggccagccttgtctcgaactcctggcctcaagtgatccacccatctcggcctcccaaagtgctgggattataggtgtgagccaccgtgcccggcctctcagactctttaaaaaagatagctgaatgggactgaaccaaccagtgcagatccccaagggcaaaatttgggagtaccttgtgtccatgtctctagttatatggggatagagagacaaaattgtgtttaaaggagtttcaggcctcaaggctagaaaaattggcttatccaaataggttctcaaagcaacatgaaatgagatttaggagatgcgttttggaaatggccctaagagctaggaaagaatggagtaaagtataatggttccaaatttgaatttaaaaggaaaattagagacaatgtctctagagactagggactctgtcttgttcacagctgtattctctgtgaatagtgcttagaacataaatatttcttggctggcaaaacaccgtttaccaattgtgtttattacatgcttctgctaaggtattgtgtgagcaaaccagacacaatgaaagggctcaggaaagaaagaacaagatcctggtatcaaaaacaggtatataaagtgtggctcttaccctccagtaaaaggcaattaagtccccccatggaactcagtttcaacaaatcactactcatattgtgtgggagagaaggatctcagaggatgcttataaagtgacctgaagatgagacaggaatggaatcccaggcagaagcaaagcaaaagtatgtgcaaagtcttggagctgtataaaaggatggtttgtttggaaaatctctcgcagtttaatatgaggatcatgagaaatgacactggggaaatagacatgaatcagactataagggttttcgttgttgtgctaagaaatttgggcttggttaagactaagcttcaaatagttaattctaggatattgacatgaaactatagcccagatatgttaatcatgttacaggaaagtttagcttgttagcaaaagtataatactgacctaaaagagcatacttaagtcctgaaagtggagagccttgtctaaggaggagagaaacaaatatatatagtcagaagcagtgataaaacagaaacttttcccctaccaccccaacagtatttagttaaaatatattttatatcagcctctagggccattatgtcccaatatgcatcccctctagttttattatataagtttattaataacctcttatgtatttatgattgtagttaatatacaaagagaactaaatttatggtagttcagttttaggtattgcttatatgattttttccataatgctgtcaacccgtgggacacctgatgacattctttttcaagaaccaacatcacaactaagtttgtatgtgaccttaaagtagcagaaggagctggtcatgagatgaaaagaaatgctattctacttctattagattattctcaaggactgataaatactttggattctaggtatccttggtgcaaatgatttaatgaacatgtgccatgaagaaaaataagattatagagaatgaaattaaatccgtgctctacctgacttaaaagtgtgcatattatttctctcttccaaaatatctagcatccttatataaagaaagaagtccctacataatcattcctttcccaaccatcacattcaaattatcaaatataaactctgttttcagtttggagaaagaagatatagttgctggcaaaatttgggggtgtgagtcgggaattagaggcagaaaaggcaagggatgtaacagaaaagctttatgaatatatctttctgtgccaaaggaaatggaacacatcttgcatgaaacaaaatgtgacttgttaggcagcctaagatcttatcaaaggagtggaaaatatcacccactgctgactggctagtaaaagggaattgtgctcaaatgggtcaagactcacttctcaatgtccacaagctttttttcctccttatttcctctgtaaatgctgtttttttgtttttgtttttttttttttttggcatgcaaagggacacacacacactgaacacactgacacacacaatgttatgcagagagtttcctcccagatctattcatggtttaaagccccccacctccctttacctgtaataaatatctgttggctttgatgttcactgtcagggataaaacaaattcacaaatatttggtacacgctgctcctgtatgtgacattgaacaaaatgttgatcattaataaatggtgggggaaaaactcaaagactaataaatgtcattgtttctgatgaagtagaacacaagaaggtaaatacccacaactacccccctgctaaggtacaaatatcagtaaaaaatgtgtatatttgaagtatttggtctattacaattcttcagatataaaacaagcactataagcattatggtggtgttgattttaaaattccaacttcacaaattcttccagaagtaccttatgaataaaataatgtaatattcagatgacacatatatacacatatgcacacatgcacatgcatgtatgtagtaggtatcaatagatgatagatgggtagatagatattcttctctctaccttgctgcattcaagtggctgtcatataatataaatcgtatttagtatgtatttttttttaacttggggggttctggatattttgacccacattcatatttttaaccacggtgttgaaaattctctaagtgatcttactgttccacaccttattacattaatcccctataaggcactttcccaaggagtccctgaacacttctgggagaattataggcagcccatgctactctgagcacatttaaaacatagaaacttatttacatgggcctaaatctacctctagaacacctgggtttattctacctagggctcacttcagaaatggtatgtttttcaaaaatgacaaatcatgaagtctccagtatgatttatatttcaaatccatctcttgagaaaattctggttaatagtgactgactagagtgttaggaacaattccaaggtgttttcaatctcatcaggaaaaagagctgctgtgatccattagtgatgcctgctatgggcagggtgtaggactagccaagttttgagtctatttcttctttcccataaaactcccttaaacatgtgcaaataggatccatgtttcatctaaggaatgtattctacccaaatctgaactcttttcagctacctcacaacacatgggctggcattctctgtagcctttggcatgatgtagcttgtcctatgaatatccttgtagccatcgcctccaccataaagcacagagctaatctaatctatgtttgcagtaattccatagaaaaatctttatttcaggatcacaagtgaagcttgaatacttcttaaaagttcctctgagctcatatgtatgtgcaattaagtgtactgaaagcaaaacgttatcttgtcatttgactgctaagagagcttgccataaacatcaaaaacagcttaacaatgcattcttattttttattctgcttttaaagggcattgctaaaagtcaactccatggtctggttctaccttgaagattttgtatctttctatgtctctgtggacatagttaaggatataccgatgactctagtagtgagtgcaacagcacagttgacacacacacaaaaactgcttacatttttaaaatggaaatccagtcatagaaatatcacagcacaacctctcaacgctaccccttgccaagaggctgtgaaagaaaaaggattttttttttttttttttttttggaattttgggtgatgctcttttaagagctagtgggacaaagtggaatatgttaccacttttggttctacttgagaccaaattccatgtgccctcatataatgtacttccaggatagccctgcttcaataaatagaacatcaaatattatactttgaattacaaatacatcaatgtaaaatgatttcaattttgaatatcctccattcatgctacatgactggttaagcaaaactgtgctgacatcatgacagacaattccactcacattttagttttgaatttctggtatatttatgattctagcttttcattttatatgctgggttatcttgtatcaacaatgtatataaaactgttcatgtttcctattatgacagctgcaccaagtccatgtctcagagctgtatatcaaagtggcaaacataataacacaacacagatctgttttgacactaatatggatttcatgcttatttcacatccccttggccaaacattcaaaaacattgtagttcccagtaaataacattccagaaacaaaatccagatgctgtgtctattatttcaagcacacattatcagatacaagaatgcacaatgcttttctacaatttacttttcattttgtatcctgtttttagtgctaaagcacttcattccccaaattctaaatattactgaaggtgaaataagagcctttagagggttctcttactttaaaaaaaaactgacatagaaaattacatgtatttatcatgtacaacatgatgttttgaagtatatatacaatgtagcatggttaaatcttgttgaaccattcttacatccctgggatgaatcccacttgatcatggtgagtgatcttttaattgtgctgttgaatttggtttgctagtattttgttgttgacgatttttgcacctatgtttcttgaagataattgcgtgtagttttcttttaatgtgtgttttgtctggttttgatatcaggataatggtggcatcatagaatgaacttggaagtgttccatcctcttacattttttggtatagcttgagacaaattagtattaattattctctaaatgtttggtagaattcaacagtgaacccatcaagtcctgggcttttctctgacgggagacattttactactgattcaatttcctttcttattattggtcagtttaggttttctctttcttcataattcaatcttggttatctgggaatttatccagttcttctaggctatccaacgctttggtgtataattatttataatagtctcttataatacgttgtatttctgtggtatcaattgtaatgtctccttttatctttgattttatttgagtcttctttttttttttttttttttttagttagttagtctaggtaaagggttgttgattttgcttctcttatcaaaatagccagtcttcatttcatggatcttttgtattgtattctagtctttatttatttctgctctgatctttatcattcccttccttaattttgggttgagttttttctttcttttcttctggttccttgaggtccattgttaggttgttgttctttttcaatgtcagcatttattgctaaaaacttttataactgcttttgctgtagcccatagattttggtatgttgtgttttcatttttctttttttttttttttttttctgagacggagtctcactttgtcgccaggctggagtgcagtggcatgatcttggctcaccacaacctccatctcccgggttcaagccattctcctgccccagcctcccgagtagctgggattacaggtgtgcgccaccacacccagctaatttttgtatttttagtagagactaggtttcaccatgttggccagtatggtctcgatctcctgaccttgtcatccgcccgccttggcctcccaaagtgctgggattacaggcatgagccaccgtgcctggcccgtgtttccattttaatttgtctcaagacatttttaaatttttcttttaatgtcttcattgatccatttgttatttgggagcatatggtttgatttccatgtatttttcaggtttccaaagttcctcctgttatggatttctagttttctactattgtggtcataaacgatacttcattctaatacttttaaagcaaaaatataatgattttgtcagcacattgatagatttttttttctagctttctatgtgctgggcacctatttctgcactattgtttaagttttgcaatgaccctattaggtagattatattattactccccgtcaccagtgagaaaaattgaagctcatagaggttaaataatgtggccaagattcaaaatttgtaagagtatagtcagaatttgaacccaggaagtcaggttttagtgcctattgttatcaacatatcatgctgccctgtacataaaaattataatgaaggtgggccaggtgcggtggctcatgcctgtaatcccagcactttgggaggccgaggcaggcagatcacgaggtcaggagatggagaccatcctggctaacacggtgaaaccccatctctactaaaaatacaaaaacaaaattagccaggcgtggtggcgggcacctgtagtcccagctactcaggaggctgaggtggaagaatcgcgtgaacccgggatggggagcttgcattgagccgagttcgcgccactgcactccagcctcagcgatagagactgcatctcaaaaaaaaaaaaaaatatatatatatatatatatatatatatacacacacacacacacacacatatatagacggagagaaggtgaagagttgagtaaattactaaagtttcttaagcccctagtatgtatcaggaattatgacaggcaattaacatcaataatcttacttagtcttcacaacagctttatttgttagaaaccaacattaccccattttgtaaatacaactcataaggttaagcaaacaagcaataaaattaggaaagtaagaagacattagttacacccctggtaagggaaaaagctggatataaactcctatctacttgcatctgaactagactagactttctgtatttatatcatctctattctaaaacagaacctaaccttaataaagtggttgactaaattgacttacctattttctcacttccatgatatttatgtattgaaagtacaagaagctaaaggtctttggatgaaacagaacatagcactgtgtttacaacagctttaagccacattcaaaacactttagcgtcatctcgtgttatttatttatttatattatttttgcaaattgagtggcattgttagcactttgaaaggcagaaaatatagctgcatattatatcataagaatagacaattataaaaagagtgtaagatgaagtacctttacatgagctgtaattgcagctggtaattaaactgaagtgtttcattttctcagtcagctcatcagtgacaccagaaaataaacaatttgaaagtgaaatccttaggggccaacaatagtaattaattgcattttccagggaagaagcgttcctaaagtctgtttggggtgacctcttgagtaatatacacagtgatttacactgtgagcagaagtgtggggttcagaaccaaatctgatttaacttgaatattcatgaagtctccagtatgattcatacttccatttccattgtcaagtttattgtctcctaggttaacaatgaaagcaaatttatattctgaataattcacataacacaatgagatgatcagcatggaaaaactttaccaggccagtaacacataaagtgaggctgctattaatcccttccaacttggaatctcctcaagtatcaagagcattgttttagagatacttgggagctgaaaagaaaatatttatgtgtgtaaatttggatccatatctcataagcctattggattaaaatcataacattcaggcagtctagtttgccactgttcattttcacagagaagagctttgtttgagatttgtgcacatctttttagctattctgatcacagggaacaaactgccatgacttatactctaatttctcttcttgtttttacttatgatatgaacatggcccttggactcagataggcataggtatagaatccagccccacttcttactaacaccttgtgttagttagctcataccagataacaaagaaccttaaaacttgctttaaaacactaaccctttatttagattatcattctacaggaagacaatttggggtgggctcagccaggtggttcttctggtttaggccaggctcatttggtctcagctggggctcaattatacacctgcaggtgactgccagattgggtaggtaggctgatctatggaggcttcagctggcatggcttgcctctgcttcctgtatcttccattttccagcattgcagcctgagcttttccaaatgatggtgtggcagtgatcagtaagagaaggtaaatccaaatatgcaagtctctgctattgttccattggcaaaatggccaagcccagagacagactgaagggtactgtcaagaaataatagtgatactaaaacccatgaaaaaatcgggggccattattacaacaatcaactacatatatgtataagaaactatgagccagtttcttaatccctcaggcccagttgctgctcatctcatagagttgttgtggagattaaaattaactcatatatgtaaaccaatgggtcaatcacctggcacattggagacacataataaatgttggccctcttttctctgacagatatttatgcactcccatttattggttatacaaagcaaatattctaatatgagaacaacctgttaatgatatgtcatcccactgacctctatagttattcagttatccggctagtgaggttagtgtctccttccttaacaatttcatattaatctgctgaagctatgcattaacctggaggatcaacttctgcacagaagtatattcctaaaattacgtattatgcatgtatgtttgcataatatacttccataaaagctgaaacttggctgggcacagtggctcacacctgtaattctagcactttgggaggctcacgcctgtaattccagcactttgggagaggatcacttgaggccaggggttcaagaccaacctggccaacacagggagaatttgtctctacaaaaatattttttttaaaaattagccaaacatggcggtgctgcctgtagttccacctactcagggggctgaggcaggaggatcacttgagcccagaagttcaaggttgcagtgagttgtgatcacgccgcaccactgcactctaacctgggtggcagagtgagcctctgtctcagaaacaaaacaaacaaatgaaaacaaaacaaaaactaaacttttattgagccattgatttagctatttttaaaacttccttacaatgtacaatcagaggcaaatctgtgttaataaagcctatatgttgcactggggggtcgcaggctagaagaggtcataacggtttaaaatttccaaagtgtcgattatggccattgaagaggctgagtcatcttaaagtcggcttgacattacaatcaaataatcagaaaagcccgtaaattgaattctactttggcctgattgtcttaaaagctggctctgatattaacggacggatgttcacatctttaatttggatcagggccactgacacaatagagtagatgagcctccataattttcaagtgaacacatgcttttccccattgatctgtggataatagatcattctattggctcccctgcagcatttaaatacagtctgcctaattcaaaattggtcagtaaatgtaatactaaactgccttgacctgaagacgatagaaatgaaaacccattttaaaaaatcccaggaaatcactgtacttgtcatatctactgcatgaaataaaaaatatatttcaccaaaatacacttctacctctattattttatagattattaaaacagtgcagaacatacaaggattaatataatgtgcaaagagatcttatatatatggccagggtctttcatgactgacagaacctctctgatgtttgctgactttttagccaaaaagaaagagaacatttggttaacacaggctcagagatagatagaattataataatacctgacagccctttgatacttggtagttttatggtgcagggaagggaaagattttgaagacttcattgggatcaaatgttaataaggaacaaggtgaaacatgcctgtaaaaataatattgattatatcacaatattctctatcattccaatgaataatccaataaccaatgaattcctaatagcaacattaatagggtgattaccgttttgtgaacatttattaaagaagaagaattttaaaataaagctatccatgaatttgctgttatgtcttaaaatactacataaacaccacaaggtgtctgaggtgtgccctatattaattttatgtttgtttggtaactccagtcatggtctctatagccaaagtcattcttcaaatatacagttatttgaactactcaattgaagggaaaatctggggtgacagataacaatgctttacagagtacatgtatatttaatcatagaagctcaagtatataggaaaataaaatgttagttacaaaatgtttatttgataattacacatcatgacaaagaatattataggaagtaaattcaaaatttaaatatattcatacagccaagatatgatccatatttattatgttgtcatgttttgctttataatctatcgtctgtttatgtgctagtttgtttaagtaaaaatattatcttcattttaaaaaagctgagcatgtaaaaaggccaaaattcggggttttggctatacttgaatagactgcatttgattttctttttgcaagctatacccttgatgacagttaaactgaacgagcattcattgagcaactatttagtttatagtcactatactagaatatagtgatacaaagatgataaaccatgatccctgtcctcagaaaagatggacgtatacatagcaactgtaatacggtatgtaagaactatacaagcagtatgaattgggttactcagaacaatcgagtgagggattcttctggcgcaggaggaatggaagtggcttcacatagaaggagctgagaatgcagaatgatgtaacagggctttccaaggttacccccaggttcagtgattcactaagaggactaacaggactcagcagatagcatactatggctataatttattacagcaaaaggatacggaacaagatcaacaaagggagaaggtatgtgtgagatgactaccagaggaaaccaggcccacgcttttaagagtcctttcccaggggagtcacacagaatgcacttaatgccttcagcaggaagttgtgacaacatgtgtgaaatgttttctagtaaggaaattcattacagactcagtgcccagagattttactgggggttgttcatgtaaacgccctaaaccatactgtctgcacaaacagtttaggcatagtaaacccatttgttatcagaaaatgctgggaacctttctgatatctaagttttcagaagcataaatattatggcaatgtactcaaaagaactgggcctccattttaggattccagctgaatgctaaccttgcaagcagtcctttctaaggacagcagcctcaggcctgttagattaactcttttctgcacaggtgaatagatctgtccagatatagttggtggagaaatgaattcaggctgtggaaatttcaagaaagggctcggatgtgtggaaaaccgttcaaaacatttcattcagtgagatgtttaatcttaagtgtttctgggactatttggagtgtcaagttcacactcctgaggcctgacatgatttcaggttccctgaacaggccccatcttgtaaagaggattaaaatggcaattgtgttaattcgaaacatttggcctctgttgtgtacttcattcatgtgaagatgtgattctaatttagaatatccagatatttgttttagttcagtgttttgttgtcacagtatataaagtttctgaccataacacctttgaagttgtatagttcaaaggtccctgttacagtgcaacggagacttcagtttcctggaggagagtatgtactttcaaagacgacatttcagagcatagtacattcatacaagtgatcgacacaaaatgtcatttttgtcactagtacttgtggcattaactataagctgtggagttgtgcttttgttttccccccagccagattgacatgcttcagtgcctttcagatcctacacttgtacaacccaaaacagaactatccctgtatttcactaggagaaaaatgaaaactgttaagcttataaatatttcactacagattgctgtatattcgctgctcactgttgaattcagctgctatgaaatgctaataactctctactgagggcttgagaacaacctctatttcgataaatattatggcgtgtactgaattatgagttccgtacattcactgatagacaagatggaatgttagccttattaatgcaactggtgcaatgtactcaaaagaactgggcctccattttagagatttagctggtaaggtacatgaccactgtaacatgcatgggccttagtagtataaaatagatatgaaatattgtacaaataatatctctgctgtggtttggaaatctattggaaaatatatacatttgtcttatcttctgatttgttaattactcttaggacattatgagtgaattttagaactaaaaagtcagtataaaaacagatggttacattttgtgattattagcttcctgtgactgctataagaaattgccacagacttagaggcttaaaacaacacaatttttttatcttatagttgtggaagtcagtccaaaatcagttttacagggctaaaatcaaggcgtaggcagggcttggtcttttctggggactctagaaggtaatttgtttccttgtctttttcagcttctagaggctgcctgtattccttgacacatgactgtttactccatcttcaaagccagcagcatagcaattcaattctctctctttctcacttctctctctctcttcaattctctctctctctctctctctgtgtgtctctctctctcatctctacttccatcatcacatctccttccctgactcggaccattctgcctgcctccatcttataaagatccttatgactggacccacccagatattccaggcttgtctctccatttcaagatccttaatcacatctgcaaagtctcttttgttttgtcaggtaacatagttacaggttccagagattgagattaggacgtggacatgttttggggatcattattttgtctcctacaaccccaataactctattttgtgttataaatactgtgaattattcagcaccaatacatggtattcaatcagattttgaccatgtctgtctatccatccattcagtaaatatgtattgagaacctaatatatgtcaggcaatgttctagatgctgaggtgcagtaattaacaaaggagacaaagtctttgttctcatggaggttgcattctagaagggaacacatataaattaatattggatatgtcctgaatatttggtctataacaaaaaataaggcaggattagatggcatactgtgttagtatatgtatgatgaggggtgccattttatcactaagtatggtcaatgatgtcctctctgaagaagcaatgtgatatgttgaatagtggcccccaaaatataggtccaagtcttaacccccggtacctgtaaatgtgatcttatatggaaatacagtcgaccttcagtatccacaggttttgaatccatggatttagccaactgtggatcaaaaatattctaagaaaaaacaaaacaataaaaacatacaaataaaaacaatgcaatataacaactatttacatagtatttacattgtaataggtattataaataatctagagatgatttaaagtatacaggagaatgtgcataggttatgtgcaaactacataattttatatcggggacttgagcatccttggattttgatatccacagcgagtccaaaaccaatccttcttggatacaaggaacaactgtattgtaagatctttgcagatgtaattcagttaagaatcttgagatgagattattctggatttgggtggagctaaattgaattataagtgtccttataagagacagaacaggagaagccacagagacacacaaagaggaaagccatgtggtgcatttacatgccaacaaatgccaaggattgtgggcaaccaccagaagctaggagagagacatggaaagggttctttctctgagcctccagaagtaacgaatcctatagacagcttgatttcagagttctggcctccagaactgtgacagaatacatttctgttgttttaagccacctagtatgtgtaatttgttgcagcagcgcaaggatactaatacaggcaatgtttgagcaaatacctatttgaaataagaaaacaagccatacagatactgaaaggaaaagcagtataggcagaagacacaataagtgggagactctctgtggtattcaaataacaacaatgggagacagtgtgactagaacccagaaagccagggggaagagtgtttgaagatgattccagaactatagtgctaaccaggtcgggtagggagggttttgtgggccatggtaaggactttgaatttaattctgtttattatatataagctagaataattatgatttactgaaatgtagtgtttctgggcatgacagttttaactgccagaagcaaataatcgtgacacaactgaatattaacacaaaacatgaaggttgaattctggtgagctccattgtgttcccagtaacttaactatcacatttttaataatgttggtcctggcctgaataacaaaatatattggttcctccacccccaacacgcaactactgtattaggccattatcacattgctataaagaaatacctgagagtgggtagtgaaaagacgtttaattggcccacagttctgcaggctgtataggaagcatggtggcatctactcggcttctggggaggcctcaggaaacttacaatcatgcagaaaggcaaaaggtgagcaggcgcgtaacttggcagaaacagcagcaagagagcaaggggggaggtgccacacttttaaacaaccagatcttttgagaactcacttagtatcatgaggacagcaccaagggcatggtgctataccgttcatgagaaacccacccccatgaaccaatcacctcccaccagtccccacttccagcactggggattacatttcacgtgagatttgggcagggacgcacatccaaactaatcaactacttatttctttttgtgtctgcatatataaaatctgttaggtttggctttccgtgcaacactgtttcatgtgttattagtatcgctgttacactctgatactcccacaagataaccctacccatcaatgagaattgaggccagtactgcagaatgaggatcctacacaaaatacagaaaccttacttgttcaccaaaggtgtgaaccagtagtaaaatgaatggatttgtttcccgtccccttgctggtccctgctaactctgactcttaaaagccataacattttagccaaagaggacggaagaaatagactcaaaagttgcttattaaaacttgcaatatgtgtgccaataattgctagaactgtgttagaaataaggacattgtaatgagataggatgttatttttctaacatgatgtctctatgttaagagataaaggtcaagtcctaggaaatgaagggctactttttaatggcgttgaaaccacgtaatgggtaggattgtctctagaagatcagtaatgcactgatacataatcaatggaagtttcttaggagatactttatttcttttagcattggttcctctccctactatgtcaaatataaatatttcacattgtatagccattaatcaaagtaaaactaaccacagtctatatatatatatatacatatatatgtatatatgtatatatatgtatatacacacacacacacacacacgtatatatgtatatgtactctgtatgcatatatacacagtgaattttagcttatgtccctatgggcagggaagagaacaaaagatgcatataataattcatctctgctcattttcccatgctccttcattttgtgtatcatctcacatgcaaattaaaatgttctaaatgacaaaagaaaatctcagttgtgggaaattaagcataaaatgtggactgaatcttgattttgaaatcctaagggttactaaaaatagaacatttcacacccctttcaagggagcacctgctaaattcatttgagtcaaatgtagaaatctctgtaattcgagtagataaggataatctagaaataagaccacgagcagaggaatggtcaatgttttttgtagccaacagctttgaaatatgcttatagaaaacattgcttaaatcaggactattttaattcagaaggaatctacccatggcctactaaattatcatcagagaggtggtcaccacacattggtttagtgaccaagcttgacatcagaaggcctgaattctgcttctgcttttattattagtgagataactgatctcatgcaggtcatttaatttcactgtaattcaagttctttatatttacactgagttgtgtaaaaattttaaaaaacaaaatacagcatcattttaagctgcataaaaggtagaaaatatatcatttttaaatatcaccaatgttatcaaaatcatatatccagacaagggatctaagtaatttatctatatagatggcatagatagactacatacactacttatgttcctcattttgaatgtgaacagattagccatagcagtaaattccatcgctgaagaaagttaaatacctttaagaaaaatacaagcctgtccttccagttgtaattttctttcttaatgtgctttatctttgatttgacataatgaaggtttttatcctgtgcccagaaatacaaaaacatgagatctaaatatcttttttggttacttccccgtgctttttcattttgttttggtttaatatacaaattaaaatgttttagaaaatattgccaaatttgtacattttgaagttttattctggaaatatgatccattctgcttattcttttaaaatactacatattttcattaaaaaatgatctgatgtaataaaaaaaagtttttgcttgagaattgtatcagtagatacaattctcaaatagaagagttcaactctttacagatgatcagaagtatatttcctttaaaaaagtgaaacttaaaaatcacacatttttagatgatgacagtttcttttgtaggagagtgtgtacctttacaagatacaaagagaaagaacatttgttatcacaatcataaatgcaaattgtggactcagcctagaaacttaaaagatctgtgtagaatgatttttctccccttttatttccagtttaattgttttctgtcatagacttttattgaaacaaatacatgctactgattcttccctaatcttacgtggctaaagctaatctttcttactatttgcttagtagaaaaaaagcaaacagcaccacatattttttttcttttccaaaatatagcaaaaaaaaaaaaacatcctattatttcattccaaaagcagtagtccttttcagacttgtgcagagcagcttatcccacagggatttcaaatagtaactcattggatgcaggtgataaggactttctatgaaaggccaaagcaactaaatagttatggtttttgtttgtatttaatattattttgttgtggatgcgttagtcatattttttcaaagggaagcaatcaagtgtgatagaaattatgatggaatgcagactggactactgtcaagagagctgagctctggtctggactctgtcactgacttagtatgtgcctctagtttccatgtttttattttattttgagacagagtctcactctgtcacccaggttggagtgcagtggtgcgatctcggctcactgcaacctatgccttccgggtttcaagcaattttcctgccttagccccccgaatagctgggactacaggtgtgcaccaccatacctggcaaatttttgtgttttcagtagagatggggtttcaccacgttggccaggctagtctcgaactcctacccttaagtgatccacccacctcagactcccaaagtgcgggggttacaggcatgagccaccacaccctgtctccatgtttttaaaataagaacagcaagatttgctcttaccaacctcatgggaataacagcaagaaaaaaaaatgggtaagctaccaaaaaaatcttttatttttaagaagaaatgtagttttctatttttggtatattatcaaattctcccttatgttctgacttacattaaaccattacatgtaaacatgtaaataaatattgatagtctgtcttgaagcctgactctgatacctgaaacctgaaatacagtcctaattctatagactgtatagtctgaaatgtattataaggaagagactcttttaggtgctgggatacctggtgaccaagataacccagttcccctacaagtttgtattctatgaaatagacaggccctatacaatgaaacaagcaaatattttctcaggtattgattagtgctgtaaagaaaagtaaagccagctaactgaatagaaagtgtcagaggaggggggacactttcatgaagattggtaagagaagacctgtctgagatggtgacataagacctgaaacctgaatactgagaacaactgagctatcgaaagctttagagacaaacattccaggcagagggaacaacaggacataaggctcttgaagcctgaagaagcgtgacaagatggaggaacttgaggcttactggcctggacagaaatgaagggggaagagagctttggatcaggtcgaagaggctgccaggggctagatcagacaagatcttgcaaaccgtgaaaaggagtttttattttattctcaataaaaagagaagtcattggaaaaataagcagattgttaaaatgacctcaacatgacagaattgagttggggagggtgtcctcagagtattacccagagaacttggccccaaatcttttacagatttctcttcctctcctcaaactttcccactcttgagtggctaaaatcttaatctctttctctgtctctctcaacaagagtgaacccgatgcactgcttttccttttaacatcttctttggcatttaagggcacctgagtgtagtcccttgggaaagtagattttcttcttcttcaaataaggtcatcacattcttcaaagaagaaaattctggtgagtgaaattcttcctttctgcccaccatctacctacttacttaaaccttagcagtcatctgtcaaggggatcagtgtttatttgtgcatccagtagcactttcttgtcatagccccatgaccctgctccttcagattttctcaaggacctctggagatgtttccaggttaggcatagccatgtgtttcaaaatgcagtccaccagttccaggacccaggacagaaagaactgcctgtgccaaatcttgttgaggcttaattgggaccttaaggacccttcaggacctctaaggcctttccaaagagcaagaacatgtgattcccggatgaaaagcctcatggttcacggctgccacaattgaggtggtgcagaccaccctctcccctgctggagcccgtaaggctcggtgtgggtggcgactgtggaaagcagggcaggaatacattgccttccagaaggaattcaccttattgctgctcgtggggacagtgttagctggtatgctttggcttcaggcagctgtgcctcagttcacccttcagccagtttttatttttcagtcttgagcagcttcacagacagtaacaatgcagcctatattcttccactaaacgcagtctaagattattcaataatatttggctattagttgttcccacaataacttcatctcgaacttcgagccttccaaattcagtgttttgtttcatcctggatagaccttgatgagagttcttcctattctttatgtaaataataccaagaactttctccctttcctttgaggaggtaaagttaggaatttgacatctgaatcccagtatctgtccagattgccatgttcacctttaagtcagtaagaaaatatgccttcaaaactgcattttgattcgtttctaatggaaaaggtggggcagtggcataaacaaaaatcttgaagaccctcatatatacagtctcagtacttctaactttaaaatcatcttgacccatatttctgtatctctctggttgtatttttaaaaccaccaaggctcctgtctgatttatcatgcccctttatctcttaaatcctggagttatgtcagccatgatgaaaatatacaataagctcagctttttatccaagttgtggctggatacctttgggacacaattctgaaaaagtagtcccaaatatcgcccgattatatagtacttcccctcaaaaggctggtaatgcacccatgcaaacaagaacaaattgaataactcaatttccagaaggccactgaaataatgtagagccctgaaggagaatttctataggggatttcaactggtttatcatactgaaattattttcaagaatccttctagacatttattggtttctcaaaattgtcctgtttaaggcagtaaccaaaacatcttgccttttctgtcatgcctacccctttgagttcacttccttcgtttctgtgcagtgatgctctgtcttggcttatctgtacataggtcactctcagacatgcatagacctgggggagctgtaggtccttttctgttctgatggcttttcttgtgggttctatctccttttcccttccccactaccatgcccataattctatcaaagaaaaagaaaaataatagtaaaaacaagaagctgttctttgttgtggctcattggtaagcaaaagattccatttactttaacaaatatatatagattgcctactgaatattatggactgcagcaatcagaatagcaagttattcttaaaacatagtgatgctcttaaagtgttttagctttgaattgagctgtctgctttgattcaaagtcacacagagactgctcttggaaattttcccataggcccaggggccactcctcggatttacagcaatgaaaacgtaaatgaatctgctcacttaagggagaccaagctgtgcagaagtggtgaatgttaagccaacttgccagaaactgatttataaaccagaatgctgattcattaaatgaaatgggagatgaatctggtaagataaccggcatcaatcatttgaacagggtactccctcttaatgaataagctcattgaagaaactaaattgcagatcagaaggatttttggtacagggaattagaagagaaaaaaaaagtgttaaggggcattcccttaaactcagtttactcaatttgttcctccccattttggaagtctttcagtctacgaatctggcagcagacactggaatgatgtcactcttgggcagttcttgcctttcatctaactttgatctcttcttcattcataccaccaaactttttttgggacaacaaagccctaacattgttacacaaatttaggtcagagtttattttgtattcatgacagttagtctcctgtacctttaggagataaactacagaatccagtaaagagatttgggaagtaccttaaactcatcagcaactatctatataaaccatttttttatagtcagttttttcaacagatgaataaccatgtctgtttcagcttaatgcttattagcttcaattttcaagaggtgactattttcctcattcaatttagcagctacttactgagctcctcaagagcaagaaaagtctccagaggaaacaaaaatgagcaaggcaatcctttatgaagtttacagtcagatttgagcaataacaacaataataatgagcacaaataattatggcacagaattaagaaatcatgtaagagagtctgttccagaaaatgaggcaatcacacagctgactgtgagaatcctgtggcttttgacttggaccttctagggcacatggggttttaccaagagagataagaaactgtttcatgcagttgaagagaccttggtgagacacagcatttagagagaaaagccccagacacattcagagaaaataatgggatggaccctatttgaagactgcaaggagtacatgtaaaaactgatctgccaattctattatggctttaaaaaaaaaaaaaaaaaacacggccaggtgcagtggctcacacctataatcccaacacttgggaggctgaggtgggaggtcccttgagcctaggaattcatgaccagcctgtgcaacaaagtggaacccagtctcgaaaaaaagaaaaaaagaaaaaaaaattagccaggcatcatagatcacttgagctcaagaggaggaggctttagtaagccgtgattgcacaaacgcactccagcctgggcaaaagaacaagaccctgtctcataaaaaaacaaaatctaagacacaacaaaacaaaaaacaaaagccctgtctctccttagaaccacaacagatcaagttatctgatgctttttttttctttttttacttttatgggtaacacttgtatttgaaaaagaaaagaatggcaattaaaagttaattattaaggcaataagcataacatttattaaatcgatttagaagcaacttgattataaatcttttttcagtagaattcagtcatcaatcgctgttccatatataaccatctattcctgatggtgtaaaagaaaacatgcaaaattaatataagttctttaatttctgaattttggcaatccctttacgctttgggtgactgattatctgtcattttctattatatgatttcactcagaggagctattttttgtggtgttataattagaggaaaaccaataatcgataagaagatagtttgaactgagcaacaagattgttttgattcaatgtttttaactgattaaaagtgactaacgtattttgttttcatccgtgacatgtaaacaatagaagggaatctcgctgtatctaacttttttccccaaacccctctctcattctccttccaaattttcgaggtacgaaggatgactttctgacttcacataaattgcccctgaaacatttctgtagttagtgacagctgtcttctacttacttccaggagaaagactttattcacacaccgttaaggctctttttactggcttgagcagcttacaaaagagagaaaaatgtaacgttatcaaagactttcttgtggctttcactttatgctgtcttccaataatatatactggtacctaaacactgagcagcatggagaaggagtggcctgacctgggtgaatttaacttacggagacagggctttctaagatgacacaggaaaggtattgatgagataaaagccactgaaggaataaatcattcatatgatattttatttttattaatttctggttcagctaaaagtagagaaatatcagatgaatgctattccacctagtcgtcagaattgacaagccacccaaggtcaggattgggggctggtctggttctggaatcagatggctacatttgaatcccaacttccccttttcactaactgtgactttttgggcaagtgacttaattttatacccttaagttaattttttctcttattcaatggaaatattaataatactttcctggtttagagtaatgattgaattatatggtatatataagacatcagtacaaagcgaggcacagagtaaatcaagcaataaatggcaactattataaaaaatggggccaggcacaacggttcacccatataatcacattttgtgggggccaaggcgggaggatcacttaaggtcaggagttcaaaaccagcctgaccaaatagcacacacacacacacacacacacaaaattaacgggaggtattatttctctataacacctatttaattgttctgggcaggcatttgtatacctctttatgttctatctgtcttcgtaaattatagaacacccatggctgtcactgaaagacaacttaagcagacccttcaccatgcccagtgaagaaacagaaagagaggaatttgggggattagtatccaagccattgaatcattaagacagaattgattgataaaaggatttgtgtttattaccccagatagtgaatttctctcagtagaaagagtgtcttttcatatcagtgtaggaggaaattcattacccattaatttcttaatgagacaaatggtaggcatctactggaattcatctatggaaacatgtttgtgtatgtgcataaacacaagtacagaaactcacatgtacgctcatatgcgcatgcgtgcacacagaacgggagagaaatttgttgactaattcttttatctttaaatatatgccatttttactgagatcacactcactgagtgggaatttgagagttattttagggttatttttggtgtatataattatctcaaggctctagataaagatcctggagttttaagcccatctaccaacattctggtttgaataagttatttgaaccagcatattagagagaagataaagtcttaagatgtgaggttataagattcctttttttcacgagggcagctaatgctggaactgcacgagtggcagaggtagggtaggagttgacttttaaaagcaataataccccttagccccaattttgggttttttttttcaacatgtttcaatatccatatgttaaaatgttgaatatttctacatctaccatattcacctatgcctgcttgtgaatttgttgtggagggttaaagcaagcaggacaatgtctgtctcatgttaactgctcagaaagtggtagctactcttactgtctcagacagtacctgagtctctcagttatccaccatcagtgttattttcttattaccattagctctcaaatggtaattttcaatcttttctacatcaaaaaccccttggggaatttgatgaaagctatgtatcctctattaaagaaaagtgcgtatacctacatgcatataccatgcaccatttccatacatagtttaggagattcacctattccatgaattgagagttttggtacaccagtctaagagctccagcacgagttgagaaactgctctttcatcttttaaggatacattccaagtgacttatatttgattttagaaaatactggtgaacatactccaaactacttccttgaatcttttctcttgggtcttgaggtaaagcctggaatccttgatgctctggaaactcttcagacagactaagattacttaaatccgtcagtacctcctgggagctggtacaagatgcaattcagaatttaaaattattcagaatgtactaagatgagacagtttatatatgcatcatgtattacatagcatccaagagagttcagtggcagcatcacataacgaaacagattaatatttcttcatcaaaacatgtgaatattcatattaagtgtaataaggactgtagatagcctcacagtagtttcttttgctaccaaatgagtaacattaccataaaaacaactttcagttatcagagcttttagaaattcagaattgcaaataaggatttgtggatctgtagctgaattcatgtatccagggaatcactataaaactcacatccctttatatttctcgactatacctaaagggttataaattgtatactacaatcagccttagatatcttgtagtttgccaagatggatagtttataaatttatgaattacacacagactacatgcatataaagtaatatatatgcataagtgtatattgcattacatgtattagtctgtataattcttcttttagcagtattcagcaatgcatccaagtagctctacttaaactagtatatattgcttgcctagcccaataaggacatataaatcattaagaaaagatttgaaaattatagctggaaattagaaaactgtctgcaatggcatagtttcatagaaacagaaaatggattgagtaccatacttgaatctggagcccctctcagcttcacttgaaataattttgcctgaaaattgcataacacgagttcactgataagaaaagcaattaattttaataaaataagtacgtctaaatttaaactatcttttagatttcaaatagcacaagagaaaaacttccacagaagtttaaaacgtactgagaacattaaaggaactgccaaataataataaaacataataataaaacccctaaatttaaactatcttttagatttcaaatagtgcaagaggaaaaaacttccacagaagtttaaaacctactgaaaacattcaaggaactgccaaataataataaaacaaagtaaaccaaatttctatgtctatgtccatatttctaactatcatattgtcttcaagtcactgctaaaataaagtgctatcaatgtaaaaatgctgaagactgcttctcccttcctttcaaagaaaatctgacatttagatatgaagaatgacaccttcttatgcctccttcatctcccatctatctagaataaattgaataccttgcaagggaggcaaaactttatcttcacccttttagggtcttcagctggcctgagaactaaattgatataagacagattgagaggggaaaagcatacaaatttaatatgaattttatttgacacaggagcccttgtaagaaaatgaagaaccaaacaagtggtaaaacctaaatggttttacactagattggacaaagggaggcaattctggaaaagtgactgactaagttgtatgaagaggcaaagagtatgggagacaaagagttattttcacaaggtctgtttgtacagaatctctaggctttgactctccatctctggtgatgagaatgtttattttcttctggtataggaaagacatctttcacttgggagtttcatcgcttgctttcaggaagaaaagggggagatcagaatgttcttcttgtacttgctgttttccaagtgcctttagctcaacataatccttatgccaaagtggcatagttgagggtagcaaattgtgccacccttcaacctcctggtgttccaaattttgctttgtgccttgaaggaatctaacagaagtaccagaaacacccttctatgagaagaatttacagtctatttagaaaagatgacactagggtggtatggatcaatacagcacacaacacacaatacaccgtaaagtgttttgcacatcataaaaactcaatacatatccgttgcttgattatagaacgttcactttcacagtacctctgaccttttatttttcaatttagtctctctgcagttcctaggaccacatatactctggggagtgcaaaagagacttttacattaaaatatatggaagtgccactctgtaagcctgaaaaagcccaatgccagccattttttatggttcattgtggcataagaattgttctagaatatgttaccctaggtcagttactcttttattcatcttctaacctcaatcttggactttttgtattagagcaacagccacctcctacccgcaccatgaatttgttcctaaaatctgtgtatctcaagatcttcccagtgataattgtttaccctggagcttggatattacctggctggacatctggctaataggccttgtgtcagttttcttttccctccagacttgcacatccctgagagagagtgttttgtttttttttaaattttgttccctaggctctttatttgcctcattttagtcctagtcctgcatggcatcacacttgatcatcaaccctgagctgtctgaattcagccatccaaattccactgaaatgttctcactcctaagtgggtatttttcaccctaatcatattacctcctctgcagcattgggcactgtgagtcactctatccttaccaaagctctttcctctgttagcaatcatgaagcagctgccttgcttctctgtacatctgtacttctctaatcccacaattaccacttaccttttgaatctacccaaggcctggtcccctctcttcttttcattttaaattttctctgggcaatctcattctggaatggcttcaactgctaactacatgatgatagctttgtaaaccccatctctagttgaaacttctattctcaactgccatctcaacctggaggtatcacaaaggtcataggctcaactatttatcctcttcaggttttttcttttacagttggtaacaccatccagtcacctaaattaagactttggaatttacctctgatggctctccatagccaatctaccaccaagtattttctttcttttttccctaaagccttcttaaaactgtgtttttcctccccataccttctgcacttgtaatggagatcaccaaaagttacccaaagccctcctcagataacacctctgaatgtgatttttcccttttcacctgagaccagcataagaaccatctagaaactgatgctgtgatagcatgaattattttcatacacctttgtatgtaaataatttccacataaaaatttctatattacttttttatgaaatgtgttaaaaattactgaaataaaatacttctactttgaaccaatttatgaacaatatttctagaagagttatagatattctatacaaaatgagttcaattgtcgttggtttttaccataagacattattgataaaatcctaatgttggaatctaataaatacttacacagaaagggtccttaaaaagacattaaagtgccattgaatgtcttctagaagttacatttaaagataaaatacattgatatgcttttaacttatttgggcattgaataaaagacctttcttataaatgagcataagacgattagtacaagagtggtgaggactgaaaaacaattcaagataggaaatcctgaaattgatgttactttataaactctatttctaacaaagaaaattgaaaaactttgagtttttgaaatgtataattattctaatacattgagaactgtttatcaattatgaccaaggatacttcacaaaggctagtaagcatgtcattctatgtcaaatcaccctcccgataggtattgcttaagaacctgctaggaagagtgatgtgaaaaataatacaaggaacaatgcattgtttttattccaaattagcttataatttagtgtgtcaataaaccatataaataactataatactctagtagcatatgatgcggcttgtaaaagccagtcacagagttaactgatgtgactttttaagttagaattaaatttttttttattatacttgaagttctgggatacatgtgcagaacgtgcaggtttattacataggtatacacgtgctgtggtggtttgctgcacccatcaacctgtcatctaccttaggtatttctcctaatgctatccctcccctatccctccaccccctgacaggcccgtgtgtgatgttccccctctctgtgtccatgtgttctcattgttcagcttccacttacgagtgagaccatgaggtgtttgattttctgttcctgtgttagtttgctgagaatgatggtttccagcttcatccatgtccctgcaaaggacatgaactcatcggtttctatggctgcatagtattccctggtgtatatgtgccacattttctttatccagtctatcattgatgggcatttgggttggctccaagtctttgctattgtgaacagtgccacaataaacatgcatgtgcatgtgtcttgcacaaaatcactctgtcaccttagcacctctttctttttgtttgcctttggaaaattctgttgaaaaccctttctaaattcctgcccacaaaatattataaaaggaggagggagataaagaataggagtaagaggaggagaaagtaatgaactgtggttaaagattaaagctttttcagaaaagcacttatcaaaagtttctaaagagctcaggagttaatgctgtactttttaggcaataatggatgggaattgcttttggaaagcactcttttttcttgaagagtgcaaaaaatgtattcctttgagtgaatgaaaatcaatgttatggtcaaatatagaggaattgaggagaaaacaaggacaagaaatgctctaaagagaagactttgttgcctcttttcttcttcatcttaggaataggatatcaatatttgaatcatccatgggagcttttcaaaacccctattcctgagctctacccccagagaaatgcaatccaaatctctaaggataaaactcaggtgtcagtattttaataaacttcccaggcaattgtgatatgtagtcacagttgagaaccactgctacaacagatctaaaaggcagaagccaagtaatgctttaatgaagaatttgagaggaggaatatacatcaccctcagctactgtcacctaactagctgatcctggtaagactggtagaaatatagcatccaaaataagcaagggataaaagactacaaattgggttcagtgtatactgcttaggtgacgggtgcatcaaaatctcacaactcaccgctaaagaacttcctcatgtaaccaaaataccacctgttcccccaaaaacctatggaaataaaaaataaaataaaaataatgaaataataaactgcatttctcagaggtgcaaaatacccaaaccctaaatttaaaaaaaaaattagtgagaaaaaataaaatttccctagctgttaaatccgtgatgtgatatttcttcttttaatctgaatctaaaatgttcagtcttggtccaataataaacacactcactgaaacacacagtaaagaatctaagcagggtgagggccatggctcatgcctgtaatcccagcacattgggaggccaagatgggaggattgcttgagcccagaagttcgagaccagcttgagcaatgtagcaagaacctgtctctacaaaaaattaaaaaataaaaaaaaattaaccttgtgtggtagagcatgaagttgaggctgcagtgagccatgatcacaccaactgcagtccagcctgggcgacagagcaagaccctgtctcaaaaaaaaaaaaaaaataagaataatctcagcatttgagaagatgataatatggaaagtcaggtgtgaggtcagcatgtgggtgaataatttcaaaagctcttatttcttaatatcagtaaatatattcccctcttacagaattcatgcatggtattttggggtgtgtaaaggtacctctcacttattctcattctgaaagtctttcacttccttggtggatgaaaaggaaagctgcagttggttataaaaacgtgacggatgatttaggtggctgtattcagctgtaagcaataaatgctgagctcggcagaaagtactataggcaaaaacgtgtgatttactagctatccaaagcacatgagatttataatgcatgagaccctcaggcccatcacttctcttcagtaatgggaaacaatattgtgggaaaaaatgacacatttaatttcaactttgtgttgtaaaacaaaaacgcagcctaattttcattttattattattttttttcttttcgtaaagcatctttgcatcttattggaaatacaaatggcttcttaagaagtaggaacaatagagcatgttcaaaacaatatctatcggtagacatttattactggctgcatgtttgtacgtgtttggtgggatgaaaatgagaaacccggagtgctgtgacagactcattgtgttctgatagactctcccgaaaactgattctagaagcttagtgttctttaaggcagatgtttagccaggtgattgccgtggttacctatggataccggataccgaaaagagtcttggcatacttaaaaaaaaaaaaaaaaaaaaggctagagaaaaaaatagtagagacattttttacccactgaactgagggtgaaaaatgtagtcacaaaagaccatgaactcaaatcccaactctgttaatgatatataatgtgaatgccataaactttctgtatctcattatatcatcctgtgaaatactgacctattttgcaattgcaatgtgagagataaatcaaacctcttctaaggtactttgaaaatagattctgcatttcagaataaatattaaacaataataatgatgatggaatagctgacacaatgcaaattttaaatagagcagagtaactttctaattatgagctacattttattctttgtgagtgtaattagaaagcgaccatgttcctttaattagaaagttaattagactgtgacctcttttcctgtcttactgtcttggactacaggccaggagtaaattgcaaatcccctgacctacatgactatagccccccaaaatcagactgtttaaatagaaataacattataaggaataacattgggacttgcaagtcagatggggacttcataggctatagaagggttctctcatgagagaaaagtttatgtggataaataaaaaagggttctctcatgggagaaaagtttatgtggataaataaaaaagatacttttccagatcaagcctatagagtaagttccctaaattgtattcaggatgttggttcctttgtccagtgactctattactttagtatgcatgcaagagaattacctgaaggacttgtttctgggctccacacatacaacttttttttttttctttttttgagacagagtctcactctgtcgctcaggctagagtgcagtggcacaatctcagctcactgtaacctccgcctagcgtattcaagcgattcccctgcctcagcctcccaagtagctgggattacaggcgtgtgccaccatacccagctaatttttgtatttttagtagagacagggtttcaccatgttggtcaggatggtttcaaactcctgacctcgtgatctgcctgcctcggcctcccaaagtgctgggattacaggcgtgagccaccgtgcccagctgcacatacagcttctaattcagtaaatgtgggactcgagaatttacatttctaacaagtttccagatgatcttggtgacattggttgagagaccacactttgagaactactgacttagaatattaatagtgttaggccgaagtattgttttgtgatcaaataagtttggaactttcaatgttgaacaaagttaagcaagtttgttttttgtgtgatacctcaaaacctttgaatgttaatatgctttggaaatctccaagaaggatagactgcattgctcctgaagggggtggcccttacaaatgttttggctctctttatctcggagctacaaacagaggttttgctatttcacatagtgttcttagaatgggttgttagaatgctttgttttttagcattaacagaagaatgtcagaaatgagtttccattggtgtaatttgtggtttccccatgtgtgtactggccaaaatattgtagagacattccctactcttgtatgaagagggtatacaaatctagtaaggtttcaccctttaatgtgagaaatggtactgtacatttgattaccatttttggaagtttcttgattgcctggctcctgatagcctaattagctgaattatttctctgatcttatcatgtttacctcatatgaaattttcatgtaaaatgacatttggaccactttaaagaaatgtgtgacttcatagagtcgactgttttgagctagcttgttcgtaaatgtctaaagaaaaatttgctgtgaaatttgctcacattacaatctagaagcaaaattcctagagcgagaggttaaccctctgccacttctaaccagtggcaattatagatacttatcagaaaagagcataataagttgtgcaagatgagattgcctgaagtcagattaaaacactgcccctgctccccactccaatacttgtttgagtccttgttttcaaaggatttcatgcatccagtgttattcaaaaacacttgcgaaaatgctgtgtgattatttttaacttctcagaacaaaaaagaccgatgtcacaggaaaccaagcagcattagtaaactggtctgtgacatctctattgcactctgtgaaaattccatgaaaagcaaaatgggaatacaagaatcacagagaaacaaacaagtggagaagaggcaatgacttcatgtttatgttcttggtagcaatttcctagggaaataataacttcagagaaatagtcaatttgccttacctggtgtgatatacgttgtatattgtctaaaaaataagtgctctagaataggcaaaaacactttgcctaaaaagttgtgtacgtgaatgatactggaaaattcaatgatagcctttttgtctgttctcattttgtgtagttgagagcaagatgctcacaagtacatattaatattgagtgaaattaagaagtctcatccccagaataatgttgctcacaaaatagatgctcaataaatgcctgtggttgcattgggctcatttctgttcatgtgctgtttttttcttttcttttcttttttttttttttttttttgacagagtcttcctctgtcaaataggctggagtgcagtagtgcgatctccactcactgcaacctgcacctcccacattcaagcaattctcctgcctcagcctcttgagtggctgggattacaggtgcacgccaccacgcctggctaattttttttttttttttttgtatttttagtaaagaaggggtctcaccatgttggtcagactggtctcgaactcctgacctcaagtgatccacccgcctcggcctcccaaagtgctgggattacaggcgtgagccactgtgcccggccacatatgctgttttaatttcaacttattacatggcttagaatatatttttaaaaagatattttgatgacacaatgaccctgatctataggaatgccatttttagccagaattaatatagagcactctgctttgggattagctttgggttcagtttttggccatatcatttaccagctcagtcatgggaaggataccttggaacatttaataattttttggagtttcagcttgattctcccaaaatgtgactgattaaatcttacctaatacgtcattcattcattcaacaaacatttaatgaatgtccagatgtgacaggtgctgctccaggactgggggccaggagtaaattaatgcattagctgctctcatggagcccacatctggttgcacaagacaggaaagaccaccagaaagtacgtagtagaatatcttgggataatgagcaccatgatgagaaataaatcagagtaagggaacagggagaattataaagacgctcttttattaagaatcaggcacagcctttctgataaatggaggtttgcaaagacgaagtggtcttctgtgcacgggacaaaatgagataaagcatacacaaatagattgtgaaatatttgacgtggtgttaggtatgaagcaaaaaaaaatctatttcattgtgattaccattaccatattatcactgatgttgatgtattttcagaaacacctatctcgtgtgcatatttggtagacaaacctgaggaaagaattcctaactaataaaaagcctcataaatcaaatgccacttaacaaagggaccagtcttgttaacattgctgcaacagaactcgagctctcaccactgctttagtgagatcattaatatgatcattgcaatagtttgtgctcctaggattattgatagagaaaatgtgtatgataataactattaaaaatgatatcacccatcaccatcaattactgattcctctgtatgcatcatacaatgtgcatagtgctttatattttctattgctgttagttctcccaacaatcctataaggtagatattcttaagatgttgtcaaataacttgttcaggatcacccgggcaactttgtaatcagacctgggatggaagcctggagcagagtgaaaacaatgcccatggcctattgaccacattcataataaaatatatattggtaaaaaaaaaataaaattacaagactcttaaacttttatatgtttcagttaacattatgaaatagacaactaaacttttgccctgatttggaacccagacttctgtgtgctctttgttttttaatgaaaaatgtgttttaaatacttctgtggtctgaaagtatcccctagaattcctattttgaaaatccctagtgtgatggtattaagaaacggggccttttggaggtgattaagtcataaagatagaaccttcatgaatgggattatcaaccttaaaaaagagatcgaagagagtggcctaggcccttttttgccattccaccacttgaggacacagcattcaaggcaccatcttggcagagaccagtcccttaccagatactgaacctgctgataccttgatcttgcacttcccagccttcagaactttgagaaataaattctcgtttataaatttcccagcccctatagcaacacagactaagacaaataccaaataaacataaaataaactcttggagaacacatttgcacacccaaaacttcctgaagatagcaattcctagaattcgaagcactgagagagtaaacaatttactttaacttttgaaaccatgcagcctcccctcaattccatgttttatccctcatctgtcgatagtgcatggtgctgtaggtcatgatcaaacttccaaatagaatcattcatacaattctaagtcatcattaaggccaattcagaacgtggagattttataatttagttgctgtttgagaaactgaatacctaagacagcttatttgattattgaactttatttagtggaatgacctctggtggcacaaataatagaaactgctttcaaattatcattcagggtagcttgtagttggccatgaatagagagacaattaagtagcaaatttattacaaagcaaattccccagtgacctactgtttttcttttctagtgaggttcctcaacgcataatcctattacttttggcttgaatgagctagtcactgtcttccaagctgaactatgatgttacatggaagtttaattttcatcttatttaatttgaccttaagtgagctggatcatgaaaaggcaacataatctccaattctcgacgttaagcgtcttttaactactctacccagtaatcattcccaagagacattgtgaaattgtttaaaaattggtcacaaatgctaatgctaattttatgcccccagatattttggcatctctttcttcttattgtgccttttacactgtgaggcacccagcaggacattcctatggatggatggacttaaaataataaattccaaccaccattctctctggctaggccccctgctctaatgcttaacacaatgcgtggcacatggttagcactcatttggtgttagttgtctgaatcacgaactcaacgaattaatgaatatacaaatcagctaacaaacagacagcagaatgttgaccttctactttctctcatttgtttgaagtgcaattcaagaccggagaaccaagtggacaaaatactgcatatagatacagcagcaaatgcttaatgacttaaatatcctggaaatatttttatatcttactctgacttttcacaaacattaaaccaaaggaatgcttaactggcaattttaggttctcactgggcaaactcatgggataggcagtgtggagaggggcttgcatatgttttttgcatcatttcaataccccacatctgagagtgtacaatttgggttagatttccactcaaccggttggaatttcaggttttggactacgtcctctctatttcctctttatactttcatatttggaaagcatgatatgagtactgtcttagggagaggatagacaggaaagggaagctactgaaagccttcttttgaaataataatttcttaatctatgcactaacacacaagagtttatatctcctggaattttaaagtaataattgtagtgtgacaaaacaatgttaagtcataagatacatttcaacgttttaaaacacacacagaatacatcagtgcccattatgtgataactgagagattaatttgcaaccaataatatccttggtattttagcgttgtggattgtcaaaggcttgcttattgcaggttaagacattaaagggcccacattcccacttcttattaaagggagactttacgaaaggtaggcactgtctctacacttctgggaagaaagcctggtgatacgtaatgctccccctagcagaaaaatagtggtcaccagaagcatctctccataagataaggtgagacaaatagtgctgggccaaaccttgtgaactatgggcttcaacaaaagctaagagtctcatcatataactctcacctagactcagactatttcaagcaagaattaaggtaatgacatgaacttcttgccacagttatctctttattataaaatgtccttgactacaaggaggtgtaaataataactgccattccatggataatcagggtaagctctatacattgtctgccaattaccatgtactacttgaaaattgttaatttagttgaacttgaaaaaataaacaagtggccctctttggcatagtctagaagagactgcataggaaaaatgggaaattaaggtggaggatgatggatggggttctctgagtacagcagagggggcaagcagaagagttggagcatcatgaatggggtcacagtacattagtatggcttctttggcttgattgtggaaatgtgagagacaactattgtgagattcaaagacagtggtaacatatataagaagtgactgacaagatgacagccactcaggaaaactgcctcagaaggcagccagaaaggatcaattctggaaaatgactggcggaagctattaggcatattgaatgggtctgacttagtggttgatttgacaatgagagcaaaagatagatgttataaaacatcattcagagtcaatgaatctggctattgccaaagacagagaaatgaaagaataaaagggaaggtatggggaagaaaataagaaaaaaattaaatgattatctttagtttctgcattagttcttctgctttggaatctccctagctgcctgcagccaggggcaaagatagtttcacctagagggtcctgattgaggctgaggatacctaggctcaatcacagcagtggcacttcccattcagaggaaggcttaacattaattatgagacatgagatccaggtgctgaactgacaaatctattctctctcccaaggcttcccaaatcacagctccgataggcagttatcctagcttgtattagtcataattccctgtagccagagcttccacttttccttgcgttctgattttgatgctatcttatagattaccctcctaattacaactcactgcttacctggttctccaggaatcatagcatagttttttgagtactctgtctcacttgcctggtcaggacacactacctcactttctattctaaccatttctcaatgccgaggactcatatctcagactcaagacagttatattgttttatttttaaagtcactaagatatacccatatcttggtattccataagcaagaaggaagtgagatgagaaagtggttgcaaccacagtgttaaaaatatggactggaaacttgtctatttgcagatggtattagatttctattgctgctgtaataaattaccacaagtttagtggcctaaaacaacacaaagttctcgtcttacggttcagtaggttagaagtctgacatgggtcttactagaacaaactcaaggtgaggctgaactcaacagggctgaattcctttctgaagctctaggaagagtccatttccttgccttttctaaattttagaggctgcccacattcctcagtgtgtggccccctttttccatcttcaaaaccggcaacgtctaatctctctggcccttttttccatgctgtatctctgatcacagcgggacagattttctgctttaaaggaccaatgtgattagattggacccaccaggaaagtctcccatctcaaagtctataatgttaatcatgcctgcaaagtctcttttctcatggaaggtaacatatgtacaatttctgaggttcagatgtagacatccttgggggaccattattctgccttccacaaagatattttctaaaccattgagaacagatgagagtctcatatccactaacaagagccattttgatatgcaacacagcaacccaattgacaaggaagtcctcagagatagtgtagactgtgatactcttcatctttaattctataggttttacctgcgtagtgtctgacctgaaagtgacaaagtttcccacaccttgctagatattcccacacattcctatttagcccatctagacattagaagggaagctttcctatttatgattcctatttaattggagtgaatggatttctgtcatttcctgttgttccttccatagccttatgattgtgtggtaatttgaaatctagacctttttcttttcttttttttgagatggagtcttgctctgtcacccaggctggagtgcagtggcgctatctctgctcactgcaacctccgcctcccaggttcaagcgattctcctgcctcagcctcccaagtagctgggattagaggtgcccaccaccacgccgggctaattttcatatttttagtagagatgtggtttcgccatgttggccaggctgacttgaactcctgaccttgtgatccgcccgcctcagcctcccaaagtgctgtgattacaaatgtgagccactgtgcccggcccaatctagacctttttctaagttagttataaaattttacatttttccctccttgcaaatttgttcccatttgaagaaccatctgcaagaagaagaatacataccattcaccaaaccttctatccgttgggtctatcagagaattagtattggtggtgtcttctagtcctcttgcagattaacaggttatccacttgacctgattatccatgacatcaatttggtgtatcctaaacttcatcagagcagaatattcctcagaaggaatatcatgtcaggtagcttttcagcactaagcctataaatatcctgcctgtgtaggcacatgggagtcaatcctgagaaagcagctcattgaggcaaaaaggggagatttttagctgaatcagacaattactcaataagtctgctttgtggatgtttgtgtctcccccaaaattcatatgttgaaagctaattcctaatgcaataatattaagaggtgagacctttaggaggtgattaggctctaccctcatgactgggattgatgcatgtataaaagaggcccaagggagtttccaacaagtgctgggctatctgctgttagctagcacttaagatgtcttacctgtaaagtgtctttcactataattagtctttctgactaattgtcagattcagctaacaatctcttctttttgcctcaatgagctgctttctcccatttgcctacacagaacataattgtttcatacactagaattagatcagagtagattcaggctcttcattacaaaatgctcatctctgctggatgttaatatcaaaatcagaattctagttctatcacatattgactgatataagaataagtttagtttaaaataaaaggtgagagaaagaatggaaaagtaataatatggaacatgagcagcgtctcgacttgtttctgcttcctctctttttcttactaattaaaacagataacaacaaagccctttggtcacagcccacacaatcacaagtggttccctttgttgatgtgatgtcactggaggggaaatgagcagttgacaggctgtgcaaccaagaaggcaaaatgagctcaaccatttgaataaaacatagcaggtctcccactccatgtcattgactgacataacccaccagacagtaccctttaaataggctgtctctcttttatgtagcaaataaaaaaaaaaatgtaacatgtaaatatcaggtgattcttcttcagcatctgtggttgccagaaggaatttactgccttttcattgtgtggttcaacttggtcttcaggtggtgtgccccaaaatccacaattagtgggatccagtggtgctgtggatgtttgtgccccccccccaattatatgttgaaagctaatccctaatgcaataatattaaaaagtgagacctttaggagttgattaggctctgccctcatgaatgggattgatgcctgcgtaaaagaggcccaagggagtttgttagaccccccacttccgccctgtgatgacacagcaaaaagtgtaatccgtgaagcagagagctcacgccagacattgaatctgctgtcacattaatcttggacttcctagcctccagaactatgagatataaatttttgttctttataagccaccgactttgtggtattttttgttataacaacttaaatggaccaacacaagtgatgatgtttctagagtctgtgtatgtgcatgtgcctaagtattttgccaatttagcgttaatgagtacagcaatgccaacaatggatccattctttgcctctcctattaccgcaggtctccttttcacagatcagtatagataagggtagtagagataaatattacgaggttatctgttagtgcctgttcaatcaactcttgattttacagtagtcttcctgtgtaccatgacccagacatcttataaaagcaaaacacaaattgcagttttaaaatgctattgctctgcaccattattttcctcttcccactaatttgcttgcgattcaatgtgttttctagcatctctcatgtcttgggttcttggccctcatatttccctttggattgcttcattttggtggattttgggaattcccccttggctaataaaaccttggttattcctttctgttctgctgcctagatgactattccccattccaaactttaaccctgtggaaccccacccccacacaggccatctatagacctttgttcttcctaacattttcaacagggcaatgaagtgtttcataaatatttggggttttatggaaaaaaaatgctctaaggcagcttaaagctattcttcaaaataagaaaagtattctatattttaaacatgtatatagtcatcttctttactggggaattaatggagtactctaagctattgcccctcccactctcttctcttcagctacccaaagtgatgatgtggaacttccagattttctcctgcaagttcatgctttatttattccattatgaggtccacatcaaattatattaccattcctgggattctggagttcagatctttggaaaatcacagtgtcaacagaaattataagataaaggcacttatatatgaggaatgatcccttgccctgcatttacagattcagatcaaaaaccaatgcccacatattttatctctagcttttactaaacagtagagtccgtgacttcattcacagtaggtgattgatacatttcgacaaaagtattttgcaaagacgcttcctgcagcatcaacagtaaaagagatactgaggtaggtgctatatgtatcttctggatacaaatttccaccaaaaaaaatttcatcttagcacatatctttgacttatggtgttcaattttaaatataactggcagttttgataaaatgcattcctttccattgtttctgttacaaagaatgcaattttaaggttttctgtttttgtaaattggagcggtggatacaacagttaccacccccacacatacacttctctaacacatacatatatacacacagttttaacattcccaattctttaaaaaattatctttgatcaaattattgtttatatgatgtaaatgccttggacactactgcctgtcagtgatgcgagtcagttcttctattccttttattggctcctcagagatttctggaagtccatctataatagaatcattatttcataatgataacatattttaaaaactcatggtttcagaaacatgagcaaattgccttgtaaaagcctacattgagggagttgtgcagactttaaaacacctcagcttctcactgcacattggatatggttgagtattgcaaatacagccatatttatccatgctatctagcattagacagtccttatcatcaagtgatctgagggcctccttcatcagcttcccttggaatgcttgctatcaaagtactttcctgagcccgctacagatttaacaaaccagagtctctgtgcacccagagaagggagtttgctccagtgattttcgtgcacactaaggttggagaaccattgtccctcagagccattagaaattcagcttgcatcagtctagagttctacaagaggcaatcacaacaacatgctatctacgaaaatcctatatttccatccctgactcagaatctataaatttcagtttaatttccactaaatgtattatcccgggaaaaagggcaggaagtaattatggaaaaaccattgaaacgtaagcatggtgagcagatagtatgaatatgagtataatctgacacttttaatatctcagagaacagaggaacaatagggaaagcaggtactgaccagccccagttcacgtttgtttctgccctcttgggctgtgcaactgtgtgacttgggcaagttacatgaccttgatagtcaaaatgtgaatgacagtatgtgtatattagtgatgttgtgagaattaaatgactgatataatgtgtccaccaagatagtagacagatagtaggcccccgtgtattagttacctttcttgttttctaccactactacccaagagggaagcttctaaactctgaaggagatctgttgatagagtctaatgtgtcatccagctttgtctctgggtcatatagagatacagtttgtatgccaaaaaaaatgtagtcctctatacagttcagaaaattaccaccaatatgctttatcaaacagcagctacagtgtagtatatgccaacctcagagtgggtctcctcttaaaggttcccaagtatccagtcatgtaaatgaagactgcatctaaggagttagctgtacagagaagagtctctgagaaagcgaaatagggttatagtctcctctagtccttactttcgctttaaggaaggagaaaatagcaaagagtgaagaggcctggaaaattgcagtaaaacagagcaaataggataagagactaataaaataagtggagcacagagaaactaaattgaatgacaacacatgagaaatgtactcaagttttgactcctgatttgtgaaccagaatctgccaataacaactaccaaatagatcagcccaaatatctattagtaacccccaagaacagtgcgatgtagtagagtgacccagcaataaacaaggccccatctctgccttctagtgttttacagactaggaggaagcctccacaaatttggcacagttaatgggtagctaatcagaaaaaattaagcttatatcaatgtacttaagctgtgaagaaaaagcctcatacttcttgttaaaaataaatatagtttgattgctcaaagagatcccagtccacagattaccacagtaaataattgcacgcccatctcttttgcaaagcacaaagcaacctgctccacgcgcctcagatgcctttctgaatcaccacagagggagacttttaatcatttcaacaaccagagcaccagctttgttctcaaacaatgctggaaggtttctcacacctctactatccatagtattataatttttcatttttcataggcaggggttttgttttatttggttggtgttgtcatatcccagaaacgaaacaggcctgcaaaatcaatgccacacgtacaactatgtatatattctcccctgtaaatctccattagcttgattgggactccatagtggctggaggtattgcctgcatctgcctttcattcttagtttgggcaaaatgagtggtgaatgactcttatacctgccttttaaaattggggatctcagatgagccctggctctaccactaattgcatggaactacttggtaagcagcatcactgaggcatcagcatcccatcatatttatttctagggaagatgacaaattatggccaaattagcatcgatatgaacaagtttgtagaagggtcaaaatataaatacaatatacaaataactacagcagtaatgtttttaatcactacattttcaaaaatattctaccgaaaagggtgattaacaaattattattatgttaacctagaaaaagaacataatcagtatataatcactaagaagacattaggcacatttaaataagtaggtgtttgcatgttaatacacacgtactcttagctcaggaacatgatccattaaccgatagaacgagtaagatgttagctaattggtgagttcttgcagtgagaaatgtctaatgtgagtccctggtacctgtgattttcaaaattatttaaacaggaatcaaaactgttttaataatttttgaaagcattcccatgctttagaattttggtttaaggcttagaccaaaatcatcatggaaaaaatgtgtgtctagtgctgaatcactttgacttgtattagaatgtcagctccaagaagacagacatttttgtcaatttttaatcatcaatgtacccacagtgtttacaagagtatctggtacactgtagggttattagcaaatattcacaaaataaacaaataaataatacttacctgtttcattacagtttctctgccagaattgtaatcattggtcaagtttgatagtggacatgggcctctttcttgggaagtaataacaataggaagatatggtactgaatgctagcttatgggaggtgtgggttaagaggtctcagggatgccctgtcttataaagagctctgcacaaacttaagcttaaactaactggaaaattaggacagccatctctgtcatttctctagcgtcttctaccctctattgctttccagatgcaactcaggggactctccttcccattttcctggccctttgctttctttattgggaactagttaccttcaattctccccctttgggtttatatgcattttagattattatggttattcttcttgtaacctcatttgcgtggtagatgcaaaacagaatttgagacattgccatgaacaaaaatggagccaattatttgtatttacatacttttctgaagtctattcatcagattttctgattcttagtgaggacttacttaggattattcagatgtggtcaagacaaaagcaatgaaataatcatctgaggttttgtattatctacagatataattctttatatttgctaaataacaaaaggaaatatttttctcttgttctctctgaatgaagggcaattgtgctgtttttctgtcactgtctataattttacttctaagaaatggcatgaaggtatatcagttacataagagggcttttatttgtcctttttggtattttttagtgtttggtttaatgattaaaatatattgtatctcttagatagttaactatacacttaccatatgacccagcaaccttacttctgggcatttaccaaagagaaatgaaaatctatgctcacacaaaaacctgcacatgaatgtttatagcagccttattcatgattgccaaataacttaaaaaagcagcctacatagagttcattgggtgaatggataaaaaccaactgcgatacagacatacaatggaatagtacacagcagtaaacaccaaagcagactcttgatatgcacacaacatggatagatctcaaagacattaggatgagtgaaacgatctggtctgaaaaggttacacactgtataattccatttatatgacattcaggaaaagataaaactatagtaatagagaacagaacagtggttgcctgggattaggagtagggagagaatgccacttcaaaggaataataggattaagactttgggggtgatgaaactgttctgtaacctgattggggtgttggggtggtagttttatatatgtgtgtgtgtgtgtgtgtgtgtgtgtgtgtgtgtgtgtatatatatatatataatatttgtgtacatgtgtatctgcatgtatttgaacatatatacaactgtataccaagagaaaaaaaggtaatttcccagtatgaaaattttaaaagtaaaatttaaaatatatcaaaaatatcatattgttccttataaatctataagcatagagaaaaagctggaagggtactcaagaaacgttatcatctgtgtggagggacttcaaaataagaatctatttcttttgtctttggaaaaaaaagctatttccgttttaaaaatatcgtgaagtcttttgtttagaattggtaaaggtgcttttctaaaaacgctcattttcttgtagcttttggttaataaaaatactcaaattattactgattatttttatacagtattttttctggcagtattaacagtatttgtatatggtgagtgttatattacttctgccaagcttgaaaacagagatgacaagttccgtaagtgtaaaaaaataaatgaaattaatagtttcgtgcctaagagcctctctttgcatatgagattagtacactgttctcatgcttattttgtattataattcacttcttcagaaagctcactttattccattcagttgcaaagcttggatggttggtatgcctataataaatttagaaaattaagttattactgcagtgaagttttcaaaactccatccactcacaggtatttcagttataattttgataatggagaagatggaaagatagatactatcaatattttttcctttgctacatttattcccttatgccttaaaaacgagggcatgatatgatattccatatgctaacgtgtgtatatgtaaaagaaagagaaaaaggaacttgctctatactttaatttcagaatatggctacctttgcttatgttagaatgtcagcaacagaaaattaaatagcccatataattaatgcttgtcttttattccagagtaagtttctttctgtgttttgcacatagtgtaacacaagtttgttgctgttgcttttttcattgagaaatctttaaaatgatcatgaagtgtgcaagtcaaagtaaaaacaataaaacgaggtattcaagtagatactgagaggtaaatgaattatgttcgttttatggcaacatccaaatattttgtgtttccattttatgtcaaaagttaagctttagctggaataaaaaatttcctctcttggtaaaatcagttgacttagcagttttatgcaagaactgaagtattcaatcaacatttttttttccatcaaacttcccttttgacaggaaattctgtgtctgattctttttttctttaaactgcattcaaaagaataataaaagagcaccacatgtcctctttgctgaaggagtttttaaagagataccacaataattattttcttgcttggaagctacctttattaagaggccaattttatactggaatctactattaaaattatgtgactaatgtttcattatgaatcatgatcacaaacagagtcattatgtatgggagacctgagaaatgttcgccaaccacattcaaaaatagatatttgtgtgtgttccagttacattttatttgaaagatcaccttcctttttttcttccaaatattccctttccccctcccttgtggtcctcctcacatctgagctccttttcttttcacagatggtgatactctttgaggtcaggtacctatgacctggagtgtttcttgaagcacttccaatattcggttctactttttcaatactcatgacagcacgcagtctaaggcaaaacagaagtgagggttgattgatcataaatatagctgacaccaccaagctgtcagggagcaggacactgaattgatcaaattttaaaagtggaggatgtgtggagccaaaaggaggtcgccttattttggagtcatcagctgagggctaagaaaagaaaattctggaattctgctctgtcaggatatgggatgggcttttagaagaaaataaggaaactgatttcattgcaacatgacttttggcagttgttttaccttaccttttgctaaaatgtcatccccgcacccccctcatgaccctttactattctccttctctttatttttaattttgtaaattttaatttttgtggtgacatagtaggtatatatatttgaggggtacatgagatgttttgatacaggcatgcaatgtgaaataagcacatcatggagaatggggtatccatcccctcaaacatttatcctgtgagttacaaacaaacaactcgattacactcttaaaggtattttaagttattttttacctcagaaatctctggttcatattatcagagacttaataatatttattgatcagaatttaacatttgaataatttattcttttcttatatgtacagtagtgattgggtgggaagagggctgagttcaaatatttactctcccacaagctacttggcaacttaggtagttggaacctcatgatccaagctctgaaatctttggaaactacattgtaagagacaattggttctatagagggaaacccttgcaaaagttacatgtgctctactgatatatcaaatgtatgtgtgtatgtgtgtgtgtatagtagaactgatggtagattatttcaattatatagcattaatgacaggtggactcaatttattttctctaagcagctgaaaattctcaccaagaaacagccttcctgtattcaccacctttatttgaagttgagaaataaaatgttgccaagtatatccagggtcatcccatttttctaaacacaagttttctctgcactatgacactcacattactgctgctaacatgacgagcttcagatattatcaggaggcattttgtatagtagttaatagtataagttcgggtactagtcctggattcaaattttgggttggctactatccagcttataatcctggataaattatttaattgctctcagtttcaattcctcatcttccataaactggaataatactagtactgacatccagggttgtgaagagaataatctacatcaaatgtcaacagtcattttctgtaacagaccagacagcaaatattttaggttttacaggccatataatatagtgtctttcacaactactcaactgtgcctttatagtataaaggtggacctatacaatacataaacaagtgggcatggctgtgtttcaataaaactttatttacaaaaacaggcaggaagactgatttagcccactggccctagttggcaaacctctggtctatattaatgcttaacacagttctaaacattaattttaattaatgtaaattaaatgttattagttctgtggcatacatttcaacgtatgccattattcaagaatatgtcacaatcatacaggccatactgtatttctccagaaactaaaattactatatcctaaaggaaactaccatggtttgaagatttgtttgtgagaaattctgcagtagcatctggtgatctggtgagagggacataataatcagtaaatagtttgcagtaccttcttatcaactaaatagatgaacgatgctataaaaatgaaacaaaagtgacttaatgaaatcttcagtaacgtagggtcacacatttattcattcttcaaagtagttatcctttcactataatttccttcctagattttgctaaacatatacaactggtagaagcctaatgtgctgttcctgtaacattatattcctgttccttgacttcctgatataatgaagctgattatattccgtgtttgataatgttcatcctattaggattgggaaatccattgaccaccgagcacaaccttatgttcatgttcttatcattagcaccactccagctatggagctgtcagcattttcagcctaaatgctgctttcaggggcctgcaattcagtcataaaaattagctgcaggcagaaacttgatatatgaagtccagatccaagagagaattttattacatttttaacacagagagagaagtacattagaccattataaaaaaacatacaaattagtgtagtgaacttgctctgcatccttttctgttctgacgtaatttaagattgcattcatatctgcccccttcgttttccatgtatccatgaaggaatcttacggatttccagtgccaggtgactttacgacaagttcccttaaggttacatttaagattggaacagagcagcttgagtctctatttgtcaatgggaaaaagattttccagccttttatgaattcaaaattaattagaataaattttctgccataatgcagcaacacagggtatgacctgcatcaggcttcatgttttatgattgagttttaagaactggcttgtgtgcaaagacttttctttgacgtgagattgaattaaggaaacttaattaacattttctaattaaatactgcattgtgaactcaatcgcattgtactctgcaactatgatgagattgttctgtctttatttaaataaacaagatggctcacagggttgagagcttggttgataaccatccctttctttcctcagttgtcacctctgcttttcagaaatattattagccactcacctaactgcaggaatttggtagacacacatttctcaaaaatgctcaaggatactaaaaatgatacctgatctcatgattgacgagagtagtagtctacccatttaatacctaattccagttcattctattcattcgagacaaaccctatttttattccctttcaccttattttctccatggaatatgtgatgtataacatgtatcatgtaatacacaataggtagcgtataatatgtgatttccagtgaccaccatggtgttcaatttaatagttaatgtgccatcctcatcttacttgccccgagagctgcactggacaaagtacacaccatttctccatgatactcatcttcccatggctcccaggacaccacattctcttagtttccctcccaccattctggtcactccctctcactcttttttgctggttagtcctcttccccctagtctcctaatattgcagtgccccagggcttaatccttggtcatcttctctactctccctactctcattccactgatgagctcatcctatctatatgccagtgcctccttaatgtatatactctgccctgacatttctcaaatcttgcatacctaactgtctatccgtctctgctggaatagacactccaaactccatatgttcaaaatcgagttcctgatcttttcctgcggacctgcaccacccacagccttctctgtctcagggacggtaactccagttgtcagttgctgaggccagaatcttagaaataatccttgactttttattctctcactctttacatccaatctgtcaggaaattttcatgcctctcacttgaaatttatccagcatctaaccacttatcacttctccaactcttatcaacctggtataaggcacttaccacagtttgttgctccaaagctctctgttttacattgtcagcaacagtccttacaatgatctacaaggcccaatctgggtgaattcttcatccccccgtcttagcatgtctcctcctctctgactttcttatgccacaacagccccactggccttcttgctgttcttctgacatgccaagcacacttccttcttagacctttgtactcactgcctgcaatgaatgcctgcaataacacatcctcctggctaactccctcacctccaagttttttctcaaatgtcaccatttcagtgagtcctatttcgatttctatttaaaattgcaaacctattctactgccagcatttctgaggtctaccttttctcctttccccatatatcttatcacctttgaacagattatctaacttttgtctgtctgtctaccccttatcatttgcccaccacattaggatgcaagtcccatgggggcggaaagttttgctttgttctttcgtacatcccaagcactgagagtagtgcctggcacatagaagtaactcagtgaacatcagaactattaaaagcatatacaatcagacgggcatggtggctcatgcctgtaatcccagaactttaggaggctgaggcaggagaatctcttgaggccaggacttcaagaccagcatggacaacatagtgagaccctgtctctacaaaaaatgaaaaaataaaaaaatcagctgagtgtggtggcatgcacccgtagtccgagctactcgggaagctgaggcgggaggttcacttgagcccaggtgttcgaggatgcagggaactatgagttcaccactgcactccagcctaggtgacagagcaagaccctgtctcaaaaaaacgcatatgtaatcattgaagaaaattaaattataactatgaaaattcaagcagtcacaatatagtgcaaaactgaatggtttattaaagatgtttaatttgaaggagattttttacaagtaacatttgttttaaattattcttattaacattttaaaagattgattttgcatgatacaagaaggatggtggcttcctatattacagaagtaatattttagagaagtaatagttccagtcattgccacagagttctaaataaaatttgcacatggaaaattaagcatgtaaagcaattgcatcctcatgatttagctaagaaaatgtccaaaacagttaaggtcagtcgtagatttaactcagtgtttcaaaaccatttgattcattggtaccaaaagcaagcgttttacatttttctccaaatctttggatgttgttatttcttctttaagcaccataaatttttagctatgcatgcttactagaagtaagcaataagcaataacttattccttttcatctgtggcttatagaacctcttgctttgtgcatatgttttgcccctctatttcactccagaggttttgatcatatcaagtttcacttaataaagatgagtagagggcaaaaatcagtagtaactttggggaaaagtagaagttccccttaggcattgaattataatcaagtgaggaaaagctattattgatactcattcagaatttcatattagatcattgaaaatctttaggaataatgattgcggagtcaccgctaataacttaatgacaattgaatatgttaaaggctttgaaaaagataaaatagatgtagatgacaactcctgactcagatgactatagtaatttttcataattaccattcacagaatacaatttagatagaaataagagcaagagttaaatgcaatacggagtagctctaataggacctagacatcagggttaatttgaaaattatagttcctaaagtaattgtgttgcagaagcctatcatacaaaatataaaccatgaaataaaatttttatgaacttcttactaaagctgtttttatacccttgttttgatgatttacatttctaatttcacaactttagcccttagttgagccctaagcaaatttatgaaaacatatttcttattagagtacttgaaatcccctgtatgttactaatcccaaccaatgaataagaatttccattctgcaataaatatcattgctatcccataacctatgtttcacttgtacaagaaaatacttcttcagcacaaagaaggaatgattaattcttaaaatattaagaaaacagcctaataaagtctctcaaattccacttgtaaaagcagaaaaaatattagagtaaaatcgccacagattgtctcctcaaatcataggaacatgaaaattggaaactttcagcaaaatttatttttaacattgttcaactgttttgtatagaacatttaacgttaagaagcaattttgtggtttgaactatttgcatgataatttctggtgtggaagatgccttagagctgtgttgcttcaacttttcacatcagcacagtaacagtggggccaatttggtctctttatgtatatttcaacattaaagttatttttagacaaatctaccattggaagattattgttgcattggtggtggtgagtgagattcagctatgtcaaatctctccatttaaaaaaatgaggctgtcacatatttcaggacttctctgatgaggtgtcacagtattttgatttaacagactttgtataactatgtggatacaatagcaaaagtttattttcatttttttttttgtaaattgttttgagctaggtcagaatgatttctaagcatacacacgctaaaacaatgctaagacatagaaaacagcaaatttttcaggctattggtagatagtttaataagttcgtcctcttttgagaggtctagtcacctgtgtctagtgttggatggaaaggggcttggatccactggttagtcttccttattgtctcagagaaggagaaaagggctttatcgtgaagaaaaatgactgatggagctctatatacacaatagtataatttgaatttaataatcaactaatagtaccaaacaatttataacccccataaactcctaacacccgatcttcattttcactgtaataattctgtcgcaatacaaagtgttcatagttttttcttgtatttgtcaataagatggctcaattttggatgagaatttcaaccactgttgtttacagaagttaggattttttttttaccaccatgttgagctccttgaaaaaattaaaggtaaactttttgaggtgaggtagcctttgtgaataacattgcaactgaggaatttttttttttttttgagacagagtcttgctctgttgcccaggctggagtgcagtggcatgatctcggctcaccgcaacctctgcctcccgggttcaagcaattctcctgcctcagcttcctgagtagctaggattacaggtgcccgccaccacacttggctaatttttgtatttttagtagagatgtggtttcactttgttggttaggctggtctcaaactcctgacctcaggtgattctcccgcctcagcctcccaaagtgctggggttacagatgtaagccaccatgtctggccacaactgaagaatttgaggtcaaaatagtcctaatgaaggctatcattcttcagctctgcctttcatgaccctttcagtgtacatattcatctggttatattttcagtcaatttcttggctcacccaagaaaaaaatgcatatcttgttgaaaaattcctcgccaactattttccatcaaacagtttttcataggtcttcacagggagcgttattttaaatactgagactccaaggcaaatgaaacaaccaattcattatgctataataaaaccataagaaaaataacagaggtaatctgaatcgagtgactggttgttccacagtgtttttaaaagacgcttcttgttagtgttagtaaataaaggtgtctatgtttttcagcttagctacctctttttggctcaaatcagattctactatccagtttttaatcaaattttctcttatctataattaacccttcaaaactaaactttaaagttcaacttgtttcctttttatgactagctgaaaattttttaattgtaaaagaaaaatgcttataattttttctatatgcatatgattgattttaaaatgtcattgcaaaaacgatggcctcatggcatataggttcatgtttttttgtgtgccagacactaaaattgaggctcctttatattattaaattgaaactcatgtttgaaataaactaaatacagcctataaggtttagattcactgcagtttactgctgattggaatacttttggtatcgagtttaatatctgacacaaactttcatcatttgtgatattcccttctaatttatcttgcatatttccaccagtttgaaatttgcacttcaaacttcctatttttattcatgacccatttcaaaatatgatatattaattatcctttactgtaaatatatgtactcaaaggggtttggtaataccctctttgtaataagtatgaaaagaagtgtccaataatatggattgattaaataaatataatccatataatactctgtagctacgggaatgaaaaaaatagagttacttgtactgatagaattttgtgctttttagaagatatatgtgtatgtgcgtccatacatacatgtgtgtatactgtatatgtgcgtatttctatatattcatgtacatatgcatatgtttgtcatgtttgtctattattatacacacgtgttgtttatatatgtagtattagccaagaaacatacagaaaaaactgtttccatggttacctctgagctctggggagtgaaaccaaagcacagaatgtgggtaggagctctttactcttcatcatctatcctttttaactgtttcaattttttttttactatgaccatttgatttagtatgaaatttgttatatatatatacacatacatatgatatacattcatacatgttgtgtacatttatatcatatatatattacattatatatgtatctatatacaatgtagtagctatcttcaaagaagattttttataactaaagataagaatgttaaaagtgaaggaaaacctcaaggcccaaataactttgtttgtagtatttaaattctgctttttctttctattctctcactgtctattcccttcatcacttaaattcattcccactaaaaatgactcacggacatagtttggaactagttgccacatcacctcaaagttaagggcagcagcttctctatttacagctgggaaaacttgtaactaagagggaggccatagctttagttaaatcggcatccaaggaaacaaaataccagaaattaacaatggttgcaaaatggagtcctagcctaatccctctcctttctaattactccctaattgtttcttaaccatgtgccgccaggctgcagtggttggggtatggagagtgaagaactttttgaataaggcaattcttactctggaaggactaacgaagaacctgattgtaactaaaatgagggaacagttcctactatttccatcaaattcattctgcccaaggaaaaagatgatgatttgattttaattatgctaacagcatttcaatagcctccggagaaaatgcctgctttccaaaatgcagatcactaaattatactgtgcctcctagcaactcctactactgagaattcaaagcttatctcaactttactttgttttaaccatcctaagatttcagtccacagctttcccataggctctacctgccttttagtgtctagaacacactctcacggcatctgggtcttcaaacccacacagttcctgtgagctattcaagataggtcaggttccagctgaggtcaggcattgtgatcactcaagttaaccctcctctaaaccctacctctagtgtcctaaatttgctttttgtctcagcagataaaacccagaggttcccaaacctgctgtgcatctgagtcatgaggaaagtttgtgaaatagattcttggtttctcagctacactaatacacggcaaggcttgctatcctttcttccagttcactgcttctgggtcctgcatgctggagcaccaccagtgctgcctcacctctggcctcctcctgacaaaggggtctctacactctgcactctgtcatctgtaaccagccttcttaggcacaagctgccttctattttttaactcccagtttcgtttttatgaactattcaaatcaaataattaagaataacatcaatgatgccagcaccagtagaataaggcacacctttgctttaggtcagatttccttgttcctctgtttcctgatgaaggcctatgcttctggactttcccttgattcaagatgagtgttctgcttttccaaatggccatcagcagggactaatggtggtcactattagtcttcactgacaggctttttagtccaaacttggagacatggctattgagcccagagttctcctcacaggcactgaggcacaggattctatgagcctcctctaataggtttcattcacagggataatgacatggatggatatggttatattcatgtaggttttagcaagaaagatgctgtccactgagagctacctgaaagattatgatacacactcttggaaaagaataagaggagcagattaaaataaaaatctttgcttaacagtttgagttggatggcttgatgaattgcaacacctaggaaaagaaatcttcctaggttatcttacagttatgatttttttaagtataaaggagatgagaacaataccaatgtaattcatcttaaaagactttaacctgtactaaagatttgtgaaattcttcattaattatgattgactattaataccatctcaaagattttgctagacctagaaaggctttgttaaataattttccatgtaccccatactctcacagatttaaaacctaacactgggagatagtctatcaggcaaaattatgaacttatatattgatgtaggcatagttgctcataggttccaaaagttaatatatacatttccaaaagttaaatataacattgtggttttgattacatatcacgttttcctttcccgctcaaatgaagttttaacatgattgcctagatttggtttcaaatttacctgccttagaaactgtcactcaaatgtacaattactttttcaatgttaagaagaatatgttatgataagaggttcctaaagaaagcatttcatagttctctggcattgaattttttttatttgttaccttgtttacttgtgtgtgaacgagcataaagtgaaccctcagaggacaagaaaaaatatcaggtatttctttatggatttaatctctgaaaattttccatcatcactaatgatgtcccaggagtccttgaagctaaaataacaagatatacaatttacacatttttatttagatgcactcattgtttgcaaataactttgcaatctgataaagaggcaaaaagataaactataggtataataaacttgaataaatggatagaatttagaatgtatctgggggatatatcaagggtctgtttggcaacttgggaagatgattggagaaaaggacagaaatacttgaggaaatctttctgcatggactggatcaagtctaaattccaaaatactgtccagccatggaatggcaggttagatgacagcttagagcgaggattggaaatgggaaacaatgtgaggatggcaaaagagggtatgtctcaagatgagattcaccagagcagagcaaagcagtgaagagccttcacttcattggacagcacttgctctttctccctttacatagattaaccttgagtttagcaatgcttatggagactgctagagaatgaagggaaacaagacacaatctgttaagtaaagaagcctagaaacattgggtatgtggaaatataacatgatggtgctaacagtcattatggtgactctcatttgtagaagactagttctgtttcattaagagataggtttcagcttgtcacctagtagatcttatcttaatcatggctgtgtatgttgactcacataccatttttactagtatgcacatccaccgtttactgagctgttgctctgtgctaacttacagtgtgctaagagctttatatactgtattcatacagttaatccctataacgaacctaggagtgaaatttttcacacccagttttgcaaatgagaaaattaaaatatcagaataagtgacataactttcttaaggtcaaggagataataaaagataggcttctattttgacatagatttagctgtctcaggggcctaaattcgagccaccgcatttatgttttagaatagcgattgcaaattgttgactggagcaccaaaatcagcctggggacctgctttactgattctacatactatgttttcagacaatctgaatgtgcatttttatggaggggagtgttaactggagtcaccgtgcatcattgttttaaatcatcttgacgtttaagatttcagtttttcatttaaggttacaggttgaataatatttctccctactttatcaaaatatatatcatatatatgtataaaataaactagcacaacagttatttaaagacagttcaattgtttgtactgagatatacaaacagaaacatttgggagaaatattacaatattcgtaaagaagccagggacattggttttgcaatattgaggtgacaagtttccaaaaattaattctatactgatttcagatcctattttccatgaatagacacagccagagggattcccttctgtaatcctcatccgtatgcctctaccaaccaattaattgctcattactgcatcaacataagtgtgaatttgttgacagagagacatttaagaaagaggttgtaaatatgtcccaatggtcctacgtactctggaatgtgggggaaaccataatcacagttaattcaatgtcaaatttcttattcaaatatgtatttccagttacggtgataatttttcattcatgctcgattgtgatgatttttgcttttattttatgttattctccattacggaacttcattttgttttacacaaaatagttaatataatacttcgcagtaagggcattttgaaagaacagtggcttaaaaacaaaatttatctttgtgtttcctacgaggtggtaagccagttagtattcaacaagtgtttataaaattatttcattttcttaaaagcctataataaagatattaactggagaaagaacgttgaaaattcagatgagatgaccagtggttttaatacagaagagacagttttcatatttttagcacatagaaaaaattgtaaaatgtgtttgctaaattccatctgaacattatcgtaagaaaacctcacaaatattttaatttcttaagtaaaatagcttatttcatttatgccctttactactttattttcactagataaatcatcaacgttttacttactttttcaaaaatcccagtagaacaatcatgtttgttttgacaaactctagaaggtttttatttctattaatttaaatagacaaaaagaagacacttgaaagcagcacgaaatccccagcacctttttacgagattataacttgtgtataaaagtaattaacattttctagtatcatattttaaccagatcagagattcttaacccaggattcttggatctacaaattaattttaaatggccttaaaattgtacacacaaaaaatattttcatggggtggggaagggggacaagggctctaccattcatctgttcttttttttatttttgagacggagtcttgctctaccacccaggctggagtgcagtggcatgatctcagctcactgcaacctctgcctcccaggttcaagcaattctcctgtcagcctcctgagtagctaggactacaggcacccacaatgcccggctaatttttgtattttcagtagagacggggtttcaccatattggccaggctggtctcgaactcctgacctcaggtgatccacccacctcggcctcccaaagtgctgggattacaggagtgagccaccgcgcccggccccattcatctgttctttaagagcgtttgtaactaaaaaattttaagtcagatttggaggaagaaaattagaggttttggggaggataagtcttgttcactgaagagtccctttcacataatttaaataagagctattgtgtatgaagctgggcacagtggctcatgcctgtaatcccaacactttgggaggctgaggcgggtggatcactttaggtcaggagttcaagaccagcctggccaacatggtgaaacctcatctatactaaaaatacaaaaattagccggggtgtggtggcacatgcctgtaatcccagctacttgggaggctgaggcaggagaattgcttggaggtggaggttgcagtgagcaagatcgcaccactgcaccactgcactgcagcctgggctaccgagcgagactccgtctcaaagaaaaaaagctattgtatacgaattgggctgctattatttattctcagtatttaatagtgaagaaatgtcttttctaatcatgcttatttatccattcactttctgataagcatttattgagtgcttaatgaatgctagatattgtttaccaagataggaactcagaaggttgagcaatctggggagaaatatgactaatcaaattgctgacacattgagtgtgagatgcttgtgggatatccaaatggagatgtccatggagggcagaggtccaagccaaagacttagatttgaaggtcagtaaatatgggtggtaaagtcattaaagtgtttgatgtaggtaagcccattcttgcatgtatagtgtgagtagaggatgaatgagagaaacagccaacattccctaggtgcgtggagggagtaccttccagagaggctggaaagtggttgtaaaaaaagccagcagagaaagacttccaaaatgagggaagagtaagctataccaagaatgtagaaagatctagtaaaataaagacataaccattcaaactgggaatcaattttagtggaaggctatcagtggacgtcagactgcagttagtagatgggaaacgactttcagtgtgctgtatgtttaaggaaatgattgattgggagataaagtcagaaaggacctcattacttagcacctggtatgtgatattttataaataccaagttaatggctttaactgggaaataataaaatcattttcctcctaatcccagaagacaatccactgagagaatgggatacttaaccaggggagaagacagtgataactttggcataacgtgtatcattcagagttcaaccagagaagtagagcagtagggtattatatatgtatcctattaggtgtgtgcatgtgtggagtttgtgtgtatacacatacatatagatagatacacatatattttacagagaatcggtttacaccattatagatctggctaagcagtctccacaaagctgtctcttcatctaatatcagagcctgaagttcacaggcaggcagtcaggtgggaagatcacaagcaggcttgaattccactaggatagactgaaacctgtgttttttgttgttagttgttgttgcctctgaccacggcagtaagaatgagcacacatacctctggcccagaaatcagacactgaaggaagatccaggggggaagagagcaatcccaggtccaaatgatgctttatgtcaatgaggcaagtcagcataccagcagcagtatgcatgtgtgcacacacatatgcatgcacatacacacatactgcaaaatggcaactgccttcctaacatcctccaactagtgtgaaagaatttatcgtgtagcctaccctaactggacacatgcaagaaaatggaattctggtaaatgtagtttgacctagcaagttggcacattacagagccaatacaatgcgtactttcagagatggcaagccttagaggctactagagtaggggttctgggtaatcattgtgcttcatgaaggtcctgtcacttggtagataagtgaaggaagttatgtagaaatctgagggtgggaccatgaagatcagcttgtttatcctctcagttgttctaagggcattgctgccatccctgttaacaaggggattaggaaataactgattcaatttgcctctctactacttccaccattcttaataataaaaagaaatgaccagtttctatttatttttttttcaggcaatatttttataagatgaatgatcttgattattacagtgaaaataaaatgatctctcagaatgttctgaaaacagttgtacaagtggaagttacagtgttggcttaaagaagagaacataaatactattcacacttctttagctgtactaaaagagctatagaatgtagccttatttattgttatgtaaaccagtaaaacttatccagcaagtgacaggaccttcatcctgtaccaaatccctgtttttggagtaagatgccaatggaaatagtggagctagtttaaaatcaaacatcagttcaaccaaactgatttaacattttcatttgtgttggggaagctcacggtctttaaatatcgatgagaaaggtgtctcttctaatacttgcttatgtgctgttaatgctgtactcccaaagatgatcgctaatctataatctaatctatacaactacacttttcaaaggatgtttagagtcacagacctgaacctgacttagggaaaggtgtttctccaagagcttttctgtgactacagattgttggagaaaacaggtagtgaaggaagatggcgcatgatctgctgcgctaccatgaagtagaatatatggtgatattttaaggctatatgtttacttttgcctaaattataaaagcaatatttttatattataaaaatttaaatgttgggaaataaagactcatataaaaaagataacaaagaagtaactgagatatgtcacaagttctttaaagcttcatccgtggaatcttaagaggctctctcctacttcagatgagaaagtcaggaagcatatcgtttgactaaacagtgatataaaaaatactaattaagtgacatttcagaattgcagttttgaaatgatttgctgttctgctcacaagaatcgtagttatgtttactaactttattcattttgtcttaatatttgctatagctgccgtgggcatggccacggcaaatgtaagctatcagactgaccaggttgatcacatcaatgaggaatattttcattaatccaagatggtgtttgattcagaatgcgcatcgtatcagcaacacttgccatcgaccattaaatgtgaggaattccaacagttagttagcaccaaggagttaacgatatgaaacatcatccagaactgaacaaatggctttactccttcctgtatcttgggctgtgtggaagttgtcagggtttcctggaaaagagttagatatgcttatatagattaaatatactaaagggcattccccgtaacagtcaagtaagtgttgggtaaaaggcaagtttattcatgtaactacagatagaatacgaatagtgtgaatgattccgtaagtattttagggaaagtattcatctttatgcaatgaaatatataaagtggtcattttcctaaagacaagaagacagttattttaattgacttccacaacttcccacttagagagttgctagtattaaaaaataaataaaatatcactgccatgaagattaagagtgatagtcagaaaatggacttcagaaaatgatacactttctttaggtaggaaagcagtaaagctattctcaagtgataaccttttattagatgctggcaagtctgaaatgctccttgacaatctcttttattgaacgaatcttgaggactataaacctagatcagtgccttataatccttgcataaggctgttgtgattaaaaaccaagtgaaaaacttcccaatagctcacagaagagtaatcagtctgtcttagtatttattagggtgtgtgtgtgtgtgtgtgttttaatgggatactgcttaagtatacaggccaggagtaaaggtaacaccatgagggagggtaaaggcatggaaagtcagattgggaactccaaaaagaaagaaagaattttgagggttgtcagagcttctcaagagatcacacgtttagagacaattcaaatacttttaaacaataataacaaaaaaatctactgagcctttagtttcatgatcagaatgggggatcaaagtcagaataccaggattagtttcaagtgattttaaagacaccaatattagaatggactgagacaggagatacaggttgcaaagagaaataaataacaagtcttcctcaagaatgaaaagaactctgagagacgtagctttggtcatagactagaaatgagaataacagtgaataattttttttttttttttgagatggagtctcactctgtcgcccaggctggagtgcagtggcgcgatctcggctcactgcagcctccccctcctgggttcaaatgattctcccacctcagcctcccgagttgctgggattacaggcgcctgccaccacgcctggctaatttttgtatttttagtagagacagggtttctccatgttggccaggttggtctcgaactcctgacctcaagtgatccacccacctcaacctcccaaagcgctgggattacaggcgtgagccaccacacccggccaacagtgaattttttaaatactgaaaatatctatgaatgctaccaaattctgaaactcttcctgattaactcagcacagaaaattccctctcattttgagcttcagttgttcaaactgcttccatggcagttcaaactgctatgtctccctctatcaaatggggacaacaaagccaggcttcatggtatattttaggctcagaagctgtcagaagcattttactgagccagtatggagaagagacaagcagagcaaacttctgcctgaaaaacaagcagttaacactgagtacttctaatataatggcgactaacaaaaatccttctaggcagaaaaggagaaaacacaaaacagtgagttcactgttacatcttaaataataaacaacatgcattagccatcatgatttcctgcacttgccacgttataagcttataaagcttcctaaaaatatttcattagctttgaaaactaataaatctaatgattacaatttatatttttaaaaacataagaaaagcaggtttgtgcctaagaccttgagtgtcaagaaagtttagagaggataactcattaaagtgtacagcgaatcataaaattcaatttgaattgaaccttccattttggcccaacctatccatgtaaaaaccagcaaaacaaatcattctaagtcacaagctgctgtatgtgttttagaacagatactatttactatattacccctaaataaaccaaggtctaagtaaatggtttctagcttttctctagttaagctaagttctttcttaaaaggaaactcgttctaattcatatttttcttctcgaagagggagcttatatttttctgtttctgcactttgaacatgagtattgtgggaaagtattaggggattagcaggagataaacgtggtttttgtcttcaccactaagtggatcaaattagtgggtatatggccatgattttattctgccacactatgacctgtgagacaaggtggaaaaagtagattctagaggcactgatggatacaggctaagctgggtaacaaggataccccaaaatgtaatgtctttgatcaaattgaagtatattatttctctcgataaataaaccaatagctagcagccccagaccagtcaggtgattccattcaattaagtcattcagggactcaagtcccttatatgttgttgctccccatttttttcctcgtatttctggtggaagccagttcactgatacatctgctttccagtctgcaggaaagggaaaaataaactccagggcatgcagctttatcataaaggaaatgaccaggaaattgcacacatcacttcttcatacatctcgttgacccggtctcaggcacatggccacatgtagctgcaagagaagctaagaaatgtggtctacaactgggtagccacgtgcttacctaaaattctagggactatactactaaaaggaagaaaggactaatagacactgggacacatttagtggtctctgcctcaagaggtatcagccagggtttggagatgacgtattcagcacaaaaaagataaggcagtgtttggacagggttacatgtaagttgtgattctcttgaacagacccctagtggtcactgacatttgaataaactgctaggggtatttcactttcaccaccactaatattctttactttcctcctcctttcatttttctttccgtcttgctcctccttttcatattccaattttccccccatatttttcctttttgtttcaactgctcatgatactgaggtctaaagaatttactgagtaatgagcacagatgtatgctttctttatgcatttttaatggctgatttaaatatacttggaggctaaaaatgcaataatttgctttaaatgtgtaggactctggaaagatgagaaagcactgtaagagttaaataaatcaagaaaggatttggaatagtgactatgtaattaaaagagcagaaataaaggatgtgccttatcaagatgtaatcacaaatattggaggataaaaagacctctgtattaaaacctaaagatatctgcattacaaaaaatgttcactttgtggatgacttgaaaaactttcgaaatgagtacaattataagcagatctgatgtttttgtcagaaagcaaatcacgaggtacttcttccatccactcaactcaagggtaacaatggctgtactttctgcccttcatcatcaccaggagtttctgagtagccttttagagcaaatcaatttcctggcaggtgagtaatttctactgtatagtcatcattttcccgcatcatttatctaagacccatcttctcaacactcaggtgcaacatcacaccttcccaggggtgaggtcatcaagggcatctgggtgttaaatgtttgatgttaacaagagggacaccccctcttctggctggtgtccaccgattgttctagacaccatgaacttttgtttcatgcaggtagaaaacagccatcaagagctaaaatttgagcccttacaagaatctttttactacccagcacaatgtggtaataatattcccacttctcaggcccttttccttcaagtgaataagatttcctctctattctagaggagccatgctactgcctctcttcatttgattactgtgggaaatcccccagcagcttattccaagttcactgcgcagccctctgattcctgaaaggcataatttggcctaacttgatatatatactatatatcatcacttacagtaatgtttgtcccataatagtaatactactactaataataataataattgctaacagtgagtgagcactcaccatgggtactataaatttatattaacttaattaactccaagttatttgttgttacttaaattctcttataatctattgatcaaacaattgagttgctttgttcctaaaagctacaaaaatatatagtaatgtagtataaaatctattttcataaagaaatctgacactacagctgaattatggttagcaaatttaaaattcataccttgttttcctcttgtgattttgtctccttgaaatttgagcagatgttgttatatctttcagcaatcacatcctcaactatgagcttaatataacgtacccctttcattacttttcctttcttttagaattcttagataaatctctgatttccaaagaactatctgtgctttgatattggcaactattatctgctgtaggtcctagtacttatttaggtaaaagatcttaatgaagttccaacgaacttcatttgtctccgtgtgtgtgtgtgtgtgtgtgtgtgagagagagagagagagagagacaaagaaattcttctcttttttcatttctgaataaagctttctagaagagccattcagtgtaactaatgacaaaagataaatatgttttgtaaaccactttgcttttatcttaaatggggagtcttcggcaaaacatttatctttaccatgaccgtagagtaattttaatatacatgattaatggtgcaaatgaaattaaaatccccctactattcaacatcttagttaagaacaaaatgctcactgtttcctaattgcaaagagtaaaatgtctggatgttgatgctttttaattagaggagaattttctttttaattaaaaaaagagagcttttttatttttcagtaagttagagagtgtcctctagtggagagagactctgatctcatagttttagaaatggctatatgatacccagttagaactgtgctccacttagctgattggaatctactggttgaagggaaaaagtattgtttttcctctaagacccctcaaatcatggcctagttaaaaggctgcagtgtgacaagcattgttctcattttagataggaatgattttttatgatcaattttagcatgcttccttctgaacctgttgaggttgagctgactgtgcacctttctgccaaaaaggaggcagaagcatttagtgcaatttactgtggcttttacaggtatcaactggaggcagcaagaataccattgtcttcaggactgcagacctggctgactgatatatttgatgtgtgcagatccctaggccatagcttaaatttgtttcttttattatttgaaggaaaacaaagaaacaaaattgagagacaaattaaataaaggtctctcttctccttaacttgtcgaattctaatgctaatttcctgtatttctggttaaatgtgctaagcagtcttagctctatcacttgtgtatcagagatgagaggtggaggagttttttcgatatctaaatggaagagggtacggaagagctgtggtggttggctctctgaatcacatactagaattgccttatcagaaattgcttattacagcaaattagagactgaaagaaaagaacgatagttgctcttgataacaagctaaatagcttggacttaaataaagataaaaattttattgctgattctttttttaattttaattttttaagttctgggatacatgtgcagaatgtgcaggtttgttacataggtatacatgtgccatggtggtttgctgcacccatcaacccgtcatctaggttttaagccccgcatgcattaggtatttatcctaatgctctccctccctttgcccccaaccccgacaggccccagtgtgtgatgttcccctccctattccatgtgttctcatttttcagctcacacttatcagtgagaacatgcagtgtttggttttctgttcctgtgttagtttgctgaggatgatggcttccagcttcatccatgtccctgcaaaggacatgatctcattccttttttatggctgcatagtattccatggtgtatctgtgccacattttctttttccagtctatcattgatgggcatttgggttgcttccaagtctttgctattgtaaatagtgctgcaatacacatacgtgtgcatgcatctttatagtagaatgatttataatcctttgggtgtatacccagtaatgggattgctgggtcaagcggtatttctggttctagatccttgaggaatcgccacactgtcttccacaatggttgaactaatttacactcccaccaacagagtgaaagcattcctatttctccacagcctagccagcatctattgtttcctgactacttaataatcgccattctgaatggtgtgagatggtatctcattgtggttttgatttgcatttctctaatgatcagtgataatgagcttttttcatatgtttgttgactgcataaatgtcttcttttgagaagtgtctgttcatatcctttgcccactttttgatggggttttttttttcttgtaaatttgtttaagttccttgtagattctggatattagacctttgtcagatgggtagattgaactttctcccattctgtaggttgcctgttcactctaatactagtttcttttgttgtgcagaagctctttagtttaattagatcccatttgtcaattttggctttttttgcaattgctttggtgttttagtcatgaagtctttgcccatgcctatgtcctgaatggtattgcctaggttttcttttagggtttttatggttttaggtctaacatttaagtctttctttaatccgtcttgagttgatttttgtataaaggtgtaaggaaggggtccagattcagttttctgcatatggctagccagttttcctagcaccatttattgaacagggaatcctttccccattgcttgttgctgattcttatatttgaaaaaaagggggataaggagagtgttcataaaatccttcagtaatccaacaaatgtcagagccataatgaacaataaggcaaatatattcccttttatagataattttcagaaacatgtatagtcgtgactcccacacagatggaagaatgaatacatgttaaaaaattttttgctgatgtgatatgaggggaccaagcagatgttatgaccagttcaaaggaaatatcaaagcagcagatttacacagattaaagaaatgttgagatgaattgtaaatggagacaaaattgtttttttccccaggttataggggggataggagaggtgagtcaattaaatcactatcagacaggagagaatttgtacccctatcagtgtcctacattttacagagtcaaaatatagttcaaagacagtaaaaaagcctttgggaggccgaggcaggtggatcacgaggtcaggagatcgagaccatcctggctaacacggtgaaaccccatctctactaaaatacaaacaatcagccgggcgtcgtggcgggctcctgtagtcccagctactcgggaggctgagacaggagaatggcgtgaacccgggaggcggagcttgcagtgagcccagatcgcgccactgcactccagcctgggtgatagagcgagactctgtctcaaaaaaacaaacaaacaacaaaaaaaaaaacataaaaaagcaggaatccaataatctggaagggtgtgccatagaccaatgagtagttttccaatgaaagatatttctttctacataactttgtaaatatatatatatatatatatatatatatatatatatatatatatatatatatatatatatatttctgtagcctggttgggttgccagtgacccagttttatatcctactttcttgtctacaccagctacttctctacctacaactgccattattgtgaaccctctttctctttcctcttctccagcctccctgtccttgcttcctgcttacaggacctgccctaatatttttcaattttgttgcttttctgagccccagttccactttaaacaaattccaaggtaaaaacaaattgttctggacagttaactgtaatcacttgcatgaaaaaatcacctgagggtgcttgttaaaaattcaaatccctggaactctccagacttgacttgctgaatctaaatctggtggggggtggaggtaaattttttgacaataaatttggaactcactgacttaagtaaaataagaaaaaaatgtaacatctaagccatatgactctaagctaaatgacattgtagaatatatgggagtataaaataaaaactgatatgaaagttagtggaaatatgcaagaaaaagcaaagttaatggtagcattagtaattgctagtaataactttccctaaagttcctatcacaatctatctagcactaattattttcaagttgaatatctggaatgtcaatctattaattttttaatgtccattctagatgctatgctaagtgagttttaaaattatttttcctttttaattgaaagcatacccagacacacattaaataaacacaaaaaataaaaattcataatcattctgttttttctttgtatcactttccattctactgaattttactaattataaatttaaatcttttaatcttgcacttttttgttatttctagacttcaattttaagaaattatttttcctccacatatttataaaatatatactttctcctatatagtatatttatttcatagtaatatttaactctaataaatcccacatttatttttctatattatatgaaactaatttttgtttttagaaaataatgcaattctgataactcattgcctggagttaaatctggtaccatatctgagcactacaattgatttcaaagagttgtaccactgcctgcgggataaacatgatgttgtttttttataattgttttaaaatacattttgctctttgtttagaccaacaacgtaatgtccagatctatcatcattacacttctttaggatagttgttgacaatatctacctacttaaatttctaaataaatatagattttgttgagttctacatcttattggacttttattagcattagcattacatctaaaatgtaacttgggaatggatttgtttaattgtttattgctagtataaataggatctcttctattttctaattagtaactgtagaaatcatggatgataatgatttctaaatatcatagaccataactaactacagagtttcttcttaaggctggcaaaactatgataaaaatcagtgtctcttagagaataagattaaaaaaatttaaatcacattaactatagctaaactgtaagtacattaaatttattgctacaaatcatgtagtttaaaaaaaacccctcaaatttgccagatttacaaacttaccccactatggaaaactggctttcttctgaattgccttcatcaattatttattgctgcagggttgcaataggctgaggtagatgctcttatggagtatctaatatttcatattaggcagatagtgtttcatttttaaatttcaagccttgtgcctgtaatcacagctactcaggagaggggaagaccgcttgagcccaggagttcaagaccaggctgggtaacatagcaagaccccatttcaaaaatatatatatatatatatataagcaaacttttttaataattttagaatctatgctcttaagacccacattctctcttggttttattttgcatattctcttttgagtttcttaagggtatttttgtctggacctaaagttctatccaaatatattgaaaaaaatgggtagcccctcctttgagaattaccacatagactccatttgatctataggatagtgagtcttatttttacgtgattatattttgtttaaaataactcaaactatagagaattttatattttggaataccaatacaaaagaatgttatatcaaaaggacaaatttttaaattttgctagtaagtgattacaatatatgtcttagatttgaatatttaaaataactttttaaaaagtcaaaatatagggctttttaattggttaagtatgcaatcaggttatcttcaaacaatgtttttattgaaattggttcaatatatgaagcctttatttggcaattttcatctttatgcactttccaaatgttagctagttaatctgcttaacaatattccattaaacagttgtacacattttatgttcatacactcctataaactttaacaataataataataatgatgcttttatcagctttttaaaacatctcattgctttgttatatcctattgtattagtaaaacttctaaaacattatcatattaaaagaatgctggccaggtgcagtggctcatgcctgtaatcccagcactttgggaggccaaggtgggaggattacttaagcccagaagtttgagactagcctgggcaacatagggagaccctgtctctatttaaaaataaaataaaaaattagctaggcacaccaacctgggtgacaaagctagaccctgtctcaaaaaattagccaggcatggttacacatgcctatagttccagctacccaggaggatgaggtgagaggattgcttgagctcgggaggttgaagctgcagtgaaccgtgattgtttcactgcactccagcctgagcaacagagtgagaccctatctcaaaacaaacaaacaaacaaaaaactgaaaagaatgctagtaggcacatttctatataccaacaacatccaagctgagtgccaaatcaagaatgcaatcccattcacaatagccacaaaaaataaaataaaatgcctagaaatacagctagccaggagggtgaaatatctctacaataaaaattacaaaacactgctgaaagaaatcagtgatgacacaaacaaatggaaaaacattccacactcatagataaaaataatcaatattgttaaaatggccatactgcccaaaacagtttaaagtttcagtgctatgattaaaaagtcaaaacataacagatgctggcaaggttgtgaagaaaagggaacgcttatatactgctggtgggaatgtaaattagttcagccactgtggaaagcagtttgatttctcaaagaacttagagctaccattggacccagcatcccatttttgggtatatacccaaaggaatataaatttgtttttaccataaagacacatgcatgcgtacgttcattgcagcactattcacaatagcagacatggaatcaacctagatgcacatcaatggtagactagataaagaaaacatggtttatatacaccatggaatactatgcagccatcaaaaagaatgatatcatgtcctttgcagcaacatggatggagcgagagaccattattgtaaatgaagggaaagaaaaccaaataccacatgttctcacttataagtggaagctaaacattgagtacacaatacaggtatacttgagggtggagggtagagggtgagaggaggctgagaacggaaaaactacctaccagataccatgcttataacctgggtgatgaaataatctgtacaccaaacccctgtgacatataatttacctatataacaaacctgcacatgtacccctgaaagtaaaaatttaaaaaaaaaaataatgcttgtaggcatatttctattgaatttaaaggagatgatactgtgagtcccattgtatattcttgtttaacatatgtttacttttaaatatttggaatggaatattttcagtatttcttaataaagcaagcctacaataatttatttagttcctaaaacttgccaagtaaaaatatagtctgattttataatcatacattttataaatcattttataaattcattatagtgtttataacacaaaagtaggtaaataaaaagcattttagatatgatgttgacaattgcatgctacgatccaatgagaagcctttttatcttgatgttttcataattttgaacagtactggtgattagcaaaatagctatatttaataataaaattttggtttaatatgaatgttagggaccacaaagagatcctacttcactctcactaggatggctataatcaaagcgacagatgctaagaagtgttgacaagcctgtggagaaactggaaccctcatacattgctggcaggaatgtaaaatggcacagccactttgaaaaccaatttgttatttcttcaaatatttaaacataagattctcttatggcctagcaacatcactcctaggtatgtacccaagaaaaatgaaaacataatgtccacacaaaaacttagcagcagtattcacaatagccaaaaagtggaaacaacccaaatgttcatcagctgatgaatggataaacaaaatcaacatatgggatatattcacacaatgggatattactgatacatgctatataacatgaataaaccttgaaaacattaaactaagcaaaagaaaccagacataaaaggcaataatattgtatgactacatttataccagatgtccatagagacagaaagtagaagtagattcgtagttgctaggggctaaaatggggagtggctgccacttggtacagggttcctttttggggtgataaaagtgtcctaaaattgattgtggttctgattgtacaattctgtgcatatacagaaaaccatggaattgtacaaattcatgctatgtgaattgtatctcagtaaagctattaaaatatgcatactatgtatgtaaaaaataattttatagacagtagcatctggtaaatgtttaacacttggctctaaatgtagttctgccaagaatacagttcatatttttgtttacattagctaataaaacaatggaggtgcatatcagaactttactcactcatcagtgatgtaaatgagttctttgcggaatcatattttagtaggagaatattttcttgatgtttgtgctattcccaatatggcagctatagacacgacatacttttaatttaacctgcattattaacattttccctgtcacattttaagtacagtcagtcaacaaaacaataaatcatagcctgatttgtagcatttgccaatgtatggagtaaatactccccctatcgtctttttcaagctaccaacataatgtcattaaacatatagttgagaagagatgtgcagtagtacactattgtatagtatttccaccatacggatactatagctgtaaacaatctcaaaagatgagtgaatgaatggtaaaatgtagcaaaataatttggaagttttgagtatctattatttttgtttttaattttttttgtatttctataatttaattttcaatgactgtgcttaacagcctgctcacagaatttctgaaaatgtggtaactgacttttgcaagctggtgtggaataataccactgaaataatacctgaatgaggaggctctgtacttacttacaatgtgaagcctagtttacacgataaatttgggctgtggagacatgtagacatgtagcctttaattaatgaagctttaaaaaaagggaaacaaggtaaaatgaaagttcaaaggatattaagcaggttattcattaatttgagattatgtattgagttcttaatatattcaagatgctgtaatgggtcctggtaatacgaaggtaaataaagatataatttctgcctttggggaatgcatagtcaagttgctgggctagatatgtgagcaaagcagatactgaaaggactatattatgataaaacagaaatatgttccaaagtctatggagaaaggagaagagaaggaggaagaaaaattaaatgagtattttttgaaagcgcaggcctgcattttggaagaagtttcatttgaattggatttaatggatgaagcgtgtattaggtgaaaatgagaatttaaagcaaagaatataggcttaaataaaatcaagagactataaaatggaatatgaatgggtgactcccaaaattcagatgctaaaaacctgttgtgtaattggcatatcctagttcattggccaaaggtacaaacacagtcccatcatttattactttcataactactatttatcctttttaatccttatttgcccttatttggtggacatacatcacttattcctaagctccaccctgctccatgaatttctatcaagtcctggttcttattgagattcagaggaaaggataatagtccttcattcccactttcaaacacaaggtaatacagttgggttccaacgtcacagctctctgacacaggtgtgattaattactttttcccaataaatagtacctggtgaatccagcttttctccacaacactaaggcccctggttagagactcaggtgtgagcttgacctcacctggcctgctctcagaattgactccattggactcctagtgtctaggctgtgagcagagcaatgcataagaagtgaagtggtaactttgcttagccgcacaaatttgtacaattaagagaaaccactgaaaagcctcttcacagaacaaagcactgctcaaattgactttctgttctgcctatattgagaagcaactggcagttcccagatctctttctctgtgtgggtgacacagtgatacacacacacacatatatacacatatatgtatacatatataaacacacatatatatacatatatatagagagaaaaatatatatattttctgccttaacaggattcctacttaatgtctggtttaagaggttccctattatcacattgataaaaagcagagtgttctgtaattactgctaccacctatgctttatcactttaagaaattatgtggaaataatctgatctttgcagtgcttattccttatgtgatcccagagtattgtaacattctcaatccttgattctgtctgatccaatctcaggtttgaaaatacagtaagattgttctctttagaatagagatgtgattgcgtcagtctcctatttgaaatcttccctcaacttcccattgccctgaaatggaagtctcacattttccacatgccatacatagaacagcgctgctcctgctcttgcgtcatcagggtccattcgtctcctaatcttccctctacttgcccctcgtctacactttagcttcagccccttcaaaactattttattttccccaaagctcccaggctttttctcactcatgctctttcctctctgtccagagtgtttttctattcttctctccaccgtcttctattccttccttgaatttcactgtcttacccacagcaagcccatctcaagactggttagagttctcctaggtgtccccatagcactgtagatacactcagtactggagccccaggcagggtggggtagtcaaagaacaggtgagccaagatggctgagaaagcagattgcttcttacatgggtgcaggagccattttttaggtgtggcagcacaaggcctgcaggtaaaagaaaagaaatgaattataaaattatgaaaaataaaagtgaataaaaatgaatttcacagttgatgtcggaaagaaaggagggtgatgtgagacagtaattcaggttccaatgaggaggtcaatcggcctctctgctaaggaatgtcagattccttatttatgatttttaaggtcccatatttactaaaattgtaatggaaaattaggcaacacctggagatttctatttatgagttccaggcattaagtcccacctaaaaacttaaacttggtcttataaaagacagtataaattattaatatatacatttttaaaactgtaatacatcttgattccattggcatataatgttaatcatcatactaggtagtattttgagacttattattgaattcgtgactaccttggcactataacagatagtcctggtacaaaaaaaaacaaaaacaaaaacaaaaacagtgctcttataaaaatgtaaacacaaagaatatttgatttgaaactgttttgtaatgttggttgacacttgccgtagaaatctgcaattgatttccaatcaatggaattgacatttattcattttgtaatgtaaatattctctaaaggagagggaattttatactaaaatatttctgtacaaagattaataataaagaaacctccttggagcctcagtttgcctcttaaaagtttgtagatattttctggacttgccttatctggtcatcagtgatgactatcacataaaaaatccggctggacgtggtggctcacgcctgtaatcctagcactttgggaggccaaggcgggcagatcacgaggtcagtagttcaagaccggcctggccaacatggtgaaaccccgtctctactaaaaacacaaaaataaattagtcgggcgtggtggcacgtgcctgtaatcccagctactccagaggctgagcaggagaattgcttaaacccgggaggcagaggctgcagtgagccaagatcgcatccctgcatcttagcctgggcgacagaggaagactctgtctctgggtttaggggcgggggaggaatccaagtctgtgaggaatctcttggagaacatgcagacataagctaaaatagagaaggctatatcatgccatattagaaatattagaagagcaataattttcatgaattattcttaaacaacgaacataagagaatacgattttatcctataaaaatgttgtcattgtggaacttgtagaattaagttacagatactcatgccctagtttagaaagattacatgtaagtgcattctgcttttctctgtgtttatgctgtagaatctctcataagcaaaatttcaagaaatacgtactatcaactcatagcttagccctgaggcttccagtacttaagaaacctccttccttgctccttaggatcgcagagttctcagggccctctggtaatattctttttttttttttttttttgcatttaatttttatttttattatttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacgtatgagtgagaatatgtggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatagctgggtcaaatggtatttctagttctagatccctgaggaatcgccacactgacttccacaaaggaaacaacaggtgctggagaggatgtggagaaataggaacacttttacactgttggtgggactggtaatattcttaagtatctatggctaccacaaattgagagtttgcttacttcaaatgccagcaaaggtgttgctttttcattttcagcccctcacgtggtgcccatccctgagagttcctttgccccaatccagacttacaagaccccatcttatccctcaatttctggttccatttagcggtagcaagatcttaaaactagtatctactggaatatgtcagttctgtaatgctgactgaagcttgagtaaaccaggtgcttgtaaagtggcatgaaatatccagaaataaactttactttctacgggcattaaatttacttccaccttttagaaagagacttcaatttaccttattaaataactgaccaatctgtattcaccactaaaacattctaagtagcgtattgaaataagctaatctttacagtagtataactgattttatctgtgatgaaaatcccaaatatttattgtcacgatttttgttttttaatgtgtttttctacctatgtgttagcttctttaattcgaatgttattctctatgaattaaaaatattttaatagcattctcttaggatcttgcgtttatggttcctttttctttgcagccaaagattttctatctcccacattcgagactgagaaacaccttctatctgccctataaaatcttataatcagcaacgttatgtaccctttgatatcatgcttcgagaagggcatatcacctctgtggtatccttcgcaatcattcatgacctcaatctaatcatgagaaaacatcaggcaaaccgaacgggaaaaatgttctgtacaatagccgaccagtcctcttggaaattttacaagtaactcacattccattaaacaagccatgttgtcgaaagcacacattctatcaatttgacaaagattgaaaatccctgaaaaattattcttttagaaagatattttattaaatcaatgaaaagtgatcaaaatgttacctgtcagtttgcctaaaataagtgtgaacaaatagttttataacacttttccatcacttctctctgcaggtgactctgctaatctaacctgcagagctttctttgggtacagcggagatgtcagtcctttaatttactggatgaaaggagaaaaatttattgaagatctggatgaaaatcgagtttgggaaagtgacattaggtaattttttttccttttaacctgtatagtcaagattaacatttactccattagtgaatagaaagtaagctgaaaggatttttttttgttttactagtatcataataaaaatactacaatatttaatgataaagaagcaaaacactgttaacagacttactatggaattgcaaaacatgaatgccatttgcaaagaatttaagaaaaataacgaagattgttcattaagccacatactgagtgcggctgggggtggtggctctcgcctgtaatcccagcactttgggaggtcagattgggcggattgcttgaggccaagagtttgagactagcttggccaacatggagaaacgttgtctctactaaaaatacaaaaattagccaggcatggtggtgcgtgcctattgtccgggctactcgggaggctgaggcatgagaatcacttgaacctgggaggcagaggctgcagtgagccaagattctgccactgcactccagcctgaacaacagagtgagactctgtctccaaaaaaaaaaaaaaaaaaaaaatatatatatatatatatatatatatagtgagatcaaaataccataaaatatagaaaatgttagtgtactttttgtatatgagaccttttttttaaaaaaaaaaaaaaaaaatgttctttgggaggccgaggtgggcggatcacctgaggtcaagagtttgagaccagcctggccaacatggtgaaccccgtctctactgaaaatacaaaattagccgggcatggtggtgggcgcctgtagtcccagctactcgggaggctgaggcaggagaatcacctgaacctgggaggtggaggttgcagtgagccgagatcgcaccattgcactgcagcctgggcaacaagagcgaaactctgtctcaaaaaaaaaaaaaaaaaaaaattttcacaggaaacattaacaaggtacagggactcaagcaaacacaatctctgtcatttcctgctacgtatttttacatatttgagccaccaagtggaatataagcttttgatggtagtgataaggatacacaaaatgtgtttatcgcctttcttagtctgactttaaggtcgaaatatttgtatagtgggaatgataacatgaaaatatttgaaggcataatgcctaagccccttttttgttcaatgtgtttacttatttattcatttaagtatcaattataattcattcaatgctagctgtaattatgctttggcatagatacttatttttattcataatgtaaatatgcaagaacgttaataataataagtaagttacaaccacatcaaaatgatgattacttctaaacatactcccatctaaagattgcatcttctgggtatatacaaacattttaatcatggtcccccattctaaatgtcaagacttttaaaactttatcaaaggtaaaaaagaaaatgattttcaatagaaaaataacacattttctattgggaccttctttctggcaacaaatacataagaatattgtactctagaatgccccagtgggattccagaaggctagatggacaattgtctaatatgtactaaaacatttttctgctgattttcgtatttaaaacttcactcttatcttttacccatggtctatgaaatgctaaaataaatgaaggacaattaacctcctaacttttaccccctctggctttgtgtgtgttcagggaagtttctagaaaggtagtttaattctgcatttaaaaatgttgaacagagatgacaacgaggttagtgagcatttaccattaattttaatgtcagagttaaatacttcaccagaacttttagtctacaggtttatagtttcacgttccttcaaaaacaggcaatttgttagtatcattaacaaaagtcagactgaacatttcaactgaaatgtcaaaatagctcagaaattttcttttcttttttaaaaaattaacctgacatgtaattaggccttcagcctgagacattagaatttttatctcaacttacataatatttcttcttaaagggaaagcaatttgtaaactttttcttcaaggtctttctcacctctttattatgacagtgtgattgtcctgctaagggagataattaactgcaacttcattagcatctacaaagacaagcttcctcattacaagtgaagaagaaaagggcataacttaattaacacagcatcaattcatagccaaattagaagcacagattttgtaggtagttttacatcagattcggattcatctacatttctttcttgtttgtgtatgtgtctgtttgtgtggatttttgttttgttgctttacattttagaattcttaaggagcatcttggggaacaggaagtttccatctcattaattgtggactctgtggaagaaggtgacttgggaaattactcctgttatgttgaaaatggaaatggacgtcgacacgccagcgttctccttcataaacgaggtgagtgtaaccttctaagcttcggtggtcaactgaatgtatgatgggagaaaaaatcattgggaaccaagaaacaaatttagttttgtttttctccacaaagttctcctaaataaaataatcatatttgcattagagccaccgaggcaaacagcacagtagatgggtgagtaactcagtctctaaaatcaaatttgaaatccttgcttttctttaataccaactgtgtaactttgggcaaaacatttaacttccctaagctttagttatctgataaatagaatggggaaaataatagtatcaacccttcagtatgttgtcagaataaaataagacaaaaaaatgtgaagggcttgacagagcctatacaaggaaagtcgttaaatgctatttattattattagaaatagatattaggggccgggtgcagtggctcacacctgtaatcccagcactgtgggaggccaaggcaggtggatcacttgaggtcaggagttcaagaccagcctggccaacattgtgaaaccctgtctctactaaaaatacaaaaattagctggcggtagtggtgcaagtctgtaatcccagctatttgagaggctgaggcaggagaatcacttgagcctgggaggtggaggttgcggttaggcgagattgcgccattgcactccagcctgggtgacagagtgagaccctgtctcaaaaaaaaaaaaaaaaaaaaaaaagaaaagaaaagaaagaaaagagaaaaaaaaaaaacaactaaatggttttaagtcaaagattgtatttcttactggaagattgctcctttagtgtaagaactgtctggtgaattccccactgcagtattttttgacatattgtttctgccttggataactttcatttgtacaatagtctccaatgatgaataataatgcatttttaagtaagataagctgtggttaagtgcaatgtctgttgtgctaactctgcctctacagcaccccatcaccttttgcatagggttaagtgcatttaaatgtatattgaattgtttgaaataagtgacaactgtaaaatgtgagccattcctgttagtaaaattgtttgtgtatattacaagagaaaaataatttttctacattatgctaagttaaaactttctactctttggaacaagcacacttgatgttctcttactcagcaaatttacaacgattttaatttcaaagcccgtgtttaatcctagactctttgaggtttgaaaagaaagagaacattgaaggctgttcccccttctttattgggcaatagattccctttgaataatattactgaatgctgttaaaatagacacctctgttgtcaaggtgactatggtactaaaatagtctaccttttagggatgtgagtcaaggagaaaggtatgcagcagctaacaatatgattgtatctttctatagtttagtatatagccaatcaaggaagagattttagtagaaatatcatacatatacaaggacagaagtagcttctcatagttaaaagcaacttaagtgttgtgtaattgaacttcttatcctgccataacatcttctgaagtgatctatcagcttatactggatcacattcccttctcaaggaagtccattttatctttggaaaaatccgttagaaagcatttcactttcactgtctatccattggccctagttctgtacttttaatcactcttccccaagacagcccttcaagtgtttgatgacagtcaccatgagtctctgaacctttacttcactagattcagcctctttagcttcttttactcattcttcatttgtattagcgaaatacttttaccattctggtcactctcttgaatctgctttaattaaagagtttgaattagtcctcaaaaatggagttaggggagagaagatatagggcacataaaaatgtgttgacttgaacaacatattttggggggggacaagggaggggtgacagttaagtaggaatcaaaggagaaggggaggaaaatgaattatatctaaggataaagctattaaagctctgtttttacagagaggcacacagccaagaaggggtcaaaaaacctccaggctaagttgcccaaagctatgaaaccttccatttctagaaaaataaatgaagaatgaagaaaattatttgaaattttttccagtaatatttgatttcctaaacatgaaaaaaatgtggtcaatgttagagtattcttcagtacttaagtcttttagtatgtttttcaaatatgcgtttataccaacggcattttattcttgataaataaaagcattaacaagccaaaaaaaggtccttccaagacatgtactccaaaagtccctcttaaagtgaatgtatgccttccttttaagggagctgcagcaaatgagtcatcaattcacaaagacaccaatggatgcaatttcctgctcttgagggactcatgattatatggaatgatctatcccacccatcttggggggataaaaaggactttcgttcacatatgacatgacctgaactttaccagccctgcaaggttcaggagaacagcacacagcatatatgaaattataggtttgggtctttgatcattgagtctctaaaaagtcaaatgtctgtcatgctaacaattatgtaattatcaggtgagttgctatattactcagaatactaaggcttagataaggaactggaagctttcactattaattgtatttttctgccacttactcataaattccttaacttataagccttcacagtcttcccttttaaaacctccctagagagacatgttcaaacatttgttgaatactgatcttgtataccacaagctgtcattgcttctgacaggtaaaccttccaggacattcctttgccaaaattatctaagcaatttttccttcactgttaccttttgttcattatcattgacataataaaatgatttcagagccctccaatgggtggtatggattctttgaaacattgcttccttgtatcaaatgtgtcttccttaatgccaaggggatactataataaataattcagctacatttgagctaggctatgttctgggtcagccttttatctgcgtaaaagaatcataattccatgaaagcctgcagaaaatctaccaagaaatttgaccatagaaaaatcttgctcgagaatatccaaagttgccaattcctgcagccagaaaaggtattaggttcatcagaatctcatcagacatgcaatatagatatatttcacttactatacagagcactagaatatgcagcaagagaaagacagagaatgaaacggcaaggcccatgggccatattggtttatgactgccctgctccttactcttcactcctgccagaagcttctattcaatcctctttgccagactctggcctggcaagcttgagcattagatcctggcttcaaaaataataatcaaagtaaagcgctgacaaattagatattgggttacttcttgttcttgttattgctcatacttgattgaattccacatctgagtctttgaatcttttacccagatacacttgctactgcctgtccaacacacactgaacactgaccttcagttctcctccaaagctctgatctgtcctattctctccattttttacattttccatttctctgacacaaacaatagtccaggtagatacctagaagtattgtgctctgacctcaggcctagacactcttgtacccatcaagctgtctcagattccttcttcactctctgtgccttctgtctatactctcattttgaatgacctcacagtgtagacatgtttattatcttaatggttaagagcatggacttaggagtagggctggctgtgttcaaaacccaactctgttcttactagctgtgctatctggggcaaattacttaatcactttgagcctcaaatttctcttctataaaatgggaataataataagacctctcacatagagcagctgtgaggattcaatgaactcgtatgtgtaaatacttatcacagtgtctgacacatacttagcacccaaaaaatgttaagctattacaagatttccttgctctaactatgtgatactctggctaatgaaggatgcagcaattgtgtgttccattaaaaattccctgaattctaattcatctttcattaaaatcatcagctttagctccagcaattttgttctgtcaattctgaatttgactttataatagatatactgtggtttgaatgtactgtcctaaaggataattttgtttatttattcatgcatttaatgatgactaagaacctactatgtgcctggcatttgtgctggccaaagttacaggcatgaaaattaaaattaaatgaacaggaaataaggactaatataatttggaatgccatccactactttttaaattacagtgatattaaacattcctaatgtatgattgtgcttcctagtgaatgtttcactttgaaactgtcacattggggatgttcattagcaatcttactctgaagggttatgtttccttatatggattacaaaaatatggcaattcattaatcaaaatttagtttgggaactggcaaagtatctatctgagagactcagcactagttaataatgataaacatctaggttttctttatttcccatctaacccattttacttcttgtgtgcactctctttatcccttcaaagaatgtaatcgatagaaattagacctgctcaataaactccctagacctaaaagtatctttagtaatgtaattaagtgcacatcatttaggatgcattgttttaaagccagatgaatttaaacccagtggactcctttaacccttcttgtaacgaatcatccttgtaatatgtgccccatccttgttagtatttgcctagtgaatttatttactgagagttacagtaaggtcataaaacggtgcaaacttcttttggggctggccatttgacgtctttgaccattgatttcagaatatgttaaagccaaacttcgttcagaaatcaaaacctcctacctctctttatggcagcatttccctagaaagacaatgacccattaaaagctgagctaatgtcaatgaaatggatacttttactgagtcttagcttatgcagtgccaaaatattaaggaattttagtaatgttgctgcagcatctccaaataaaagtcaacaagtttaacaaattctctccttggataagatttgacattttatagtcaaaattttcttctgtcccgtaactgtttttttttttttttttttttttttttttttttgctggggggggcttctctgctcatttgtataagacgtctaatagcacaaattatccaatactaatgattttgtacctctgcacttcttttattatttatgtttatttttacagacaaggcctcattctgttgcccaggctagagtgcagtggtgtaatcatggctcaccgcaacctcgaattcctgggttcaagcaatcctctggcctcagcctcccttgtggctaggactacaggtgcatgccactacacctggctatttaaaaaaaaaaaattgtagagacagggtctccctatgtttcccaggctggtcttgaactcctcggcttaagcgatcctcctgtctcagtctcccaaagtggtgggattacaggcatgagccactgtgcccaactccctgtgtgcttcttgatacggatattccaacaaggctattgattgccaccaaagttgcagacatgactattaaccacttgagctatttccttagacttagaatatattatttaaatgagattaatcccaagttagttatttttttgcctcaaccgtgaaatgttttgaaggcttttttttttttttgagacggagtctcgctctatcgcacaggctggagtgcagtggtgtgatctcagctcactgcaacctccacctcctgagttcaagcaattctgttgaaggccttttgatcctagtttttgctaatcagttttaatatggaagtatgtcatgtaacattgtttggcctcttagccattttggtcacacagttttcttctctatgaatgagaataaccaagtagcatcattgttagaaaagaaaaggaccattgtctgctgatgattaacttttttctcaattaataaatgacaagagggtgatcctggacaaaaccaatgtcgagggccaagaataataaactctttagtctttaatcatgcctgttgatcattcatgtgggccaaagctcttaaatatttaattatacatggttatagtcactggaagtccttttttgctttattgagttttacacttgttttcttaactaaatgttcaattcttgatacagatctttaactagtatttctctcttacatgcttcaaagtaccaaacccacttagtaaatgtgatgaatgggctgattaagtgtattctgagtgatctaaactttgtctatagcaggatttctcaatcttgtcactactgacattttgggcttgataattctttgtcgttgtgggggctgtcctgtgcattgtagaccgtttagcagtactcctagcctctgcccactacatgtcaatacaaccttcctcagttatgaaaatcagaaatgtctccagacattgccagatgtccccaggggtcaaaattgctcctggtgacaagcactgctctacagtatagatataaaaaactcagtcttcctggaaatgatttcaacacttaagctgctcaatgtagggaaattcaaaatagaaggacaagtattttaatcttgaaaaccttccaagattataccaaatgtgactagaaggtcaacagaatggctgttcttacaccataggaattgacaaaagttaggtttcttctatttccatgcttagagagtcagctaaaagcccctagaccagtgcttcacaaactttacagtatgcacaaatcacctgggaactttgttaaaaagcaattcattagcctggggtaggactcaagattccaatttcaatcgagttccttattggtgttgccactattggtctgtggaccgcagctggcataccaaagcccttgcctagacaatagatctttctaattagcttggtagcctctaataggtaaagagaaactagttatcttgagctcactgtctccatgagaaaggaaccaaagctgagtagagccagtcagtaggactgtttttaattaattgcctcattctttttacatggtcaacacctttgaacctatttgaacagtggttcattgccctcacactctactcttaatgaggttacttgtttcacctattcaatgaattgtgctatataacatacttgctactcagagagatgtctgacagggcattttcttcaagtattcaaataattaacctcttaaatgaagagggccctcactgttggacccatttcctatttatctcattttttaaaaaggaaataaacttaggaatgtctcaacgacatatatatggatatacacatatgttttagcctatgcaaataggttgaatctcagcctatgcaaataacatatggaggaacacgatgtatggtgaacacgaaatactgctgattttctgttttgaacacttacttgtattcagctaactctcaattaagtgtggtaagaaaggatggaaatggtatggaaattgaactgccacatattattggtcaatgatatgcttcaaaagcaggagggagggagggagggagggagagaagggaagagaagggaagggagggaaggaaggagaggaaagaaggaaagaccatagaccatagcaacacagactggttaaaaccatctctccgagttcaaaagtttaattcattttaaaaggcatctgtctagcatctaacagaggctataaaacacaagtatttttacagctgaagcaactaaactagtgtgtgtatagtcaacagtacacaatgtatttgaatactgccaatttttatgtgaccactgagctgccagtggcagcagtctactcaagtgagggcagaaggaatccactggaactcatatcgatgtattagaaaatgataaacaggcagtgtagaaaaaataattaagtttaaaacatttgcaggaagcccacagaaattatctagcacacagcaaaattccacttgtgtaatcagagattccaaacaagatagtatattcctagccaccacctaccaacaaccaacccctcactcctccttctcagaaccaccttcatattttcattatttctgggtcaaaacaacctgttgattgacaatacttcataatcccactacaaatctcacttcactgcaggctgcttaaaagagataattcatataatgctgttgtttgaaaaagcgacaaatcattctaattcaacaaatatgtattgagtgccagctatgggcaaagcactgggttaggcatccttactagtggactgactgaccgctgccagaaggatatctaccaccatcctggagcattaaaacagcatttttgggaagagggagatagctgtgcatttttatggctgcaaattcctgcatttggtagagaaatggcacaactgggtcataaaatgcaaggtataacttttaataagtagttcctgtacgttgaacttttgacaaccaggtcagtaaagtgagaaattagacatgacgcatacaaaaatgctaactactatctcgggtcatatagtagggagaaaacgtgttgatttccagtaaattaccatggtaacttgtatagattttagtgttgagaattacatttgccatctgtgggaaatatattatctttttgtatctaattttagggcatgtgttctatttttagcatgtgttctatgaaaaataataaattgggaggccaatttggataaattaaaagtggatattaaaatgctataaaaatagaatttatttttaattcaaaaagaaaatccagtagtacatttaggaaagcacacaaaggtcatttttaaaaccacctcaaaattgttaccattaagcgaaatttgatatgaatgagaattgactaaaaagtgagaaattctgaactgtgataaaaaaaaatggacagttacctgagagtattttgcttttgactctttagctttgtgtgacctagagccaatctctttgtgtcattgttcttcagttttatcatttgtaaactaattgcccctagccgcactgtgggaatcttgaaagagcatatatgatactgggtgactaataatatacattagaccatttgtcagattttacagattctctgagtttttacacattgtgcctcaattttgccaattttgaaagtgagatatggtggttgctcttcctagggattttcttatgccttaagtgtttgaaaagttgactcagatctttagatggcaagtttctgtaactgcaaagtagaaattacaattccttacgacatgcaactgcagttcaaagtaccgacttacaatggttgccaaattcatgcaaactaaagtggaagaggccattttcaaagcctgaaagtattaaatataaattacctgacttaaatcagcttagaattataattctactctgtatgtgatgtaaaatgaatttgacttaaaaatttatttataccacctcacaatttcaaggtaatgactcacaactgcttgggtccatttctaattctccccaaacaaatatgtctgtaacatttaaataccttaatgttgaaagcaacttaaagaaatacattaaagataccgcaataaaattctatttagttaggcttcttcggtagactgctaccactggcaattcagcagtcacataaaagttggcagtattaaaatacattttcttctgtgggctgttcacatactagtttagtttcttcatctgaaaaacaatgcaattagtcaaaatgaaatttgaaatttttacctcctctaaaatcagatgattgactccacgttttatgtgaatattcataaactgttgccaaaactgattattatttatgaagagaaaagctccacagtggtgtttaaaaaattcctgttagacttgcattgctgaaccaggcatctttaaatgatagttgcataaacagataggcaaataaataaataattaggctaaagtggttaccaagagaactcttagcagaacatagcttgcaaaccacactggacaaattccattccaaactgtccagaataaaaggcaaaatataagctattttgtagtactagtatttaaagccatagatcaattacctatgttaaggctacatgaaaacctaatacattagaaagagatgcattaaataatttagtgaagtattaacagtggttacctcgaggtggcatgattccatgtgatctttaatttcttatcatccttatgcatttttcaaattctttactaaaagcatgttttatagagtcagaagaaaagtgagaaaataaatctattttggtatagctactgaatatttttgaaaatgcttataggaaacctatcattactctctgctataaaatcaagttatttacacatttttcaagtatattgaaatctatttgcttgaatatgtactcttgctcccactttgtctattttataaaaaaacattttaggggacaccttacttctacattattttctcaagccactgctagttttcatatgctgaaaatcaatacatacagtgggatgataaggtaatgctctattctttgtgaagcagagctatgttatgctattttggtaaaagataattcattattgaggacaagcccttcatgtataccagtacagaggccactaaactatgtgagccacagacttcttctcaagtttgtcatggtttaaggaaccatttactgctccctttggatgaggcaagtaatggtagggtctcctattggtagctcccaaaacatgctcattttttcatagattgttaatggggaggggggattttttttttaaaggttaacagagtcttgaaagcatctctttacaaaatgagaaagaaaggcaaatttaccactattttcctcagcatgtttatgaattcagaagtgttcataaacattcaacatagagaataaatatatttttctgttattcccactgggggaaatgaaccaacatatgatttttgctttaatgctttgtaactctggaatcaccaagattttgcatgaaacttgtctcaagagataaactattaccaacaaattttgccacacacattttcttctaatgctttcagtaagtcagaaatccattaaacccctaaagaaacaatattaaaataataacataaaattctgaagtttattaatgtatcccatttgtatattgcaatacaatcagtttatatgtgtgtacaatattttctaaatgtagttccatcaattaaatatactataaatcatcatactatatttgtttagaagagttcaatatttctgtagaaaacatggcttcttctattggttatctaggcagtccagatgttctgggttctttggccaatccaaagcattcccaatggaagaccaaattgttctaactatgacaatataccctcttgaggaaaattgctttcaggataaacatcacatcccttaacaaggagtaaaatggcaatgccaccttcactctgacagttttctctcaagagatgttttgtaacattccatctgtgcctgtctgtttgtatgacatgttaagaaggaaattcctagtagagggaaagcaatacttttctaaggtattttcttttaggcatcagtgaagtttgacaccttgatatacaatagccctgtcttctaagctggtcacctgaggccctttttgtttgttattataacagtatcttccttctttgtctgtcttctccccatcatacttaatcttatgagatctgagataaaggaagccccatctgaatactttgtacctgtatgtgtgtgcaaacacacataatggtctgtgtacatctcacattatagtctttagatagaaatatttcaaacactgcctttataatctaaaggggaaaggttttctgcaataaagctctgtctgtgttagtaacttcacagtatacattttgaaaatatatggcaatttttcccaagggagaatcattgtcctattgtactgacctaactttgcgaaacctggtttaatgggttccatgaatccgcaaacaaatatttattgaaaaggtacatgctatttgctttgaaaataaaaaaagataacatattctagctgagaaatcaaagcatgagtttgcctaccttcacctatcacatcacacattcattttcccagtgctccagaccaaactacttgccaaaatcctttgcagctacctttgcattgtgtcattctgtgtctgacccctgtctctaaaatactcctacagaaacacacacacatacaaataccccaactgaatttctcatctggcttataattgtgatacttataatgtagcatttcttatataaaaggggtctagcacagtgacacttaagtgctcaataaatatcagctcttattattattatttattattatctgcttacatgtctgactctgaaactagacatgagcacctttaacgcaaaaacatatttcatccatcactttcactttatcactagaactcaaaagcactgtacctggtacagagaaggcacttataaaacaaatagaaaatgtatgtattagtaagaaaatttgaatagcagtatcaaagatgtgaagcagtacatgattgatttccaaatgtcaagtgaatacaaacattcttagttctgtaagtctatacaagactgtattgtcattagctttgtgaatgaaaaaaagaacagaaaccaaacaccacatgttctcactcataagtgggagtagaacaatgagaacacagggacacagggaggggaacatcacacaccggggcctgtctcagggtgggggcctaggggagggatagcattaggagaaatacctcatgtagatgacaggttgatgggtgcagcaaaccaccatgccacgtgtatacctatgtaacaaacctgcgcgttctgcacatgtaccccagaacttataataaaagaaaatggaacaataatttttaaatctatactatgaagttgatcatttttctatatattaaaagtttattcctaacttaatggactgaatattaatgctataattataccttatcagttgcttgaaccttaggatacattgactagatacacagacatattcttggaattttagaatagaaacacataaaacctagctttttattcaaaattgggtttgttcttaatcatctaatcagtcattcattttcactgaatatctttaatgtgtcagatagttagcaaggtatttgggataagtagtgaaagatatagacaaaatagacaaaaaaaaaaaaaaaagagagagaagacaaaaaacttgtcctgatggaatttaaatcccagtggaagacaaataataaacaataatacatttattgataagcaaatgaaatattatgttatatagtgatgaatactataaaaaataaagacaagtagatgcaaaatgcagccacaggtttgtgacttggaacgagtggtcagtgtatccaattgagaaggtgccgtatgagcagagacttgaagaagcaaagagagaggcatgtagaaatctaggggaaatactctctagtcagagggaagccagagcaaaggtcctaagataaagtcattgcttacaatgtaaaacaataaacaaaactaactctgatataattcaatatggtaaatgaaaaaaaaaaggaacaggaaatacatgttctaaagaggaaaaaaatcacgtttagttggaaaagttatattggaagtgcaagatcctaacctttccttgaaggactggttgggttttggtaaatgaagaacttctggtttggaacaaaaaactcatgtcaaatttaatttacattagaaggatgattatggctaaaggttagttagctgcttcaattaaaggaataaagaaacttaaatgcccacataaggggtttagactttgttccatgggcaatgtaaatcagctaagagatcctgcagaaaattccagggtgaagacatgatctgggaagatgaaattgaaggctttgtgcagattcgtgtacaatagctgtaaataacagaattttaatacaaaggtaatcaacctgaagtacactctaattacaataacacttgcaattattatcttacaatttgaccttttattttttaactttctattttggaatacaaaaactgcagatattatagaaaattacaagaacagtgcaataaattttcatatatcttctccacctagatttaccaattaatagatttgccacatttaccttatctctcttcctacatataggtaggtaaaaagagctgcactacatatacacacacacacacaacatatcattgctaaaccccatgagagcacattgcagacactgaaactaaattcttcaatgtgaatcccctaaaaacaagaattttttatgtaaccaggatacatttatcaaattcaggaaaattcaaaattacaaaatgccattgcctatgatatagtctatattcaaatttcaaaaattgtcccagtacataccctttacaccatatttaccatctaggataatgcactgcatttaactgccaattctctttagtctcctttaatctggtatggttcctcagcttttcttcgtctttgataacactgacatttcgaagagtagaagctagatggttttattttttatagttgtccctcagtttggattggctggacatttccttattttttttggatgtttatgtgtttctggctataatactacttaaatgatattgtgccctcttattgcagtacaccgggggtgggggggatgatatcaagttgtcccgttattggtgatgttaaatttggtcacttccttaaaatgatgtccatttttccccagtgaggaggtactatgagacggtgtgaatatcctgcctcaccaatctttcaaccaataattttaacgtctattgataatttttgcctgaatcaattattattatgatggctgaaaaatggtcatttctaactatatcgttcatttcatatttaccggttgacattctgctcttagggagagctttcccttcttgttggtttatttgtaactaatatgaacacatggatttgtgctttattcagttactgccattattcattttaactcatcttttaaaacataccacctatgaatacttcttaattcacagagagaaaaaccagcttaacacccttcttgcctagttgaaagagaaaaaaagcacattccaagggtaggctctagcatgctgtgaagagaatgttacactttttcttctagcctttcattttatttttcactttgaatagttcattaacacataacaatgaagttccaaggacctgtgggaccttagtctaactgggctctaatgatgggtcctagccaacaaccatatttgcattttgattggcagtaagtagaagttaatttggtgcttcgtctaaaaacctctttccaaatggcaaaatatactactttggaggtaatcttttgcccaaatgtttggtcatacagattaagccgctccattcagggatcatttttatttttattattataattttgggggtttataccctgacttcccaaaaaggacttttgcaagatcaaaactgttattcttacatactggtttgtactttcccaaaacattttcttcctttatgtgaatagcagcttgatttgttaatgtgtttcccccaccccccgcaaaaataactgcttttaaattacactgatgtattgtagaactgagttgagtatctttgtaggctgagcataattatcctcctgccaggaacaaataagttatactgctccagagaaataaatatgcatatgaatttatgtggatggataaattcttataaactttagctctttataacacaatgagagaaaaagaaatgtacctggtgaggctaatgaataaactgggatcattataatgtctgtcatgcattttccccacaaacttgcattttactgcatataaatgagggaagaacacttcaaaagactttttataatgaacgaaccaactttaggataaactacacaaaagtaagccatctaaaatcttcagttataccttctggcaaaattctatatatataggaacacacacacacacacacacacacacacacacacacacacagatcaaatagagatactgactaaaaactgcaagtcaagagttcaaaaatacatatgaacttttacttactttgttaaaagctttaccttttcgaagatttctagcagaaaatgtttgcaaacaataacaccaggtacaggccaagaaaagaacatagtttcccatagtatactaggtaattgcagcaagatcagtggaaaccaaatgcatttattatttgcaatgtaattcaatatactaagagatggcacgcactttattttaattagctgtttcttttaaggggttgcttgctcccactgtcttgataagaaaaaattgtagtcattgctcaaaatgcttgtagcaaatctagttttaaattgaaacaatttattccaaagcagtctactactgcagcaataatcaatgtgttttcccttagcctgtactggagctttcctaggactattgttaattgcctgtaactaaatgatcgctggggcccttaaatgcaactctttggcacttgttcatttgttgtttttaaccaaatgccagttttccctaggttttgcctagcaattttgctttacaattttcaatattcagtctcagtcccttaaagggggcagagtctatcattttaacaaaatacacaaaggctaaacagattttaaaaggtctgcatttctccttctgtcctcagatgttgaattgtgctgaaatgatatctttttattttttaaatgctgccactccaggcaacttgaactagagctgaaaagtagatcccatttcaaagggaaaatgacatttgctggggcaacaccatttacattgtaatgtaaagataaaatacagcagtgggcccaaatgatttctcttaactgtgacagaatttaatccttagtaattttgtataacccaaaggataagcaataataggtagcgcatgtattaatgaatctgtctggcttggagcaaaagaatacagaggctaaatctaatgcacaattttctttgaaagggttttcatatgctatataaaccagtgtgacttaaatagaaaaaaaatttaacttgcatacatgtataatgtgtaggcttgtatattacactcctgcatagaaatattgtaataactgaggggcaggcactgtgcaccatggggaaagacacatttccattttgttcctgacctctttataaggacattataagaacactatgcttctgcaatgtaatactacagaagtctctgggggaaagtctgtgatgctctcaggatctcaggataaattagctccttgtaaattctgtttctttagacttgtttttggtattcctattattagtaaatgactatctatggcccagaagaattattcttgcttattgctcattctctaagcatatataacttttcatatgtttgtaccctaaaggagtttttcatgtgacacaagactgtttctgtaactgctaagctacatcaaccctgctctctttttcttattatattttaaacaacactattgattggctatgtagagtattctaagtaatgtatatcatttcttaaatggctcgtgacatgtagcaatgggagtaactcctatctgggtaattactttgctaaaaataagaaggacttattttcatacaatttttctctaatttacctgtattcaatttctcaaaattaaaaaagtatgtagagaccagtattataaataccatctggagaaaatgagagttctgtttattagattgatcagattatatttcaggcaaatattttttattatttccaaagctcctcgactatctatgggcacttaaggcatgccacatgcccagcccctgtgtagtgcctccagatataaagaatgtgcttgggggcaccgtaaaagaatcattccctgcctgggcccttatctacagcagagcagctttcctgactcccagctttcttcccacacttctccccacataggcctttggttagaacttacgtttttcttaaaaaaagaaaaatcaaaatgttaaagaattgaaatatgattcacataatataaagcgtgtagctctaagtgtttggctaaatgagttccgacaaatataaacacttgtgtatccacaccataaacctatttcctttaccccagaaagtttcctcttgctccattccaacaagtttcccttcactcatcatcaatgaatctattttctgatttatgtcactatggatcatgttggtctgttcttgagtgtaatttaaatagaatcatacagtaggtattatttcttgtctggcttcctttttctaacataattttgtgagagtcatgcatgttttgcgtatcagtagtttactacttttattgctgagtatattctatcatatgaacatacaatagtttgttcatcatttcctgttaatggacatttaagttgtctctatttgtggctgctgtgaataaataagactattctgagcattctcatacaactcttcttgcagatatctgcttatatttctcttggacaaatacctaggagtggaactgctattgatatggtagatttttatttaattttattagaaattaccccaaagtttacaatgtggtaatatcactgggtactctcactagcaatgtttgggagtggaagctaagtgttcttgattctttttccatttctttttttgtacaagaaatttttgagtggtaaattcctagtgtttaatatactaaattagaaaatcttaaaagaagccatagtcaaaatgcttatttctcacattatatccaatgtattttaaatcatatcttcctgatgtataaatcaccctgtgggcataagttagaattttacacaggcttctgtgtatggtggagtttattatcttgagtgaacaagacccaatgtatccccacaggattagccgctcaccctttctgttcatataatagggggaaaacattatactgaagagctttttgtattttgttcctggtatttttgtagtactgtcttgtgtggttccccacaatgttaatcagataagctgctggaggtatttttcagtgttttacacttcatattaatttacttagactctaaaagagttgatctcactttattttttcttagatgcatacagttcaatcgttttaaataagattttcttcaatttcccatttaattttaataattacagaaaaacacacttgattaaacagcagttaatgtgttgtttattaaactgtagaattagaaatcaagggctaggtaataggaaatatgaatgaggatttttttttttttttttttgagacggagtctcgttctgtcgcccaggctggagtgtagtggcgcgatctcagctcactgcaacctccacctcctgggttcaagcgattctcctgtctcagcctcccaagtagctgggattacaggtgcctgccaccatccccagctaatttttgtatttttagtagagacagggtttcgccacgttggccaggctggtctcaaactcctgacctcaggtgatctgcccgccttggcctcccaaagtgctgggattacatgtgtgagccaccgtgcccagtctgaggactttttttcctgtaattattacaggaaaagtgacatcacctgcacacacacacatacacaatgttcttgtaagaaaatgatggccgtgcttttcagattatttgtcactcatattacaccagtcccatcatgatttcaccccatttgtgagaactcaggactgatctgataacctgagggtacttgttaccagcaaaaccgtggatcattttaaagttctcagtctaagcttacattgactgtgttatgaaattagataacttactggtggattctgaattacagaatcaagaataacattattttacagctttaatttcagaaatgtttatatttaattgtagttaaggaaactagtacttttcaaggtagttgtcaactgcagggaacaatggctacccatcagtaacaacatttgggctgtgatgattaccgacaacgcttaaagtgagtttcaaaaatctatgcatgatggcttactatttaaataccaatatccttatttttgttacaatgtccatggttctaaagaaggaaaaaataacaaaaaattttatctccaagttttcctgataagttttgatctaaggtagatattcagtagaaaaaggagaatttgtatacagtgagtgtcaagaaaattccttttttggatagaacgtagtaacatgcctggtaaaaggggaagcaaaaatcttaaaaagtaaacggttgaatgaaaataaaacaccaccaacatattcatatactgtcccatccactaggaggcctacttcttacacccaaaaagcattcagcctccaagattatggtagaccaccttggtatcactgtattcaggaagatacagcagaggagctattgctcctggcaggagtcagcagacagcattcattagatagtcttcccaacattctatgcaacaatccacagtgctctcctgaaactgtgttgtttgacctctcacctttctttggcccccaacccacaggtgacagctcaagtgagagggatcaagattctcattgggagaggccaaaagtcatcctggcttaaaagcttcatatccacaggaatcagtatttattttatcaaccccataagcatagcttccgggatctccacaagtgatacatttatataagagagttatggtactctgttaaacccaatattatagtttccaatcagatatttacaattctcttaatccaaatgcaagctaccaaccaaggttcatttttaccacaagcaatgttgcttagcaacatggttgtcacataccaccttatctagttaccaaggaaacagagctagaaagttatcaaaaggtcaaattctcatgcaaaaaggaaaggggttgtgtcaacccgttaacccacatctgatctcatccaggaaaatgtgaaatcaaactgagtttaatttatgattttggatgtgaataccatataattccccattgtggttttttctttctagagctaatgtacacagtggaacttgctggaggccttggtgctatactcttgctgcttgtatgtttggtgaccatctacaagtgttacaagatagaaatcatgctcttctacaggaatcattttggagctgaagagctcgatggaggtaggatgttacctcttttattgttctttctgaatgttctaatttctttcttgtctttgttttattaaggggaaaaaaattacgtgcataatcaatggcagcagctcgtatattctttcagtgctcagtttgtaaatttctcttttgtaaggaaatgtgtgatgctttatagccaatactgtaggtattttcctctgaaagttgtaaagcaacacctatccattttagaattgtattccaaacacttacaaattacaaacactgattgcaatgccatcagagtgttccttttctctcaccttgtaatcaggactgaaaggccagttttacttttttttaggtaaggagtgtctcttttaattgtgttttctagcccagtagtttgaagcgaatctcaatttgctcctgtttagactgatccgttataataaactgtactgagtattttaaattcatccagcagtcttttcaatcttgtttatttagctatatttagatagcctaatttttattccaagtgtggaccaacagaaaaatgcacaagcacattaatttcatagtaatgcatctcatatttttactgtacgtagacaaataaatattgttttgtggaaatcataattagtatttgcttctggtcaccaatgaatatgtgtacaatctaagaggaaaatggagtccttaaaattcagctccctaaactgcacattagacttatgtttttaaaaaataacaaaaaggaaaataaactaagataaaccagcaagatgggaagcatatgcaaactgacaatgaatagtacagatgacaaagctttcttcatcattttttttttttttagtgaggtggagtttcactcttgttgcccaagctggagtgcaatggcgcgatctcagctcactgcaacctccgcctcccgggttcaagcgatcctcctgcttcaacctcccgagtagctgggattacaggcgcccgtcatcacacccagctaattttttgtatttttaatagagacagggtttcaccatgttggtcaggctggtcttgaacccctgacctcaggtgatccccccatctcggcctcccaaagtgctgggattacaggcacgagctactgcacccggtctcatcatatttatatactgtttttttttcagtgattttcagttttgcagtaaatggtaccaaggaaaatgaggcaattgcctatgttgccacgtttccagggtcctctggaataataaatccacaagcaaaactagttttgcaggtttgtaaagagaagtggtttattcagaatgcctaacactcctcttggtttacccttctctccttcccattagggtgaagcctgagctgcagcaaaaccctttctttttcttaagtttttaattgctgatttgcctatttgtttctaactttcttgcctattgatgcaaattattattattactattgctgctgttttaaagaaatataaggactttgccattgtcggaactactgttgaatgagcaccaagcatagtgctaggcattcttagagtcattcttgctaaccctcacaaacatcctgaggtcaatattgtaatctccattttactgataaggcaactgagactttcagaggttaaataacttactcaagaagataacacaaatactgtaagtgtccaagatgggatttgaaaataagtctattcccaaagcctttatcttatcggatactctctattatttgtattttttttaaatttagtatgttcagtatcatctaaagatctactgttgtttgcacaattagcacagtacatggtatttgaaaaagcacattacctaaacaagtctccccttttctattaaccctgttttgaatatgtttattttgtgttctgaatgagatgaatcattttaccaaactatcaatttctagggcagtaatctgtcattttctgaatgtagaaaattctggaatataatgaaaatgaattaatcatacgcagtggaactttcagtgattcgaagtttcgtttagtgggtcctgctaattgtaaacacttcagtgactgacttgggtagccttaccatatttcattgctgttctgaagctgctgggttctcagttttttaaaaaatgttttaagtaagaaaacaaagcagacagacactaacaaacagtattctaacagatgagaaggttctcttggaaagcaatttagttaataaatcctttagcgattcttagaactctgtctctgaggccatcttaagcacaatcgagggtctaactattagggcttttcttgaaatgccactgaaaatgaattagacccaaagaaaaccaagataacaaacttaactgtcatctggaatatgttaatgtacaagttattcccctaaaaagcggggggcagggggaagcaaagactgtcaaggcagtgattgttcaaatggttttatgggaagaaattattactagaaccgcaatcacatgttcagcctccctatattaaagcagacccgttcctgctgaaatggtggtcagggccccactcttaactcgtatctcccgctgcatcacacctaacctctagaacttccagacactgttttatcagaaccatacagcagtactaataattatatagcaagtttaaaatctatatcttaacaaaagttagaagtgtataattgcaactttctttaattctctagtgctctaaaaccattcagcttggctctcaagttcccatttctactgagaaaaaactcataaccttgcttctccaagattactccgtcacttctggtttggaattcagcttcttgtgggttaacactcagttgaaaattggaatattccatttcccttcttctcttttactcttgtttaaacctgtttccagggaactcatatgtagctttctggtaaaggaaaaagtcacctggtgcatatgccatcccttcctcacttgagatactaccacctggtctttggacatgttgagcactgacttctgaaggcgtagatccttgtcatggcctccagtcacaagtttcacacacttgcccagatgtttctcccttgggaatttcagacattcttacctgtgtttctagtcccataaactcggctacacgcatacccaccttcccattaaaaaaaaaaaagtaatcatcttcttcatcctttgcctctttcatatacggtttccacattgagtgcaggatttctctatgaagtttacagtttcccaagattttccctgggaaacttgacacaaatcctcgcccttctcagattctgcctcaaaccatatgaagttctgttatcctcttctcctctctgtggccctgagggcccccttctcagaaacccatgcaggctgtaaaccttagtcacagccccttagagcctcctatacatgcttttatggtcaaagaatggtctactcttccaatagtgaaaaacttctctgacatcatcaaatccccatgcttcctagctctgcaagctttttcctcttccaaagaagagatggctattcaacaaaacccaaggctttgtaaattcttgtcttttaaaaaatgtaatttagagtcaaacctgagtattgccttctttattcatggctatcatatttaccttccctgaaggggtaatttataaaatacttttgaaagtaagataaggcaaaaagtgtgaaaaataaccagggaaaaatgtttaataatatcctactatagcaatatgataataatagattcaatggccatttattgaataacaagtgatgtgttgactactttatcaataatcagagaatcacacaattagaaagacagaatttaagctccggtctaaatggctctaaattccaagatatacagccattttatcagacttgcagatggagtttctggcatcagggacacattcactcagttcctttggagtcattacaaaaggcattacctggctatatcagttctttatcagaaggattatgattgatatagaaggattctaatattttttaaagatagaacatattgatgcttttctctctcagttcgttcacatcactccttgttcccctctatataaccttacattttattatctcccctgcattcagtccttagcatttccaattccacaacactccccgcccatactcattctttgtcatcctccattttacacctcagttcctggtatcaccttctatctcattggccacactttcccctcatatgccatttctaattagtcatcaatatcagtcaattgcacctctcaaaaatagatattttccttacccttaattgcaactgctttgtccaagcctcctacaccaccctcttgttttcattctctacttctctatcttatccttcacattctaacagaattatctaagtacaaatttactgttccattttttaaaatgcctccattttgcctgctagaacagtctagacttagctcagaaagcaattgccatcaaagggtgacccaccttacttttgtagcattgccacccccatgggatctcaacatgcagagttctagttagaataagatgttagtctttgtaataacacagctattgagaatgaacctaagacaatgtaatcttgcataattctctgaggtttttggggaaaatgaagtaaccacaatggttaaggggaggagaagatacgctatccccctaccactttgattccacaataaaaggaaagaaagtttggataaattctgccagaaaaatatttattagcagacagccttatcactcaacttataaatcagaagaagttccaattctgttgtatatgtgtgtgtttgtgtgcatgtatgaatctgcatgtgtgcatgcttttcagaaaccttgcaagaaattttctcccaaggcaaatgtggcaatactccagtggtaggattgaactcaccttctgttgacatccaagaataattttcatcaagaccattttggaattaagcctagaagatcttctccaagggggcagaccactggccctgctagatttttgtaagggtgggaatgtgtttctaaattgtgttaagtaattcatatgtcttgattaacactgattttaccatggaaataccatttccaagacccattgtacacagtaaaaagccactatctttagcaatgaaacttgatttctaatatccattgtgttaattgatgaagcatctacttttgatcagaaatatagtttaagtgcttgtagtgaccgcctctggagtgttgcctcattttagttaaatgcttgctgaccatcctaataagggcaagctactgtctttagagtagaacttatactaacaaagtaccaccaccatttatgctggaaagattttaaaaaacaatacagacatcacaacagtgttagactcctttgctcctccatgtctctgaatggagtgtcccttcaagttttgtttaaagttataatcctactttatatatttttttcagagtgtaaaatggtttttgttgttgttttcagctttttttccttctctgactatgaagtatgtggggcatgcttactcataatgacgccagggcaagcttataagaacactgtaatcactaacacgaatcctattttaaagatgaagaaagagatctcctagtcctacgttgggagttattacaggcattgaacaaaattagttagagcaattttttataatctccacctccatctcagaaaatgtgaacatctgttccatttcaggcatattaagcacattggcatctatgaaatcttaggccatagaatttctttttctttctctttcaatgacaaggtcactcactattcatagtttcaggaattattgtcctcatgtccatcagtgaaacatagtacctctgcaaatcatttaaaaaccttatagggattttttttggtgtttttttttttttttggtgggggggtgggtggtggtggtagttagaccatttacatacacaggaataatctttagaagctagaacaagtttttggatcccagaaggagagatgtagagttgttctgggtatatgacttgcctcaaatcattaactgttaaatggtaggaaccgaggcttcttatcccaaatcttgtgctccctttgctattctgctactttttaatccccttaagacttctgaatctatgttgcctgctgccctcttagggatacaagagaaggaaataaatatctatagaatgactcctttggaccaggcattttgctatatgatggggtctcatttaattttagacatcttcaggaaggtgctattttatagatcaggaaatatagtcccaaatgagttatataaaaagttatggcaatcaagatttgagctaagcttctgggtgtttttttcactactttataccacagatattttaactagtatcaaatttaagtgtttgagaacttatagattcaaataatccagaaaagtaccaaatggcacaacatgtgaattagaacagtactgtaaatacttcaaactgtacaagtcaagcaaatttattttacaacaattgccagaggttgtcatagcagaattgaaaagcaaaatttattaagacaatgacattcaataatcataaaatcaaaccattaaggttttatatatctaatgtttattcattcaaagatatatgatctctgaagataattttatttgaaaaatcatatcttgaaaacttgagaaagcatatgatggcaaatctgagacataagaagaaatgtgacttactttttgaaaactataatttattcaaattttatcaatgcaaatttttaattatcacagttttctgtgatgatatgccacacttaaacatacaaaatcaacttttaggattaaaaaaagatgaactatacaatttatctttgaaccctcctccagtttcattttaggaatccatttactgaatgacagcctctgccactagtcaatttcacttatgtgattcatatatacttgagaacaaaaaaaaaaagaaaaaaaaaaaaggaatggccagctgccaaaaacatttgacaactattcagtaagtgtttagaggttaaaaactcccccaaaccggatgtcatacttaaaacatttctactgtcagtaaatcttttttctagccaaatccaatacagccactaccttcaacttgaaaagtgagtcttcaacctacattttcttaaaagctgtgttattctaaaataatcccgcagattccttgcttcctcagtcattttaaagaacattgagggtattatcctctcatatgttaaagagaaaggtgcatttatctataacctttccaaaccctcttttcattcctgaacataatgccattttttccttcttcatcaagagttcttaatattttaaattcatattttttatttgttaacgccacagagtccaaacttccttctttcctctcaaaaatgtttttataaaacatcaaagcttttagttaattcaatttaagaagaaatatctgctggacttgttgattgacttcaagtaaccaaacaactagttgaatgattggatcttgttttttgtttgtttggtggagcatatctgccggggtcttttgaaagtcataagaaagagtaacttaatgactacattgcagattataaagaattactacaaagagtgtgtataccagctgtttttcatctctgctgtgaacagaattatagttgatgcttaaattgcagaggattttgagaataaagctcagaataagaaatagactcttgtaccaacctataactacttttaagctgtttataaatgaaagttgaatttaaattatcctagccctatcctttaaaaatattagcataattttgtttttcatggttataaagatgtcagcttttcaaagtttcaccagtcacatgaagttcatacacattaaactatgtcaatttatgttctttcttatatcaaaacaatctaagatgtactatccaagatgcatatacagttggtaattgaaaaagggaagacaccttagaatccatatgattttgagtcaaaaaacattgctgaatttagtatggcatctggcactctgcttccggtctgacaacttttcaaatcatgggtttgcttctgatggtaaataaatgcctaacccattactgcactgatgcagactctggagaaagagagaaattagatatcactcaagtgtcccattggtttgaggatggtgctgcagatgcttgaaagaggctttctaccagtataatctacttggaaacaactccattataactgggagatactaacttaagtactataaatacatccagatgacataaggagatagaaaactaactgatgtcatagcaccaattcctaaatttcatttaagattaatatggttatttcatatattagtctaggcaaaaatttatcccctttttgataaaaacatgaattcttagctattttattgggagtatatctcctctaagtattaggacgatctatcatggagccgagggggcaaggtttagtttttatgatgttgtggtcaaatacctggcagataactgcagttgtttggtgtcattgagacctctgcatgcctatatcctgttctagaacagagtttattgaagtgtggtccctcaatcagcagcagcatctcttgagagtttgctataaatataaattctaggaacctactcttcacctactgaatgagaaactctagaggtggggctcagccctccaaatgatggtcattcatgctcaagtctgaaaaccactttcctagaggcatttacacagatcctaaggccttttttttttttttctttttttttgagacagagtctcgctctgtcacccaggctggagtgcagtggtgcagtctcggctcactgcaagctccgcctcccgggttcacgccattctcctgcctcagcctcccgagtagctgggactacaggcgcccgcaaccacgcctggctaaatttttttgtatttttagtagagacgaggtttcaccgtgttagccaggatggtctcgatctcctgaccttgtgatctgcctgcctcggcctcccaaagtcctgggattacaggcgtgagccaccacacctggccaaccctaatgtcttttcatgaatcacagtaagaagctacagttcaagagtattccaaaggagccttgctaaactctgaaccacagctcctagtaattccttgagaagtcagagcagcatggagtctacatctccaaagcagtctctcctgagaaatgatccgagtcttgagaaaaatctcaaaattagctatcgggtgtgagtcatgtgataccaaaatgaaaggccattcgttcatttcatcaactgataaacttgagcatctactaagccccagtcacatacctgagctaaggatctcatagtctaagagagaagataagatataagcaaaatcatataatacatgggaaaaatcatcacttccaactgagggaaatcaggctaaccttcaaggaaaacaagctaaaaatgcagctgctgattatttagacaataagtagccacagatattttttaagccaccataacacatgatcagtggtaaggtctgggaaggtaaatttggtgactctcttctccagaaggagaaggaaatggaaagggaagaccactcaaatataattataacagctgagatatgagtagggcctaacctagaatggaaatagaatccaatagatttgtaccaatgaatggcgatgagattattagtaaagataagggataggtggaacgcgcatctgaagttttgacattaaagaaatgagatttttatgttactaaaattaaaatgaaataaaagatgaagaacacagcttgagatgggaagcttgttacgttgtgagcatgtgaagtgtgaggtgcatgatgaagatgcaaattaaagtgttcaggttacaggtaggagtgggggactgtcataattcaggagaaatagaacaggatcatgcatccaaattgaggaggcatctacacagaagtgatgttatggaagttgatgttatggaaggaaaggatatttttaagggaaagtgggctgaaagaaaaatgaagtggaccgcagaaaacatcttgcagaaagacggtatttatgggttggaagagaggtttccatgaaagaagcaggggaatcagagacataatgttatataagcaaaggcgatatttatctgaaatttaccagtatgggtggaccagttgtttacatctcgtctgatttctgaatgctccgttcttactggtgttcatatgttgatatggctttaaaataatcttaagcctagagaagatatgaggcaatgaatgaggatctaattattacacaaccccagttgaggggagtttcaacactttgcactactttgtggcaaactggaaaagaacagattaccagaaagaaaatagcatatgcccaaaataatactacaatccacaatctggcctgaggagtccttccattattagcctgtgactcctgaactacccttagtaatacatttatctcttaggaatgtactatttatttgtctgcatctcctgctaggctagaaactaatgaccaatattgtaaagaaagtttaatatctcataggtaatgcatgtgaatagttaatgaatattttaattaattattaaccgatattatgtactgactttattgtgtgctttcatgatttcttactcaactaaagtgtttacatcaatgagtggtacaattatagattgtactggcctatgggcatatagcttttctatagcaaatataataattatttttggagaaaactagattttgttttttaaaatgtacaactatatgctggctaaagaataaaggaaatgccaaaatatgacacatttggtatgattgtttttcttaaacttttttgccctaaaagctgctgtttaaaaaactcttctatagctgaagtttttattccaagtatcctatagtgaagttgttagtgccttatatacctgtgttaactttacatgtagcaaacacttttctgagtttgccctgaaaagttataatcatagaatgatttctagatggctcaaaattatcagactactagaattaacacacatgtatatatctcaggaagtgaattttagtgtccttgaagtcaaaaggattgtcccaaagccacccagaacaatggtgaagaatgtccctctatcgttgatgtttcatagcccaaatattttaagttctatgcttaatgcagagttcattttattctgaaatttatgagtgtttcaatttaacttgatctaatcatcaagtaatacactgcctatcatcagggaagtgcaatagagagctaaagacattgatattggtagactcagcatatcaacagtatttaaaatttaagtgaactatgaatcttgatatcttagtcgaaaaaggaaattgaccaaagaaagactatccggaagataaatgatttcttattcttagaaacaacaagtgagaaatctgagatggtatattagaaaaattaagataaagataacaaatgattgatagtagtcctcaaatatttaaaattttctcatgtaaaaagggggaagagtaaggagagaaatgagattttagaactaagtttcttttacttacattctacttcttgattcttatgaacaaactgattagcatgatgaaaaataacttggcaatattttatgtgtaagatgagtggagaccagaaaaataatgtctttctataatcattcattttaataatattctccatcccaatatgcaagaactgactcctagtaaaaaattaattctcacaagtttggttttattttctccccaacagaaaatcaacacagcacacataatctaaaaaatcattcattcacaattaagtcagttgccgttttctctctcttttttcaactgggtaaaatggccaagggtagaatcagttgaacgtaagagcatactgatatccaaacatatggcttttacaagcagtcaagattctctgtgatctgtgcatcaaaaatggtgaaattctgctgggtgcggtggctcacgcctgtaatcccagcactttgggaggctgaggagggtggatcgcctgaggtcaggagctcaagaccagcctggccaacatggtgaaaccccatctctactaaaaatacaaaaattagctgggtgtggtgacgtgcacctataatcccagctactcgggaggttgaggcaggagaatggcttgagcctgggaggtggaggttgcagtgagccaagatcacgccactgcactccagcctggacaactgagcaagactgtgtcccaaaaaaaaaaaaaaaaaaaaaaaaaaaaggaagtctgcatttcattactcttttcattgatttttctcctacttttttcacaacaacaaatcaaaattcaaccctttgtacctccaaactagttttagaatcattgaactcaatgaaacttaatgaaggcttcatttttcggtctttcagaaatgggacatttggagacgtttatgaaaaaaagtgcatgttttcatgtcctattgttatctttgtagagtagtgacttcgacttttctttggaattttttgacagacaataaagattatgatgcatacttatcatacaccaaagtggatcctgaccagtggaatcaagagactggggaagaagaacgttttgcccttgaaatcctacctgatatgcttgaaaagcattatggatataagttgtttataccagatagagatttaatcccaactggaagtaagttaatgttttcatttgagagtgtgcatattcatgtgagtgtctgtgtagtcatcactttttcatggaattttaatgtttggttctttacttcaaaatttgtatctgttagtttccctagaaagaaacgtctttgtgtgttcacatgaaatttaatttttgctagctcagagaaaagatactccattactgtataaagcatctcattttgtgagccttgacattgaaagaaaccaaatgagagatttgtaccgggaaaaaaaaatattgctgacattaggagaagcaagtcccaaactctattcagtgaactagtttcatttaatttctgaaagagaatctactaggactttctggaccaaattttccattcactcattttgatgcactcttttatcttttgtagcatacattgaagatgtggcaagatgtgtagatcaaagcaagcggctgattattgtcatgaccccaaattacgtagttagaaggggctggagcatctttgagctggaaaccagacttcgaaatatgcttgtgactggagaaattaaagtgattctaattgaatgcagtgaactgagaggaattatgaactaccaggaggtggaggccctgaagcacaccatcaagctcctgacggtcattaaatggcatggaccaaaatgcaacaagttgaactccaagttctggaaacgtttacagtatgaaatgccttttaagaggatagaacccattacacatgagcaggctttagatgtcagtgagcaagggccttttggggagctgcagactgtctcggccatttccatggccgcggccacctccacagctctagccactgcccatccagatctccgttctacctttcacaacacgtaccattcacaaatgcgtcagaaacactactaccgaagctatgagtacgacgtacctcctaccggcaccctgcctcttacctccataggcaatcagcatacctactgtaacatccctatgacactcatcaacgggcagcggccacagacaaaatcgagcagggagcagaatccagatgaggcccacacaaacagtgccatcctgccgctgttgccaagggagaccagtatatccagtgtgatatggtga

SEQ ID NO: 5553 - DNA, 1166476 bp, human; identical to SEQ ID NO: 5552

SEQ ID NO: 5554 - DNA, 1166476 bp, human; identical to SEQ ID NO: 5552

SEQ ID NO: 5555 - DNA, 77249 bp, human
ggccggaggggcggggtgagaaggctgcgcgcgggtaaaggggccgcctcgagcgcggtccgagcgttcagcggacgcgcgcggcctcgatctctggactcgtcacctgcccctccccctcccgccgccgtcacccaggaaaccggccgcaatcgccggccgacctgaagctggtttcatggcagcctcaaagaaggcagttttggggccattggtgggggcggtggaccagggcaccagttcgacgcgctttttggtgagcccggggtgacatgtgaagaggcgctgagccggggcgggagtcgggggacggagggggtggctgttgtgtccccatcccgcatctctccggcccggtgccccggccgctgggcaaggagggaggccggaacgggacctgccacactggggatgccccagccaggcctgggggacctcggcctctcatgacccccatggccgagttgaacagtcgcagttttggtggcggagctgggtcacctactaatggggtgactcttcccccaaagggagcagggactctccgagcatccgcgcagagcggcccgcttgcagtaggggacaggtggccacattgacggctaccgcggtcttccccaggaacatttggcctgcgagacacaggacgtccttggatggggggaaagctgtgtcacggctgtggtagctaacacagcgtcctttccagcagtagaacgaataaagtattggagtgatgatgcgttgtcatcctctcccataaaaattgcagagggttgaatactggggagggtggcagaacaaattaggaaacagtcacactacactggttttgccataatctttatttaattccgaagactcgcaaatttcagttctgagactttgcccattacaaacaaatgattgtccttactgtgcttcacagcataatgcgacacggaaattctgtttctctttttatttaccatgtgtgacagcacagttttaccacaaaagattgctatttaagtgactgctgattaatttttgtgcaattagtaaacttgctcttaaagtgacctagcacagagttcagtaagataatttaaaagtaattgaggccgggcgcggtggcttacacgtgtaatcccaacagtttgggaggctgaggcgggtggattacctaaggtcaggagttcgagaccagcctggccaacctggcataacaaaaattagctgggcgtggtggcgggcgcctgtaatcctacttacccgggaggctgaggcaggagaatcacttggacccgggaggcggaggttgcagtgagcagagatcacaccactgcactccagcctgggcaatccagcctagccaacagagcgagactctgtctcaaaaaaataaaaataaataaaaaataaataaaagtaattgaaatgaatgcctgctgataaaagcccatgctttcaatggatatttgactaacttggcaagttgatgtaaatatttaatgattatttagctcttcactttaccgcaaatcatgttttcctgtgttatttagtatgtatatatctgtacatatatacacatatgtgtatatttatacataggcattatacatacaatgtatatattttttcaaagttctgtcagagctggcacttgactaaaaactgcatttgtgctttgatcctgacatatctttttttgtctaaagtgagaagctttcagtctaattttggtttgaatcttatttaatgacttaccctggtttgagctgccaagcatagttccactgtctcttgcactgtttatcttttgatcacccagggcaggtttcactttgtcttatattcatagaaatgtttatagagtaatcctgaatcataagaaagtttgcttaactggatttgattaatacataatatacacgatcatcatcttcccaacttaagaaagaccattaagacatgtgccaactaactgtgggttgatgtttaaagccatattcaagaattgcccacacaaatgcctgcagggaccaggcaggtagaagggggaaggcagactagagagatatccaggtcaaggggacagctagtagctgccaagcaggaacacaagcccagtgctgccagatcgtcagattaaaagcaggtagtctagagttttcaatgaaatctttcaattcttaaatgttggcaattagtttataaagcactgtgggggccaaaccaagcatggcagatgttctcaagtttatacagcctttgctcaatatgaaaatgggtaaaatatttcataactttgtaggcttcctttaggagtcagcttgaactgtccatgccttctttttgactgttcattattgctgtccatgtagcccagcaatcttctttattcactacaggttgttcttggtccctcaggttttgttgcctaaaagacatctttctacatcaatgaagaagaacttgatcaacttcatattaccacaattaattgttcagtctgtaacatgaacaacatgagccttcaaaaattggctcctgtttactgggttctgtgaggcctcgtctcattgcatgtaagctaagatgcaaattcagaagattcttatcctgcttagagaatgattttataaaagttgatcagtaaaattgtcctctccttgagaaacaactatgaaagcatgctctagaggcaaataaaaaaaccgtagagatcctgtgtgaagtagtgaaaaacttaggaatggtttagcaaggtgttttttcctttgtttataaggagagagattgctaaaccactccctgcaaaatgcagataaaagatttgctgaataagtgcttcaatcacaagatgattcccgggagttattccagtcatattactccacgttgtaattatgactgaaaaataattgcttacctctcaggaaagaatacagtggataagaactgtcataaggaagcttataaaattaaagatatttaagtaatttcctattattcattaaatttgcatatttaacttgactttcctgagaccaataatctctgcaagctttcttcttcttttttctctgttagcaatattagctttctcccataaggagaaaaggctttatctgtgctctttcatcccagggaaatgcctccacctctatcccacatatccgcttctctacctctaaatagtggctcaactgccaccttttagtgtaagtcttcctcaaaccgttattcagaattccccccccttcctacagcacttttaaaaatacttctattaatagctcttattaccttcccccttgtattataatcgtatacctgctgtacttgggagcagggtcctccttttaagctatttgtcatgttgaccaagatgttttatgaaatacaaagatgaacagcacttaaagactgttcagagagtgttttatacatgtttattgagtagatttttatttctctttaataagttaactgaattattttttattttattttatttttttgagacagaatctcgctctgtagcccaggctggagtgcagtggcatgatctcggctcactgcagcctctgcctcccaggctcaagtgattcttctgcctcagcctcctgagtagctgggattacaggcatgcgccaccacgcccggctaatttttacatttttagtagagacggggtttcaccatgttggtcaggctggtctcgaactcctgacgtcgtgatccacccacgttggcctcccaaagtgctggtattacaggcgtcagccaccgtgcccagccaagttaactgaattttaattctggttttctttcttacctcttaaaacattcttgggtacgtttggttacttaatttcttcttacattttagtagtagacatacaatagaacatgttcatttcctcatcaaattgtcaaagaattaatcttgggaccccatgcatatgctttgtacaagcggaaaatttccaacttatctgataggaaagtgaattggggttggcacatggtaactcagattgcagagtaggaacttcttggaaagagaattagtgtaacaggttttaaggaggggccatttctttgtaagacaaaagtttcagcttaaacaatcaacttccttctttaatttggtaacttaattttttccccactatgatgattttttaaaagacttgtaatgtgttgtggcttgaaatgtgtcaggtactatgttgaagacttttccagcattatctcatttaatcctcataactctgtgatgtagatcgtattagtaagcttctttacacaggtgattagactgtggctgaggattgtgcccaaggtcacagagtaactggtggagctaggattcaagtccaggtctgttatactctgaaaccagtcctcctgactactgccttgggttccccagctgtgtagagtactgtgaaggggaaatgagagaagggggaggccaccttctcacctattaatcaagtgtcagttctgattatcatcacgaatgaatcttcaccaagaaaaacatacttataaattggttttgcaatctataaaaaatattgcctttgaatgagtactgtgggttatgatcatcttgtgactcaaattcagtgggtcctaggcagggctcaggtgtgtcactgtggataatggttgcatcatcattttgtttcaaccgacaatacatataaagaatgactagaattgtagctcagtgcttgttttggcaggaagcattcccttggccccagctgtcccatcatacttagagatctcataaggcttacagatggatttcctctttccttcatttatgtattcaacacatttattaagcacccattatgggccagggactaatgaacaataaattttggtaaaactgatttggctcacagttggaatgaggccactcttgtgataagtagagttgtgattctttttgttttttttttttctgagacggagtctcactgtgttacccaagctggagtgcagtggcacgatctcagctcactgcaccctccgcctcccaggttcaagcaattctcctgcctcagcctactgagtagctaggattacaggtgtgcgccaccatgcccagctaatttttttgtatttttagtagagacggggtttcaccatgttggccaggctggtcttgaaatcctgacctcatgatccgcctgccttggcctcccaaagtgctgggattacaggcgtgagccaccacgcccggccaagttgtggttcttttgttgtttctttctttctccactacatttgcttgtttccttgcccatcacattacacaagtaccaggaacacattctcaacagagagctgccacccactcttgtcttgtctgtcacaagactaagtggtaagagctttcaattttgagcttcttgagggatagaaccatgtcctttttcttccccaaagcctgacacagcatctggcatgtggtagacacatgttacatgaaccaacattagcagcaagggacctgcaaggactcaagtgtgttgactggaacacttggattagaatagaccgataaaacttgaggcatcttggaaaaagtcaaaatcagaaactatagctctatttgatgtatgtatatgccatttactacaatttctttctttctttctttcttttcctttttgagacagagtttcactcttcttgttgcccaggctggagtgcaatggcgtgatctcagctcacggcaacctccgcctcctgggttcaagcgattcccctgcctagcctccccgagtagctgggattacaggaatgtgccaccacatctggctaattttttgtatttttagtagagatggggtttctccatgttggtcaggctggtctcaaactccctacctcaggtgatctacccgcctcggcctcccaaagtgctgggattacaggcgtgagccaccgtgctcggccaatttcatttttaagaaaaacataatttcatttgctatgttttctttacttctgtggcttgttggaagatgccttttctagtcaaatttggcatggaacatatttgtggctaatatttttattttcagtcactcacatttacgtagtatcatggtgttctcaagaggaagtttacatttctgaataatgtcttatcacatggtaaagtttagtgtgtcataaaagagtagactagtggggaaatcacatggggagggaaatgaatgtgcacatttatgataggacagatgaattagtcataggatgagtgaggcaagcctacaggacagttacttagtaaagagagcatttcagctccccagaagtctcattcttataaggcagagaatacatgtgttgtttcagaagctaatttttaaatattttttgtttttgagacggagtcttgctctgttgcccaggttggagtgcagtggtgtgatctcagcttactgcaacctccacctcctgagttcaagtgattctcccacctcagcctccccagtagctgggattataggtgtgcaccaccacacccagctaatttttgtatttttagtggagatggggttttaccatgttggccaggctggtcttgaactcctgacctcaggtgatccacccacctcggccttccaaagtgctgggattacaggcgtgagccaccgggcctggccaaacacttttttataaaaacaattttccttgttttttcagtttttaattactctcctcctccaaatctggaattgagtcatagtttgcgcatagagctgaatatagacctggtgacttccaactgtaatactatcacttataggtaatagtaataataataataataataataacatagcagtagtagcagcagtgacagtagtggttacatcttttgggtatatactgtgtctgcacggagctaaattctcattctatgttcactttccttgtttcttcctttttaaattgcccttcacccaaaacaaaatctggaattgagacatgatttgggtttagagatgaatataggactggcttcctatattcattattcagaatgagtgatttctaatccttattctgtcatctattagtggtggtgggagtagtaattgtaataaaagtaattataaaattagtagcagtagtagcaacaatgatagtgttgacaccttttggatgtatactctgtgcctattctatgctaaatactcttcataaattactttattatccttttacaaatgaaaaacatagaggctcagaaaaaagtgtcaaatagctgatgtgggcagggctggagctcgatgtgccccagctctctgtgcttccggggtctgtgtgtgctctttgcctctacatcacaccaagcatgacgttgtcaactacctttctggcccacacaaaagtctgagaacagattttttttttttctttcttctttttttttttttttttccgagacggagtctcgctctgttaccaggctggagtgcagtggcgtgatctcggctcactgcaccctccgcctcctgggttcaatcgattctcctgcctcagcctcctgagtagctgggattacaggtgcgtgccaccatgcctggcaaattttttgtgtttttagtagggacggggtttcactaggttggtcaggatggtcttgatctcttgacctcgtgatccgcccacctcggcctcccaaagtgctgggattataggcatgagccacagtgcccagcctggatctttttctttaagcttatgacctaaaatagaagcaactgatgactggatatctccacttctgtgcccaagcaacatctcaaacacacattatctaaaacaaaatttgcaatctcctatgcgttcctgtccggaagctactgctcctaccctatcccttgtctggtaaacactgcctactcagttgcactgacctgtaacttgtcatccctgggtgttgctctttttcctgcttgtacctcctgaattaagaatctctctgcacttgcacttcacttctgtcaatcccatcgcagcggccctcctagtggaggcctctgtatgtttcacctggactgcagacacattgcaactgctcttcctgtcccagtcttgcctccctctaatcctttctcatcaacaagtactgtgcaccctcgcccacctgaacaccctgcagtcctatgcccactgtcccgcatggactcccttctgttcaacctgaagtcttagtttagaagttaccacttctgagagcccttctcagaccctcataattctgggttacatgtcctttctcctcttcatagccctgacagccctatgtgaggcagaagttgcagtgagctgagattgtgccactgcactccagcctgggtggcagagccagaccctgtctcagacaaacaccccagcaaaaaaccaaatgaccaggctagacattgtataaagcaagtgatacagccactgctatctttaattgacaatgatttctgaaatgtacttgaaaaaatcagactagcattcttgcctctgggtactgtgttttaatgtggagttaattatcctctaccatagagtcttgtggaaacatcattagccttctttgtacatttggccatctgcagacaaatcaatggccagaaggcttcatgtgaacctagatatatgaggaaaaaagtactctagaacttcatgtccagtacaatagccactggccacatgtggctactgattactttaaatatggctagtctgaattgagtagactgtaagtgtaaaatatataccaaagacttagtaaaaacaaatcattaatattttatatctatcacatgtcaaaacaatagtttatagatatattggcttaaatgtgttattaaaattaatttcatatgtttctttttattttttaatgacacaatttaaaattagtatgtggcttgcgtttttggtttgggttatatttctattggacaggctacatacactaaggtggtgtcagtctcctaagtttcagagctttgatgaagtagggaggtctaggctccatcctggtacatccaaatgttgtttgattggatggcttcatggtctaatacagcaaatagaatttaccaaaatccttctgttttctgtgtctcttccaaagatccatgaattcatttttagcataagggccctgacgttgccctagttaaaactaggaggtgatggaagaggggtctcattccattcagagccccataggtctgctattgaggtttttatgaattcagccagcaaaaagggacaccttgtttctttctttctttctttctctctctctttctctttttctttctttctttctttctttctttccttctttctttccttccttccttccttccttctctctctctctctctctctttctttccttccttccttccttctctctctctctctctctctctctttctttctttctttctttctttctttctttctttctctttctttctttctttctttcttttctttctttcgtagtttcgctcttgtgtcccaggctggagtgcaatggcgtgatctcagctcactgcaacctccacctccttggttcaagtgattctcctgcctcagcctcctgagtagctgggattacaggcatgcgccaccacgcccaacagatttttgtatttttagtagagacggggttttgccatgttggccagggtggtctcaaactccagacctcaggtgatccacctgcttcagtctcccaaagtgccgggcgtcagccaccgcgcccggccaatactttgttttcttaacctagagtcctttagggatttgagagtagcagggagcagctgtaatatgaataacagtaacacagctggaatttcctattgtagtgaagtttttctgcacataagtgtttctcattttatctgataatttttgtcctaataagtacatgtaatacatcatgttttttggacattcaacaaatacttattgagcaccaactttgtgcctggcactattctagttcctagggatacttcagtgaataaaacagggcaaatggaactggcttcctagagacacaccctaatgctaatggagttggtatcctagagacataccctaatgctaccttgtaaatcacagggctatcacatggtgtatgatgtatcaagttaacctttgacttgtaagatattttatcttctcaaaggacttcagaatttgccctcttgctttcattatgtttattatttcctccagaaaagaggaaagggggcgtgtgtgatatagaaggaggaaggcaacattcaacgctttttattttcttagtctgcattgaacaggtaattttctcccacaggaaacctaggcatggaaacactttactaattggaagtgacttcgctgctgtaattagagtaattttggaagttaattttaatcaaaatatgcatcttactctgtaagagtaagtactttggtactcaaatatagatactataacatggaaacaatatatatgaaaaacttgctctctctctctctgtatatatatagatatctatatattatatatatattttatatatatctatatatattttatagatatatattttatatatatctatatatattttatagatatatattttatatatatctatatatattttatagatatatattttatatatatctatatatattttatagatatatattttatatagatctatatatattttatagatatatattttatatagatatatagatatatatatatcttatatatatatatagatttttttttttttgagacagtttcactcttgttgcccaggctggagtgcaatagcgtgatctcggctcaccgcaacctccgcctcctgggttccggttcaagcagttctcctgcctcagccttctgagtagctgggattacaggcatgcgccaccacacctagctaatttttgtatttttagtagagacggggtttcaccatgttggctaggctggtctcaaactcctgacctcgtgatccgcctgcctcggcctcccaaagtgctggggttataggcatgagccaccacgcccggcaaaacttgctatattttaaaaagtgttgtttttagtagtgctaaaattgtagaggatcgtattacacttctttgttagttttcatccattggttttaatgttttatatcaagggtcagcaatttatgacaagcatgtcacagagagtactcagctggatggggccaagtatatacttatccctttactaacaaggactctattgccttttttttttttttttttttttgagacggagttttcctcttgtcgctcagggtggagctcaatctcagctcactgcaatctccatctcctgggtgggttcaagggattctcctgtctcagcctcctgagtagctgggattacaggctcccaccaccacgcctggctaattttttgtgtttttagtagagatggggtttcaccatgttggccagtctggtctcaaactcctgaccttaagtgatctgcctgccttggcctcccaaagtgctgggattaaagatgtaagccaccgtgtctggtcttctatttctcttttataagagctagatgcgtagccacacttcccttcaaaggaatctacacagtacgtgtctatgtgcctgagtatctgtgaccctttctgtttccacgtccaagataaatggagtggaaacttacaccattgctattagtattgtatcagctctcttttattattcttggttttcctattctgtaaaataaatccatattattaattaatgtgttaaatttccgagaaccattttggttttttaaggagtagggaattgcttcttaatttacctttatcttcaataggtttctttttacctaaagagaagttatttctgatgctgccttatatcttttatgaatccatatgaaaagaaagtggaacatcttatatggcatttcatctaattggactttttctaccagtgaacaagaacttcagttactgaataactttaaacatccttgatatctgcctgcatttttacattaatattacaatatctttttcaggttttcaattcaaaaacagctgaactacttagtcatcatcaagtagaaataaaacaagagttcccaagagaagggtatgtttcctaatttaatatgtaaagacacattatgtttgttagtccatctcacccaacttgccctgtggatttgtaaagtaaacttggtcagacatcctcctgaaaacatttgaaaggttgttattagtcaagaaaatatgcaataacttggtatgtcttacatgtgaggaattgatggcttaggaattcagttaaagataaggaatgaataataaagtaataaagcaaaagagtattaaatatcagaaatttcacattaactttgaagtcatttagttttgtgttcctattattgcaaaaatgctgctttgctgatttgagtgtcaggtttgttttataataaaggtatctttttaaaaaagtattcacatatcttaacatctaatactaaaatcacatttttgggaatagtattcataagtagtaattgtgattaaatatgatgttaagtatattatttaaaatttaatgatttttatgatataaccactttgaaaaactgtgttgcaggttattgcaaagctaaccatacacctgcagcatttcactcttaggaatttacccaagaggaataaaagcatatgcccatcgaaagacttgcacatgaatgtttatagctactttattaaaagtcgccccaaactggaaaccacccaaatgtctgtcatcagtaagatggataacaatggaatgccatttagtaattttaaaaaagtggacagatacttgcaccaacacaagggaatgtcactggaaatatggaaaatgaaaaagttggatacaaaagagtatatactgcatgactccatttatctgaaattttataatagtctaaactaatctaggatgataggaatcagaaaagtggttgtctgtgaggtgtgtgattcacttgaaaggagcatgaaagaactttctgggttgctggaaatattttgtatcttgactggggtgttggttagatgggtatttccacttgtcaaaactcagcaaattgtgtgctttcgatttgtgcatttcactgtaaagtttacttcaatttaagaaagagagaaaaaaattgatgtgtttctaaattgtattgtcttcttcacatgaaaaaatgttctaattttttagagttcctttgtttaataataaaagttattgatatgttagaggcattagcatgactgtccacaagcctgaacccagtgcaatttgtaaagaagatacctgagtcttggctagatgaaaattataaatacacagaaggagactgggtttttaaaaataaattagagacgacttggcgcggtggctcacgcctgtaatcccagcactttgggaggccgaggcaggcggatcatgaggtcaggagatcgagaccatcctggctaacatggtgaaacctcgtctctactaaaaatacaaaaaattagccgggcgtggtggcgggcgcctatagtcccagctactcgggaggctgaggcaggagaatggcgtgaacccgagaggcggagcttgcagtgagccgagattgcgccactgcactccagcctggacgacagagcgagactccatctcaaaaaaaataaaaattaaaaaattaaaaaaaaattagttagagacagaattcaaagcccaggaaagggaagcatttagttaggcctgagaaaggcagagaagaaaggcagttggaattcccttgctacttctggatcctatggtagaatcattttagtttgtatcatttctacttttggacttcctcaaattaccatatttctcctaggcttctcacccttctcatttactattagcctttcatccttctgaggccctggtactttaccaaaattatactgagattgggtctgagaacttggaccaatcacttatctacatgaaatagttaaaaggagttttaaatttctccctaaattccaacaaaacattttgggaaaaaagtagcaaaaaagactagtatacttatttgacttttcagaattccttttgcttcccaaatatatcattctcaataataataaatatatttccatctacttagaaataatcagcgattagtgaaacatgcagataatttatcaaaattaattaaatctgcaggatataaagaaggggaactaatttcttattagacttggaaaaataattttaaaataggtagatatttgctgtttgtggcctgccattagtggcctccttgaaaatgattaattactatgtggagaataataaaattgtaaggaaataggcttttcttgaaatcatttctttaaaatgtggaatgtaatttgctttgcttaatctggttttctttaatgtatgcaccagccacaccctcataagttaacatttctatagaaaaaagttatatttgtgttgctttcttactaaccaaatgccttcttttgttcaaagatgggtggaacaggaccctaaggaaattctacattctgtctatgagtgtatagagaaaacatgtgagaaacttggacagctcaatattgatatttccaacataaaaggtattttagtagaatattttacccacataataagactctctcaatcaaattcattaatttattctttcagcttataattgagtgcctatgcagtgccaagcatttctatgagaacttgaggatacaacactaaagaggaagatttaagttcttgtcctcatggagcttttatttggatgggggcgagataataagagcagaaaaatataatttcaaatactaaaaagttccattccaaaaaataaaaaccaagtggtatggtgggttttgcctagaagggcttgctttagattaggtggccaggaaaagcctttctaaggatgtgacacttttgctgagctctcagagggcaaaaggggtcagccatgccagtgtctagaagagtgtttgaggaaaaggatgcagcacgtacaaaggccctgaagtgggaataagcctgggacatttccgggtcagaaagaaggccagtgtgtcaaaagaagactaaaaatgttgagcagtgagactgggtagggggtttcagtaggcgatcaaattgtggaagtgggtcgggcttcatcagccatatttaggattttggatgttattcttagtatcatagggagccatgagaaagtttaagcaaggcggcaagggatgacttgcagtttcaaggcaactttctgactgctgtgtggagagtagatggtaaaggcaaaagtgtggacacagggagactagtgcggaggctgctatggaagtcctgagagaggatggtggcttgaccaataatggtagcagtggaggtggagagaaagggccagaatttgctgatagactggatgttggggtaacagagagagtagtggggttgagggaagagattggtcaaaggtgatgctttggtttttgccagagctcctggatagatgaggatgccttttgctaaggagagaaagactagaggaatgagtaggttgtggggaaggggtatttggaatccaaactcttcacttctaaaatttccctgaaataattgcttgagggtgttagattgttatggatttctctgagaagtcctagtagttttttttttttttttgagatggagtctcgatcttgtccccaaggctggagtgcagtggcatgatctcggctcactgcaacttccacctcccaggttcaagcaattctcctgcctcagcctcccaggtagctaggattacaggcacacaccaccatgcccggctaattttttgtattttttgtagagacggggtttcaccatgctggccaggctggtctcgaactcctgacctcgtgacccgcccgcctcggcctcccaaagtgttgggattacaggcatgagccaccgcgcccagcgaagtcctagtagttttaattgaatatctatgtttggcttttcatcattcatatagggaaaaaaaatccagccacccaagattgatataatagcataaaaggtggaagcatagtgtggaagtttgctgtctactttatagcctaaaattttcaagtttaccattcaagggctctttttttcctccttaggtagtttgactatagatagagagaacatcaattggtggtggtggcttgattgccatcatcttggctttgatacttaccatcgctcctgagcctttcccctatttgtataaattaaaactcacttaaaaaaaaagactacaaatctatagagtgcctactatgtgccagatgtgctaaggatacaatggaggtaatgcttaagtgcagaaaacatgttaatctgataatcacaaataaatggaaatgcataaaataatagagttatttctgttattgcagattttttaaaagtataatttgatattttattaacaacttttaatactatgcacatattaatcctatcctccctttatccctacatctaagtggaagggcttcaaacttctcttagggttgtagtcctgaactttagatgagttgtgcattagtgattgttgttgatcatttccttgagctgttcttgcacttctcacagtctaaacagtgcaaacaaataataggcaatcagtagcacactcttgtcaaaattaccaaagacgtaagtaatccaggcagcttaaagccatgtttagaatgtagagtccagggtgattgaccatggctttgacatcattctacctcccttacaggtaaggtaggttgtgatgtgttggctttctggacccacttggatgctattcctttctcccttgtttttacggttatgtgaagatgacacacaactcctgcccaagtgatttgtcttccgtttgcactacctggtctaagaattgaacaggcagcttctctatactcctctgtgtctggccagtgtgaagtccacatctgagccaaactgacccagcacttccatctgtacaactaccatcctctggccacagaagagaacatcccacaagctcctccataccaggccagttgtactatttttttttttcccagaaaatttatccaattggcattgccaaggaccaagcttttgcttgcctgcatagaactctatatcacaaactgttaaagctgtaaaggaggctgggtgcagtggctcacacctgtaatcccagcactttgggaggctgaggtgggtggatcacgaggtcaggagttcgagaccagcctggccaacatggtgaaaccctgtttctactgaaaatacaaaaattagccaggcgtggtcgtgggcacctgtaatcccagctacttgggaggttgaggcaggagaatcgcttgaacccaggaggcagaggttgtggtgagccgagattgccccactgtactccagcctgggcaacagaacaagactttgtttcaaaaaaacaaaaccaacaaaaaaggctgggcgcacagtggctcacgcgtgtaatcccagcactttgggaggtcgaggcaggcagatcacctgaggtcaggagttcgagaccagcctggccaacatggtgaaaccctgtctctactaaaaatacaaaaaattagctgggcgtggtggcgcacacctgtaatcccagctacttaggaggctgaggcaggagaatctcttgaacctgggaggcagaagttgcagtgagccgagatggcgccattgcactccagcttgggcaacaagagcgaaactccatctcaaaaaaaaaaaaaaaaaaaaaaaacaacactgtaaaggatcttcagtcaactagaccagctccctctatctgcaaattagggaagaggacttaactgcaggttatgtagctttttagtggtagattaacattaaagcacagctcccctgactcctagaccagagttctttttcctgagccacactgatggtaatctcacaaaccacttctgtttttatttcttgtgtggcaagtaaattaactttgccaactgaagagtgatatcatttatagtcctacctgacagtcattaagagttcttcatgtctggtatttccttggcaaatttcaatttcattggttttgttatgcttatctgacagaaggtttgttgatttcaagtcactaggaacagtgcctccaaaattaaaattcactctccaactgagcagcacacactagctcaaggcaattaaatagactgcttctttccttctagcggtagagtcagctctgtttgcctgtcactgggctcaaggaattacaaagtataaagagttacagtagcaattccaaaatacaaagagttacggctgggcatggtggctcacacctgtaatcccagtactttgggaggccgaggcgggtggatcccctgaggttgggagttcgagaccagcctgaccaacttggagaaaccccatctctactaaaaatacaacattagctgagcatggtggctcatgcctgtaatcccagctactcaggaggctgaagcaggaaaaacgcttgaacccaggaggcagaggtagcagtgagccaagatcacgccgagccgagatcatgccattgtactccagcctgggcaacaagagcaaaactccatctcaaaaaaaaaaaaaaaaaaaaaaaaagagttacatattcattcatgtgatagaacgaaaacacaacataaactctttcaaaattgagagcataaaattctcagagattagattatcttgtatctaaaacaattatttccctgttagagaaaagggaaacccacatatccattcctccactgccttgccctacccaacatattcacacacatttctaccacctcttagactcatactgtcaggggcctctcaggggtttcaggaaggcacctcgttctccaaaatgtttccagcagcagccacatctcatttgcaatttttctaacccacctcaagtacacatcttccagagcctgttttaaaaagttttatcaggccgggcgcagtggctcacgcctgtaatcccagcactttgggagactgaggcgggcggatcacctgaggtctggagttcgagaccagcctgaccaacatggagaaaccccatctctactaaaaatacaaaaattagctgggcatggtggcgcatgcctgtaatcccagctactcgggaggctgaggcaggagaatcacttgaaccagggaggcagaggttgcggtgagccgagatcgcgccactgcactccagcctgggcaacaacatcgaaactctgtctcaaaaaaaaaatgaaaataaaaagctttatctctcttcccacatggtattcctttttgtagccagagaaccttcctctgaagctcttattattttgttctgtgtgtttttagttttctcctaaaaaatgtgttataattatatgttatgattttaattttaaaaaaggatgcatctcatccataattctaccaagacaacaattattaacatcctggagtattttcaaaggctcttttttctaaggtatattttcttaactgtgattataacttcacggaaaattttaagaaaaattaaccagggattttgagtgtagcttttaactagtttaattttactactgacattcagtgtagagaaaagtgcccccaaagagaatatgtgggtaaagtatgaagctggtaaatgcaagagcaatacgatatatgataatggttatgatgtccgtaaatgaaagactttgaggccaggaaatacatgttttatgcatgtgactttcatattatcttaaacagtgcacatgaggaggagtggagaattataaaacctgaatgtgttattccaagaaagaaggaattaaaattaggaaccattaggaatggcacatgtgctgagattagcagttggcaacgttttctttaaaaaacatagaggattttagggtaggaatgacaagacactggaacattgaaaaagttcagagataagttcacacataagacttgtgtgccctggggagaaataggtagtaaagacatgtttgtggctggcagagaatcctgggaagctgtttcactggactttgcctgcaagcaaagcaattttacttggcatgaaggaatccaattaagatagaagagaaaaaaggaatgcccagggaggaacccgtgactgaagaatcagattgaaatagctctaaattagattctgaagaaaagttaaaatgacctggtaaagataggtagcatgagaggcatagaatagtgactcaaggattgtgagtaagaaagtagccagcttattgatggtaaaattaacatagtgaggaggaataggagattttagttgactataagttcattgtgatcccatgttgtaaagttgtcacacgcacaaaaaaattacattcacaatatgtacccatagagctgctgcagaattcctttatttgccctccttagctcagtcccattctctgaaactgttactctactctcttctcaataataatgaccatggcagcagcagtaggtaacatttattgagtgcttactgtgtaccaggcatgtgttttaatatacattgactcctcactgtaaccctgtaaagttggaactattattctctccattttacaagacacaaaactgagacccagagtcacactgctaggaagcacaggaattggaatttgaatcccagctatctggcctcagagcctgagctctactgaatggtgccccaaactcttgccctgttttggcagataaccctacctcctgcttcatggagaaagttgagggtctgcggccttaaatcctcaccttcctgttgctgtgcttaatatctggatctcctgccaactttccttcatcacaagggcagcaatagccttctgccccacttggagctcctccctccacttgtgctggtaatccatcctctcctgtcactacatcagtcagaaccaagtccccattgattcccagccccatccatcccctcattctcctttctcttctttatttacttttataaacatttttgtcttacccagaatctcttccttataccctatgcctctaaatttctttggagtagaatctcaatcatctttgtatctctagaaaatattttttaaaaaatatatatatatataaacttttagatacagagggtacatgtgcaggtttgttatgtaggtatattgcatgatgttgaggtttggggtacagacccgtcacccagttagtgagcataccacccaataggtagttttagaaaagatgttgaataaagtaagtcaatctgcattggataaatagtattagaacaagggagctgatgttccccctcagctctgtgctggtcagaacattcctagagtattgtgttttattctggacgtacagtttgagtgatatggacatacacttgcatgttcctaggcgtggtgataaagggactttaaaccatgccatgtttaggtggggtcagttgaaggaaattggattgtttaggctacacagcagaagagaagacttgaggtacaaaagagctgcttcaagttttgaaagactggcatgtagaaggattacccttattctatatatctccaaagaatatgactaagatcgggaggtggaagctacacaaaaaatgatttttttttttttttgagacagagtcttgctctgtcacccaggcaggagtgcagtggcccgatttcggctcactgcaagctccgcctcccaggttcatgccattctcctgcctcagcctcccgagtagctgggactacaggcgcccaccaccacacccggctaattttttttgtatttttagtagagatggggtttcaccgtgttagccaggatggtcttgatctcctgacctcaggatccacccacctcggcctcccaaagtgctgggattacagacgtgagccaccgcacccggccacagaaaatgatttttattcttctttttttttttttttttgagacaggatctaactatgttgcccagtctggagtgcagtggcaccatcagagctcactgcaaccccaaactcctgggctcaagcaatcctcctgggtagctgggactacaggcgtgcaccaccatacccccctaatttttaaaatttttttttagaaacaaggtccaactatgttgcccaggctggtcttgaactcctgggcttaaggaatcctcctgagtagctgggactaaaggaacacaccaccacacctggctaatttttttttttgagatacagtctccctctgtcgcctaggctggagggcaatggcgcaatctcggctcactgcaacctccgcctcctgggttcaagggattctcctgcctcagcctcctgagtagctgggattacaggcacatgccaccatgcctggctaattttttgtatttttagtagagacagggttttgccatgttggccaggctgatcttgagctcctgacctcagatgatccacctgcctcggcctcccggagtgctgggattacaggtgcaagccaccacgccaggccatctggctaatttttaaaaatttttttatagagactgggttttgctacattgccgagggtggtcttgaacccctgggctcaagccatcctcctgcctcagccccgagtggctaggactacagttgtgtactgctgcatctggctaattattttatttttttgtagaggtgaggtcttgctacattttccagtctggtggatttacaaaaagaaaaaaagcaccaaagttgtccaatggagattgctctgccttgagagatgtagtgaatatcttgtcactagaagtgctatctggatggtcatatgacaggagattctagagaagatttgagcttgagaagtatttttgcttatacagcctttaaggtctgtcctaatcttaaattctggaagagctggatcctttggccaagtgtgttctatccaggatgcacattagaatcacctggggaagttttaggaacccataccaatgctcacatcccatcccaggtcagttacattggaatgttttgaccagggcttggtcattggtattttttaagagctcctcagttgattctaaagtacaatcaagtctgaaaacctccaatttagctcaaccaagctgaattgaataagatagtgtgggttagtgtttttttacactaaatatagtacttgttttatgtaggtcaatataatgtaaatgccattatatattatatttatgcctgattcaaattcttatgtattgtgacatattaaaaatacaggaataaaactgaatttctaacaaaccataatataaggatgctcagcatgaaggattttgtccatagctattttcttaaaatgtaggcatgtacatgtgcacacacacacacacacacaaatgcacacacatagggaggaaaatttcttgtagcaattggtaaacaaatgaatgagttgattattggtctgctcagaataataaattgggtattataaatttgtgaagttattgcattccttaaagcaaccagtgtgccttttatttgggtattgatctgggtccatcattgtgtgctagtagtaaagctggaaggagtatgtagaaatgaaaagaaacacttggcattgggtattgactttttctggagccactcaaagaaaataaactaatatcactacaaatgtttcaagtatttttttgatttgctatgtttagttgtgtctctagtaagatgagagctgttttcctgaagtagtttcctacttgttaaatttttgacttccttctgtttaactttctctttaaagctattggtgtcagcaaccagagggaaaccactgtagtctgggacaagataactggagagcctctctacaatgctgtgggtaagctgtcatgcatggatgtcaaatgtagggcctttcttcacattgcaaatgtggtcatattaaaatatcttgctaaaaaagcatgcagtcgccaggcatggtggctcacgcctgtaatcccagcacttcgggagactgaggtgggtggatcacgaggtcaggagttcaagaccagcctggtcaacatggtgaaaccccatctctactaaaaatacaaaaattagccaggtgtggtggcacacacctatagtcccagctactcgggaggctgaagcaggagaattgattgaacctgggaggcagaggttgcagtgagccaagaccttgccattgcactccagcctgggcaagagagtgagactccatctcaaaaaaaaaaaaagaaagaaaaaaaaaaacacatgcagtcatggtacctataatcttgatgggatgggcagaagagtctgctaagaaattaactgttgtatatttaccatttttggatcatacatattcacatagtgaattaactctcccatgctctctcctcttgcagattgtcttacaaatgagtgaatgtttgccaaattgttttataacccctgctgtttgtgacatctaaaagagatcttacctccttaccctcaaaaaattaaaattacgtgtgttcacagtcatttttctataaagtacttgtgtgtttgtctttccatctaggaatttgaattattcttctaaggttataaaaatagaatattcgaattttagctgcttcttctacaaatgtggctatttgagcagggatttaaaaaaccccaaatctcaaatataccacttttaggtatcacaacttattaggtgtaaatgatcctgagtatattttagcatcattattagcatgacagttgttgaacaccgaatgatactaccacttcctaaaaggaaaattttgttctaaattacaatcactaaaagacttcattgtgtcagaaagcaaagcacaattttttatcaattaaatactaagttgtgggatggggaatggaatcagaaattatcagagaggggataattttgggggaataatctttattaaaagttaaagtatttaatgttattgtattataagaaagtatttagtatgttttctgtatttatgataaaaaattaaattctcaaaaaatttgaaagaattacaactaaagatccttttagtacatctttttctgtggtgttttttttttttttctttcctctgtttttttttttttgagacagtcttgctgttgcccaggctggggtgcaatgacacaatctcggctcactgcaacctccacctcctgggttcaagcgattctcctgcctcagcctccccagtagatgggatcacaggcgcccaccaccatgcccagctatttttttttttttttttttgtatttttagtagagatggggtttcaccacgttggccaggctggtcttgaactcctgacctcaagtgatccacccatctcagcctcccaaagtgctgggattacaggtgtgagccaccacacccagccagaagtacatgttttaaatgtttattttgttctcattctcatgagtaattcattttgaatataagacagactatttaatgactagtatttaggagagtatcctttgatagatcaatgttagctaacttcctgaactagttaaggttttactttcttttgttttcttaatgaaaggaagagcctactcaggcaaaccagaaagttccagttaaattctgagctttttttttttttttctttttttgagacagagtcttctctttcactcaggcaggagtgcagtggtgcaatctcggctcgctctatctcccaggttcaagtgattttcgtgcctcggcctcccaagtagctgggattataggtgtgcaccattatgcccggctaatttttgtattttcagtagagacagggtttcaccatgttggccggactggtctcaaactcccgacctcaggtgatctgcccaccttggcacgcccggctagttccagttatattctaaacattgaattgtaaaaatggaactttggactttggattgttatttttcaaataatgcaactaggtaagctgaagttatgcttacagtaaagatttaagtaaatgttttactagaaaatctttctgtgatgttcttatttacttatttccttctcttctgcctgtgtccctctgcacccctcccccattctacgtgctttgcagtattaattcaaatgttcataggatatgaggaactcttttcttctatcctgagccacatacatgttttgagaacctcttacatgtttgatgttatcttgggtactataaaggatacaaattatattggctgtttttttaagcactttataatctagttttggaaagagaaaactagattagggaacaatccataaaacaaaattagggaatagttgataaatcatgtgttgataggttgaaaaggacttagagcaagtacatatcagtatggattttgaaattttagcatacttttcacagtggaggttgaacttcacttgggccttgaagcgtatattggattgcgttaggaaaagagaaaattgaggaataatgtgaacaagctatgaaggtgaaaatgtgtacacatattttgccagagtaaagaaatggatgagtttcatgcataggttgactcatttttttttatttttagtagaactagcagcgataataatactcagtaagtgctaactgctattactttgggattgtgctaagtattttacccatattatttaatctcactgaccctgtgaaacagattttactacccctattttataaattaattgtggaaaagctctataacttgtccaatggcatgtagctataagtagagtaaagccacagtttaaacatgaacactctccaaccttaaagcttgtgttctaatttgggtagacaggggttggtgaggatatagagggggctgaaagccatgcagtgtagtgtagacttaaaacacggggcagcttgaggcaaaacagatgataaaggagagtttagccatcccatgatggtggaatgggttgtttcaaacacaccagtatgcggagaacaaccagaaaagctggatgaaaatgaaataaaattctgaagaactggaaggctaccaaggcagtgaggacagaaggaaagcccagagacataagcctagcatttggcattgcttatctcctggagatatcggtaggttctgaaaggagtatctgacaggctaagccacacttctgcaggtccataaagataaggaggcaaaaggtgaagtcaagggctgccaagggtggggatgagtgttggtaaaatcccagactttggactgggactgtgaaaggtcaaatcctggaagtgaggtaaactgaaaataaaccaaccctcacaggaattgaagcccagattcaaatgatctttaacactaattggattaagatgatctgagattgctaatgctagtggcctaacttcctttcagaaataagagtaaatcctttctggaggaagacaacatcatctagagcctcaaataatctctagaatttttcatacgcattatctagttttctatttaaaaaaaccatgcatacaaaacaaaacgtgactgaaaagcaacagaaacaagtgacattagaaacagactcaagaaattcagatattagagtttttagagtttaaaatagccataattaatatgttcaaggaattaattgacaagattgagattgataatcttggcaaagaattggaagtccagtttaaatggacattctaaaactgtattaagaactcaattgatggggttttaccatcagaggagacatagctgaagatgaatttgtgagctggaagataaatcagaactgggagagagagtaaaatatttagactgaagcacagagaaacaaaagtttagaaaaggcacaaaagaatctaagagaaatatgggaaaaggtgaagaagtttaatatatttgtaattggacttccagaaggaaaggaatgagaaaaaacgaggcagaaataacattagacagataatgggagaaagtttttcaaaactgatgaaagatagcaagctgtagattcaataagcactataatccctaggcaagataaatatacagaagaccatacttatgctgggatatgaagatataaagttttgaagtagctgaggaaaaaagatatataaccttcaaaagagtgaccctaagactttcagctaagttatcagtggaaacaaaggaagtcagaatgcgatggaatgaaacctttaaagtactcaaagaaagtaacttccacatacagttctatatccagtgaaaaaattattaagaaatgaaagtgaaatatactaggagttggtgaggatatagaggtcaccaaaagctatgcagagtagtgtagacttgatacactaggcagctaacccattctcttagtccattctggttactataacaaaataccctagattggataatttataaacaacaaaaattttattgtttatacattggatagggcataaggaggagggagaaaataaagcaggcctgtgagattttcagcctgagagaacagaaagaaattaaataatatttagggggtaccaacctgagagaaaaaatggccttgttttcgacaaagtgagtgttgaacttgtaatagaagctaattctgggcaatgagaaattagatggttccaaatgtagacttgaaaattgataacatagatgtgataatctcaatttattatggatgaactcactatagtaattaatataaaattaattcaatgaaagaataggtgcctttctgtgttctaggttttgtgataacccttggcatatagtgacaaaccaggaagaccttgtacttgactttctgctacagaaactaaggatagaagtttggaagctagaaggagaaagggaaataggaaaggaggagagccactaagaaatgacaaggatagattctgccttcagttttatttcatccaggaaaactctaaagtgtcatatctccatgtaggtcttcagttgaaaatatcaacataatattaaatctttagcagttttattctaaagcaacacaaggtaggatggatggaaacaatgagattttcacgtatatttgtctttgaacttcttttgctttgtttatatcacagtctgcaggttttatacttttttctctgtctcggttcaggctgctttaacaaaaatatcatagactgggtggcttatagattagaaatttatttctcacatttctggaagctagaagttcaagatcaaggtgcttacccatctggtgtctagtgaggaccttcttcctggtttgcagatgactgtcttctcatcctcatatggcagacagtgataaaaagaaagtaagctctctctttttatgagggtactgatctcaatgagggctccaccctcatggcctaatttatctctcaaaggtcccatctctaataccatcatattaggggttaagattttaacatacgaatttggaagagacacatacattcagtccatagcattctctttgtatgttttcttccttcgttgtctatttctcttgtaaatctctgtaactctatgcctgtccttctcctctttatttctgtcttactaaattatacaacagatgatatatgcatatatatatacagctgtatataaatatatatattttaaatacagatagggtctcgctgtgttgagtaggctggtcttgaactcctggcctcaagtgatcctcccatctcggcctcccaaagtgctgggattacaggtgtgagccaccatacccggccagatgagcaatatttattacaaacaagcatatgagaggagcacattatgtttccctttttaaaaacttctatgtggcctcctttgtttatggctcagggacacttgataagcaataattcactcacccccactacggtaacagaaaaaccaagataggagaacttcaggatatcattggtggccacggcataggcttgatgaaggtaaagactgagaagggctatttgtttttgcttgcaataaaggtgtgtttgtttattgacatcttttctatcagatacaattataaacagaaaaaaatttaaatgggtccattgaggaagagatggcctaatttacaagttctatgtatttttagaatttatctgttaattatgtgattaataaggtaaacattaatgtgatatctaaaatgggaaagtgttactttgcatcactgctttccagccactgtgccatgatgcaggcatttacaataatgacctcattggtggatcagcaagagctttgtggccctggaaccaaagcaggccttgggcttctcttgcctctcttcagttgccctagtcttcctggtacttctctctttcccttttagcattatcttcaatattcccttccacggggtttcctctacccacccatttttctaagccttttccttccaaaagcagcttttattaatggtctacataactggttgtcttctattattgaaaaagtaaataagccacagactaaactgaccaagaagcacaaaactacccaagtagttaaaatgtgaagcgggagaaggcttgaatcagtgatgtttagtatgtttacacacacattttactgatgctaccagggaaatgttctgtccaaactagaatggcctagctgtatttccccctaattggccaagtttgctcactcaccactgcagttgattggtatgtatggtaagtatagagcaatatgaccctcactctggtagctttctgtagagcacaattcttgatttaatataaaaataccattcataggccaggcgtggtggctcacgcctataatcccaacactttgggaggcccaggtgggcggatcacctgaggtcgggagtttgagaccagcctgaccaacatggagaaaccccgtctctactaaaaatacaaaaattagctgggcgtggtagcgcgtgcctgtaatcccagctactagggaggctgaggcgggagaatcgcttgaacccgggaggcggaggttgcagtgagctgagatcgcgccattgcactccagcctgggcaacaagagcaaaactccatctcaaaaaaaaaaaaaaaaaaaaaaaaaaaagcattcacagtagggactaatccagcaaggcaagagtccctggcttaacacttttaggatattaaagaaaaccacccacaaaaaatatttcgttgtccctgaaacatttttctatatttaaatggtagtgcaaacatttttttctaagatgttatatttaaagttcccaatggcacacataactctttatggagagtgttgcaattttaaagattggttatcgtttttacatttttttaacatactggttaatactgggccaattattaaacctatgtgatcatgagttgagatctgaaccttgagctcaatccttttatcttttctggaactggcttatgtttcaaagaatcagcagaaaagaaaaccatagatgacaaaccacctaaaacgcctaagcacacttaactttaaacaataaagtattttttttctttttttttttctttttttttgagacggagtctcgcactgtcgcccaggctagagtgcagtggcgcgatctcggctcaccgcaagctccgcctcccgggttcacgccattctcctgcctcagcctcccgaatagctgggactacaggcgcctgccaccgctcccggctaattttttttgtatttttagaagagacggggtttcaccgtgttagccaggatggtctcgatctcctgacctcgtgatccgccggcctcggcctcccaaagtgctgggattgcaggcttgaaccaccgcgcctggctaaaagtattttttttcaattagttctttgtgggagaaggtttttcacttttgtaaaatctagaattttcagctttattaagatccacttattttccgttaaaaaaattccattattacaggattctttgaaaaccttacatctccctcaatcctgggtaaagaaatactgctgtatttattttgcagtgattgaattattcaaatctggccaaataaaaagaaactgacttagttttcaactttgagttctccaatctttaataattatttttatcccgttaagactgtgacgtcatcatggctatacctacctagaggtttaattctagattcaggttctgggttcagatcctagcttttccacttcctaccattctgtgcctgttaccttgacagttaaactggggagatgaaaagtgtagacctcatagacttgaggtgtagatcagtgagttaatccatgtaggatacttaagccagggcctgacggactataaggcttcagtaattgttagctagggccactgttctgaattggctgatagcctttttcatccagtaatgccagatgaaatgattggtttatacatgataggtgttcctaggggaaatgcagagcctacctaggatcacccacactcaagtcagtcattgatattttggcattttatacccaagagctgaaattggcttcagcccccgccttttggcatatatgtaaatcaatctttccttcccaactctgttttacttttggccccacctgtttctgagaatgtcatcaggtgaggggcagccatcaatatagtctcttccaccttgcaaatgaccacttacccagcttaattaatagcttagcttttgacaaatagtaaaatgccataactaaatctgttttactatcatgtctcttgtgggagaaacaacccaataacactttgtataactgtcagcagtctgtgcttaggatgtgttccataacctggagcctcaccttcacctcacttcctatcaccctagcagctcatgacagaccatctcagagaagatttattatttgcctgtttctagtcaaatggaaatcagctagatgattttagtggggtttttttttactttattttgtttttccttctattgtcatgactaacgaaaaactggaaagttatgaggttttattattctaaatatttaaaaaataatttattcctctgtactgtttgttactatgtcactaactctagcccatggggattgaggcaactacatttatcttcactcttcaaactttttttttccagaacaaactaaatctaccagacagattggatgtgactttatttaatacaaataagttcagatcatccaagttatttttattaacttacttatttgatgggcttgaccatttacttctgctttacttggtgtagataaggggagggacataccttctagaagtgggctgtctagtgttctggactccctagcatcaattttccttctatttttttcctaattactttggaagttagcaatcccctgttccctctagacacgttgctcccttctgtgaaggtgccctttactcccagctatcttaccaggaaagtgctttcttggggacctgccttcccaaagcagccctttcatgtcttaatgtagatggccacaacacagactgtagcatgctccttgccattcctttctaacatcctctaggattgtgctccctcagtacatcatccatcatttcaatttagtggttgaatgagtagtcagttaccacctgagccacttttctaattaggatgcatatatgttgccagatagagaagagtcatcctaaacaagaagcaggtatttacctggtcttcatccaaatggaaatattattgaatcagagattcatactggacttcctttgttccctttctgctccctgcctcttccttttctttttctacaccaatgtgtagaaaaagtgttcattctgataaacttgcccaagtgatctaccatttcctaaatggtcaacaagagaccttgaacctggccatctctagcgtgaattgcccttatttcttctaatgctccagctgctccagtttctcctggcccttcagttccagttgccgttgttccctctggctcttcagttccagctcctggtacttcctcaggtattggtgctctggctattgctcacttcccagcctcccaagtcctatatgttgggggaaattgacttctgctgccagatctggatctgtcattccttttgattgttctcagagattacctacacaaggggcttagtcctccagcttgggagtcttctctttggcttttggtctctctgcaaatctaattctgccatcttagcttctttaataagttttctaatttttttgttcttaattcaattaattttgagcatttgtgaattgcttggtagtgtaccaaccactgatatttttctctttggcagttttactaatgcattccatgtattctaactgccttaatgtctgtctataaaaacacagtaattattatgacaggtttctatgatcatggaacaatggaaggagaaagactttagagaccatctagtccagcctccttattttatatttagagaatccagaccaagaagggtaaaatgagttgcctaaatcacatagcttattggtggcaaagccaaacattgaattttggtctccctgatttcacatccagtgttttgattctttgtggtaaggatttaactctgtgtttaccactattgtcagtcacagctgcaaactttcaagtgaggaataaagtgcctaagtggtccttgccaaggagcaatagaatcacagggccactgggacttggagaaccatctgattatcgggggggttctttagatttttttaaacatataattggaacacacctagtattttaaagaatatgctcttgaaaagatgaaaagagtttctcccgggaggcggaggctgcagtgagccgcgatcgcatcactgcactccagactgggtgacagaaagagactctgtctcaaaaaaaaaaaaaaaaaaaaagggagagagagagaaagaaaacaggtcctcatgttttagtattatactgaattacttgagacacttttaacaaaagtacagaggctcagagctcaggccttgcctagacctgcaaccagaatcatgcaaggtagggcctgaattttaaggttttccaggtagtcctggtatgctttataggaaagaaccactgccgtgaagtctagcagtgtttctcaaaatggggcacctatttaaaagtcagatttctgggcctcattcccagaactactgtcctagaatttatggggatggagcccatctttaagctcccttgtgaatgttatgtccattaaaatatgaaaaaacacggtctagaatattttaagtcattaaccaaaaaagcctggggcagtggctttcaaatgtatttgttcatgccccttggtaagaattacattttacataatgatccagcaaatccacataactaaaacaaaagtttcacaaatcaatatttatcttacccagtgcactgaactctgatattttccattctaattcatcctatttcaatttttaaagtaggtaatcaaaactcactaaattcatttttaaactcatagctcactgtattttgaaacactgagtattgagatgtgcttgttaattttacctatcatagatttaaaacttttctaattcttctactttttctagttatttctgtgagccaataacacctgctaggattgcttacctgtaaggaaggtccacatttgtcacagtcatacagtactgccactgtgtaaaagtagactgcccttgttccctgggcatgggagatcttgccacctccatgatgatgtcactaatggcttgtatcaatcacagtgtaaataatagaaaattctatttcaactaaatgaagtttaaagcagggggcagttcttttgctcttggaagcagcagtgcaagggtagctaagttcaggtgctgtttgattccagactcagacagtatcacctgcatccccctcaagcctgccttttctgggatggctcctgatgtggcatattcaactcccacttcatgagggcagcaggcccaagccacacactgccaaggtcagctgagaagagggactcttgcagactgagcacaaatctctttgaccacatgtttcctgatccagtcactggggcccagacccattcctggagctgggagtaagatcaaatctcaggtacactacatggctgagggtgagggtggaacgatttcctaaaaagaattcgaaatacctctccccaacagatgcaggaggagtagatactgggcagcaaatgcagatgttatctattataggccatctattttcatggtctttctcttttccctcctgttttcttggttgtggtgagtcttttcttgctgcttttcccacctacagaaacccgtatcttgtcctgaagtccccagtttaagtcttgtggaaagtagccactgtcaaaatgaagtgcagggccctccagggaaatgacagcataagtaattagaaagaattgattaaaatttactacaggaaataactgctttttagtgaagagaatggagtaatatagaagagttaaccaaactgcacaatgattgctagcattcaaatatgtggtagtgggcaagcttgtatagtcttccctggagtcctttaaatagactatgaaactgagtcttttcaggaggtatctgagcagtcagtgtcctaaaaatatcaaatgaccacaaatagattaaaagttatcgaagtttaagtacaaaacttaaatctggcaaataaagcttagctgattctattggctgcctttcacaattactttatgtactatttagtgtttcctcttcctcaagcctactaacatgaagtaaaacagaaatcgtttccaccagggggttagaaagtagataatagctacttagtaaagataatgttgatccattaaaatggagattttttttttttatactccagcagagagaaagaatggtgcctttaaaaggattctaatgattccgggtctagcatacttggaaagatttcaatgtaaataagcatttcatacataacagacggaatcttttgtttcctgaataacagaatcaagttatctactttgtcttagtcacaaattgctccctagtttgttaagatgcacactttatatatggtatgatgatcctgggttttgcattttgtgctaccaactagcctgcctagcttttagatattctctggcctcatgtatacttagaaaatctatattccaaatattttttgtagttttgttctataaaaataatacaaaataagcactctaaggtttgtattattctcctaacttggtctgtaattttgcataaaagctttaaatcctctcataaatttatttttatctaacaatatgcccattcatttctaattttctaatttctatctcttaaaagctatagaattttaattccttatagaaactaatcagtcttttatccttgatagtgatttcagtaagttcttattttttaaatgaagtttttcatgtatattattttattttggtctatagtgtggcttgatctaagaacccagtctaccgttgagagtcttagtaaaagaattccaggaaataataactttgtcaaggtaagaatttcttcagaagtatactataagaatgtttctttttttaaaaaaagtttgcagatttcactagaaagaagcatcttatggtacaatagttatttgatacaatttatagaatctttttcccggataattgaggccaactcaagtctttaccttcccgtctttcttgctctgtggtggattggaacaataataacacaaaattgacaggctggaagagattataatgcgtcccagtggcttaagtcacacttcccaaggggtgctttttttttttttttttttttgagacggagttttatgcttgttgcccaggctggagtgcaatggtgtgatctcggctcaccgcagcctctgcctcctgggttcaagcaattctcctgcctcagcctcccgagtagctgggactacaggcacgtgccaccatgcccggctaattttttgtatttttagtagagatggggtttcactgtgttagccaggatggtctcgatctcctgacctcatgatccgcccacttcggcctcccaaagtgctggtgggaggggtgctttctataattgaactatgttttccaaatctatccctattttttctactgcccatcaaagaatgttctggctgcttttgagtttttaagcatctggattcagggagagagaaagtaaaagacactctagccctttattgaacccctcttccactttgttcatatgaagaaggctaataaaactgcctaattttcagtccttgtatagatccctcttcacataaaggaagggagagtgaatttttaaaataggtgaggaattttttttagcaaggtcaaggccaagttcttctagcgtctaaaaggaagttccctttttctgtttttgttttttgtgttttgttgttgtttatcccgtttttatttgtcagtgggatgcttgtatcattttcttctaaaactattgttgaaatcccattaattgcagtaatctgaccattccgtccccccacaataacttcagacttgtcctgaataaatcattttctattccgttcccttcatcaccctgcccaatcctcatcctcacctccagctgcactctgcttcgagggatgcatgcttttctctccgatgtcattttaggcaacttttacactttctacccccatgatgaaaataagatattatgtactacctcgctattgactttgtgagatcttcccaggtcatcttttgggatgacccttgttccttcaaattaaataatatttccataaaatatctccttccattttttttttcgagacagggtctcactctgttgcccaggctggagtgcagtggcacaatctctgctcactgcaacctctgcctcctgggttcaaatgattctcctgcctcagcctccccagtggctgagattacaggcaagcaccaccaagcccggctaatttttattctatttttagtggccaggctggcctcaaactcctgatctcaggtgatctgcccgcctcagcctcccaaaatgctgggtttacagacgtgagccaccgcgcccggcctccttccattatttttgtgcattgattttttttttttaaagaaagctagaaaaccttgagttaagatttttaatttacaggttgcattaaagtattaaatcctttggtttgagttttcttacaaaaccatactcatatgagataggagggaaaaagttatcactttctgtagttaggtgataaataagaatacagatggggaggggaatcatagttgcattatttttgtgtatgtattttctttttcttttctttttttttttttttttttttttgagacggagtctcgctctgtcacccaggctggagtgcagtggcgtcatcttggctcactgcaagctccgcctcccgggttcatgccattctcctgcctcagcctcctgtgtagctgggactacaggtgcccgccaccatgcctggctaattttttgtatttttagtagagacggggtttcaccatgttagccaggatggtctccatctcctgacctcatgatccgcccacctcagcctcccaaagtgctgggattacaggcatgagccaccacgcctggcgtattttcttaactagttaactttaatcagcctttatatacatttagtgtttaatatactaaccacaaatgagttgggtttgacccattctcaaggaagattggtaagcacatatgtgtttcatttttgcccattaatctttcttcagttcacattccctctgtttaatatatttgctaaatttaggcaactgctgttttagatagagtaattctgtgttgctttatttattttttattttttattttttttgagacagagtctcgctctgtcatccaggctggagtgcagtggtgcaatctcagctcactgcaacctctgcctcccaggttcaagcgattctcttgtctcagcttcccaagtagctgagattgcaggtgtgtgctactatgcccagctaatttttatatttttagtagagacggggtttcaccatgttggccaggttggtttcgagctcctaacctcaagtgatccacctgcttcagcctcccaaagtgttgggattacaggcatgagccaccacacctggccctgtgttgctttaatttggcatgtctttgagctctactttagtgtctactaatttcatgttatgttatttgaacttgtgtgtgtatatatgtaaaatatattattaagtcttattgttttaaaagttttctggttatgatcattagtttatgatttggtatactctctggtttttaatagtttaaatgtcatttttatggaatataaaataaacagcatagttttgggctaggttctacatacaatactaatttattgcaaaaatcaacatctacattgtcactatctaattacaggatgttgtgtcatttaattttctctttaccttgctacgtggatgccctttgaactgtaaacatgtcaccctaatctttgttcatgaacatgctttcctgtgccatgagacaggaaaagtatttttattcataatactatgggattgccttcagggtctttgaatattttgtgatttgttgagttcttttgtttggtggttttgttttaaactgttacacttttcatttgctaactgaacttcacaactgttttagtccaagacaggccttccacttagcacttacttcagtgcagtgaaacttcgttggctccttgacaatgtgagaaaagttcaaaaggccgttgaagaaaaacgagctctttttgggactattgattcatggcttatttgggtatgtttaaatataatggatatatggagaattttttcagaaattttttctagactgccttgcctattgtttctactagcaggtcagactttttaattagcagcattatgaagaaaaaccactcaaaaagcaacaggagaagttttcagcttccattcgagaagcatttttgcctacttcctctttattttttcttgtcttacttcagtgaaaatgaaggataattaccaaaactgtatctaatatctattatctttaggatgagtaatttagataccctttccctattgtctgttatatactcctttcccactagccatgtcttagacgaaataactatttagcaggataaaatacctagagtacttttatcttttgctttcaacattacataactgtctcttgtataatcaagccataatatgaaactaaatcatagtggaaatttctatttagaatctttttgcctaagctgaatacacagcaatcatcaacctatggccaatcttatttctactatactcacatattctttctccccacagataattttaaaacaaatgccagacatttcattttatttgtaaatatttcagtaagtatgtaatgatcttttttaacattcaagggaatgtcaaggaaatattgtccccactctcacttgacagatccacagagcaggtctttcagaacccatatcagaaagaggcaccttcttcacctctccatgtgcttggccagggcagaatgtgctttgtgttcatggccagccattttcacgtgtgtcagtcacagttgaatgagtacctttgacaattgcatcgaaccagagtaaggcaagatgtggaaactgtgagctgcaggagactcaagggagcacattttggctatatcccactggatgctgtttattgacctttgttcctttcctacctcttattgcttccatgtaaaggaaagcagcagtgccttcagttcaggcatgtgggtacacctgagaaagaaagtttaaaactctcctttcaggatatatgcttaggtgagtgtagatagcataatgcgaattgttatttaaacaacaacagcaacaacaaaaaaaaccaaagagataacaacaacacacaattctctaataatccttatgaggcagatatttccatttatttcatctcgccgaatttaataagactctgagttttctcaacataataggatgaaaacaaaaccgattttttatttatccatcaagtaactggaattgtgctgataaggtggccactagccacatttggctattgagcacttgaaacatgatcaaattgaggtttgctgtaagcatggaatatacaccagatttcaaagacttagtacagaaaaaagaaggtaaaaaaatgtaatgttccgttcttttgctttatgtgctctgctgattatgacccttaacaatatgtaaattaaattgccaataagtacaaatttaacctgatttttttactctgcctagagtttgacaggaggagtcaatggaggtgtccactgtacagatgtaacaaatgcaagtaggactatgcttttcaacattcattctttggaatgggataaacaactctgcgagtaagttctgttttgctctaaatatagttttcccaatacactacctatttataaccgaaatcttaatattttcagatgtcagtggagcaccaaaatttaactgttgatatttcaactacaatatgcaaatctatgttatgtgttttttaaagagagactattattgcatttataataaacaggccaaattaattattcttcacggaagtttaggttcctttataaaagtactttggtttctgtgtgctttctaatttttattgattggcttgcataaagttagaatgttaaatatctaagaatacagctatgttctgttggcttacgtatttattgctatctaactccatgctcaaaaacatccatttctaattgttatttatgctttttgcatttaaatacatataaatgtttctagatgtctatttaaaacagtgttaaatacccaatcttcttgtttttcagattttttggaattccaatggaaattcttccaaatgtccggagttcttctgagatctatggcctaatggtaaaaaacaaacaaacaaacaaaaaacacaccaaaaaaccaaaaaacaaacaaaaaaaaacctaataattaaagtttttttattacaaaacaagtttactattcataattcaaaagtcaactgtgttatgttttgtgacttaaaaactttacagtcctttttacaatggatttgcatttataaactttaattggtttttctttgagtattattatttttaaagaattgatgggatactctaactttagatgttggcatgagccaatttattctttgaatccaaataactgtttagtggttgtgatgtctgcttttaatttagcggagagactctgcatatttagtagtgttctttttcccgttgaatcttttttatggccaagctatgttatatattagattctttgcctgagcaaaatttagcaaagaaactgaaagcaaagagtctgtttctgatttgggattgctaattaaactagtttctgtaatggacatttttacttttgatttcactgaaatccagtaaagacatagcttcagcaaaagtgtgcctagcatcattaagagtctgtggttaaacatcaggaatgaaaacctctaggaggatttgcactggtgtttgagcacaaaaatctggaatttatgataagactcaggaataagtctgataaattacaaaaagtattgcttagacatttcatgaaagatatgagaaacttcacttacaaagttaataataatatagatgaacactaagtgctctggataaagcttgagcaagaatttttaactgttttatttataataaagctttttaaggcaacatagaatttcttaaggaagccatagtcactgcttatctacagtaaaagtgctttgatcatttcatagctgtctgcaaactgacttgggtcaaggaaaaagaaacgatgcttgagaaatagtttcacaggatggttagaaaaaaaaacgtggaactggcctagttttctcttgtatttaaaatattatgcttctatccttctctctcccccttgctgactatagaaaatctctcatagcgtggtgagtaggttgcccgccaattatgtacccattcatttggaaaagatacagtgcacttccatttatttttagacaagcagaagtccatttactaaacatatatatctagaatttccgtgaccttccaaattattataagctctagtcagattttaatttttacaaaaacttaatcttgtttgtttttaaagagtaatgttctaaaataaaagactaaggtagtttcctggaatgagagattctgatattctcataaagtacaactgtgatgtgctttgggctttaccataatagggcaattagatagatacagtttgaaatgtctattttaaatgatatattgaccacctttccagaccagttagttggaaatgcactgttactttttctgcatgcttcatcaaggatgctccaggaggagcatcagaggtccctccctctgaagaaaaaagagcactttacatgcctgaacacacatagtagatcctgttgatagtttgttaattttgaaagtataagcaaagacttcttgtaatacttaaatatatcaagatatatagcctctaggtttcctatagattcactttaagccttttatgaaatttaccctttacttaatatccaggttcagattttcaaagaatatatacagtaaatgaaaatagcaggttttgctgggcacggtggctcacgcctgtaatcccagcactttgggaggccgaggcgggcggatcacgaggtcaggagatcgagaccatcctggctaacatggtgaaaccccgtctctactaaaaatacaaaaaaattagccgggcatggtagcgggtgcctgtaatcccagctacttgggaggccgaggcaggagaatggcgtgaacctgggaggcggagcttgcagtgagccgagatcgcgccactgcactccagcctgggcgagagggagactccgtctcaaaaaaaaaaaaaaattagccgggtgtgctggcacatgcctgtattcccagctactcgggaggctgaggcaggagaatcacttgaacccaggaggcggaggttgtggtgagccgagatggtgccattgcatgccagcctgggcaacaagagtgaaactccatctcaaaaaaaaaaaaaaaaaagaaaagaaaatagcaggttttgaattaaccagaaaacaagaaagaaataaaatgataccagctatctagaggacattttctattttgtaaagggtttctacatttatgctattatttcttcattatcatagctatgtgaggtgaattctattcttgccctcactttaacagacgggatatctaaagctcccagagcctgggagacttgctcatacatggcagaccaaggagtcaggtccaaagctttagtttggtgctcatcctagtacatcacccctacttcagggattttatatatatatatatgttttatatatatgttatatatatacatgttatatatacatgttatgtataacatgttatatatacatgttatgtataacatgtatatatacaacatgttatacataacatgtatatatataacatgttatatatatatatacacacatacgttttatatatatatatacacacacactttttttttttttttgagacggaggctcactctgtcacccaggctggagtgcaatggcatgatcttggctcactgcaaccccgcctcctgagttcaagtgattcttccacctcagcctcctgagtagctgggattacaggtacccgccatcatgcccggctaattttggtatttttgtggagatggggtttcaccatgttggccaggctggtcttcaagtcctgacctcaggtgatcctcccacctcggcctcccaaagtgctgggattacaggcaggaggcacagtgcccggctggggatcctatttcttagttctcctaattccttaatatcattaaatattgccttgagttaatgtgtctttttttaaaattaaggttgtcaagtctacaatcagccacttaaatctcatttttcttcctagaatgctggccatcatgatcaaaataaaaaccagtatttatgacataaattaactgttgcttatctaaatttgaagaaagatgtttgctatgaacaaataatatacaatacctgaacactcttgtgtttagagcagcttgagtagaaagaaaagttgctaaaatatggccttgcaaaataaatgtgtttcatactggtttgatagctattggaagaatatattagtcatttcttaataatggcaataatagcaaagtactaatgaacttgagcaatcacgtagcccaatctccattttgtagagaaataatgtgatgtattgagaggtttcaacagcctgctagtagattaatactaactaactaaccaagagtagagccctcatttactggctcccagtctaacgttttatgttcattctccagtgccacatctcttcctgtcattctaggaatacttgtagtatctgtctctttatcattcatttagttgaaatgctttctttgtcttgtctgcccacatcctctggcacattgctacttgtgttcactcttgttgcagctatgttagtagagccaaaattttgtgactattcataatcctttttttaaattttattagaaagctggggccttggaaggtgtgccaatatctggggtaagtttcatcaccaagtgtctccccatccccacccttccccatgttatggctttcctcctcttagttcatcagtgtgcctctttttaaactagggaaaacaagtaaaagttgcaaaattggctaattcttgttcttacatgtcatactgtgggccattgagaatcttttgaataaattaattttaactctcccttcccatacctattatcttacatattaacaaatggtattaacaaatggggaaaatggccaaatggagaaaatgcaaggaaatagacagttcattctttgataaataaaaaatgaaaaatcctatggctcttctaaaaagaaagttaatactattgtattagtcagtgttctttattgtcatttatactttcagtgtttaggggaccagtctgctgcattggtgggacaaatgtgcttccagattggacaagccaaaaatacgtgagtttaagaaacagacttaaaaaccaatgctgttttgttttttctacttggtgctttgaataaggaaaagcttttgaagttcatccaggatgaaaatcaatagcttaatagctccaatatgcatatatacactttttaccatttttttatatctttaaataaaatacaaaatgccatatatatgcacactgatgaagcttataaagacctaaatttgtaggctgggcgcggtggctcacgcctgtaatcccagcactttgagtggccgagacaggtggatcacctgaggccgggagttagagaccagcctgaccaacatggagaaaccccatctctactaaaagtacaaaattagccgggcgtgttggtgcatgcctgtaatcccagctactcgggaagctgaggcaggagaatcgcttgaacccgggaggtggaggttgcggtgagccgagatcacgccattgtatgccagcctgggcaacaagagtgaagctctgtctcaaaaacaaacaaataaacaaaaccttaatttgtaaaattcattaccttttatatcctaaaaactaaattttggttcaaagtattcttgcctttttggggagattggtggggtggtgagaggggtgggaagaagtgaggaagagctgtaatatatagtttttggcatattaagtctttctcactaactgtaaagttatatttttgtgggattttcaaggttattttcctggcattgtgctttctctccattatctgaagtttcgcctttcctggcattgtgctttctctccattatctgaagtttctcctttgacaagaagcagaaagaatgatagaagtagagatttggtatatttttctctcaatctcatcttcttactactcacacatgcagaatctggaacaagccccatatctaagagtaataagaagatgactcccactttaggataagaaaatggatactcaaggagcttgcctaaggtcatagccttgacacaaaagcagaaccagatctcaaggccatgccttctgagtctgaatctggcactctttctttctgttcccaccaatcactatatttatttgaaggtaatctttttatttatttatttatttttactttttatttttatttattttttttttttgagatggagtttcgttcttcttgcccaggctggagtgcaatggcgcgatctcggctcactgcaacctccgcctcccaagttcaagctattctcctgccttagcctcccgagtagctgggattataggcatgcgccaccacgcccagctaattttgtatttttagtagagacggagtttctccatgttggtcaggctggtctcaaactcctgacctcaggtgatctgcccgccttggcctcccaaagtgctgggattacaggcgtgagccaccactcctggccaaggtaatcttttaaatattaaaaaatctacctgccaattatacgtattcatgaacaaaattaaatatgcctcaaaagctgaattaatactaacaattataacacaagcttagccaatggctattgtgttacctataatgtttcatgtgctttaaacacatgatatcatttaatccacatatagatcctattattcccattttatagatcaagaaactgagaattaaagaaaaaaatttatgcaacagcacacaactagtaagtgggagatgcaatatttgcacccagatccatgtcattccttagccagggttcttaacctgtgtactgtactacctcctgtatggaaaagatttccatataactggcaagaggctacatttaattgctattttcttgaggatttcctaattatctcatcgattttaacttcagtggttaagttcttcctttgtgaataatggaatgtgtaacatttctagattaaacgttcttgtagtctagcagggtcagtggctctcatgcaagagtgtgacattatttgtgtgagagttttttgaggaggagggatgtgggaattctttgcaggtcatggtaatctgaggttacatgaccaagagcatctgagtcagcctgagtctggaaacattcttggaatctgggttccaggcagctggaatcaagtgccatgagaaactttgaagcaaagctgttgggtttcaatgggaggatagaaaagtcacaaaagattatcttagtaatgagatgctttgaaaaatgagcagtattggagggtacagggaacattgaacaaagatacgtatggggaaatagaagactttgtttagagaatgtagagaacattagagtagggaagtgacaaaaaatataaagctaggatcatgttgtgaagccctatatttcaggctaaggagcttttcttgataggcaataggaaacttttgaaggtttataagctggtgttcagagatgactggagttgtcagtagcagtcttgggtgaaagtgaggaaagactagaggccaagatgccatggaggaagccaccatagtgtcccggtaatgagcacatgggctcagaaggatggagacagagagggaggccatgagtgaatgtgcatggcactgcagaggagaaagggaggggaagtaggtatgtcatctaggtacctggaccctgtggttaggcttagccaaagtaaggaaagggtctgagtggaagaatttctgttcagagcgtgtttgtggtgctggcaggctgtatgttgcacacatttggaaatgtggaataagttcagtataaaaatagaaatttttggccaggcacagtggctcatacctgtaatgccagcactttgggaggccaaggcaggtggatcacttgaagtcaggagtttgagaccagtctggccatcatggcagaaccctgtctctactacaaacacaaaaattagctgggtgtggtggtgagtgcttgtaatcccagctactcagaaggctgaggcatgaaaattgcttgaacctgggaggtggaggctgcagtgagccgagattgcatcactgcactccaacctgggtgacagagagactgcctcaaaaaaaaaaaagatggaaattttagaatttccctagatagaggggattttgaagcaacagaagtagatgaaattaccaagaaaaaatatacaagtagaggagatatttacacaagtagaagtagcaggcacggggatggagaagtcagaaaaacaatgcagttattcattttatatatatatatatatatatgagatagggtcttgctctgtcacttaggctggagtgcagtagtgagatcccagcatactgcaaccttgacctcctgggctcaagtgatcctcccctctcagcctcctgagtagctgatactacaggtgcatgccaccacactcagctaatttttaaattttttgtagagatagggtcttactatattgcccaggctgtgtcaacttcctgggctcaagcaatcctcctgcctcagcctcccaaactactgggattataggcatgagccactgcacctagcctgaaattattcattagtgtggaaatccagggtagacatatttatgagggaggcatggtcagtagcgcaaaacattactaagaggtcatggaggctgagtaccaagaatggaccattatacatagaaattaggtcttcgtttggtgactttttttttttttgagatggagtctcgctctgtcaccaggctggagtgcagtggcatgatctcaactcactgcaacctctgcctcccaggttcaagcagttctcctgcctcagccccccgagtagctgggactacaggcgcccgccaccacacccagctaatttttgtatttttagtagagacggggtttcaccatgttggccaggatggtctcgatctcttgacctcatgatctgcccacctcagcctcccaaagtgctgggattacaggcgtgagccaccgcgcccagccgttttgtgactttcaagagtgaagttgtactagaatgctcaagatagaagcctggttgcaaatggtcaaaagagatgtaagcaggtaggaaatcgaagacatgtgctttgcaaaaatacaaccatccaggaatggtgagagaaggacatagtttgtgaggttaacaggattatgtaacattttgggaattttgtttgattttgtttgtaagttatggtaagaccagagaatgtttctttggagtctgagcggagaacagatgaaagttgtaaaataaatgggggataagtgatggacaagaccaagtaagaggttagagagattgggattgaaaatttagttaatttctcccaacctcagcagggagaaaatgacagtcagctcagaattcaatgaaaagcccatctctgtttcagagtgggggaagaaattatggatgattctaatttttctttcagcttagctgtattttccaatttttctagaatgtaaaaattatttgaacattaaattttatttttctgaaagagcacatgagatagctgtctcatttgtccagtagtgctgactgggtgtgacagagttttttacctccctcacagcttcctctggggtcaacccccctgcccctatgcgccatcttcgtcacacctctctgggctgctcagtcctgatctgatagtcatgaaggagagcaagcaacgtttacctttgtagaagttagaaaagtgagacatctttctgctatgtttgaacacagtacagtgttctgtgagtacaatgtacaatgaggaaggcgaggtagatcatgtaaatgctgaaagctccatatgtgcttgatgactgggaagaaagaacaataaaatttaagaggaaaatacttgcctgtgtactgctttaaaagctgtggcctaagtatagcaaagaagtctcttcatatttgctaatactcattaattgcttattaagtatactcacttaagaattcacttttattaagtaccttcagtcttctcatcagttttgcactaagacgcgtacgctactgttcagtatagtgtttatatggatgctaaattggtacagatttctcctttaaaaagcatgaaatagataattaacttccatttttatgaatatttatcacagtagattaacttgaaacatgtagctttttcagtgtgcggcaataaaacggtatagtgattttgtgttttagtttgtaaatgtattacctgtacctagtgttatttgacaagtatctttacaaaattagatattagtcccatgctccttgaatttgtcacctgctcatcaagcaggccaagaatatatttgggtgagaagagatagactatcctaggctaatccttatggtaacaatggtacctggaaaaatgtcggaaaacaatttcccttggttttgtgtttgttgcacaatcaaaatgcagctgatgggatctgttgagttagtgctgactggtggtagcttcttctgggatccttctgccagctcctggactgagcactgtcccatctttcagttgctggaatgtcaccagcacagttagaaccctggtggtgcagggcacagcagcaaggcccacggggaaggaatgcccagcttgggcagagccaagcaagggtgactgtagcaaccttgttaccccaagcttaactgttcctctgtgacccttactggtatcactttgggccacttatctgcctggcacatgtcaaaactacctattaatgtccaagggccagacttgctgcagaatccaaagtttatattgataaggctgccacaaaataaattcagttcttctgtatcagccatgttacattctggctctgattatcaaaggtagaccttaaattgccttccgttccatgccactcttgtcctagctttccaactacaccctcccacactctgtatccagcctccccaccctgccagaaggtagtggtgtttctcattttatgactgtattaatgatagagctaagctggctgtcagtcatgatgcttcactccacatggattagtagtaacataactatgacagaacttagaatttgttgtaattcagtggtattttataaacacagccctggcctaggactgactaaacactaaatactatatctgcatttttctattaagattgcaatggccaggcacagtggcttaaacgtctgtaatcccagcactttgggaggctgaggtgggtggatcacgaagtcaggagatcaaggccatcctgactaacacggtgaaaccccgtctctactaaaaatagaaaaaattagctgggcgtggtggcacatgcctgtagtcccagctacttgggaggctgaggcaggagaatcgcttgaactcgggaggcggaggttgcaatgagccaagatcgcgccactgcactccagcctggtgacagagcaagactccatctcaaaaaaaaaaaaaaaaagattgcactaagtacattttcttctaggctgatttctaaaacattattccaggaagatatatgatttttgttaactttaggaacttttataaaactataatgacttttttggactaaattatatgtcagttttgatcatttgtgttattaatgtttcattatttgctttcaataaaattgtcttactattcattctcccttcaaccataggtatggaacaggatgtttcttactatgtaatacaggccataaggttggttttttaaattaaaaaattgatttaaaagtctaagttcatctaaataatgcttgaacataatttactattaaacaacttttagtctttagcttttacttaatctttatcagggtttaatttagagctcaatacaaaatttgaatcgttctaataagaaccattttagactctttgaattttatatgtgtgtttttaattgtgctggtgggaaatctagactgagacctcatcaaattcttaatgcaaatctaatttgaaacaaggaataaactttttatacagcttaaatgtgttcttaattctgatcgttttgactgtaaggatttattttaaaaattggtttattgattgcattattttgtacctatgttattttaactttaaaaaaaagttctcatgttatcttttcattttccactactgaaatcttttttttttctttcttacagtgtgtattttctgatcatggccttctcaccacagtggcttacaaacttggcagagacaaaccagtatattatgctttggaagtaagttctttttaatcaatatggataatatgacaaacattcaaagctaataaaaattacagtgttttctaacacttttctggtaaatcttaatacagaggactcaaaaagttctgctttcttggcatttgattgagttgaaggaacctgaaactgatctgggtgtcaggactcacaggagaccttgattagattggttcctcagttcttatgccaattaatcatgtcaccttaggcatattacttgagagctctacaatgtaaggttttttttttttttatctctaaagtttaatcggattaacgtgctctctaacatttctttcatcttgaaaattctttgattttataaataaaatgctccagtgttccaaagagaaccctgggcacaaataggcagaacaactctcttcacttgtctcctcataaaaataaattttgtgtaacattttgatatagaaaagaaagtgaggagatttatgccacttatcactggaaacatttgtttcaaacatttttgtatgttatagtaggaatatgccagcctaagcctataggatatggtaagttagtgttagaaatatttatttataaagtcaaagaaataatattctttttgtaaaattagatacatttcttataagcatttctatataattaattttgaaatggctaccttataatgcacaagtatacacttgatctgcagactcattgaggctcattttttggagtgcctgataataatttggtcacaagttaaagacttctagttagagttaaaacattttattagtcattatgcctagcacatgaggaatattagtttatttctatttttctcccttccccaccccataaacactataatatttctccccagctccttttctatggatggaagcatttgtgaaaacttagtctgtatattaaatgtatcttaacacttctcagaacttaaaatcctacaagccctctccctctctactttccctctgtggagagtgcatagcacaacactaggcacatagaatatgcacttgataagtgttacctataatataataagaatatgattctgctttttttcttcttgcatgggaaacaatcagtgctttagaatacaggtgccttagacctgggacaggcctcagggacaggggtcactcggtcttaactcccctcccaatgtgaaaaaccttctcctgtctcctttaccagtagccatccaacttctatctgaagacagcacccaaagttgcttcttaataacacctctagcattggacctgcattggttgtcaaaagtgttccaacattagaggctgcggtcagtttctctgggtcttcctcctccagggtaaactgacccaatgccttgatctcacatggtttctggatgctttatagttctgagctcccttcattgggtgcattgcaattcatgtcgtccagaatggaatataacattctacatctaatctgacctgtactcaatcaataggatgatttgtgcctctcctaccataagcactacttttgctcctctagcctgagagttcattaatttagactaatatttattaaattaatatttattaattaaaataattaatattaatttagacttcatattattggccctgggagcatatgctaaaaaacctagctcgttttcaaatgaatcattgtcaaaccaagtctgctctgttctgtatttgtgtagtttttttgttaaatctaaattcaggtctttgtttcttcctgtttaatttcataatagtgattttagcctattcctatatagtctgaattcgttttcactctttactgttactctttcagttttgtctcatctagagatttaacaagtatatgctttatgattttgtttcaatttatgtaatgcttttagatgcttagaattgtaaaagctcagagagacgctagatcatatgacaatataccctcctatccccttgttttacacgtgaggaaaccgagattagaaaagtgaaattggagtcccttggccaagtaacttttgacaacagtaagtagcagatccagatgcttggacatcaaagccttgatgcctaggccaccctgctgtaccatttccttccttgtaagtctgaaagttctgggctccagtctcccaagtccagtgttgttgtcactgcatctagcttatgtcccttccttcatctgctaacctagcggtctcagcaacaacaacaacacacatacgcatactaatatgttaacggtgtagttagaatttttttctttgttttcttaatttttttttacaattaacaaacatttaaaaaaaattaaattaaaccaaaccaaaaaacaagggtggggaataatgctagactggtaaaactttttatcagtaaacacatgctaatttcacttggtcatactaattcctttttttgtaaatgcttacaaagtatatatttaataatattgtctttcatttgatcaattgttgttaggcttagaagttggagataggaaaattttagtctttatgctctttaaaacctaaaactatagctacccatcttcagtcttttagtctttttccattcttcctctgctgatttgggaacaataagatacatttctatgtttttattttggtgattttttttcttttgcgtataccctcagatttttaagatattgtttaaccatatatttttctaagagtgtatgtcattttttggtatttttaatctcccgaccatgataaggaactctaatattttattctaccgcctccatcaccaattgtgttattttgtttaaagctttcatttcccccattttgttcaacatgtaataattactgttgttttctttgcagtccacagtaaatcatatttattgacttatttttcttagtttgtgtccagtatcatttctttggtctcacaccttttttattcccacctacttttttcctttttttcttcttctttttttttttgctgaggggcatccttctatagttcttttagttttagtgtgggatagtaagcctattctttttaggtttgtctttgttttgccctcactctgaggatgagtataaaagcctatattaacaattgtttttcccacatcccttctggccattttcgatgttgatgagacctctgctgtcaatatgtggttcatttgtagataatctggtttattgtctgggagtttctaacattatctctttatcattgatgttctgtagttttactatgatatgcctgtgtttggatttatttttatttatcctgttaggtacttggatccaagtctgtcttcagatctggaaagttctcagcaattatctcttcaaatattgctcctctaccattacctccatcctcttctggaattgctattggatgaatattggaacctttcaacccatcatccatgtctcttaactgcccttttatatttttttaatctctttgtttctctgtgctgcgtccctggtgagtttctcagtatctaccttccatttccaaatcctctctttaaaacaaacaagacaaatcataaaagccttttttgtattgtgaaatataagacacatagagaaaaatgcattaaatatcaatgtacaacttgaaaaattattataaaggctcatgtaacttgttcatagaacgccgccaatcccaagaacctctatttgccccacgatcacaacttcctccctctccctgagataaacatcagcctgacttttatcataatcacttccttacttttctttgtagttctaacacttaaatgtgcagccctgaacaccagagtttagttttgcatgtgtttaatatttgatatattaaaaatataaaagaaaagagagagagagcatgtgcatgcatatctgagtcacttagtatgtatttttttgtattttttgatctggcttctttcactcaacattatgtttgtgagattcatccacagtattatacatagctgtttttttcattgcttcttattgctatatgaaattattgaagtttagtatttattcagctgttgatgacattcgagttgttttcagtatttggctattatgaaaaatgctgctatgaacatttttgtatatgcctcctgatgtaaatgtattcacctttctgtaggagtagaatttctaggccatagattatgtgtatcttcactttgagtagatagtgcaaaccatttttcacagtagatgtgtcaagttacactcctaccagcaatatgggggaatgctagtttactcatcctctctatctagtctagagtttaccccatctagtacatttttcatcttatttaatattttcatttctatagtttttatttggttatttttcacatccacctgattttgtttcagttctcttttttttttattcttagtttcatgtttgtttgtttttaaaatggaagtcatttcctaatttatctccgaatacttaaaacatatgtattttaaaatctgtgttaggccggaatgaactctagtccagctattaagtttgttggatttcttttttcttttctttttttttttttttttttttttttgagatggagtctcgctctgtcgcccaggctggaattcagtggcctgatctcggctcactgcaagctctgtctcccaggttcacgccattctcctgcctcagcctcccgagtagctgggactacagatgcccaccaccatgcccggctaattttttgtatttttagtaaagactggaaataacgaagtttcaccgtgttagccaggatggtctcgatctcctgacctggtgatccgcccgcctcggcctcccaaagtgctggaattacaggcgtgagccaccgcgcccggccttgttggatttcttaatacaagatttcttcgtatagtttagaattgtcacttccagccttgtcttccattaagccatatagcctcagtcagcaaatacacagttgcttgtttttctagcatccctacacaagtaagagagcgccacctagctcctggcttcaagcattgagcctgattctattccctgtcttgcgcaaaacattttggacccctttcttctggaggaaccagttcccagccaccactcctactccctgacacatatagaaaaataaatcagaagccatcatgcttgtggcttcagtcctgtttggttatgtgtttccgtgtctgtccacatagatgttattctgtatttgagtcagcatgttgtttcagttttctcttttatatcgtgtctgttatcctctgtggttagaacaaaggggatttttgaagtacaaactcattatttctgctcatgtaagcatctgcatcttctttttcatcaccaagagaactctttttctctccctgaagcccctggcaggtgatagtaaggcctgacattttaatacctctaaattctcattttcattatttgtaaaaagaaataggtgttcatgatccttaagttgttctgtgacattaaactcatattaaactggttaaatttgtcccaccctttctagttggaaaatatttctcagtagtggaagagactggagcaaaatagagccattgagtggttctgccttccctctggcatccttgttcctcttctttttccaaatactgtttcacaaaacaaaaatccttttgggaacttttaatatgagtatgaacctgagcttacttatgacttgagacttccatgttccgtgttttgtcactagaatatagatttcctgaggccagggtacttgtctatcttgtttaccactctgtcccagcaggctggcagataatacatacccattaaatattgttcaaataccgaatcctatgttaggccatttttttctttttaaatatgagcttcaaagagggttccctatattgcctccctggtttctttaaatatctcttcccctatcttttctttgttatggtttaacgattatagcgttaagatttcctttttagagtttttcatccttcttgagctaaatccctattttaggtataaacctatgtaatagattatctattgctgtgtaacaagattaccacaaacttaagtggcttaaaacaacacatttattgtttctcagttcccatgggttcagaatccaggcacagcttagctgggtaccctgctcagagtctcacagggctgcagtcaagatgttgactgaggctctgctgtcatctgaggtttaatctgcttccaggttcattcaggttattggcaaaattcagttccttgtggttgtggaactgaggacttcagtttcttgctacctgtcagatggaggccaccctcagctcctagggctacctgcagttccctgctatctgagggacccccagtggttctctgcttccttaaagtcaggaagggagggaatatctccagcaagacaggcacagtaaatcatgtaatggaagcacgtacacatcaccacacatatcccatcacttttgacatgtactgttgggtagaagaaagtcacagatatcaccacgctcaagaggcgaggattatgcaagggtatgcacatcaggaggcagggatcatgggagccaccttaattaaaagtctatctgccacaagcatataaacattgtttatgaacttttataatgttctttcttgaaaagtatactttctgagcaataaatgcttttaattttagttccccaacttgttactgaagtattaatgaaatctgttacatttcaaaaataatgttgctccaattcaactcttccctttctctatgcaattaaaaatgctatagagttagacactgcatttgtaatctaatatatacaaattaactacattataaatcatatacgtacagatacatagcactgtagtatacacaaaactgtgtttgctatgcctgatgaatgattgtaagcaatttagggtaatctttactttacctgatttttctccatactcaccaattttcaccctaattgccttgtaagctacaattctactgcatcctgaaatatcctgctttatttttatactgtttgtggcagtggcattcatgtcaaggagcttttgaagaaaaatgtatttgcctgctatgacattacatcagatctacttgattatttttaattcaatcttcctatagcctgtttattagcctttcactttccaggctacatgtctagttttaaaataatttattcctcttgccctgttataatttaatttattattctttacaccctctcactttcattgcatctcccttagtgtacaactattaagcttgcatgcatcttttccagggaatcataacctagaacaagggctgattcaaatttgtagatgatatactaaagtattggatctttatacttagggtgtaatttatggtaacttaactgataacaagtagacagtcaccttcttttatcattttaggttttggctgctatactcttttcctgtccagctttgaaacattattaccatcttccattttatttcctgcctctgaattcagaagaccacatgtcttttgtgaattagagatgtctctcatttttatttctttaaaagctaaatcataccatgtattatatcctgacagcaaaattatttacttttttcagataagtgtttttatctaccttttattgtgttatattgaatctagtttttcaatcacaacaaaacacttctgtgtattcctgatgacagaatttaaaacagttatctcctggagccttaacagtgactatgtattttttttcttttgttttaatctaaataatactctgattctcaactaattacctctaatcaaaaccttgattttccttttgctaaaatcatattgctttctcttaaaaatatggtgtaagcatgtaacatcctatctttttcaatggaaatgaggtatatcagcacgtggtttcctagagtataaagtcccaccagctgtgccacaaaatcactttactagactcctagcacagtggcttctaaaaattcgcagtttaactgtacttgcctaaaacaattatgtatgcatttcttggttagatgctatttaaggacagtgtctttgagagtataaggaggagggacacctgtttttgtttttctttttcaattaggtctagaattatactgcccatggcagccatggccacatgcagctattgagcactggaaatgtggctagtctgaattgagatgtgctgtaagtgtaaagtatataccagatttcaaagatagtacaaaaaaaaatctcaataatttaatattgatttcatgttgaaattttttttaatacattgggttaaataaaatattaattttaccttccttttacctttttaatgtggcaaaaatataaattacatatgtgactcactttatatttctgttggacagcactggtctagaaactcttacatatttactagtatttggcagctgctatctctgaattgtctgtttccaaaggaaatttgaatcttaaatctctttaaaccaaaattttacttagttctcttgaatgatcccactaagtacctaaatatgtaaatgtgtcaaacttaatacaacaacttattttaggcagggaatgagctgtgttagagtcccttgtaaggtatttcttgaattgtttttgtcccatttttaaagccttgtcatatttgcacagctatgccagatctgttcctcaaatacttcctgtggttaaaaagccattttatatatgtaatgatacagagtactgtatgtatgtctacatatataaaaatgtataaacagaacaattgtggcattctgtagctttgcagtaacatagtaacttctcatagaagctatgaatgatggaatataccagcatattcattctctagtttacttacattttgacaactgacaacaagaaggcatgaccatttgtaattcagttaatagaactgaggacaggtccctacatttaatattacctgacgtttggtttggagtgactctgtggaagtaatttacattaataatctatatgaatgaactatcagagctaaaaaaaatttcttggtattcctaatggttcgtgctgatacttctttttttttttgccttcaggatctttttataatagctttattgagatatagttcatattccacacaatttacccttttcaaatatacagttcaatggtttatagtaatactatatttacagatttttacaaccatcaccacaatctaactttagaacattgtcaccaccccaaaaagaaaccccataaccaccccctatcccccagcccaggcaaccactaatctactttctgtctctatggatttgtctgttctggacatttcatatgaatgggatcgtacaatatatcgtcttctgtgcctggcttctttcactttgcataatgttttcaatgctcatccatgttgtagcatgtattaagacatcattccttttcatagtccaataatactccattgtgtagacatactgcgttttatctattcatcagtcagtgatatttggctgatacttttttaacattaaagaaattaatgaagtcaatatttacatttagtaagaaccttcacatatattctcatattgagcctcacagtaatttgtttaggtaagtgttgtcatagtcatcattttataggtgaagaaatggaggctcagaaagcctaagtaacttaggcaagttacttagatgaacttgctaagattaacttactaagttacttagattagttactaagattacacagcaattaagtactagaactgggactcaaagccagtttatccaactctgaaatatgtttttattgttattgccacagctctaggtgattttgttttaaagaaaaattacttactagctagcttctttgctttttgttttcttgatttactatactgttagatatgggaaacagacttgaaaaaacttttaatgtggcctctcccaataattttatgaacaatatggcaatatatttctaagtgataacatacctcagtagcttagcaacagacagaaaattgttcaagaagcaaactgatcaaagatcaatgtccacctatggggacaaatccaagggtgtgctggaaagctcacttcttttcctcatcccgtgaaaaacttttattagtgacttagataaaactatgtttgtattagaagacctagtttacatatttgtcggagtctcaaaatggaaactgaattctgtccatctgattgtgtcatacacagaatatgctcaataaaaaccttggatagtgataaaatatattctgtcttgaattcctttttttctttagggttctgtagctatagctggtgctgttattcgctggctaagagacaatcttggaattataaagacctcagaagaaattggtgagtgtgttctaacaaaaggttagaaaatctgaaaaatgacacatttcagtattttatctctgcaaagtaaatacttatgctttgccccaaatgtgatccataaattatatggatccctattatgagtttgacttatgcaaaagactatcttgtgaagatttataaaacaaggaattgacataattagtggtggttgttaataaactggcaatgtagggcataaaaattacccaagtgtaaaattgaacactggagattgccagaacctgcagatagagaagttgagttaaatttatctgatgagaaagagctttaactcttagattagagtgagcattaaaactctggtacctataatttaagtattaatacggctgttttcagtctatagataattagtttgaacttacctactcactctttcatccacttgcttaactttgcctgaaggtgagacaatcagaaatacatttctgattagggacacactagaggccactttttcatctcctagtcagcaaccttaaaaatagtggaaatgagctaaaataccttaaataaatgaatctggttccttgatttcttgagctaggctacattttagtggggggtatttaatgtgagagaaactcatttctgttgatcctagcatactactgtagttagcaacattttgctctaccaatgaattggaaaccaaaacccctgtcctaatttttctaatttttaaaataggtatgcttatataataatacacaatatttgtgtgatttttgttttgttttgtttttaatgttagaaaaacttgctaaagaagtaggtacttcttatggctgctacttcgtcccagcattttcggggttatatgcaccttattgggagcccagcgcaagagggtaagtattgaaaatatggagtgcttttggggatcttgatttatttaccaaagtcgttaataacttattagtttcttatctattttcaaataattataatgtgttgagaaaaccttttctttttggagaatataatttcagaaactttaagctccaagaagttatgaatcagctgacaataacccctgccatatccgtattcatgttatcttttatcttcatgatgtctgtaagttgtatagtgaagggacatcatcataatgaatactgattcagttttatgatgccatcatcttttcaaatgtgtcatgaattttttcatacatgaatgcagaattgtgaaatataaggactttctgagttacttaatgattatgtccaattttctcttcctggacatttctgtctaccaaatttgaccttttcatatttgagatatttcaaattgattggtttatatcattctaatctgaaaatctttgtgcgtatttttaggataatctgtggactcactcagttcaccaataaatgccatattgcttttgctgcattagaagctgtttgtttccaaactcgagaggtaacaaatatgggcctgttttcttgtacttagttcacttttatcactcttaagttatatgttaacacccgagatttattcagtactgaaaatgtagttaatcaaatattaaggctgcctaaatactaatctaaatataagcagggttttccccctttttccagctgtcattaccttctaagttcctgttccctgtcaggcactgggaattttatggttgtggggaggctgagtggcacacattaggcaaaggaaacagcacaaacataggcatcaaggcagaaaaacagggtgcaaaatagagttgtatagcttagctgaatatcaaggtgaatgcagaggtgtagtgagagaaaaggttggctgtgaccagatcaaagagggcttagaagaccagaataagaagtctcaatttattccataggctcttggaagctcttgagagtttctgagtggaggattgccattttcagagatgttactatgaaatagatttataacattaattgcactggtttatttaagattttggatgccatgaatcgagactgtggaattccactcagtcatttgcaggtagatggaggaatgaccagcaacaaaattcttatgcagctacaagcagacattctgtatataccagtaggttagtaagtcttcattcctttaaactcccagagtaatgtttcttgtggaataactagttctttgggcatatgtaaccacaaagatattgatggaactctctctcctcagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggagggtacatttaaagaatgaaatgttcagtgatatactgtgaaaacgaccttagtgcacgggagttttgtttttctgtttagttaaaagttaaggaaccaagtaaaatagtaaatgttatcattgcagattcggctgccaagcatattgggctttactgaataaatgtgaatgagagaaatcgttgcttatcaaaagaacttctaaaatcactttttaaaaatcatttgcttttactgtttatggtcctttagtgtaggataataatactgccacactgtcaggtatagctagttagaatagcctttttttttttttgagacggagtctcactttgttgcccaggctggagtgcagtggcacaatctcggctcactgcaagctccgcctcccgggttcatgccattctcccgcctcagcctcccgagtagctgggacaacaggtgcccaccactacgcccgcctaatttttttttttttttttttgtatttttagtagagacagcatttcaccgcgttagccaggatggtctcgatctcctgacttcgtgatccgcccgccttggcttcccaaagtgctgggattacaggcgtgagccaccgcgcccggccatagccttttttaaagtgagaaggaagatatatcagccactcatccctaatgtctacaccagatcatctttggtgccagtggcccagttttaggacataattagctgggttaagagacactctggtaacttttaagcacagcaggactaacctgatgaaggcagcaacaatttaagtaagtgaacattagatatctgattcactgtgctaactaagctaagccacaagctgtgatcagcacttttactaaaatgtagtgatgcggttcttaaatttaaataaatgtagaaaaataaggttttatatattagaattggttttataactttttagaaacctatgcataaaatagcatcagctgggaatggtaatttgtgcctatagccccagctacccaggaggatctcttggcttgggcccaggagttcgagtccagcctaggcaacataatgagacccctgtctctaaaaaaacaaaaggaaaaaaaaagcatcaaagtggattttgaggtattgggaataagctttcaaatgcatttttgtttggttttctgggagaatataccagtgtttctcaattttattcattcttttaacatataagaaaatgaattataatactagtaattttatagtcagattataccatgtaccttgatttagaaatgtatttcaccatctgatattctgtcatttttaacttttgcaatactggataaaatatgaagttcaaaaaatttttctacttttcaaaaaaaatcaactttataatatgcaaataatgtccagagcgggtatatggcctctaaatgccaatctcactcttaaagcaaggaagttctgtgccaagagagccatctccattcttaggggagccatctttgctggtgttgaaggccttagcctggggttgatcagtcatgccctattgtcctccctctcaccagccctcactcctccccataaacgaatgggcacctaggcatagatagtacattttgccagcaaacagttgtttatagccaaccacaggccagagactgtactgatgtggggatatagagatgaataaggccttatcttcttatcttcttttgcccttcagaagattagagtatattgggagcagaagacaaaaccataaaaatttggtagctgacatcctggggtgtgtgtgaagagagagggggggatagaaatggggcactggaaagctttctgaagtgagtgattcttgagccttctctcctgggtgttgcaggcctcaggtgctatggaaagtctgggaggcttgagagaaaggtagccccacatggggttcagcacccttagaagtgtacaacatcaagctcatttttgtttagactttctattgtggatttccacctttaaaaaatcttgctttaagatgctggggttggggggcatggggctgtctcagaggaatgcaattcaaatcttatgagaaatcagtatttgttaaatcctgtgactgaaataaaaacgtctcctgcggggcgtggtggctcacgcctgtaatcccagcactttgggaagccgaggcgggcggatcacgaggtcaggagatcaagaccatcctggctagcacggtgaaaccccatctctactagaaatacaaaaaattagctgggcgtggtggtgggcgcctgtagtcccagctaccggggaggctgaggcaggagaatggcgtgaacccgggaggcagagcttgcagtgagccgagatggcaccactgcactccagcctgggcgacagagcgagactcagtctcaaaaaaaaaaaagaaataaaaatgtctccttctagtcttcccacattacagcatacccttttcctcgtaccctttccccccaaaaagaagagaaaacagatcaaatgggattcccctttctaattcattaccacttgtttgtgagtggcccagtctgcatagcaggcagtctgtctgccaatctccctttaccctgctgaatttcccctatcctgtttttgtttgtttgtttgtttgtttgtttttgggaccgagtcttgctctgtcacccaggctagagtgcagtggtgtgatcttggctcactgcaacctccacctcccaggctcaaatgatcctcctgcttcagcctcccaggtagctggtactacaggcagggttttaccacattgctcaagctggtctcaaactcctgaggtcaagccatcctccctcctcaccctcccaaaatgctgggattacaggcatgagccactacacccagcctccctgtgtcctgtttcactccaacttccaagcaagcatgtcttccagtcactggcagtcatcagcaaccatgtgctttcaaatctgagtcctgctaaagccctactgcagtttaatgtgtgcaataatttgtcaagaatgttgagtgatcataagtatggtactaagaacatctcagcaaactacctttcgttatgtgttttttctaccttctaattctagaaagtgaaattcgttattctacatggaagaaagctgtgatgaagtcaatgggttgggttacaactcaatctccagaaagtggtaaaaatgtttttgtttattattgtcacattttcttagtatattaaatagttatttaagtatctaggcatttacacatagccaggctgctctgaagaaaagcattatcatatgtccagagattctgacattttgaaaacactttaaagttctaaacacaaaatgtaaattatcaggttgatatacatactttaactttatcctgccatatctttccttattagtttattcttggtacttcaattgacaacttagtcttccaagagtaaaattatttctagtttcttcttaatgaaaaaaaaaaatcaactagagtcttcatttttttcccctctcctcttactttacctttttggggggctgtctttatgacctgaaccaactgaaagctgtattaatttcagaatatattctgctacttcctaggctgattccaagtacataatgggaattcctttggaatcagagaaagaaatataccaaacatagtaaattcgaactcttataaatagattgggaagtgctcttagcagaaaaaatagtggactattctacctttcagtcacttaggaaggtcaagagcttaagtaaaccatttagatttaaacagccttaagatgcatagtattattattttttgctaaatgcaagatgtggagcataatgaatggaacaatggcagataatttattgaagcatatacttttttttttttttgagacagagtctcgctccgtcacccaggctagagtgcagtggcacaatcttggcccactgcaacctccgcctcctgggtttaaatgattttcgtgcctcagcctcccaagtagctgggattacaggcgcccaccaccatgcccagctaatttttttgtatttttaggagagacggggtttcaccatgttggccaggctggtctggaactcctgacctcaagtgatccgcccgccttggcttcccaaagtgccaggattacaggtgtgagccactgcacctggcttgagcatatactttaatggggaagagttgacaaatgaaataatacctgccttccaaccccaaagttaatgtatctgttttttaggagaagcttccagaactatctactgccacagataactgtggtctgtattttcagtcccggatgttcctatttgaagcttttgtttttctcctaaataagcttaatatcttttgttgtgagactcagcttcattttccaagatggtggcaacgtttttcttgctaagactgtaattttgagagaccctttacaactaaacttctcaatcataagtacttttctagcacagtgctagttgctgtgtgagatataacagacgtaagccttgacttcttttctagttgcccttaattattgcttataggaaattgagttacattatttctttaactagctggatgttttaaaatggcactttaaatggcatgtttaaaatgacattttgttttgttttttgttttttgagatggagtctcactctgttgcccaggctggagtgcagtggtgggatctgtgctcactgcaacctctgccctccgagttcaagcgattctcctgcctcagcctcctgagtagctgggattacaggtgcctgccaccgtgcccggctaatttttttgtatttttagtagagacgggggtttcaccatcttggccaggctggtcttgaactcctgacctcatgatccacccgcctcagcctcccaaagtgctgggattacagacatgagccaccgcgcctggccttaaaatggcattttaatcctcctgtctccctccctccaaccccatgccttacacacagatacacagttctcctcactagcggttgaggatgtaattttaactgcaaaattcccacaaaatcaactgatcatttttcccttgtttgtgtactttactatcaatgaatttaaaatactaagaaaaagttgataaaacaaacaaaaaaagatatcattgctccaatttctgctatcagcattaatgataaaagtaatttgatcttttgagagttttatattttaaagaactttgtttttgtttcagttaggctgcagtggatttaagccagtttgattttttttttttttttttgagatggagtttcgctcttgttgcccaggctggagtgcaatggcacgatctctgctcaccgcaacctccacctcccgggttcaagcaattctcctgcctcagcctcccgagtagctgggattacaggcatgcgccaccatgcccggctaattttgtatttttagtagagatggggtttctccgtgttggtcaggctggtctcgaactcccaacctcaggtgatccgcccacctcagcctcccaaagtgctgggattacaggcgtgagccactgcacccggcctgaaaatgttttttgaatagatttatgaaaaacactctaatatttaatattttgggggtctctaagctgtataataagcttggaatagtaataaaatgctagttgtattcctttaagcaatctaagctatataactatataagttatatgataatagcaatatagatagaatcctattttgataaacttgagaggatattagaattgctacctgtatcttaacctatgggaagaatatcaggcttgcttaagtttcaaagcaatttgccaattttgaagcaatcataattattttcttgtttgtgactatatttgaatgctttgtaaacaatttttaacatacttttcatatgtgtttaaaatgtattgtcaggtgcattttgttacgcaccaaattctattaaaaaaataaaactgaactaatattttagcaaacatagggttttaaattcatcttaggacactaatataactcttctctcatggccaaaagagaactataatttgaacttaggtggaattaaatagatcatttaatatatttgggggaagaatcaagaaagctaaaattaacagcctcccaaaaagttatccataggctcactctggctttgccagtggaaggctaatgttagtctatatgtattatgttcttggctgtgtggcatgctatctgtattgtttgttaactgtcataaaccttcaatattgattatatttttgatttgaagtaataactctttgctagcttttatgaatatactatttttatagcttattttgttttgctatcttgtgattcttaacacaaatattgtaattatgtgtctctcttttggtttgcttgactggaattctcttctgcttggatgaccacaggtgaccctagtatcttctgtagtctgcccttgggcttttttatagtgagtagcatggtaatgttaatcggagcaaggtacatctcaggttagttactctttaaattagacaactctattagttagctttaatgttttcgtgtataacttagcagaaatttttcagtgtttttcattctttctgtgtctaggaagctggaaaatcaataaaaggtctaattagttagaccaattaatctttgggggcagttagaagtaagaactgtgactctgcttaccctttttaaatttttaatgtgatgacttctttaagagggactacattctgctgtcagctgcagcaataagcaaaagtgaaaatactaatatttaaatgaaaggactttcagactgactgctgaaagttaaagtatacttttgacattaattaaattgtctttcaaatgtatataaattatttttcataatcctgaaaatttgctaagcaagtcttaacttttcaattctggcaagtttcagccagagcatgtccacagagttcctgtaaaaccctaaaaccagggaagatttatagttactcttattttagttaaaagaatatcttttatgaactgaagttttaaaaatgattccttaaatgaaggggttgaaatgaaaacagaattatttttccacattaatttatactgaataatctttttttaataaaagtaaaatggctcagcatgttatggaatatattgcataatcttattaatttataatagccatttgtggaagctgctcctggtgatagctcaatttttcttaaaattactggcttaaatggaaatgatgcttcttattctgtatgttcccatgaaagtgaaacttaaaaaaaaaattcatgattagggtttcatgaaaaggccttgtttctatgaaaattgagacaggttgcatctctctaagctaaaagatgggctatgtgtctagagtcttagacttctaaaatgcatgtggtcactatatgtaggttatctcttcggtgacatacactgcaatttgagagggctggaaattgtttgccttggtaaacgattagcaacagtggcaatatttgttaattttggaattggccctgtttgttgcattttaattgtgaggcatgatttagaaatcatatggactttctagcttaataaatgattgaatcatctgcattgctttaactcctgaattgtatgcatgtattattgacatatatggtttttgttccccatttcaggtattccataaaacctaccaactcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctatagaaatatttggtggttttttttttttttaaacatccacagttaaggttgggccagctacctttggggctgaccccctccattgccataacatcctgctccattccctctaagatgtaggaagaattcggatccttaccattggaatcttccatcgaacatactcaaacacttttggaccaggatttgagtctctgcatgacatatacttgattaaaaggttattactaacctgttaaaaatcagcagctctttgcttttaacagacaccctaaaagtcttcttttctacatagttgaagacagcaacatcttcactgaatgtttgaatagaaacctctactaaattattaaaatagacatttagtgttctcacagcttggatatttttctgaaaagttatttgccaaaactgaaatccttcagatgttttccatggtcccactaattataatgactttctgtctggatcttataggaaaagatactttcttttttcttccatctttcctttttatattttttactttgtatgtataacatacatgcctatatattttatacactgagggtagcccatttataaattaagagcacattatattcagaaggttctaacagggctggtcttaagtgaaccactgtgtatataaatatgttggaaaacagctgtatacatttttgggcaacggttatgcataatatttaccaggagaatttttttcttaacaagccaacatttaaaatttatgttttatgtcaataaaagaaaatatactttattgtgacttcaactatatttcttatcccttacatttttatttaattgtcttagcttaaaaaaagaagaaactgtggaatactacagtaaatattgttttcaaacacaagcaataattcaaatagttatttttcttttgaattaattttagacatattttggatcctattgaggggataagaggatgtcaaaaaagttaaatacctaagtagaaaaaaatatagaaataaagccaagaatctctttcagttcaaatgttatcaattgttaataagaaattgctatctgggatgacagaattacctctgcttagtatctcattataactgaaagaaggtttatcattacaaataccttccaatgaaaccaagaatttctcaaaatatttaatgtcacatattataagaagttacctaatcctgcttcttaacatcaatttttaaaaatatcttaaaattactttgttttgtagtaaacagtgaagaaaagattgcctcctaattatttttttcaatgagtgctgaatgggaaaacatttatatcttactataaaaggttctgttttgtttggaatcaatggtagctttattgactgttctgattgtgctgtttctaatttattgaatctgctaggttttattgatgcagccaccacttaagtgacataaatattatagaaaggtactgtgaaatgatcactttgtggcaggggtacttttaaacataaatgtttctacaaaagtaggttgagttcattgtaaataattgtgaaagccactgttcaaataattttaagattacattaatttttctataaattggaagatttataaatgtttgaaattgtacacattgatatttaatgacaaatttacttaaaataaattgaccccttgttctta

SEQ ID NO: 5556 - DNA, 77249 bp, human; identical to SEQ ID NO: 5555

SEQ ID NO: 5557 - DNA, 77249 bp, human; identical to SEQ ID NO: 5555

SEQ ID NO: 5558 - DNA, 75692 bp, human
tcccgccgccgtcacccaggaaaccggccgcaatcgccggccgacctgaagctggtttcatggcagcctcaaagaaggcagttttggggccattggtgggggcggtggaccagggcaccagttcgacgcgctttttggtgagcccggggtgacatgtgaagaggcgctgagccggggcgggagtcgggggacggagggggtggctgttgtgtccccatcccgcatctctccggcccggtgccccggccgctgggcaaggagggaggccggaacgggacctgccacactggggatgccccagccaggcctgggggacctcggcctctcatgacccccatggccgagttgaacagtcgcagttttggtggcggagctgggtcacctactaatggggtgactcttcccccaaagggagcagggactctccgagcatccgcgcagagcggcccgcttgcagtaggggacaggtggccacattgacggctaccgcggtcttccccaggaacatttggcctgcgagacacaggacgtccttggatggggggaaagctgtgtcacggctgtggtagctaacacagcgtcctttccagcagtagaacgaataaagtattggagtgatgatgcgttgtcatcctctcccataaaaattgcagagggttgaatactggggagggtggcagaacaaattaggaaacagtcacactacactggttttgccataatctttatttaattccgaagactcgcaaatttcagttctgagactttgcccattacaaacaaatgattgtccttactgtgcttcacagcataatgcgacacggaaattctgtttctctttttatttaccatgtgtgacagcacagttttaccacaaaagattgctatttaagtgactgctgattaatttttgtgcaattagtaaacttgctcttaaagtgacctagcacagagttcagtaagataatttaaaagtaattgaggccgggcgcggtggcttacacgtgtaatcccaacagtttgggaggctgaggcgggtggattacctaaggtcaggagttcgagaccagcctggccaacctggcataacaaaaattagctgggcgtggtggcgggcgcctgtaatcctacttacccgggaggctgaggcaggagaatcacttggacccgggaggcggaggttgcagtgagcagagatcacaccactgcactccagcctgggcaatccagcctagccaacagagcgagactctgtctcaaaaaaataaaaataaataaaaaataaataaaagtaattgaaatgaatgcctgctgataaaagcccatgctttcaatggatatttgactaacttggcaagttgatgtaaatatttaatgattatttagctcttcactttaccgcaaatcatgttttcctgtgttatttagtatgtatatatctgtacatatatacacatatgtgtatatttatacataggcattatacatacaatgtatatattttttcaaagttctgtcagagctggcacttgactaaaaactgcatttgtgctttgatcctgacatatctttttttgtctaaagtgagaagctttcagtctaattttggtttgaatcttatttaatgacttaccctggtttgagctgccaagcatagttccactgtctcttgcactgtttatcttttgatcacccagggcaggtttcactttgtcttatattcatagaaatgtttatagagtaatcctgaatcataagaaagtttgcttaactggatttgattaatacataatatacacgatcatcatcttcccaacttaagaaagaccattaagacatgtgccaactaactgtgggttgatgtttaaagccatattcaagaattgcccacacaaatgcctgcagggaccaggcaggtagaagggggaaggcagactagagagatatccaggtcaaggggacagctagtagctgccaagcaggaacacaagcccagtgctgccagatcgtcagattaaaagcaggtagtctagagttttcaatgaaatctttcaattcttaaatgttggcaattagtttataaagcactgtgggggccaaaccaagcatggcagatgttctcaagtttatacagcctttgctcaatatgaaaatgggtaaaatatttcataactttgtaggcttcctttaggagtcagcttgaactgtccatgccttctttttgactgttcattattgctgtccatgtagcccagcaatcttctttattcactacaggttgttcttggtccctcaggttttgttgcctaaaagacatctttctacatcaatgaagaagaacttgatcaacttcatattaccacaattaattgttcagtctgtaacatgaacaacatgagccttcaaaaattggctcctgtttactgggttctgtgaggcctcgtctcattgcatgtaagctaagatgcaaattcagaagattcttatcctgcttagagaatgattttataaaagttgatcagtaaaattgtcctctccttgagaaacaactatgaaagcatgctctagaggcaaataaaaaaaccgtagagatcctgtgtgaagtagtgaaaaacttaggaatggtttagcaaggtgttttttcctttgtttataaggagagagattgctaaaccactccctgcaaaatgcagataaaagatttgctgaataagtgcttcaatcacaagatgattcccgggagttattccagtcatattactccacgttgtaattatgactgaaaaataattgcttacctctcaggaaagaatacagtggataagaactgtcataaggaagcttataaaattaaagatatttaagtaatttcctattattcattaaatttgcatatttaacttgactttcctgagaccaataatctctgcaagctttcttcttcttttttctctgttagcaatattagctttctcccataaggagaaaaggctttatctgtgctctttcatcccagggaaatgcctccacctctatcccacatatccgcttctctacctctaaatagtggctcaactgccaccttttagtgtaagtcttcctcaaaccgttattcagaattccccccccttcctacagcacttttaaaaatacttctattaatagctcttattaccttcccccttgtattataatcgtatacctgctgtacttgggagcagggtcctccttttaagctatttgtcatgttgaccaagatgttttatgaaatacaaagatgaacagcacttaaagactgttcagagagtgttttatacatgtttattgagtagatttttatttctctttaataagttaactgaattattttttattttattttatttttttgagacagaatctcgctctgtagcccaggctggagtgcagtggcatgatctcggctcactgcagcctctgcctcccaggctcaagtgattcttctgcctcagcctcctgagtagctgggattacaggcatgcgccaccacgcccggctaatttttacatttttagtagagacggggtttcaccatgttggtcaggctggtctcgaactcctgacgtcgtgatccacccacgttggcctcccaaagtgctggtattacaggcgtcagccaccgtgcccagccaagttaactgaattttaattctggttttctttcttacctcttaaaacattcttgggtacgtttggttacttaatttcttcttacattttagtagtagacatacaatagaacatgttcatttcctcatcaaattgtcaaagaattaatcttgggaccccatgcatatgctttgtacaagcggaaaatttccaacttatctgataggaaagtgaattggggttggcacatggtaactcagattgcagagtaggaacttcttggaaagagaattagtgtaacaggttttaaggaggggccatttctttgtaagacaaaagtttcagcttaaacaatcaacttccttctttaatttggtaacttaattttttccccactatgatgattttttaaaagacttgtaatgtgttgtggcttgaaatgtgtcaggtactatgttgaagacttttccagcattatctcatttaatcctcataactctgtgatgtagatcgtattagtaagcttctttacacaggtgattagactgtggctgaggattgtgcccaaggtcacagagtaactggtggagctaggattcaagtccaggtctgttatactctgaaaccagtcctcctgactactgccttgggttccccagctgtgtagagtactgtgaaggggaaatgagagaagggggaggccaccttctcacctattaatcaagtgtcagttctgattatcatcacgaatgaatcttcaccaagaaaaacatacttataaattggttttgcaatctataaaaaatattgcctttgaatgagtactgtgggttatgatcatcttgtgactcaaattcagtgggtcctaggcagggctcaggtgtgtcactgtggataatggttgcatcatcattttgtttcaaccgacaatacatataaagaatgactagaattgtagctcagtgcttgttttggcaggaagcattcccttggccccagctgtcccatcatacttagagatctcataaggcttacagatggatttcctctttccttcatttatgtattcaacacatttattaagcacccattatgggccagggactaatgaacaataaattttggtaaaactgatttggctcacagttggaatgaggccactcttgtgataagtagagttgtgattctttttgttttttttttttctgagacggagtctcactgtgttacccaagctggagtgcagtggcacgatctcagctcactgcaccctccgcctcccaggttcaagcaattctcctgcctcagcctactgagtagctaggattacaggtgtgcgccaccatgcccagctaatttttttgtatttttagtagagacggggtttcaccatgttggccaggctggtcttgaaatcctgacctcatgatccgcctgccttggcctcccaaagtgctgggattacaggcgtgagccaccacgcccggccaagttgtggttcttttgttgtttctttctttctccactacatttgcttgtttccttgcccatcacattacacaagtaccaggaacacattctcaacagagagctgccacccactcttgtcttgtctgtcacaagactaagtggtaagagctttcaattttgagcttcttgagggatagaaccatgtcctttttcttccccaaagcctgacacagcatctggcatgtggtagacacatgttacatgaaccaacattagcagcaagggacctgcaaggactcaagtgtgttgactggaacacttggattagaatagaccgataaaacttgaggcatcttggaaaaagtcaaaatcagaaactatagctctatttgatgtatgtatatgccatttactacaatttctttctttctttctttcttttcctttttgagacagagtttcactcttcttgttgcccaggctggagtgcaatggcgtgatctcagctcacggcaacctccgcctcctgggttcaagcgattcccctgcctagcctccccgagtagctgggattacaggaatgtgccaccacatctggctaattttttgtatttttagtagagatggggtttctccatgttggtcaggctggtctcaaactccctacctcaggtgatctacccgcctcggcctcccaaagtgctgggattacaggcgtgagccaccgtgctcggccaatttcatttttaagaaaaacataatttcatttgctatgttttctttacttctgtggcttgttggaagatgccttttctagtcaaatttggcatggaacatatttgtggctaatatttttattttcagtcactcacatttacgtagtatcatggtgttctcaagaggaagtttacatttctgaataatgtcttatcacatggtaaagtttagtgtgtcataaaagagtagactagtggggaaatcacatggggagggaaatgaatgtgcacatttatgataggacagatgaattagtcataggatgagtgaggcaagcctacaggacagttacttagtaaagagagcatttcagctccccagaagtctcattcttataaggcagagaatacatgtgttgtttcagaagctaatttttaaatattttttgtttttgagacggagtcttgctctgttgcccaggttggagtgcagtggtgtgatctcagcttactgcaacctccacctcctgagttcaagtgattctcccacctcagcctccccagtagctgggattataggtgtgcaccaccacacccagctaatttttgtatttttagtggagatggggttttaccatgttggccaggctggtcttgaactcctgacctcaggtgatccacccacctcggccttccaaagtgctgggattacaggcgtgagccaccgggcctggccaaacacttttttataaaaacaattttccttgttttttcagtttttaattactctcctcctccaaatctggaattgagtcatagtttgcgcatagagctgaatatagacctggtgacttccaactgtaatactatcacttataggtaatagtaataataataataataataataacatagcagtagtagcagcagtgacagtagtggttacatcttttgggtatatactgtgtctgcacggagctaaattctcattctatgttcactttccttgtttcttcctttttaaattgcccttcacccaaaacaaaatctggaattgagacatgatttgggtttagagatgaatataggactggcttcctatattcattattcagaatgagtgatttctaatccttattctgtcatctattagtggtggtgggagtagtaattgtaataaaagtaattataaaattagtagcagtagtagcaacaatgatagtgttgacaccttttggatgtatactctgtgcctattctatgctaaatactcttcataaattactttattatccttttacaaatgaaaaacatagaggctcagaaaaaagtgtcaaatagctgatgtgggcagggctggagctcgatgtgccccagctctctgtgcttccggggtctgtgtgtgctctttgcctctacatcacaccaagcatgacgttgtcaactacctttctggcccacacaaaagtctgagaacagattttttttttttctttcttctttttttttttttttttccgagacggagtctcgctctgttaccaggctggagtgcagtggcgtgatctcggctcactgcaccctccgcctcctgggttcaatcgattctcctgcctcagcctcctgagtagctgggattacaggtgcgtgccaccatgcctggcaaattttttgtgtttttagtagggacggggtttcactaggttggtcaggatggtcttgatctcttgacctcgtgatccgcccacctcggcctcccaaagtgctgggattataggcatgagccacagtgcccagcctggatctttttctttaagcttatgacctaaaatagaagcaactgatgactggatatctccacttctgtgcccaagcaacatctcaaacacacattatctaaaacaaaatttgcaatctcctatgcgttcctgtccggaagctactgctcctaccctatcccttgtctggtaaacactgcctactcagttgcactgacctgtaacttgtcatccctgggtgttgctctttttcctgcttgtacctcctgaattaagaatctctctgcacttgcacttcacttctgtcaatcccatcgcagcggccctcctagtggaggcctctgtatgtttcacctggactgcagacacattgcaactgctcttcctgtcccagtcttgcctccctctaatcctttctcatcaacaagtactgtgcaccctcgcccacctgaacaccctgcagtcctatgcccactgtcccgcatggactcccttctgttcaacctgaagtcttagtttagaagttaccacttctgagagcccttctcagaccctcataattctgggttacatgtcctttctcctcttcatagccctgacagccctatgtgaggcagaagttgcagtgagctgagattgtgccactgcactccagcctgggtggcagagccagaccctgtctcagacaaacaccccagcaaaaaaccaaatgaccaggctagacattgtataaagcaagtgatacagccactgctatctttaattgacaatgatttctgaaatgtacttgaaaaaatcagactagcattcttgcctctgggtactgtgttttaatgtggagttaattatcctctaccatagagtcttgtggaaacatcattagccttctttgtacatttggccatctgcagacaaatcaatggccagaaggcttcatgtgaacctagatatatgaggaaaaaagtactctagaacttcatgtccagtacaatagccactggccacatgtggctactgattactttaaatatggctagtctgaattgagtagactgtaagtgtaaaatatataccaaagacttagtaaaaacaaatcattaatattttatatctatcacatgtcaaaacaatagtttatagatatattggcttaaatgtgttattaaaattaatttcatatgtttctttttattttttaatgacacaatttaaaattagtatgtggcttgcgtttttggtttgggttatatttctattggacaggctacatacactaaggtggtgtcagtctcctaagtttcagagctttgatgaagtagggaggtctaggctccatcctggtacatccaaatgttgtttgattggatggcttcatggtctaatacagcaaatagaatttaccaaaatccttctgttttctgtgtctcttccaaagatccatgaattcatttttagcataagggccctgacgttgccctagttaaaactaggaggtgatggaagaggggtctcattccattcagagccccataggtctgctattgaggtttttatgaattcagccagcaaaaagggacaccttgtttctttctttctttctttctctctctctttctctttttctttctttctttctttctttctttccttctttctttccttccttccttccttccttctctctctctctctctctctttctttccttccttccttccttctctctctctctctctctctctctttctttctttctttctttctttctttctttctttctctttctttctttctttctttcttttctttctttcgtagtttcgctcttgtgtcccaggctggagtgcaatggcgtgatctcagctcactgcaacctccacctccttggttcaagtgattctcctgcctcagcctcctgagtagctgggattacaggcatgcgccaccacgcccaacagatttttgtatttttagtagagacggggttttgccatgttggccagggtggtctcaaactccagacctcaggtgatccacctgcttcagtctcccaaagtgccgggcgtcagccaccgcgcccggccaatactttgttttcttaacctagagtcctttagggatttgagagtagcagggagcagctgtaatatgaataacagtaacacagctggaatttcctattgtagtgaagtttttctgcacataagtgtttctcattttatctgataatttttgtcctaataagtacatgtaatacatcatgttttttggacattcaacaaatacttattgagcaccaactttgtgcctggcactattctagttcctagggatacttcagtgaataaaacagggcaaatggaactggcttcctagagacacaccctaatgctaatggagttggtatcctagagacataccctaatgctaccttgtaaatcacagggctatcacatggtgtatgatgtatcaagttaacctttgacttgtaagatattttatcttctcaaaggacttcagaatttgccctcttgctttcattatgtttattatttcctccagaaaagaggaaagggggcgtgtgtgatatagaaggaggaaggcaacattcaacgctttttattttcttagtctgcattgaacaggtaattttctcccacaggaaacctaggcatggaaacactttactaattggaagtgacttcgctgctgtaattagagtaattttggaagttaattttaatcaaaatatgcatcttactctgtaagagtaagtactttggtactcaaatatagatactataacatggaaacaatatatatgaaaaacttgctctctctctctctgtatatatatagatatctatatattatatatatattttatatatatctatatatattttatagatatatattttatatatatctatatatattttatagatatatattttatatatatctatatatattttatagatatatattttatatatatctatatatattttatagatatatattttatatagatctatatatattttatagatatatattttatatagatatatagatatatatatatcttatatatatatatagatttttttttttttgagacagtttcactcttgttgcccaggctggagtgcaatagcgtgatctcggctcaccgcaacctccgcctcctgggttccggttcaagcagttctcctgcctcagccttctgagtagctgggattacaggcatgcgccaccacacctagctaatttttgtatttttagtagagacggggtttcaccatgttggctaggctggtctcaaactcctgacctcgtgatccgcctgcctcggcctcccaaagtgctggggttataggcatgagccaccacgcccggcaaaacttgctatattttaaaaagtgttgtttttagtagtgctaaaattgtagaggatcgtattacacttctttgttagttttcatccattggttttaatgttttatatcaagggtcagcaatttatgacaagcatgtcacagagagtactcagctggatggggccaagtatatacttatccctttactaacaaggactctattgccttttttttttttttttttttttgagacggagttttcctcttgtcgctcagggtggagctcaatctcagctcactgcaatctccatctcctgggtgggttcaagggattctcctgtctcagcctcctgagtagctgggattacaggctcccaccaccacgcctggctaattttttgtgtttttagtagagatggggtttcaccatgttggccagtctggtctcaaactcctgaccttaagtgatctgcctgccttggcctcccaaagtgctgggattaaagatgtaagccaccgtgtctggtcttctatttctcttttataagagctagatgcgtagccacacttcccttcaaaggaatctacacagtacgtgtctatgtgcctgagtatctgtgaccctttctgtttccacgtccaagataaatggagtggaaacttacaccattgctattagtattgtatcagctctcttttattattcttggttttcctattctgtaaaataaatccatattattaattaatgtgttaaatttccgagaaccattttggttttttaaggagtagggaattgcttcttaatttacctttatcttcaataggtttctttttacctaaagagaagttatttctgatgctgccttatatcttttatgaatccatatgaaaagaaagtggaacatcttatatggcatttcatctaattggactttttctaccagtgaacaagaacttcagttactgaataactttaaacatccttgatatctgcctgcatttttacattaatattacaatatctttttcaggttttcaattcaaaaacagctgaactacttagtcatcatcaagtagaaataaaacaagagttcccaagagaagggtatgtttcctaatttaatatgtaaagacacattatgtttgttagtccatctcacccaacttgccctgtggatttgtaaagtaaacttggtcagacatcctcctgaaaacatttgaaaggttgttattagtcaagaaaatatgcaataacttggtatgtcttacatgtgaggaattgatggcttaggaattcagttaaagataaggaatgaataataaagtaataaagcaaaagagtattaaatatcagaaatttcacattaactttgaagtcatttagttttgtgttcctattattgcaaaaatgctgctttgctgatttgagtgtcaggtttgttttataataaaggtatctttttaaaaaagtattcacatatcttaacatctaatactaaaatcacatttttgggaatagtattcataagtagtaattgtgattaaatatgatgttaagtatattatttaaaatttaatgatttttatgatataaccactttgaaaaactgtgttgcaggttattgcaaagctaaccatacacctgcagcatttcactcttaggaatttacccaagaggaataaaagcatatgcccatcgaaagacttgcacatgaatgtttatagctactttattaaaagtcgccccaaactggaaaccacccaaatgtctgtcatcagtaagatggataacaatggaatgccatttagtaattttaaaaaagtggacagatacttgcaccaacacaagggaatgtcactggaaatatggaaaatgaaaaagttggatacaaaagagtatatactgcatgactccatttatctgaaattttataatagtctaaactaatctaggatgataggaatcagaaaagtggttgtctgtgaggtgtgtgattcacttgaaaggagcatgaaagaactttctgggttgctggaaatattttgtatcttgactggggtgttggttagatgggtatttccacttgtcaaaactcagcaaattgtgtgctttcgatttgtgcatttcactgtaaagtttacttcaatttaagaaagagagaaaaaaattgatgtgtttctaaattgtattgtcttcttcacatgaaaaaatgttctaattttttagagttcctttgtttaataataaaagttattgatatgttagaggcattagcatgactgtccacaagcctgaacccagtgcaatttgtaaagaagatacctgagtcttggctagatgaaaattataaatacacagaaggagactgggtttttaaaaataaattagagacgacttggcgcggtggctcacgcctgtaatcccagcactttgggaggccgaggcaggcggatcatgaggtcaggagatcgagaccatcctggctaacatggtgaaacctcgtctctactaaaaatacaaaaaattagccgggcgtggtggcgggcgcctatagtcccagctactcgggaggctgaggcaggagaatggcgtgaacccgagaggcggagcttgcagtgagccgagattgcgccactgcactccagcctggacgacagagcgagactccatctcaaaaaaaataaaaattaaaaaattaaaaaaaaattagttagagacagaattcaaagcccaggaaagggaagcatttagttaggcctgagaaaggcagagaagaaaggcagttggaattcccttgctacttctggatcctatggtagaatcattttagtttgtatcatttctacttttggacttcctcaaattaccatatttctcctaggcttctcacccttctcatttactattagcctttcatccttctgaggccctggtactttaccaaaattatactgagattgggtctgagaacttggaccaatcacttatctacatgaaatagttaaaaggagttttaaatttctccctaaattccaacaaaacattttgggaaaaaagtagcaaaaaagactagtatacttatttgacttttcagaattccttttgcttcccaaatatatcattctcaataataataaatatatttccatctacttagaaataatcagcgattagtgaaacatgcagataatttatcaaaattaattaaatctgcaggatataaagaaggggaactaatttcttattagacttggaaaaataattttaaaataggtagatatttgctgtttgtggcctgccattagtggcctccttgaaaatgattaattactatgtggagaataataaaattgtaaggaaataggcttttcttgaaatcatttctttaaaatgtggaatgtaatttgctttgcttaatctggttttctttaatgtatgcaccagccacaccctcataagttaacatttctatagaaaaaagttatatttgtgttgctttcttactaaccaaatgccttcttttgttcaaagatgggtggaacaggaccctaaggaaattctacattctgtctatgagtgtatagagaaaacatgtgagaaacttggacagctcaatattgatatttccaacataaaaggtattttagtagaatattttacccacataataagactctctcaatcaaattcattaatttattctttcagcttataattgagtgcctatgcagtgccaagcatttctatgagaacttgaggatacaacactaaagaggaagatttaagttcttgtcctcatggagcttttatttggatgggggcgagataataagagcagaaaaatataatttcaaatactaaaaagttccattccaaaaaataaaaaccaagtggtatggtgggttttgcctagaagggcttgctttagattaggtggccaggaaaagcctttctaaggatgtgacacttttgctgagctctcagagggcaaaaggggtcagccatgccagtgtctagaagagtgtttgaggaaaaggatgcagcacgtacaaaggccctgaagtgggaataagcctgggacatttccgggtcagaaagaaggccagtgtgtcaaaagaagactaaaaatgttgagcagtgagactgggtagggggtttcagtaggcgatcaaattgtggaagtgggtcgggcttcatcagccatatttaggattttggatgttattcttagtatcatagggagccatgagaaagtttaagcaaggcggcaagggatgacttgcagtttcaaggcaactttctgactgctgtgtggagagtagatggtaaaggcaaaagtgtggacacagggagactagtgcggaggctgctatggaagtcctgagagaggatggtggcttgaccaataatggtagcagtggaggtggagagaaagggccagaatttgctgatagactggatgttggggtaacagagagagtagtggggttgagggaagagattggtcaaaggtgatgctttggtttttgccagagctcctggatagatgaggatgccttttgctaaggagagaaagactagaggaatgagtaggttgtggggaaggggtatttggaatccaaactcttcacttctaaaatttccctgaaataattgcttgagggtgttagattgttatggatttctctgagaagtcctagtagttttttttttttttttgagatggagtctcgatcttgtccccaaggctggagtgcagtggcatgatctcggctcactgcaacttccacctcccaggttcaagcaattctcctgcctcagcctcccaggtagctaggattacaggcacacaccaccatgcccggctaattttttgtattttttgtagagacggggtttcaccatgctggccaggctggtctcgaactcctgacctcgtgacccgcccgcctcggcctcccaaagtgttgggattacaggcatgagccaccgcgcccagcgaagtcctagtagttttaattgaatatctatgtttggcttttcatcattcatatagggaaaaaaaatccagccacccaagattgatataatagcataaaaggtggaagcatagtgtggaagtttgctgtctactttatagcctaaaattttcaagtttaccattcaagggctctttttttcctccttaggtagtttgactatagatagagagaacatcaattggtggtggtggcttgattgccatcatcttggctttgatacttaccatcgctcctgagcctttcccctatttgtataaattaaaactcacttaaaaaaaaagactacaaatctatagagtgcctactatgtgccagatgtgctaaggatacaatggaggtaatgcttaagtgcagaaaacatgttaatctgataatcacaaataaatggaaatgcataaaataatagagttatttctgttattgcagattttttaaaagtataatttgatattttattaacaacttttaatactatgcacatattaatcctatcctccctttatccctacatctaagtggaagggcttcaaacttctcttagggttgtagtcctgaactttagatgagttgtgcattagtgattgttgttgatcatttccttgagctgttcttgcacttctcacagtctaaacagtgcaaacaaataataggcaatcagtagcacactcttgtcaaaattaccaaagacgtaagtaatccaggcagcttaaagccatgtttagaatgtagagtccagggtgattgaccatggctttgacatcattctacctcccttacaggtaaggtaggttgtgatgtgttggctttctggacccacttggatgctattcctttctcccttgtttttacggttatgtgaagatgacacacaactcctgcccaagtgatttgtcttccgtttgcactacctggtctaagaattgaacaggcagcttctctatactcctctgtgtctggccagtgtgaagtccacatctgagccaaactgacccagcacttccatctgtacaactaccatcctctggccacagaagagaacatcccacaagctcctccataccaggccagttgtactatttttttttttcccagaaaatttatccaattggcattgccaaggaccaagcttttgcttgcctgcatagaactctatatcacaaactgttaaagctgtaaaggaggctgggtgcagtggctcacacctgtaatcccagcactttgggaggctgaggtgggtggatcacgaggtcaggagttcgagaccagcctggccaacatggtgaaaccctgtttctactgaaaatacaaaaattagccaggcgtggtcgtgggcacctgtaatcccagctacttgggaggttgaggcaggagaatcgcttgaacccaggaggcagaggttgtggtgagccgagattgccccactgtactccagcctgggcaacagaacaagactttgtttcaaaaaaacaaaaccaacaaaaaaggctgggcgcacagtggctcacgcgtgtaatcccagcactttgggaggtcgaggcaggcagatcacctgaggtcaggagttcgagaccagcctggccaacatggtgaaaccctgtctctactaaaaatacaaaaaattagctgggcgtggtggcgcacacctgtaatcccagctacttaggaggctgaggcaggagaatctcttgaacctgggaggcagaagttgcagtgagccgagatggcgccattgcactccagcttgggcaacaagagcgaaactccatctcaaaaaaaaaaaaaaaaaaaaaaaacaacactgtaaaggatcttcagtcaactagaccagctccctctatctgcaaattagggaagaggacttaactgcaggttatgtagctttttagtggtagattaacattaaagcacagctcccctgactcctagaccagagttctttttcctgagccacactgatggtaatctcacaaaccacttctgtttttatttcttgtgtggcaagtaaattaactttgccaactgaagagtgatatcatttatagtcctacctgacagtcattaagagttcttcatgtctggtatttccttggcaaatttcaatttcattggttttgttatgcttatctgacagaaggtttgttgatttcaagtcactaggaacagtgcctccaaaattaaaattcactctccaactgagcagcacacactagctcaaggcaattaaatagactgcttctttccttctagcggtagagtcagctctgtttgcctgtcactgggctcaaggaattacaaagtataaagagttacagtagcaattccaaaatacaaagagttacggctgggcatggtggctcacacctgtaatcccagtactttgggaggccgaggcgggtggatcccctgaggttgggagttcgagaccagcctgaccaacttggagaaaccccatctctactaaaaatacaacattagctgagcatggtggctcatgcctgtaatcccagctactcaggaggctgaagcaggaaaaacgcttgaacccaggaggcagaggtagcagtgagccaagatcacgccgagccgagatcatgccattgtactccagcctgggcaacaagagcaaaactccatctcaaaaaaaaaaaaaaaaaaaaaaaaagagttacatattcattcatgtgatagaacgaaaacacaacataaactctttcaaaattgagagcataaaattctcagagattagattatcttgtatctaaaacaattatttccctgttagagaaaagggaaacccacatatccattcctccactgccttgccctacccaacatattcacacacatttctaccacctcttagactcatactgtcaggggcctctcaggggtttcaggaaggcacctcgttctccaaaatgtttccagcagcagccacatctcatttgcaatttttctaacccacctcaagtacacatcttccagagcctgttttaaaaagttttatcaggccgggcgcagtggctcacgcctgtaatcccagcactttgggagactgaggcgggcggatcacctgaggtctggagttcgagaccagcctgaccaacatggagaaaccccatctctactaaaaatacaaaaattagctgggcatggtggcgcatgcctgtaatcccagctactcgggaggctgaggcaggagaatcacttgaaccagggaggcagaggttgcggtgagccgagatcgcgccactgcactccagcctgggcaacaacatcgaaactctgtctcaaaaaaaaaatgaaaataaaaagctttatctctcttcccacatggtattcctttttgtagccagagaaccttcctctgaagctcttattattttgttctgtgtgtttttagttttctcctaaaaaatgtgttataattatatgttatgattttaattttaaaaaaggatgcatctcatccataattctaccaagacaacaattattaacatcctggagtattttcaaaggctcttttttctaaggtatattttcttaactgtgattataacttcacggaaaattttaagaaaaattaaccagggattttgagtgtagcttttaactagtttaattttactactgacattcagtgtagagaaaagtgcccccaaagagaatatgtgggtaaagtatgaagctggtaaatgcaagagcaatacgatatatgataatggttatgatgtccgtaaatgaaagactttgaggccaggaaatacatgttttatgcatgtgactttcatattatcttaaacagtgcacatgaggaggagtggagaattataaaacctgaatgtgttattccaagaaagaaggaattaaaattaggaaccattaggaatggcacatgtgctgagattagcagttggcaacgttttctttaaaaaacatagaggattttagggtaggaatgacaagacactggaacattgaaaaagttcagagataagttcacacataagacttgtgtgccctggggagaaataggtagtaaagacatgtttgtggctggcagagaatcctgggaagctgtttcactggactttgcctgcaagcaaagcaattttacttggcatgaaggaatccaattaagatagaagagaaaaaaggaatgcccagggaggaacccgtgactgaagaatcagattgaaatagctctaaattagattctgaagaaaagttaaaatgacctggtaaagataggtagcatgagaggcatagaatagtgactcaaggattgtgagtaagaaagtagccagcttattgatggtaaaattaacatagtgaggaggaataggagattttagttgactataagttcattgtgatcccatgttgtaaagttgtcacacgcacaaaaaaattacattcacaatatgtacccatagagctgctgcagaattcctttatttgccctccttagctcagtcccattctctgaaactgttactctactctcttctcaataataatgaccatggcagcagcagtaggtaacatttattgagtgcttactgtgtaccaggcatgtgttttaatatacattgactcctcactgtaaccctgtaaagttggaactattattctctccattttacaagacacaaaactgagacccagagtcacactgctaggaagcacaggaattggaatttgaatcccagctatctggcctcagagcctgagctctactgaatggtgccccaaactcttgccctgttttggcagataaccctacctcctgcttcatggagaaagttgagggtctgcggccttaaatcctcaccttcctgttgctgtgcttaatatctggatctcctgccaactttccttcatcacaagggcagcaatagccttctgccccacttggagctcctccctccacttgtgctggtaatccatcctctcctgtcactacatcagtcagaaccaagtccccattgattcccagccccatccatcccctcattctcctttctcttctttatttacttttataaacatttttgtcttacccagaatctcttccttataccctatgcctctaaatttctttggagtagaatctcaatcatctttgtatctctagaaaatattttttaaaaaatatatatatatataaacttttagatacagagggtacatgtgcaggtttgttatgtaggtatattgcatgatgttgaggtttggggtacagacccgtcacccagttagtgagcataccacccaataggtagttttagaaaagatgttgaataaagtaagtcaatctgcattggataaatagtattagaacaagggagctgatgttccccctcagctctgtgctggtcagaacattcctagagtattgtgttttattctggacgtacagtttgagtgatatggacatacacttgcatgttcctaggcgtggtgataaagggactttaaaccatgccatgtttaggtggggtcagttgaaggaaattggattgtttaggctacacagcagaagagaagacttgaggtacaaaagagctgcttcaagttttgaaagactggcatgtagaaggattacccttattctatatatctccaaagaatatgactaagatcgggaggtggaagctacacaaaaaatgatttttttttttttttgagacagagtcttgctctgtcacccaggcaggagtgcagtggcccgatttcggctcactgcaagctccgcctcccaggttcatgccattctcctgcctcagcctcccgagtagctgggactacaggcgcccaccaccacacccggctaattttttttgtatttttagtagagatggggtttcaccgtgttagccaggatggtcttgatctcctgacctcaggatccacccacctcggcctcccaaagtgctgggattacagacgtgagccaccgcacccggccacagaaaatgatttttattcttctttttttttttttttttgagacaggatctaactatgttgcccagtctggagtgcagtggcaccatcagagctcactgcaaccccaaactcctgggctcaagcaatcctcctgggtagctgggactacaggcgtgcaccaccatacccccctaatttttaaaatttttttttagaaacaaggtccaactatgttgcccaggctggtcttgaactcctgggcttaaggaatcctcctgagtagctgggactaaaggaacacaccaccacacctggctaatttttttttttgagatacagtctccctctgtcgcctaggctggagggcaatggcgcaatctcggctcactgcaacctccgcctcctgggttcaagggattctcctgcctcagcctcctgagtagctgggattacaggcacatgccaccatgcctggctaattttttgtatttttagtagagacagggttttgccatgttggccaggctgatcttgagctcctgacctcagatgatccacctgcctcggcctcccggagtgctgggattacaggtgcaagccaccacgccaggccatctggctaatttttaaaaatttttttatagagactgggttttgctacattgccgagggtggtcttgaacccctgggctcaagccatcctcctgcctcagccccgagtggctaggactacagttgtgtactgctgcatctggctaattattttatttttttgtagaggtgaggtcttgctacattttccagtctggtggatttacaaaaagaaaaaaagcaccaaagttgtccaatggagattgctctgccttgagagatgtagtgaatatcttgtcactagaagtgctatctggatggtcatatgacaggagattctagagaagatttgagcttgagaagtatttttgcttatacagcctttaaggtctgtcctaatcttaaattctggaagagctggatcctttggccaagtgtgttctatccaggatgcacattagaatcacctggggaagttttaggaacccataccaatgctcacatcccatcccaggtcagttacattggaatgttttgaccagggcttggtcattggtattttttaagagctcctcagttgattctaaagtacaatcaagtctgaaaacctccaatttagctcaaccaagctgaattgaataagatagtgtgggttagtgtttttttacactaaatatagtacttgttttatgtaggtcaatataatgtaaatgccattatatattatatttatgcctgattcaaattcttatgtattgtgacatattaaaaatacaggaataaaactgaatttctaacaaaccataatataaggatgctcagcatgaaggattttgtccatagctattttcttaaaatgtaggcatgtacatgtgcacacacacacacacacacaaatgcacacacatagggaggaaaatttcttgtagcaattggtaaacaaatgaatgagttgattattggtctgctcagaataataaattgggtattataaatttgtgaagttattgcattccttaaagcaaccagtgtgccttttatttgggtattgatctgggtccatcattgtgtgctagtagtaaagctggaaggagtatgtagaaatgaaaagaaacacttggcattgggtattgactttttctggagccactcaaagaaaataaactaatatcactacaaatgtttcaagtatttttttgatttgctatgtttagttgtgtctctagtaagatgagagctgttttcctgaagtagtttcctacttgttaaatttttgacttccttctgtttaactttctctttaaagctattggtgtcagcaaccagagggaaaccactgtagtctgggacaagataactggagagcctctctacaatgctgtgggtaagctgtcatgcatggatgtcaaatgtagggcctttcttcacattgcaaatgtggtcatattaaaatatcttgctaaaaaagcatgcagtcgccaggcatggtggctcacgcctgtaatcccagcacttcgggagactgaggtgggtggatcacgaggtcaggagttcaagaccagcctggtcaacatggtgaaaccccatctctactaaaaatacaaaaattagccaggtgtggtggcacacacctatagtcccagctactcgggaggctgaagcaggagaattgattgaacctgggaggcagaggttgcagtgagccaagaccttgccattgcactccagcctgggcaagagagtgagactccatctcaaaaaaaaaaaaagaaagaaaaaaaaaaacacatgcagtcatggtacctataatcttgatgggatgggcagaagagtctgctaagaaattaactgttgtatatttaccatttttggatcatacatattcacatagtgaattaactctcccatgctctctcctcttgcagattgtcttacaaatgagtgaatgtttgccaaattgttttataacccctgctgtttgtgacatctaaaagagatcttacctccttaccctcaaaaaattaaaattacgtgtgttcacagtcatttttctataaagtacttgtgtgtttgtctttccatctaggaatttgaattattcttctaaggttataaaaatagaatattcgaattttagctgcttcttctacaaatgtggctatttgagcagggatttaaaaaaccccaaatctcaaatataccacttttaggtatcacaacttattaggtgtaaatgatcctgagtatattttagcatcattattagcatgacagttgttgaacaccgaatgatactaccacttcctaaaaggaaaattttgttctaaattacaatcactaaaagacttcattgtgtcagaaagcaaagcacaattttttatcaattaaatactaagttgtgggatggggaatggaatcagaaattatcagagaggggataattttgggggaataatctttattaaaagttaaagtatttaatgttattgtattataagaaagtatttagtatgttttctgtatttatgataaaaaattaaattctcaaaaaatttgaaagaattacaactaaagatccttttagtacatctttttctgtggtgttttttttttttttctttcctctgtttttttttttttgagacagtcttgctgttgcccaggctggggtgcaatgacacaatctcggctcactgcaacctccacctcctgggttcaagcgattctcctgcctcagcctccccagtagatgggatcacaggcgcccaccaccatgcccagctatttttttttttttttttttgtatttttagtagagatggggtttcaccacgttggccaggctggtcttgaactcctgacctcaagtgatccacccatctcagcctcccaaagtgctgggattacaggtgtgagccaccacacccagccagaagtacatgttttaaatgtttattttgttctcattctcatgagtaattcattttgaatataagacagactatttaatgactagtatttaggagagtatcctttgatagatcaatgttagctaacttcctgaactagttaaggttttactttcttttgttttcttaatgaaaggaagagcctactcaggcaaaccagaaagttccagttaaattctgagctttttttttttttttctttttttgagacagagtcttctctttcactcaggcaggagtgcagtggtgcaatctcggctcgctctatctcccaggttcaagtgattttcgtgcctcggcctcccaagtagctgggattataggtgtgcaccattatgcccggctaatttttgtattttcagtagagacagggtttcaccatgttggccggactggtctcaaactcccgacctcaggtgatctgcccaccttggcacgcccggctagttccagttatattctaaacattgaattgtaaaaatggaactttggactttggattgttatttttcaaataatgcaactaggtaagctgaagttatgcttacagtaaagatttaagtaaatgttttactagaaaatctttctgtgatgttcttatttacttatttccttctcttctgcctgtgtccctctgcacccctcccccattctacgtgctttgcagtattaattcaaatgttcataggatatgaggaactcttttcttctatcctgagccacatacatgttttgagaacctcttacatgtttgatgttatcttgggtactataaaggatacaaattatattggctgtttttttaagcactttataatctagttttggaaagagaaaactagattagggaacaatccataaaacaaaattagggaatagttgataaatcatgtgttgataggttgaaaaggacttagagcaagtacatatcagtatggattttgaaattttagcatacttttcacagtggaggttgaacttcacttgggccttgaagcgtatattggattgcgttaggaaaagagaaaattgaggaataatgtgaacaagctatgaaggtgaaaatgtgtacacatattttgccagagtaaagaaatggatgagtttcatgcataggttgactcatttttttttatttttagtagaactagcagcgataataatactcagtaagtgctaactgctattactttgggattgtgctaagtattttacccatattatttaatctcactgaccctgtgaaacagattttactacccctattttataaattaattgtggaaaagctctataacttgtccaatggcatgtagctataagtagagtaaagccacagtttaaacatgaacactctccaaccttaaagcttgtgttctaatttgggtagacaggggttggtgaggatatagagggggctgaaagccatgcagtgtagtgtagacttaaaacacggggcagcttgaggcaaaacagatgataaaggagagtttagccatcccatgatggtggaatgggttgtttcaaacacaccagtatgcggagaacaaccagaaaagctggatgaaaatgaaataaaattctgaagaactggaaggctaccaaggcagtgaggacagaaggaaagcccagagacataagcctagcatttggcattgcttatctcctggagatatcggtaggttctgaaaggagtatctgacaggctaagccacacttctgcaggtccataaagataaggaggcaaaaggtgaagtcaagggctgccaagggtggggatgagtgttggtaaaatcccagactttggactgggactgtgaaaggtcaaatcctggaagtgaggtaaactgaaaataaaccaaccctcacaggaattgaagcccagattcaaatgatctttaacactaattggattaagatgatctgagattgctaatgctagtggcctaacttcctttcagaaataagagtaaatcctttctggaggaagacaacatcatctagagcctcaaataatctctagaatttttcatacgcattatctagttttctatttaaaaaaaccatgcatacaaaacaaaacgtgactgaaaagcaacagaaacaagtgacattagaaacagactcaagaaattcagatattagagtttttagagtttaaaatagccataattaatatgttcaaggaattaattgacaagattgagattgataatcttggcaaagaattggaagtccagtttaaatggacattctaaaactgtattaagaactcaattgatggggttttaccatcagaggagacatagctgaagatgaatttgtgagctggaagataaatcagaactgggagagagagtaaaatatttagactgaagcacagagaaacaaaagtttagaaaaggcacaaaagaatctaagagaaatatgggaaaaggtgaagaagtttaatatatttgtaattggacttccagaaggaaaggaatgagaaaaaacgaggcagaaataacattagacagataatgggagaaagtttttcaaaactgatgaaagatagcaagctgtagattcaataagcactataatccctaggcaagataaatatacagaagaccatacttatgctgggatatgaagatataaagttttgaagtagctgaggaaaaaagatatataaccttcaaaagagtgaccctaagactttcagctaagttatcagtggaaacaaaggaagtcagaatgcgatggaatgaaacctttaaagtactcaaagaaagtaacttccacatacagttctatatccagtgaaaaaattattaagaaatgaaagtgaaatatactaggagttggtgaggatatagaggtcaccaaaagctatgcagagtagtgtagacttgatacactaggcagctaacccattctcttagtccattctggttactataacaaaataccctagattggataatttataaacaacaaaaattttattgtttatacattggatagggcataaggaggagggagaaaataaagcaggcctgtgagattttcagcctgagagaacagaaagaaattaaataatatttagggggtaccaacctgagagaaaaaatggccttgttttcgacaaagtgagtgttgaacttgtaatagaagctaattctgggcaatgagaaattagatggttccaaatgtagacttgaaaattgataacatagatgtgataatctcaatttattatggatgaactcactatagtaattaatataaaattaattcaatgaaagaataggtgcctttctgtgttctaggttttgtgataacccttggcatatagtgacaaaccaggaagaccttgtacttgactttctgctacagaaactaaggatagaagtttggaagctagaaggagaaagggaaataggaaaggaggagagccactaagaaatgacaaggatagattctgccttcagttttatttcatccaggaaaactctaaagtgtcatatctccatgtaggtcttcagttgaaaatatcaacataatattaaatctttagcagttttattctaaagcaacacaaggtaggatggatggaaacaatgagattttcacgtatatttgtctttgaacttcttttgctttgtttatatcacagtctgcaggttttatacttttttctctgtctcggttcaggctgctttaacaaaaatatcatagactgggtggcttatagattagaaatttatttctcacatttctggaagctagaagttcaagatcaaggtgcttacccatctggtgtctagtgaggaccttcttcctggtttgcagatgactgtcttctcatcctcatatggcagacagtgataaaaagaaagtaagctctctctttttatgagggtactgatctcaatgagggctccaccctcatggcctaatttatctctcaaaggtcccatctctaataccatcatattaggggttaagattttaacatacgaatttggaagagacacatacattcagtccatagcattctctttgtatgttttcttccttcgttgtctatttctcttgtaaatctctgtaactctatgcctgtccttctcctctttatttctgtcttactaaattatacaacagatgatatatgcatatatatatacagctgtatataaatatatatattttaaatacagatagggtctcgctgtgttgagtaggctggtcttgaactcctggcctcaagtgatcctcccatctcggcctcccaaagtgctgggattacaggtgtgagccaccatacccggccagatgagcaatatttattacaaacaagcatatgagaggagcacattatgtttccctttttaaaaacttctatgtggcctcctttgtttatggctcagggacacttgataagcaataattcactcacccccactacggtaacagaaaaaccaagataggagaacttcaggatatcattggtggccacggcataggcttgatgaaggtaaagactgagaagggctatttgtttttgcttgcaataaaggtgtgtttgtttattgacatcttttctatcagatacaattataaacagaaaaaaatttaaatgggtccattgaggaagagatggcctaatttacaagttctatgtatttttagaatttatctgttaattatgtgattaataaggtaaacattaatgtgatatctaaaatgggaaagtgttactttgcatcactgctttccagccactgtgccatgatgcaggcatttacaataatgacctcattggtggatcagcaagagctttgtggccctggaaccaaagcaggccttgggcttctcttgcctctcttcagttgccctagtcttcctggtacttctctctttcccttttagcattatcttcaatattcccttccacggggtttcctctacccacccatttttctaagccttttccttccaaaagcagcttttattaatggtctacataactggttgtcttctattattgaaaaagtaaataagccacagactaaactgaccaagaagcacaaaactacccaagtagttaaaatgtgaagcgggagaaggcttgaatcagtgatgtttagtatgtttacacacacattttactgatgctaccagggaaatgttctgtccaaactagaatggcctagctgtatttccccctaattggccaagtttgctcactcaccactgcagttgattggtatgtatggtaagtatagagcaatatgaccctcactctggtagctttctgtagagcacaattcttgatttaatataaaaataccattcataggccaggcgtggtggctcacgcctataatcccaacactttgggaggcccaggtgggcggatcacctgaggtcgggagtttgagaccagcctgaccaacatggagaaaccccgtctctactaaaaatacaaaaattagctgggcgtggtagcgcgtgcctgtaatcccagctactagggaggctgaggcgggagaatcgcttgaacccgggaggcggaggttgcagtgagctgagatcgcgccattgcactccagcctgggcaacaagagcaaaactccatctcaaaaaaaaaaaaaaaaaaaaaaaaaaaagcattcacagtagggactaatccagcaaggcaagagtccctggcttaacacttttaggatattaaagaaaaccacccacaaaaaatatttcgttgtccctgaaacatttttctatatttaaatggtagtgcaaacatttttttctaagatgttatatttaaagttcccaatggcacacataactctttatggagagtgttgcaattttaaagattggttatcgtttttacatttttttaacatactggttaatactgggccaattattaaacctatgtgatcatgagttgagatctgaaccttgagctcaatccttttatcttttctggaactggcttatgtttcaaagaatcagcagaaaagaaaaccatagatgacaaaccacctaaaacgcctaagcacacttaactttaaacaataaagtattttttttctttttttttttctttttttttgagacggagtctcgcactgtcgcccaggctagagtgcagtggcgcgatctcggctcaccgcaagctccgcctcccgggttcacgccattctcctgcctcagcctcccgaatagctgggactacaggcgcctgccaccgctcccggctaattttttttgtatttttagaagagacggggtttcaccgtgttagccaggatggtctcgatctcctgacctcgtgatccgccggcctcggcctcccaaagtgctgggattgcaggcttgaaccaccgcgcctggctaaaagtattttttttcaattagttctttgtgggagaaggtttttcacttttgtaaaatctagaattttcagctttattaagatccacttattttccgttaaaaaaattccattattacaggattctttgaaaaccttacatctccctcaatcctgggtaaagaaatactgctgtatttattttgcagtgattgaattattcaaatctggccaaataaaaagaaactgacttagttttcaactttgagttctccaatctttaataattatttttatcccgttaagactgtgacgtcatcatggctatacctacctagaggtttaattctagattcaggttctgggttcagatcctagcttttccacttcctaccattctgtgcctgttaccttgacagttaaactggggagatgaaaagtgtagacctcatagacttgaggtgtagatcagtgagttaatccatgtaggatacttaagccagggcctgacggactataaggcttcagtaattgttagctagggccactgttctgaattggctgatagcctttttcatccagtaatgccagatgaaatgattggtttatacatgataggtgttcctaggggaaatgcagagcctacctaggatcacccacactcaagtcagtcattgatattttggcattttatacccaagagctgaaattggcttcagcccccgccttttggcatatatgtaaatcaatctttccttcccaactctgttttacttttggccccacctgtttctgagaatgtcatcaggtgaggggcagccatcaatatagtctcttccaccttgcaaatgaccacttacccagcttaattaatagcttagcttttgacaaatagtaaaatgccataactaaatctgttttactatcatgtctcttgtgggagaaacaacccaataacactttgtataactgtcagcagtctgtgcttaggatgtgttccataacctggagcctcaccttcacctcacttcctatcaccctagcagctcatgacagaccatctcagagaagatttattatttgcctgtttctagtcaaatggaaatcagctagatgattttagtggggtttttttttactttattttgtttttccttctattgtcatgactaacgaaaaactggaaagttatgaggttttattattctaaatatttaaaaaataatttattcctctgtactgtttgttactatgtcactaactctagcccatggggattgaggcaactacatttatcttcactcttcaaactttttttttccagaacaaactaaatctaccagacagattggatgtgactttatttaatacaaataagttcagatcatccaagttatttttattaacttacttatttgatgggcttgaccatttacttctgctttacttggtgtagataaggggagggacataccttctagaagtgggctgtctagtgttctggactccctagcatcaattttccttctatttttttcctaattactttggaagttagcaatcccctgttccctctagacacgttgctcccttctgtgaaggtgccctttactcccagctatcttaccaggaaagtgctttcttggggacctgccttcccaaagcagccctttcatgtcttaatgtagatggccacaacacagactgtagcatgctccttgccattcctttctaacatcctctaggattgtgctccctcagtacatcatccatcatttcaatttagtggttgaatgagtagtcagttaccacctgagccacttttctaattaggatgcatatatgttgccagatagagaagagtcatcctaaacaagaagcaggtatttacctggtcttcatccaaatggaaatattattgaatcagagattcatactggacttcctttgttccctttctgctccctgcctcttccttttctttttctacaccaatgtgtagaaaaagtgttcattctgataaacttgcccaagtgatctaccatttcctaaatggtcaacaagagaccttgaacctggccatctctagcgtgaattgcccttatttcttctaatgctccagctgctccagtttctcctggcccttcagttccagttgccgttgttccctctggctcttcagttccagctcctggtacttcctcaggtattggtgctctggctattgctcacttcccagcctcccaagtcctatatgttgggggaaattgacttctgctgccagatctggatctgtcattccttttgattgttctcagagattacctacacaaggggcttagtcctccagcttgggagtcttctctttggcttttggtctctctgcaaatctaattctgccatcttagcttctttaataagttttctaatttttttgttcttaattcaattaattttgagcatttgtgaattgcttggtagtgtaccaaccactgatatttttctctttggcagttttactaatgcattccatgtattctaactgccttaatgtctgtctataaaaacacagtaattattatgacaggtttctatgatcatggaacaatggaaggagaaagactttagagaccatctagtccagcctccttattttatatttagagaatccagaccaagaagggtaaaatgagttgcctaaatcacatagcttattggtggcaaagccaaacattgaattttggtctccctgatttcacatccagtgttttgattctttgtggtaaggatttaactctgtgtttaccactattgtcagtcacagctgcaaactttcaagtgaggaataaagtgcctaagtggtccttgccaaggagcaatagaatcacagggccactgggacttggagaaccatctgattatcgggggggttctttagatttttttaaacatataattggaacacacctagtattttaaagaatatgctcttgaaaagatgaaaagagtttctcccgggaggcggaggctgcagtgagccgcgatcgcatcactgcactccagactgggtgacagaaagagactctgtctcaaaaaaaaaaaaaaaaaaaaagggagagagagagaaagaaaacaggtcctcatgttttagtattatactgaattacttgagacacttttaacaaaagtacagaggctcagagctcaggccttgcctagacctgcaaccagaatcatgcaaggtagggcctgaattttaaggttttccaggtagtcctggtatgctttataggaaagaaccactgccgtgaagtctagcagtgtttctcaaaatggggcacctatttaaaagtcagatttctgggcctcattcccagaactactgtcctagaatttatggggatggagcccatctttaagctcccttgtgaatgttatgtccattaaaatatgaaaaaacacggtctagaatattttaagtcattaaccaaaaaagcctggggcagtggctttcaaatgtatttgttcatgccccttggtaagaattacattttacataatgatccagcaaatccacataactaaaacaaaagtttcacaaatcaatatttatcttacccagtgcactgaactctgatattttccattctaattcatcctatttcaatttttaaagtaggtaatcaaaactcactaaattcatttttaaactcatagctcactgtattttgaaacactgagtattgagatgtgcttgttaattttacctatcatagatttaaaacttttctaattcttctactttttctagttatttctgtgagccaataacacctgctaggattgcttacctgtaaggaaggtccacatttgtcacagtcatacagtactgccactgtgtaaaagtagactgcccttgttccctgggcatgggagatcttgccacctccatgatgatgtcactaatggcttgtatcaatcacagtgtaaataatagaaaattctatttcaactaaatgaagtttaaagcagggggcagttcttttgctcttggaagcagcagtgcaagggtagctaagttcaggtgctgtttgattccagactcagacagtatcacctgcatccccctcaagcctgccttttctgggatggctcctgatgtggcatattcaactcccacttcatgagggcagcaggcccaagccacacactgccaaggtcagctgagaagagggactcttgcagactgagcacaaatctctttgaccacatgtttcctgatccagtcactggggcccagacccattcctggagctgggagtaagatcaaatctcaggtacactacatggctgagggtgagggtggaacgatttcctaaaaagaattcgaaatacctctccccaacagatgcaggaggagtagatactgggcagcaaatgcagatgttatctattataggccatctattttcatggtctttctcttttccctcctgttttcttggttgtggtgagtcttttcttgctgcttttcccacctacagaaacccgtatcttgtcctgaagtccccagtttaagtcttgtggaaagtagccactgtcaaaatgaagtgcagggccctccagggaaatgacagcataagtaattagaaagaattgattaaaatttactacaggaaataactgctttttagtgaagagaatggagtaatatagaagagttaaccaaactgcacaatgattgctagcattcaaatatgtggtagtgggcaagcttgtatagtcttccctggagtcctttaaatagactatgaaactgagtcttttcaggaggtatctgagcagtcagtgtcctaaaaatatcaaatgaccacaaatagattaaaagttatcgaagtttaagtacaaaacttaaatctggcaaataaagcttagctgattctattggctgcctttcacaattactttatgtactatttagtgtttcctcttcctcaagcctactaacatgaagtaaaacagaaatcgtttccaccagggggttagaaagtagataatagctacttagtaaagataatgttgatccattaaaatggagattttttttttttatactccagcagagagaaagaatggtgcctttaaaaggattctaatgattccgggtctagcatacttggaaagatttcaatgtaaataagcatttcatacataacagacggaatcttttgtttcctgaataacagaatcaagttatctactttgtcttagtcacaaattgctccctagtttgttaagatgcacactttatatatggtatgatgatcctgggttttgcattttgtgctaccaactagcctgcctagcttttagatattctctggcctcatgtatacttagaaaatctatattccaaatattttttgtagttttgttctataaaaataatacaaaataagcactctaaggtttgtattattctcctaacttggtctgtaattttgcataaaagctttaaatcctctcataaatttatttttatctaacaatatgcccattcatttctaattttctaatttctatctcttaaaagctatagaattttaattccttatagaaactaatcagtcttttatccttgatagtgatttcagtaagttcttattttttaaatgaagtttttcatgtatattattttattttggtctatagtgtggcttgatctaagaacccagtctaccgttgagagtcttagtaaaagaattccaggaaataataactttgtcaaggtaagaatttcttcagaagtatactataagaatgtttctttttttaaaaaaagtttgcagatttcactagaaagaagcatcttatggtacaatagttatttgatacaatttatagaatctttttcccggataattgaggccaactcaagtctttaccttcccgtctttcttgctctgtggtggattggaacaataataacacaaaattgacaggctggaagagattataatgcgtcccagtggcttaagtcacacttcccaaggggtgctttttttttttttttttttttgagacggagttttatgcttgttgcccaggctggagtgcaatggtgtgatctcggctcaccgcagcctctgcctcctgggttcaagcaattctcctgcctcagcctcccgagtagctgggactacaggcacgtgccaccatgcccggctaattttttgtatttttagtagagatggggtttcactgtgttagccaggatggtctcgatctcctgacctcatgatccgcccacttcggcctcccaaagtgctggtgggaggggtgctttctataattgaactatgttttccaaatctatccctattttttctactgcccatcaaagaatgttctggctgcttttgagtttttaagcatctggattcagggagagagaaagtaaaagacactctagccctttattgaacccctcttccactttgttcatatgaagaaggctaataaaactgcctaattttcagtccttgtatagatccctcttcacataaaggaagggagagtgaatttttaaaataggtgaggaattttttttagcaaggtcaaggccaagttcttctagcgtctaaaaggaagttccctttttctgtttttgttttttgtgttttgttgttgtttatcccgtttttatttgtcagtgggatgcttgtatcattttcttctaaaactattgttgaaatcccattaattgcagtaatctgaccattccgtccccccacaataacttcagacttgtcctgaataaatcattttctattccgttcccttcatcaccctgcccaatcctcatcctcacctccagctgcactctgcttcgagggatgcatgcttttctctccgatgtcattttaggcaacttttacactttctacccccatgatgaaaataagatattatgtactacctcgctattgactttgtgagatcttcccaggtcatcttttgggatgacccttgttccttcaaattaaataatatttccataaaatatctccttccattttttttttcgagacagggtctcactctgttgcccaggctggagtgcagtggcacaatctctgctcactgcaacctctgcctcctgggttcaaatgattctcctgcctcagcctccccagtggctgagattacaggcaagcaccaccaagcccggctaatttttattctatttttagtggccaggctggcctcaaactcctgatctcaggtgatctgcccgcctcagcctcccaaaatgctgggtttacagacgtgagccaccgcgcccggcctccttccattatttttgtgcattgattttttttttttaaagaaagctagaaaaccttgagttaagatttttaatttacaggttgcattaaagtattaaatcctttggtttgagttttcttacaaaaccatactcatatgagataggagggaaaaagttatcactttctgtagttaggtgataaataagaatacagatggggaggggaatcatagttgcattatttttgtgtatgtattttctttttcttttctttttttttttttttttttttttgagacggagtctcgctctgtcacccaggctggagtgcagtggcgtcatcttggctcactgcaagctccgcctcccgggttcatgccattctcctgcctcagcctcctgtgtagctgggactacaggtgcccgccaccatgcctggctaattttttgtatttttagtagagacggggtttcaccatgttagccaggatggtctccatctcctgacctcatgatccgcccacctcagcctcccaaagtgctgggattacaggcatgagccaccacgcctggcgtattttcttaactagttaactttaatcagcctttatatacatttagtgtttaatatactaaccacaaatgagttgggtttgacccattctcaaggaagattggtaagcacatatgtgtttcatttttgcccattaatctttcttcagttcacattccctctgtttaatatatttgctaaatttaggcaactgctgttttagatagagtaattctgtgttgctttatttattttttattttttattttttttgagacagagtctcgctctgtcatccaggctggagtgcagtggtgcaatctcagctcactgcaacctctgcctcccaggttcaagcgattctcttgtctcagcttcccaagtagctgagattgcaggtgtgtgctactatgcccagctaatttttatatttttagtagagacggggtttcaccatgttggccaggttggtttcgagctcctaacctcaagtgatccacctgcttcagcctcccaaagtgttgggattacaggcatgagccaccacacctggccctgtgttgctttaatttggcatgtctttgagctctactttagtgtctactaatttcatgttatgttatttgaacttgtgtgtgtatatatgtaaaatatattattaagtcttattgttttaaaagttttctggttatgatcattagtttatgatttggtatactctctggtttttaatagtttaaatgtcatttttatggaatataaaataaacagcatagttttgggctaggttctacatacaatactaatttattgcaaaaatcaacatctacattgtcactatctaattacaggatgttgtgtcatttaattttctctttaccttgctacgtggatgccctttgaactgtaaacatgtcaccctaatctttgttcatgaacatgctttcctgtgccatgagacaggaaaagtatttttattcataatactatgggattgccttcagggtctttgaatattttgtgatttgttgagttcttttgtttggtggttttgttttaaactgttacacttttcatttgctaactgaacttcacaactgttttagtccaagacaggccttccacttagcacttacttcagtgcagtgaaacttcgttggctccttgacaatgtgagaaaagttcaaaaggccgttgaagaaaaacgagctctttttgggactattgattcatggcttatttgggtatgtttaaatataatggatatatggagaattttttcagaaattttttctagactgccttgcctattgtttctactagcaggtcagactttttaattagcagcattatgaagaaaaaccactcaaaaagcaacaggagaagttttcagcttccattcgagaagcatttttgcctacttcctctttattttttcttgtcttacttcagtgaaaatgaaggataattaccaaaactgtatctaatatctattatctttaggatgagtaatttagataccctttccctattgtctgttatatactcctttcccactagccatgtcttagacgaaataactatttagcaggataaaatacctagagtacttttatcttttgctttcaacattacataactgtctcttgtataatcaagccataatatgaaactaaatcatagtggaaatttctatttagaatctttttgcctaagctgaatacacagcaatcatcaacctatggccaatcttatttctactatactcacatattctttctccccacagataattttaaaacaaatgccagacatttcattttatttgtaaatatttcagtaagtatgtaatgatcttttttaacattcaagggaatgtcaaggaaatattgtccccactctcacttgacagatccacagagcaggtctttcagaacccatatcagaaagaggcaccttcttcacctctccatgtgcttggccagggcagaatgtgctttgtgttcatggccagccattttcacgtgtgtcagtcacagttgaatgagtacctttgacaattgcatcgaaccagagtaaggcaagatgtggaaactgtgagctgcaggagactcaagggagcacattttggctatatcccactggatgctgtttattgacctttgttcctttcctacctcttattgcttccatgtaaaggaaagcagcagtgccttcagttcaggcatgtgggtacacctgagaaagaaagtttaaaactctcctttcaggatatatgcttaggtgagtgtagatagcataatgcgaattgttatttaaacaacaacagcaacaacaaaaaaaaccaaagagataacaacaacacacaattctctaataatccttatgaggcagatatttccatttatttcatctcgccgaatttaataagactctgagttttctcaacataataggatgaaaacaaaaccgattttttatttatccatcaagtaactggaattgtgctgataaggtggccactagccacatttggctattgagcacttgaaacatgatcaaattgaggtttgctgtaagcatggaatatacaccagatttcaaagacttagtacagaaaaaagaaggtaaaaaaatgtaatgttccgttcttttgctttatgtgctctgctgattatgacccttaacaatatgtaaattaaattgccaataagtacaaatttaacctgatttttttactctgcctagagtttgacaggaggagtcaatggaggtgtccactgtacagatgtaacaaatgcaagtaggactatgcttttcaacattcattctttggaatgggataaacaactctgcgagtaagttctgttttgctctaaatatagttttcccaatacactacctatttataaccgaaatcttaatattttcagatgtcagtggagcaccaaaatttaactgttgatatttcaactacaatatgcaaatctatgttatgtgttttttaaagagagactattattgcatttataataaacaggccaaattaattattcttcacggaagtttaggttcctttataaaagtactttggtttctgtgtgctttctaatttttattgattggcttgcataaagttagaatgttaaatatctaagaatacagctatgttctgttggcttacgtatttattgctatctaactccatgctcaaaaacatccatttctaattgttatttatgctttttgcatttaaatacatataaatgtttctagatgtctatttaaaacagtgttaaatacccaatcttcttgtttttcagattttttggaattccaatggaaattcttccaaatgtccggagttcttctgagatctatggcctaatggtaaaaaacaaacaaacaaacaaaaaacacaccaaaaaaccaaaaaacaaacaaaaaaaaacctaataattaaagtttttttattacaaaacaagtttactattcataattcaaaagtcaactgtgttatgttttgtgacttaaaaactttacagtcctttttacaatggatttgcatttataaactttaattggtttttctttgagtattattatttttaaagaattgatgggatactctaactttagatgttggcatgagccaatttattctttgaatccaaataactgtttagtggttgtgatgtctgcttttaatttagcggagagactctgcatatttagtagtgttctttttcccgttgaatcttttttatggccaagctatgttatatattagattctttgcctgagcaaaatttagcaaagaaactgaaagcaaagagtctgtttctgatttgggattgctaattaaactagtttctgtaatggacatttttacttttgatttcactgaaatccagtaaagacatagcttcagcaaaagtgtgcctagcatcattaagagtctgtggttaaacatcaggaatgaaaacctctaggaggatttgcactggtgtttgagcacaaaaatctggaatttatgataagactcaggaataagtctgataaattacaaaaagtattgcttagacatttcatgaaagatatgagaaacttcacttacaaagttaataataatatagatgaacactaagtgctctggataaagcttgagcaagaatttttaactgttttatttataataaagctttttaaggcaacatagaatttcttaaggaagccatagtcactgcttatctacagtaaaagtgctttgatcatttcatagctgtctgcaaactgacttgggtcaaggaaaaagaaacgatgcttgagaaatagtttcacaggatggttagaaaaaaaaacgtggaactggcctagttttctcttgtatttaaaatattatgcttctatccttctctctcccccttgctgactatagaaaatctctcatagcgtggtgagtaggttgcccgccaattatgtacccattcatttggaaaagatacagtgcacttccatttatttttagacaagcagaagtccatttactaaacatatatatctagaatttccgtgaccttccaaattattataagctctagtcagattttaatttttacaaaaacttaatcttgtttgtttttaaagagtaatgttctaaaataaaagactaaggtagtttcctggaatgagagattctgatattctcataaagtacaactgtgatgtgctttgggctttaccataatagggcaattagatagatacagtttgaaatgtctattttaaatgatatattgaccacctttccagaccagttagttggaaatgcactgttactttttctgcatgcttcatcaaggatgctccaggaggagcatcagaggtccctccctctgaagaaaaaagagcactttacatgcctgaacacacatagtagatcctgttgatagtttgttaattttgaaagtataagcaaagacttcttgtaatacttaaatatatcaagatatatagcctctaggtttcctatagattcactttaagccttttatgaaatttaccctttacttaatatccaggttcagattttcaaagaatatatacagtaaatgaaaatagcaggttttgctgggcacggtggctcacgcctgtaatcccagcactttgggaggccgaggcgggcggatcacgaggtcaggagatcgagaccatcctggctaacatggtgaaaccccgtctctactaaaaatacaaaaaaattagccgggcatggtagcgggtgcctgtaatcccagctacttgggaggccgaggcaggagaatggcgtgaacctgggaggcggagcttgcagtgagccgagatcgcgccactgcactccagcctgggcgagagggagactccgtctcaaaaaaaaaaaaaaattagccgggtgtgctggcacatgcctgtattcccagctactcgggaggctgaggcaggagaatcacttgaacccaggaggcggaggttgtggtgagccgagatggtgccattgcatgccagcctgggcaacaagagtgaaactccatctcaaaaaaaaaaaaaaaaaagaaaagaaaatagcaggttttgaattaaccagaaaacaagaaagaaataaaatgataccagctatctagaggacattttctattttgtaaagggtttctacatttatgctattatttcttcattatcatagctatgtgaggtgaattctattcttgccctcactttaacagacgggatatctaaagctcccagagcctgggagacttgctcatacatggcagaccaaggagtcaggtccaaagctttagtttggtgctcatcctagtacatcacccctacttcagggattttatatatatatatatgttttatatatatgttatatatatacatgttatatatacatgttatgtataacatgttatatatacatgttatgtataacatgtatatatacaacatgttatacataacatgtatatatataacatgttatatatatatatacacacatacgttttatatatatatatacacacacactttttttttttttttgagacggaggctcactctgtcacccaggctggagtgcaatggcatgatcttggctcactgcaaccccgcctcctgagttcaagtgattcttccacctcagcctcctgagtagctgggattacaggtacccgccatcatgcccggctaattttggtatttttgtggagatggggtttcaccatgttggccaggctggtcttcaagtcctgacctcaggtgatcctcccacctcggcctcccaaagtgctgggattacaggcaggaggcacagtgcccggctggggatcctatttcttagttctcctaattccttaatatcattaaatattgccttgagttaatgtgtctttttttaaaattaaggttgtcaagtctacaatcagccacttaaatctcatttttcttcctagaatgctggccatcatgatcaaaataaaaaccagtatttatgacataaattaactgttgcttatctaaatttgaagaaagatgtttgctatgaacaaataatatacaatacctgaacactcttgtgtttagagcagcttgagtagaaagaaaagttgctaaaatatggccttgcaaaataaatgtgtttcatactggtttgatagctattggaagaatatattagtcatttcttaataatggcaataatagcaaagtactaatgaacttgagcaatcacgtagcccaatctccattttgtagagaaataatgtgatgtattgagaggtttcaacagcctgctagtagattaatactaactaactaaccaagagtagagccctcatttactggctcccagtctaacgttttatgttcattctccagtgccacatctcttcctgtcattctaggaatacttgtagtatctgtctctttatcattcatttagttgaaatgctttctttgtcttgtctgcccacatcctctggcacattgctacttgtgttcactcttgttgcagctatgttagtagagccaaaattttgtgactattcataatcctttttttaaattttattagaaagctggggccttggaaggtgtgccaatatctggggtaagtttcatcaccaagtgtctccccatccccacccttccccatgttatggctttcctcctcttagttcatcagtgtgcctctttttaaactagggaaaacaagtaaaagttgcaaaattggctaattcttgttcttacatgtcatactgtgggccattgagaatcttttgaataaattaattttaactctcccttcccatacctattatcttacatattaacaaatggtattaacaaatggggaaaatggccaaatggagaaaatgcaaggaaatagacagttcattctttgataaataaaaaatgaaaaatcctatggctcttctaaaaagaaagttaatactattgtattagtcagtgttctttattgtcatttatactttcagtgtttaggggaccagtctgctgcattggtgggacaaatgtgcttccagattggacaagccaaaaatacgtgagtttaagaaacagacttaaaaaccaatgctgttttgttttttctacttggtgctttgaataaggaaaagcttttgaagttcatccaggatgaaaatcaatagcttaatagctccaatatgcatatatacactttttaccatttttttatatctttaaataaaatacaaaatgccatatatatgcacactgatgaagcttataaagacctaaatttgtaggctgggcgcggtggctcacgcctgtaatcccagcactttgagtggccgagacaggtggatcacctgaggccgggagttagagaccagcctgaccaacatggagaaaccccatctctactaaaagtacaaaattagccgggcgtgttggtgcatgcctgtaatcccagctactcgggaagctgaggcaggagaatcgcttgaacccgggaggtggaggttgcggtgagccgagatcacgccattgtatgccagcctgggcaacaagagtgaagctctgtctcaaaaacaaacaaataaacaaaaccttaatttgtaaaattcattaccttttatatcctaaaaactaaattttggttcaaagtattcttgcctttttggggagattggtggggtggtgagaggggtgggaagaagtgaggaagagctgtaatatatagtttttggcatattaagtctttctcactaactgtaaagttatatttttgtgggattttcaaggttattttcctggcattgtgctttctctccattatctgaagtttcgcctttcctggcattgtgctttctctccattatctgaagtttctcctttgacaagaagcagaaagaatgatagaagtagagatttggtatatttttctctcaatctcatcttcttactactcacacatgcagaatctggaacaagccccatatctaagagtaataagaagatgactcccactttaggataagaaaatggatactcaaggagcttgcctaaggtcatagccttgacacaaaagcagaaccagatctcaaggccatgccttctgagtctgaatctggcactctttctttctgttcccaccaatcactatatttatttgaaggtaatctttttatttatttatttatttttactttttatttttatttattttttttttttgagatggagtttcgttcttcttgcccaggctggagtgcaatggcgcgatctcggctcactgcaacctccgcctcccaagttcaagctattctcctgccttagcctcccgagtagctgggattataggcatgcgccaccacgcccagctaattttgtatttttagtagagacggagtttctccatgttggtcaggctggtctcaaactcctgacctcaggtgatctgcccgccttggcctcccaaagtgctgggattacaggcgtgagccaccactcctggccaaggtaatcttttaaatattaaaaaatctacctgccaattatacgtattcatgaacaaaattaaatatgcctcaaaagctgaattaatactaacaattataacacaagcttagccaatggctattgtgttacctataatgtttcatgtgctttaaacacatgatatcatttaatccacatatagatcctattattcccattttatagatcaagaaactgagaattaaagaaaaaaatttatgcaacagcacacaactagtaagtgggagatgcaatatttgcacccagatccatgtcattccttagccagggttcttaacctgtgtactgtactacctcctgtatggaaaagatttccatataactggcaagaggctacatttaattgctattttcttgaggatttcctaattatctcatcgattttaacttcagtggttaagttcttcctttgtgaataatggaatgtgtaacatttctagattaaacgttcttgtagtctagcagggtcagtggctctcatgcaagagtgtgacattatttgtgtgagagttttttgaggaggagggatgtgggaattctttgcaggtcatggtaatctgaggttacatgaccaagagcatctgagtcagcctgagtctggaaacattcttggaatctgggttccaggcagctggaatcaagtgccatgagaaactttgaagcaaagctgttgggtttcaatgggaggatagaaaagtcacaaaagattatcttagtaatgagatgctttgaaaaatgagcagtattggagggtacagggaacattgaacaaagatacgtatggggaaatagaagactttgtttagagaatgtagagaacattagagtagggaagtgacaaaaaatataaagctaggatcatgttgtgaagccctatatttcaggctaaggagcttttcttgataggcaataggaaacttttgaaggtttataagctggtgttcagagatgactggagttgtcagtagcagtcttgggtgaaagtgaggaaagactagaggccaagatgccatggaggaagccaccatagtgtcccggtaatgagcacatgggctcagaaggatggagacagagagggaggccatgagtgaatgtgcatggcactgcagaggagaaagggaggggaagtaggtatgtcatctaggtacctggaccctgtggttaggcttagccaaagtaaggaaagggtctgagtggaagaatttctgttcagagcgtgtttgtggtgctggcaggctgtatgttgcacacatttggaaatgtggaataagttcagtataaaaatagaaatttttggccaggcacagtggctcatacctgtaatgccagcactttgggaggccaaggcaggtggatcacttgaagtcaggagtttgagaccagtctggccatcatggcagaaccctgtctctactacaaacacaaaaattagctgggtgtggtggtgagtgcttgtaatcccagctactcagaaggctgaggcatgaaaattgcttgaacctgggaggtggaggctgcagtgagccgagattgcatcactgcactccaacctgggtgacagagagactgcctcaaaaaaaaaaaagatggaaattttagaatttccctagatagaggggattttgaagcaacagaagtagatgaaattaccaagaaaaaatatacaagtagaggagatatttacacaagtagaagtagcaggcacggggatggagaagtcagaaaaacaatgcagttattcattttatatatatatatatatatatgagatagggtcttgctctgtcacttaggctggagtgcagtagtgagatcccagcatactgcaaccttgacctcctgggctcaagtgatcctcccctctcagcctcctgagtagctgatactacaggtgcatgccaccacactcagctaatttttaaattttttgtagagatagggtcttactatattgcccaggctgtgtcaacttcctgggctcaagcaatcctcctgcctcagcctcccaaactactgggattataggcatgagccactgcacctagcctgaaattattcattagtgtggaaatccagggtagacatatttatgagggaggcatggtcagtagcgcaaaacattactaagaggtcatggaggctgagtaccaagaatggaccattatacatagaaattaggtcttcgtttggtgactttttttttttttgagatggagtctcgctctgtcaccaggctggagtgcagtggcatgatctcaactcactgcaacctctgcctcccaggttcaagcagttctcctgcctcagccccccgagtagctgggactacaggcgcccgccaccacacccagctaatttttgtatttttagtagagacggggtttcaccatgttggccaggatggtctcgatctcttgacctcatgatctgcccacctcagcctcccaaagtgctgggattacaggcgtgagccaccgcgcccagccgttttgtgactttcaagagtgaagttgtactagaatgctcaagatagaagcctggttgcaaatggtcaaaagagatgtaagcaggtaggaaatcgaagacatgtgctttgcaaaaatacaaccatccaggaatggtgagagaaggacatagtttgtgaggttaacaggattatgtaacattttgggaattttgtttgattttgtttgtaagttatggtaagaccagagaatgtttctttggagtctgagcggagaacagatgaaagttgtaaaataaatgggggataagtgatggacaagaccaagtaagaggttagagagattgggattgaaaatttagttaatttctcccaacctcagcagggagaaaatgacagtcagctcagaattcaatgaaaagcccatctctgtttcagagtgggggaagaaattatggatgattctaatttttctttcagcttagctgtattttccaatttttctagaatgtaaaaattatttgaacattaaattttatttttctgaaagagcacatgagatagctgtctcatttgtccagtagtgctgactgggtgtgacagagttttttacctccctcacagcttcctctggggtcaacccccctgcccctatgcgccatcttcgtcacacctctctgggctgctcagtcctgatctgatagtcatgaaggagagcaagcaacgtttacctttgtagaagttagaaaagtgagacatctttctgctatgtttgaacacagtacagtgttctgtgagtacaatgtacaatgaggaaggcgaggtagatcatgtaaatgctgaaagctccatatgtgcttgatgactgggaagaaagaacaataaaatttaagaggaaaatacttgcctgtgtactgctttaaaagctgtggcctaagtatagcaaagaagtctcttcatatttgctaatactcattaattgcttattaagtatactcacttaagaattcacttttattaagtaccttcagtcttctcatcagttttgcactaagacgcgtacgctactgttcagtatagtgtttatatggatgctaaattggtacagatttctcctttaaaaagcatgaaatagataattaacttccatttttatgaatatttatcacagtagattaacttgaaacatgtagctttttcagtgtgcggcaataaaacggtatagtgattttgtgttttagtttgtaaatgtattacctgtacctagtgttatttgacaagtatctttacaaaattagatattagtcccatgctccttgaatttgtcacctgctcatcaagcaggccaagaatatatttgggtgagaagagatagactatcctaggctaatccttatggtaacaatggtacctggaaaaatgtcggaaaacaatttcccttggttttgtgtttgttgcacaatcaaaatgcagctgatgggatctgttgagttagtgctgactggtggtagcttcttctgggatccttctgccagctcctggactgagcactgtcccatctttcagttgctggaatgtcaccagcacagttagaaccctggtggtgcagggcacagcagcaaggcccacggggaaggaatgcccagcttgggcagagccaagcaagggtgactgtagcaaccttgttaccccaagcttaactgttcctctgtgacccttactggtatcactttgggccacttatctgcctggcacatgtcaaaactacctattaatgtccaagggccagacttgctgcagaatccaaagtttatattgataaggctgccacaaaataaattcagttcttctgtatcagccatgttacattctggctctgattatcaaaggtagaccttaaattgccttccgttccatgccactcttgtcctagctttccaactacaccctcccacactctgtatccagcctccccaccctgccagaaggtagtggtgtttctcattttatgactgtattaatgatagagctaagctggctgtcagtcatgatgcttcactccacatggattagtagtaacataactatgacagaacttagaatttgttgtaattcagtggtattttataaacacagccctggcctaggactgactaaacactaaatactatatctgcatttttctattaagattgcaatggccaggcacagtggcttaaacgtctgtaatcccagcactttgggaggctgaggtgggtggatcacgaagtcaggagatcaaggccatcctgactaacacggtgaaaccccgtctctactaaaaatagaaaaaattagctgggcgtggtggcacatgcctgtagtcccagctacttgggaggctgaggcaggagaatcgcttgaactcgggaggcggaggttgcaatgagccaagatcgcgccactgcactccagcctggtgacagagcaagactccatctcaaaaaaaaaaaaaaaaagattgcactaagtacattttcttctaggctgatttctaaaacattattccaggaagatatatgatttttgttaactttaggaacttttataaaactataatgacttttttggactaaattatatgtcagttttgatcatttgtgttattaatgtttcattatttgctttcaataaaattgtcttactattcattctcccttcaaccataggtatggaacaggatgtttcttactatgtaatacaggccataaggttggttttttaaattaaaaaattgatttaaaagtctaagttcatctaaataatgcttgaacataatttactattaaacaacttttagtctttagcttttacttaatctttatcagggtttaatttagagctcaatacaaaatttgaatcgttctaataagaaccattttagactctttgaattttatatgtgtgtttttaattgtgctggtgggaaatctagactgagacctcatcaaattcttaatgcaaatctaatttgaaacaaggaataaactttttatacagcttaaatgtgttcttaattctgatcgttttgactgtaaggatttattttaaaaattggtttattgattgcattattttgtacctatgttattttaactttaaaaaaaagttctcatgttatcttttcattttccactactgaaatcttttttttttctttcttacagtgtgtattttctgatcatggccttctcaccacagtggcttacaaacttggcagagacaaaccagtatattatgctttggaagtaagttctttttaatcaatatggataatatgacaaacattcaaagctaataaaaattacagtgttttctaacacttttctggtaaatcttaatacagaggactcaaaaagttctgctttcttggcatttgattgagttgaaggaacctgaaactgatctgggtgtcaggactcacaggagaccttgattagattggttcctcagttcttatgccaattaatcatgtcaccttaggcatattacttgagagctctacaatgtaaggttttttttttttttatctctaaagtttaatcggattaacgtgctctctaacatttctttcatcttgaaaattctttgattttataaataaaatgctccagtgttccaaagagaaccctgggcacaaataggcagaacaactctcttcacttgtctcctcataaaaataaattttgtgtaacattttgatatagaaaagaaagtgaggagatttatgccacttatcactggaaacatttgtttcaaacatttttgtatgttatagtaggaatatgccagcctaagcctataggatatggtaagttagtgttagaaatatttatttataaagtcaaagaaataatattctttttgtaaaattagatacatttcttataagcatttctatataattaattttgaaatggctaccttataatgcacaagtatacacttgatctgcagactcattgaggctcattttttggagtgcctgataataatttggtcacaagttaaagacttctagttagagttaaaacattttattagtcattatgcctagcacatgaggaatattagtttatttctatttttctcccttccccaccccataaacactataatatttctccccagctccttttctatggatggaagcatttgtgaaaacttagtctgtatattaaatgtatcttaacacttctcagaacttaaaatcctacaagccctctccctctctactttccctctgtggagagtgcatagcacaacactaggcacatagaatatgcacttgataagtgttacctataatataataagaatatgattctgctttttttcttcttgcatgggaaacaatcagtgctttagaatacaggtgccttagacctgggacaggcctcagggacaggggtcactcggtcttaactcccctcccaatgtgaaaaaccttctcctgtctcctttaccagtagccatccaacttctatctgaagacagcacccaaagttgcttcttaataacacctctagcattggacctgcattggttgtcaaaagtgttccaacattagaggctgcggtcagtttctctgggtcttcctcctccagggtaaactgacccaatgccttgatctcacatggtttctggatgctttatagttctgagctcccttcattgggtgcattgcaattcatgtcgtccagaatggaatataacattctacatctaatctgacctgtactcaatcaataggatgatttgtgcctctcctaccataagcactacttttgctcctctagcctgagagttcattaatttagactaatatttattaaattaatatttattaattaaaataattaatattaatttagacttcatattattggccctgggagcatatgctaaaaaacctagctcgttttcaaatgaatcattgtcaaaccaagtctgctctgttctgtatttgtgtagtttttttgttaaatctaaattcaggtctttgtttcttcctgtttaatttcataatagtgattttagcctattcctatatagtctgaattcgttttcactctttactgttactctttcagttttgtctcatctagagatttaacaagtatatgctttatgattttgtttcaatttatgtaatgcttttagatgcttagaattgtaaaagctcagagagacgctagatcatatgacaatataccctcctatccccttgttttacacgtgaggaaaccgagattagaaaagtgaaattggagtcccttggccaagtaacttttgacaacagtaagtagcagatccagatgcttggacatcaaagccttgatgcctaggccaccctgctgtaccatttccttccttgtaagtctgaaagttctgggctccagtctcccaagtccagtgttgttgtcactgcatctagcttatgtcccttccttcatctgctaacctagcggtctcagcaacaacaacaacacacatacgcatactaatatgttaacggtgtagttagaatttttttctttgttttcttaatttttttttacaattaacaaacatttaaaaaaaattaaattaaaccaaaccaaaaaacaagggtggggaataatgctagactggtaaaactttttatcagtaaacacatgctaatttcacttggtcatactaattcctttttttgtaaatgcttacaaagtatatatttaataatattgtctttcatttgatcaattgttgttaggcttagaagttggagataggaaaattttagtctttatgctctttaaaacctaaaactatagctacccatcttcagtcttttagtctttttccattcttcctctgctgatttgggaacaataagatacatttctatgtttttattttggtgattttttttcttttgcgtataccctcagatttttaagatattgtttaaccatatatttttctaagagtgtatgtcattttttggtatttttaatctcccgaccatgataaggaactctaatattttattctaccgcctccatcaccaattgtgttattttgtttaaagctttcatttcccccattttgttcaacatgtaataattactgttgttttctttgcagtccacagtaaatcatatttattgacttatttttcttagtttgtgtccagtatcatttctttggtctcacaccttttttattcccacctacttttttcctttttttcttcttctttttttttttgctgaggggcatccttctatagttcttttagttttagtgtgggatagtaagcctattctttttaggtttgtctttgttttgccctcactctgaggatgagtataaaagcctatattaacaattgtttttcccacatcccttctggccattttcgatgttgatgagacctctgctgtcaatatgtggttcatttgtagataatctggtttattgtctgggagtttctaacattatctctttatcattgatgttctgtagttttactatgatatgcctgtgtttggatttatttttatttatcctgttaggtacttggatccaagtctgtcttcagatctggaaagttctcagcaattatctcttcaaatattgctcctctaccattacctccatcctcttctggaattgctattggatgaatattggaacctttcaacccatcatccatgtctcttaactgcccttttatatttttttaatctctttgtttctctgtgctgcgtccctggtgagtttctcagtatctaccttccatttccaaatcctctctttaaaacaaacaagacaaatcataaaagccttttttgtattgtgaaatataagacacatagagaaaaatgcattaaatatcaatgtacaacttgaaaaattattataaaggctcatgtaacttgttcatagaacgccgccaatcccaagaacctctatttgccccacgatcacaacttcctccctctccctgagataaacatcagcctgacttttatcataatcacttccttacttttctttgtagttctaacacttaaatgtgcagccctgaacaccagagtttagttttgcatgtgtttaatatttgatatattaaaaatataaaagaaaagagagagagagcatgtgcatgcatatctgagtcacttagtatgtatttttttgtattttttgatctggcttctttcactcaacattatgtttgtgagattcatccacagtattatacatagctgtttttttcattgcttcttattgctatatgaaattattgaagtttagtatttattcagctgttgatgacattcgagttgttttcagtatttggctattatgaaaaatgctgctatgaacatttttgtatatgcctcctgatgtaaatgtattcacctttctgtaggagtagaatttctaggccatagattatgtgtatcttcactttgagtagatagtgcaaaccatttttcacagtagatgtgtcaagttacactcctaccagcaatatgggggaatgctagtttactcatcctctctatctagtctagagtttaccccatctagtacatttttcatcttatttaatattttcatttctatagtttttatttggttatttttcacatccacctgattttgtttcagttctcttttttttttattcttagtttcatgtttgtttgtttttaaaatggaagtcatttcctaatttatctccgaatacttaaaacatatgtattttaaaatctgtgttaggccggaatgaactctagtccagctattaagtttgttggatttcttttttcttttctttttttttttttttttttttttttgagatggagtctcgctctgtcgcccaggctggaattcagtggcctgatctcggctcactgcaagctctgtctcccaggttcacgccattctcctgcctcagcctcccgagtagctgggactacagatgcccaccaccatgcccggctaattttttgtatttttagtaaagactggaaataacgaagtttcaccgtgttagccaggatggtctcgatctcctgacctggtgatccgcccgcctcggcctcccaaagtgctggaattacaggcgtgagccaccgcgcccggccttgttggatttcttaatacaagatttcttcgtatagtttagaattgtcacttccagccttgtcttccattaagccatatagcctcagtcagcaaatacacagttgcttgtttttctagcatccctacacaagtaagagagcgccacctagctcctggcttcaagcattgagcctgattctattccctgtcttgcgcaaaacattttggacccctttcttctggaggaaccagttcccagccaccactcctactccctgacacatatagaaaaataaatcagaagccatcatgcttgtggcttcagtcctgtttggttatgtgtttccgtgtctgtccacatagatgttattctgtatttgagtcagcatgttgtttcagttttctcttttatatcgtgtctgttatcctctgtggttagaacaaaggggatttttgaagtacaaactcattatttctgctcatgtaagcatctgcatcttctttttcatcaccaagagaactctttttctctccctgaagcccctggcaggtgatagtaaggcctgacattttaatacctctaaattctcattttcattatttgtaaaaagaaataggtgttcatgatccttaagttgttctgtgacattaaactcatattaaactggttaaatttgtcccaccctttctagttggaaaatatttctcagtagtggaagagactggagcaaaatagagccattgagtggttctgccttccctctggcatccttgttcctcttctttttccaaatactgtttcacaaaacaaaaatccttttgggaacttttaatatgagtatgaacctgagcttacttatgacttgagacttccatgttccgtgttttgtcactagaatatagatttcctgaggccagggtacttgtctatcttgtttaccactctgtcccagcaggctggcagataatacatacccattaaatattgttcaaataccgaatcctatgttaggccatttttttctttttaaatatgagcttcaaagagggttccctatattgcctccctggtttctttaaatatctcttcccctatcttttctttgttatggtttaacgattatagcgttaagatttcctttttagagtttttcatccttcttgagctaaatccctattttaggtataaacctatgtaatagattatctattgctgtgtaacaagattaccacaaacttaagtggcttaaaacaacacatttattgtttctcagttcccatgggttcagaatccaggcacagcttagctgggtaccctgctcagagtctcacagggctgcagtcaagatgttgactgaggctctgctgtcatctgaggtttaatctgcttccaggttcattcaggttattggcaaaattcagttccttgtggttgtggaactgaggacttcagtttcttgctacctgtcagatggaggccaccctcagctcctagggctacctgcagttccctgctatctgagggacccccagtggttctctgcttccttaaagtcaggaagggagggaatatctccagcaagacaggcacagtaaatcatgtaatggaagcacgtacacatcaccacacatatcccatcacttttgacatgtactgttgggtagaagaaagtcacagatatcaccacgctcaagaggcgaggattatgcaagggtatgcacatcaggaggcagggatcatgggagccaccttaattaaaagtctatctgccacaagcatataaacattgtttatgaacttttataatgttctttcttgaaaagtatactttctgagcaataaatgcttttaattttagttccccaacttgttactgaagtattaatgaaatctgttacatttcaaaaataatgttgctccaattcaactcttccctttctctatgcaattaaaaatgctatagagttagacactgcatttgtaatctaatatatacaaattaactacattataaatcatatacgtacagatacatagcactgtagtatacacaaaactgtgtttgctatgcctgatgaatgattgtaagcaatttagggtaatctttactttacctgatttttctccatactcaccaattttcaccctaattgccttgtaagctacaattctactgcatcctgaaatatcctgctttatttttatactgtttgtggcagtggcattcatgtcaaggagcttttgaagaaaaatgtatttgcctgctatgacattacatcagatctacttgattatttttaattcaatcttcctatagcctgtttattagcctttcactttccaggctacatgtctagttttaaaataatttattcctcttgccctgttataatttaatttattattctttacaccctctcactttcattgcatctcccttagtgtacaactattaagcttgcatgcatcttttccagggaatcataacctagaacaagggctgattcaaatttgtagatgatatactaaagtattggatctttatacttagggtgtaatttatggtaacttaactgataacaagtagacagtcaccttcttttatcattttaggttttggctgctatactcttttcctgtccagctttgaaacattattaccatcttccattttatttcctgcctctgaattcagaagaccacatgtcttttgtgaattagagatgtctctcatttttatttctttaaaagctaaatcataccatgtattatatcctgacagcaaaattatttacttttttcagataagtgtttttatctaccttttattgtgttatattgaatctagtttttcaatcacaacaaaacacttctgtgtattcctgatgacagaatttaaaacagttatctcctggagccttaacagtgactatgtattttttttcttttgttttaatctaaataatactctgattctcaactaattacctctaatcaaaaccttgattttccttttgctaaaatcatattgctttctcttaaaaatatggtgtaagcatgtaacatcctatctttttcaatggaaatgaggtatatcagcacgtggtttcctagagtataaagtcccaccagctgtgccacaaaatcactttactagactcctagcacagtggcttctaaaaattcgcagtttaactgtacttgcctaaaacaattatgtatgcatttcttggttagatgctatttaaggacagtgtctttgagagtataaggaggagggacacctgtttttgtttttctttttcaattaggtctagaattatactgcccatggcagccatggccacatgcagctattgagcactggaaatgtggctagtctgaattgagatgtgctgtaagtgtaaagtatataccagatttcaaagatagtacaaaaaaaaatctcaataatttaatattgatttcatgttgaaattttttttaatacattgggttaaataaaatattaattttaccttccttttacctttttaatgtggcaaaaatataaattacatatgtgactcactttatatttctgttggacagcactggtctagaaactcttacatatttactagtatttggcagctgctatctctgaattgtctgtttccaaaggaaatttgaatcttaaatctctttaaaccaaaattttacttagttctcttgaatgatcccactaagtacctaaatatgtaaatgtgtcaaacttaatacaacaacttattttaggcagggaatgagctgtgttagagtcccttgtaaggtatttcttgaattgtttttgtcccatttttaaagccttgtcatatttgcacagctatgccagatctgttcctcaaatacttcctgtggttaaaaagccattttatatatgtaatgatacagagtactgtatgtatgtctacatatataaaaatgtataaacagaacaattgtggcattctgtagctttgcagtaacatagtaacttctcatagaagctatgaatgatggaatataccagcatattcattctctagtttacttacattttgacaactgacaacaagaaggcatgaccatttgtaattcagttaatagaactgaggacaggtccctacatttaatattacctgacgtttggtttggagtgactctgtggaagtaatttacattaataatctatatgaatgaactatcagagctaaaaaaaatttcttggtattcctaatggttcgtgctgatacttctttttttttttgccttcaggatctttttataatagctttattgagatatagttcatattccacacaatttacccttttcaaatatacagttcaatggtttatagtaatactatatttacagatttttacaaccatcaccacaatctaactttagaacattgtcaccaccccaaaaagaaaccccataaccaccccctatcccccagcccaggcaaccactaatctactttctgtctctatggatttgtctgttctggacatttcatatgaatgggatcgtacaatatatcgtcttctgtgcctggcttctttcactttgcataatgttttcaatgctcatccatgttgtagcatgtattaagacatcattccttttcatagtccaataatactccattgtgtagacatactgcgttttatctattcatcagtcagtgatatttggctgatacttttttaacattaaagaaattaatgaagtcaatatttacatttagtaagaaccttcacatatattctcatattgagcctcacagtaatttgtttaggtaagtgttgtcatagtcatcattttataggtgaagaaatggaggctcagaaagcctaagtaacttaggcaagttacttagatgaacttgctaagattaacttactaagttacttagattagttactaagattacacagcaattaagtactagaactgggactcaaagccagtttatccaactctgaaatatgtttttattgttattgccacagctctaggtgattttgttttaaagaaaaattacttactagctagcttctttgctttttgttttcttgatttactatactgttagatatgggaaacagacttgaaaaaacttttaatgtggcctctcccaataattttatgaacaatatggcaatatatttctaagtgataacatacctcagtagcttagcaacagacagaaaattgttcaagaagcaaactgatcaaagatcaatgtccacctatggggacaaatccaagggtgtgctggaaagctcacttcttttcctcatcccgtgaaaaacttttattagtgacttagataaaactatgtttgtattagaagacctagtttacatatttgtcggagtctcaaaatggaaactgaattctgtccatctgattgtgtcatacacagaatatgctcaataaaaaccttggatagtgataaaatatattctgtcttgaattcctttttttctttagggttctgtagctatagctggtgctgttattcgctggctaagagacaatcttggaattataaagacctcagaagaaattggtgagtgtgttctaacaaaaggttagaaaatctgaaaaatgacacatttcagtattttatctctgcaaagtaaatacttatgctttgccccaaatgtgatccataaattatatggatccctattatgagtttgacttatgcaaaagactatcttgtgaagatttataaaacaaggaattgacataattagtggtggttgttaataaactggcaatgtagggcataaaaattacccaagtgtaaaattgaacactggagattgccagaacctgcagatagagaagttgagttaaatttatctgatgagaaagagctttaactcttagattagagtgagcattaaaactctggtacctataatttaagtattaatacggctgttttcagtctatagataattagtttgaacttacctactcactctttcatccacttgcttaactttgcctgaaggtgagacaatcagaaatacatttctgattagggacacactagaggccactttttcatctcctagtcagcaaccttaaaaatagtggaaatgagctaaaataccttaaataaatgaatctggttccttgatttcttgagctaggctacattttagtggggggtatttaatgtgagagaaactcatttctgttgatcctagcatactactgtagttagcaacattttgctctaccaatgaattggaaaccaaaacccctgtcctaatttttctaatttttaaaataggtatgcttatataataatacacaatatttgtgtgatttttgttttgttttgtttttaatgttagaaaaacttgctaaagaagtaggtacttcttatggctgctacttcgtcccagcattttcggggttatatgcaccttattgggagcccagcgcaagagggtaagtattgaaaatatggagtgcttttggggatcttgatttatttaccaaagtcgttaataacttattagtttcttatctattttcaaataattataatgtgttgagaaaaccttttctttttggagaatataatttcagaaactttaagctccaagaagttatgaatcagctgacaataacccctgccatatccgtattcatgttatcttttatcttcatgatgtctgtaagttgtatagtgaagggacatcatcataatgaatactgattcagttttatgatgccatcatcttttcaaatgtgtcatgaattttttcatacatgaatgcagaattgtgaaatataaggactttctgagttacttaatgattatgtccaattttctcttcctggacatttctgtctaccaaatttgaccttttcatatttgagatatttcaaattgattggtttatatcattctaatctgaaaatctttgtgcgtatttttaggataatctgtggactcactcagttcaccaataaatgccatattgcttttgctgcattagaagctgtttgtttccaaactcgagaggtaacaaatatgggcctgttttcttgtacttagttcacttttatcactcttaagttatatgttaacacccgagatttattcagtactgaaaatgtagttaatcaaatattaaggctgcctaaatactaatctaaatataagcagggttttccccctttttccagctgtcattaccttctaagttcctgttccctgtcaggcactgggaattttatggttgtggggaggctgagtggcacacattaggcaaaggaaacagcacaaacataggcatcaaggcagaaaaacagggtgcaaaatagagttgtatagcttagctgaatatcaaggtgaatgcagaggtgtagtgagagaaaaggttggctgtgaccagatcaaagagggcttagaagaccagaataagaagtctcaatttattccataggctcttggaagctcttgagagtttctgagtggaggattgccattttcagagatgttactatgaaatagatttataacattaattgcactggtttatttaagattttggatgccatgaatcgagactgtggaattccactcagtcatttgcaggtagatggaggaatgaccagcaacaaaattcttatgcagctacaagcagacattctgtatataccagtaggttagtaagtcttcattcctttaaactcccagagtaatgtttcttgtggaataactagttctttgggcatatgtaaccacaaagatattgatggaactctctctcctcagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggagggtacatttaaagaatgaaatgttcagtgatatactgtgaaaacgaccttagtgcacgggagttttgtttttctgtttagttaaaagttaaggaaccaagtaaaatagtaaatgttatcattgcagattcggctgccaagcatattgggctttactgaataaatgtgaatgagagaaatcgttgcttatcaaaagaacttctaaaatcactttttaaaaatcatttgcttttactgtttatggtcctttagtgtaggataataatactgccacactgtcaggtatagctagttagaatagcctttttttttttttgagacggagtctcactttgttgcccaggctggagtgcagtggcacaatctcggctcactgcaagctccgcctcccgggttcatgccattctcccgcctcagcctcccgagtagctgggacaacaggtgcccaccactacgcccgcctaatttttttttttttttttttgtatttttagtagagacagcatttcaccgcgttagccaggatggtctcgatctcctgacttcgtgatccgcccgccttggcttcccaaagtgctgggattacaggcgtgagccaccgcgcccggccatagccttttttaaagtgagaaggaagatatatcagccactcatccctaatgtctacaccagatcatctttggtgccagtggcccagttttaggacataattagctgggttaagagacactctggtaacttttaagcacagcaggactaacctgatgaaggcagcaacaatttaagtaagtgaacattagatatctgattcactgtgctaactaagctaagccacaagctgtgatcagcacttttactaaaatgtagtgatgcggttcttaaatttaaataaatgtagaaaaataaggttttatatattagaattggttttataactttttagaaacctatgcataaaatagcatcagctgggaatggtaatttgtgcctatagccccagctacccaggaggatctcttggcttgggcccaggagttcgagtccagcctaggcaacataatgagacccctgtctctaaaaaaacaaaaggaaaaaaaaagcatcaaagtggattttgaggtattgggaataagctttcaaatgcatttttgtttggttttctgggagaatataccagtgtttctcaattttattcattcttttaacatataagaaaatgaattataatactagtaattttatagtcagattataccatgtaccttgatttagaaatgtatttcaccatctgatattctgtcatttttaacttttgcaatactggataaaatatgaagttcaaaaaatttttctacttttcaaaaaaaatcaactttataatatgcaaataatgtccagagcgggtatatggcctctaaatgccaatctcactcttaaagcaaggaagttctgtgccaagagagccatctccattcttaggggagccatctttgctggtgttgaaggccttagcctggggttgatcagtcatgccctattgtcctccctctcaccagccctcactcctccccataaacgaatgggcacctaggcatagatagtacattttgccagcaaacagttgtttatagccaaccacaggccagagactgtactgatgtggggatatagagatgaataaggccttatcttcttatcttcttttgcccttcagaagattagagtatattgggagcagaagacaaaaccataaaaatttggtagctgacatcctggggtgtgtgtgaagagagagggggggatagaaatggggcactggaaagctttctgaagtgagtgattcttgagccttctctcctgggtgttgcaggcctcaggtgctatggaaagtctgggaggcttgagagaaaggtagccccacatggggttcagcacccttagaagtgtacaacatcaagctcatttttgtttagactttctattgtggatttccacctttaaaaaatcttgctttaagatgctggggttggggggcatggggctgtctcagaggaatgcaattcaaatcttatgagaaatcagtatttgttaaatcctgtgactgaaataaaaacgtctcctgcggggcgtggtggctcacgcctgtaatcccagcactttgggaagccgaggcgggcggatcacgaggtcaggagatcaagaccatcctggctagcacggtgaaaccccatctctactagaaatacaaaaaattagctgggcgtggtggtgggcgcctgtagtcccagctaccggggaggctgaggcaggagaatggcgtgaacccgggaggcagagcttgcagtgagccgagatggcaccactgcactccagcctgggcgacagagcgagactcagtctcaaaaaaaaaaaagaaataaaaatgtctccttctagtcttcccacattacagcatacccttttcctcgtaccctttccccccaaaaagaagagaaaacagatcaaatgggattcccctttctaattcattaccacttgtttgtgagtggcccagtctgcatagcaggcagtctgtctgccaatctccctttaccctgctgaatttcccctatcctgtttttgtttgtttgtttgtttgtttgtttttgggaccgagtcttgctctgtcacccaggctagagtgcagtggtgtgatcttggctcactgcaacctccacctcccaggctcaaatgatcctcctgcttcagcctcccaggtagctggtactacaggcagggttttaccacattgctcaagctggtctcaaactcctgaggtcaagccatcctccctcctcaccctcccaaaatgctgggattacaggcatgagccactacacccagcctccctgtgtcctgtttcactccaacttccaagcaagcatgtcttccagtcactggcagtcatcagcaaccatgtgctttcaaatctgagtcctgctaaagccctactgcagtttaatgtgtgcaataatttgtcaagaatgttgagtgatcataagtatggtactaagaacatctcagcaaactacctttcgttatgtgttttttctaccttctaattctagaaagtgaaattcgttattctacatggaagaaagctgtgatgaagtcaatgggttgggttacaactcaatctccagaaagtggtaaaaatgtttttgtttattattgtcacattttcttagtatattaaatagttatttaagtatctaggcatttacacatagccaggctgctctgaagaaaagcattatcatatgtccagagattctgacattttgaaaacactttaaagttctaaacacaaaatgtaaattatcaggttgatatacatactttaactttatcctgccatatctttccttattagtttattcttggtacttcaattgacaacttagtcttccaagagtaaaattatttctagtttcttcttaatgaaaaaaaaaaatcaactagagtcttcatttttttcccctctcctcttactttacctttttggggggctgtctttatgacctgaaccaactgaaagctgtattaatttcagaatatattctgctacttcctaggctgattccaagtacataatgggaattcctttggaatcagagaaagaaatataccaaacatagtaaattcgaactcttataaatagattgggaagtgctcttagcagaaaaaatagtggactattctacctttcagtcacttaggaaggtcaagagcttaagtaaaccatttagatttaaacagccttaagatgcatagtattattattttttgctaaatgcaagatgtggagcataatgaatggaacaatggcagataatttattgaagcatatacttttttttttttttgagacagagtctcgctccgtcacccaggctagagtgcagtggcacaatcttggcccactgcaacctccgcctcctgggtttaaatgattttcgtgcctcagcctcccaagtagctgggattacaggcgcccaccaccatgcccagctaatttttttgtatttttaggagagacggggtttcaccatgttggccaggctggtctggaactcctgacctcaagtgatccgcccgccttggcttcccaaagtgccaggattacaggtgtgagccactgcacctggcttgagcatatactttaatggggaagagttgacaaatgaaataatacctgccttccaaccccaaagttaatgtatctgttttttaggagaagcttccagaactatctactgccacagataactgtggtctgtattttcagtcccggatgttcctatttgaagcttttgtttttctcctaaataagcttaatatcttttgttgtgagactcagcttcattttccaagatggtggcaacgtttttcttgctaagactgtaattttgagagaccctttacaactaaacttctcaatcataagtacttttctagcacagtgctagttgctgtgtgagatataacagacgtaagccttgacttcttttctagttgcccttaattattgcttataggaaattgagttacattatttctttaactagctggatgttttaaaatggcactttaaatggcatgtttaaaatgacattttgttttgttttttgttttttgagatggagtctcactctgttgcccaggctggagtgcagtggtgggatctgtgctcactgcaacctctgccctccgagttcaagcgattctcctgcctcagcctcctgagtagctgggattacaggtgcctgccaccgtgcccggctaatttttttgtatttttagtagagacgggggtttcaccatcttggccaggctggtcttgaactcctgacctcatgatccacccgcctcagcctcccaaagtgctgggattacagacatgagccaccgcgcctggccttaaaatggcattttaatcctcctgtctccctccctccaaccccatgccttacacacagatacacagttctcctcactagcggttgaggatgtaattttaactgcaaaattcccacaaaatcaactgatcatttttcccttgtttgtgtactttactatcaatgaatttaaaatactaagaaaaagttgataaaacaaacaaaaaaagatatcattgctccaatttctgctatcagcattaatgataaaagtaatttgatcttttgagagttttatattttaaagaactttgtttttgtttcagttaggctgcagtggatttaagccagtttgattttttttttttttttttgagatggagtttcgctcttgttgcccaggctggagtgcaatggcacgatctctgctcaccgcaacctccacctcccgggttcaagcaattctcctgcctcagcctcccgagtagctgggattacaggcatgcgccaccatgcccggctaattttgtatttttagtagagatggggtttctccgtgttggtcaggctggtctcgaactcccaacctcaggtgatccgcccacctcagcctcccaaagtgctgggattacaggcgtgagccactgcacccggcctgaaaatgttttttgaatagatttatgaaaaacactctaatatttaatattttgggggtctctaagctgtataataagcttggaatagtaataaaatgctagttgtattcctttaagcaatctaagctatataactatataagttatatgataatagcaatatagatagaatcctattttgataaacttgagaggatattagaattgctacctgtatcttaacctatgggaagaatatcaggcttgcttaagtttcaaagcaatttgccaattttgaagcaatcataattattttcttgtttgtgactatatttgaatgctttgtaaacaatttttaacatacttttcatatgtgtttaaaatgtattgtcaggtgcattttgttacgcaccaaattctattaaaaaaataaaactgaactaatattttagcaaacatagggttttaaattcatcttaggacactaatataactcttctctcatggccaaaagagaactataatttgaacttaggtggaattaaatagatcatttaatatatttgggggaagaatcaagaaagctaaaattaacagcctcccaaaaagttatccataggctcactctggctttgccagtggaaggctaatgttagtctatatgtattatgttcttggctgtgtggcatgctatctgtattgtttgttaactgtcataaaccttcaatattgattatatttttgatttgaagtaataactctttgctagcttttatgaatatactatttttatagcttattttgttttgctatcttgtgattcttaacacaaatattgtaattatgtgtctctcttttggtttgcttgactggaattctcttctgcttggatgaccacaggtgaccctagtatcttctgtagtctgcccttgggcttttttatagtgagtagcatggtaatgttaatcggagcaaggtacatctcaggttagttactctttaaattagacaactctattagttagctttaatgttttcgtgtataacttagcagaaatttttcagtgtttttcattctttctgtgtctaggaagctggaaaatcaataaaaggtctaattagttagaccaattaatctttgggggcagttagaagtaagaactgtgactctgcttaccctttttaaatttttaatgtgatgacttctttaagagggactacattctgctgtcagctgcagcaataagcaaaagtgaaaatactaatatttaaatgaaaggactttcagactgactgctgaaagttaaagtatacttttgacattaattaaattgtctttcaaatgtatataaattatttttcataatcctgaaaatttgctaagcaagtcttaacttttcaattctggcaagtttcagccagagcatgtccacagagttcctgtaaaaccctaaaaccagggaagatttatagttactcttattttagttaaaagaatatcttttatgaactgaagttttaaaaatgattccttaaatgaaggggttgaaatgaaaacagaattatttttccacattaatttatactgaataatctttttttaataaaagtaaaatggctcagcatgttatggaatatattgcataatcttattaatttataatagccatttgtggaagctgctcctggtgatagctcaatttttcttaaaattactggcttaaatggaaatgatgcttcttattctgtatgttcccatgaaagtgaaacttaaaaaaaaaattcatgattagggtttcatgaaaaggccttgtttctatgaaaattgagacaggttgcatctctctaagctaaaagatgggctatgtgtctagagtcttagacttctaaaatgcatgtggtcactatatgtaggttatctcttcggtgacatacactgcaatttgagagggctggaaattgtttgccttggtaaacgattagcaacagtggcaatatttgttaattttggaattggccctgtttgttgcattttaattgtgaggcatgatttagaaatcatatggactttctagcttaataaatgattgaatcatctgcattgctttaactcctgaattgtatgcatgtattattgacatatatggtttttgttccccatttcaggtattccataaaacctaccaactcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctatagaaatatttggtggttttttttttttttaaacatccacagttaaggttgggccagctacctttggggctgaccccctccattgccataacatcctgctccattccctctaagatgtaggaagaattcggatccttaccattggaatcttccatcgaacatactcaaacacttttggaccaggatttgagtctctgcatgacatatacttgattaaaaggttattactaacctgttaaaaatc

SEQ ID NO: 5559 - DNA, 75760 bp, human
tcacccaggaaaccggccgcaatcgccggccgacctgaagctggtttcatggcagcctcaaagaaggcagttttggggccattggtgggggcggtggaccagggcaccagttcgacgcgctttttggtgagcccggggtgacatgtgaagaggcgctgagccggggcgggagtcgggggacggagggggtggctgttgtgtccccatcccgcatctctccggcccggtgccccggccgctgggcaaggagggaggccggaacgggacctgccacactggggatgccccagccaggcctgggggacctcggcctctcatgacccccatggccgagttgaacagtcgcagttttggtggcggagctgggtcacctactaatggggtgactcttcccccaaagggagcagggactctccgagcatccgcgcagagcggcccgcttgcagtaggggacaggtggccacattgacggctaccgcggtcttccccaggaacatttggcctgcgagacacaggacgtccttggatggggggaaagctgtgtcacggctgtggtagctaacacagcgtcctttccagcagtagaacgaataaagtattggagtgatgatgcgttgtcatcctctcccataaaaattgcagagggttgaatactggggagggtggcagaacaaattaggaaacagtcacactacactggttttgccataatctttatttaattccgaagactcgcaaatttcagttctgagactttgcccattacaaacaaatgattgtccttactgtgcttcacagcataatgcgacacggaaattctgtttctctttttatttaccatgtgtgacagcacagttttaccacaaaagattgctatttaagtgactgctgattaatttttgtgcaattagtaaacttgctcttaaagtgacctagcacagagttcagtaagataatttaaaagtaattgaggccgggcgcggtggcttacacgtgtaatcccaacagtttgggaggctgaggcgggtggattacctaaggtcaggagttcgagaccagcctggccaacctggcataacaaaaattagctgggcgtggtggcgggcgcctgtaatcctacttacccgggaggctgaggcaggagaatcacttggacccgggaggcggaggttgcagtgagcagagatcacaccactgcactccagcctgggcaatccagcctagccaacagagcgagactctgtctcaaaaaaataaaaataaataaaaaataaataaaagtaattgaaatgaatgcctgctgataaaagcccatgctttcaatggatatttgactaacttggcaagttgatgtaaatatttaatgattatttagctcttcactttaccgcaaatcatgttttcctgtgttatttagtatgtatatatctgtacatatatacacatatgtgtatatttatacataggcattatacatacaatgtatatattttttcaaagttctgtcagagctggcacttgactaaaaactgcatttgtgctttgatcctgacatatctttttttgtctaaagtgagaagctttcagtctaattttggtttgaatcttatttaatgacttaccctggtttgagctgccaagcatagttccactgtctcttgcactgtttatcttttgatcacccagggcaggtttcactttgtcttatattcatagaaatgtttatagagtaatcctgaatcataagaaagtttgcttaactggatttgattaatacataatatacacgatcatcatcttcccaacttaagaaagaccattaagacatgtgccaactaactgtgggttgatgtttaaagccatattcaagaattgcccacacaaatgcctgcagggaccaggcaggtagaagggggaaggcagactagagagatatccaggtcaaggggacagctagtagctgccaagcaggaacacaagcccagtgctgccagatcgtcagattaaaagcaggtagtctagagttttcaatgaaatctttcaattcttaaatgttggcaattagtttataaagcactgtgggggccaaaccaagcatggcagatgttctcaagtttatacagcctttgctcaatatgaaaatgggtaaaatatttcataactttgtaggcttcctttaggagtcagcttgaactgtccatgccttctttttgactgttcattattgctgtccatgtagcccagcaatcttctttattcactacaggttgttcttggtccctcaggttttgttgcctaaaagacatctttctacatcaatgaagaagaacttgatcaacttcatattaccacaattaattgttcagtctgtaacatgaacaacatgagccttcaaaaattggctcctgtttactgggttctgtgaggcctcgtctcattgcatgtaagctaagatgcaaattcagaagattcttatcctgcttagagaatgattttataaaagttgatcagtaaaattgtcctctccttgagaaacaactatgaaagcatgctctagaggcaaataaaaaaaccgtagagatcctgtgtgaagtagtgaaaaacttaggaatggtttagcaaggtgttttttcctttgtttataaggagagagattgctaaaccactccctgcaaaatgcagataaaagatttgctgaataagtgcttcaatcacaagatgattcccgggagttattccagtcatattactccacgttgtaattatgactgaaaaataattgcttacctctcaggaaagaatacagtggataagaactgtcataaggaagcttataaaattaaagatatttaagtaatttcctattattcattaaatttgcatatttaacttgactttcctgagaccaataatctctgcaagctttcttcttcttttttctctgttagcaatattagctttctcccataaggagaaaaggctttatctgtgctctttcatcccagggaaatgcctccacctctatcccacatatccgcttctctacctctaaatagtggctcaactgccaccttttagtgtaagtcttcctcaaaccgttattcagaattccccccccttcctacagcacttttaaaaatacttctattaatagctcttattaccttcccccttgtattataatcgtatacctgctgtacttgggagcagggtcctccttttaagctatttgtcatgttgaccaagatgttttatgaaatacaaagatgaacagcacttaaagactgttcagagagtgttttatacatgtttattgagtagatttttatttctctttaataagttaactgaattattttttattttattttatttttttgagacagaatctcgctctgtagcccaggctggagtgcagtggcatgatctcggctcactgcagcctctgcctcccaggctcaagtgattcttctgcctcagcctcctgagtagctgggattacaggcatgcgccaccacgcccggctaatttttacatttttagtagagacggggtttcaccatgttggtcaggctggtctcgaactcctgacgtcgtgatccacccacgttggcctcccaaagtgctggtattacaggcgtcagccaccgtgcccagccaagttaactgaattttaattctggttttctttcttacctcttaaaacattcttgggtacgtttggttacttaatttcttcttacattttagtagtagacatacaatagaacatgttcatttcctcatcaaattgtcaaagaattaatcttgggaccccatgcatatgctttgtacaagcggaaaatttccaacttatctgataggaaagtgaattggggttggcacatggtaactcagattgcagagtaggaacttcttggaaagagaattagtgtaacaggttttaaggaggggccatttctttgtaagacaaaagtttcagcttaaacaatcaacttccttctttaatttggtaacttaattttttccccactatgatgattttttaaaagacttgtaatgtgttgtggcttgaaatgtgtcaggtactatgttgaagacttttccagcattatctcatttaatcctcataactctgtgatgtagatcgtattagtaagcttctttacacaggtgattagactgtggctgaggattgtgcccaaggtcacagagtaactggtggagctaggattcaagtccaggtctgttatactctgaaaccagtcctcctgactactgccttgggttccccagctgtgtagagtactgtgaaggggaaatgagagaagggggaggccaccttctcacctattaatcaagtgtcagttctgattatcatcacgaatgaatcttcaccaagaaaaacatacttataaattggttttgcaatctataaaaaatattgcctttgaatgagtactgtgggttatgatcatcttgtgactcaaattcagtgggtcctaggcagggctcaggtgtgtcactgtggataatggttgcatcatcattttgtttcaaccgacaatacatataaagaatgactagaattgtagctcagtgcttgttttggcaggaagcattcccttggccccagctgtcccatcatacttagagatctcataaggcttacagatggatttcctctttccttcatttatgtattcaacacatttattaagcacccattatgggccagggactaatgaacaataaattttggtaaaactgatttggctcacagttggaatgaggccactcttgtgataagtagagttgtgattctttttgttttttttttttctgagacggagtctcactgtgttacccaagctggagtgcagtggcacgatctcagctcactgcaccctccgcctcccaggttcaagcaattctcctgcctcagcctactgagtagctaggattacaggtgtgcgccaccatgcccagctaatttttttgtatttttagtagagacggggtttcaccatgttggccaggctggtcttgaaatcctgacctcatgatccgcctgccttggcctcccaaagtgctgggattacaggcgtgagccaccacgcccggccaagttgtggttcttttgttgtttctttctttctccactacatttgcttgtttccttgcccatcacattacacaagtaccaggaacacattctcaacagagagctgccacccactcttgtcttgtctgtcacaagactaagtggtaagagctttcaattttgagcttcttgagggatagaaccatgtcctttttcttccccaaagcctgacacagcatctggcatgtggtagacacatgttacatgaaccaacattagcagcaagggacctgcaaggactcaagtgtgttgactggaacacttggattagaatagaccgataaaacttgaggcatcttggaaaaagtcaaaatcagaaactatagctctatttgatgtatgtatatgccatttactacaatttctttctttctttctttcttttcctttttgagacagagtttcactcttcttgttgcccaggctggagtgcaatggcgtgatctcagctcacggcaacctccgcctcctgggttcaagcgattcccctgcctagcctccccgagtagctgggattacaggaatgtgccaccacatctggctaattttttgtatttttagtagagatggggtttctccatgttggtcaggctggtctcaaactccctacctcaggtgatctacccgcctcggcctcccaaagtgctgggattacaggcgtgagccaccgtgctcggccaatttcatttttaagaaaaacataatttcatttgctatgttttctttacttctgtggcttgttggaagatgccttttctagtcaaatttggcatggaacatatttgtggctaatatttttattttcagtcactcacatttacgtagtatcatggtgttctcaagaggaagtttacatttctgaataatgtcttatcacatggtaaagtttagtgtgtcataaaagagtagactagtggggaaatcacatggggagggaaatgaatgtgcacatttatgataggacagatgaattagtcataggatgagtgaggcaagcctacaggacagttacttagtaaagagagcatttcagctccccagaagtctcattcttataaggcagagaatacatgtgttgtttcagaagctaatttttaaatattttttgtttttgagacggagtcttgctctgttgcccaggttggagtgcagtggtgtgatctcagcttactgcaacctccacctcctgagttcaagtgattctcccacctcagcctccccagtagctgggattataggtgtgcaccaccacacccagctaatttttgtatttttagtggagatggggttttaccatgttggccaggctggtcttgaactcctgacctcaggtgatccacccacctcggccttccaaagtgctgggattacaggcgtgagccaccgggcctggccaaacacttttttataaaaacaattttccttgttttttcagtttttaattactctcctcctccaaatctggaattgagtcatagtttgcgcatagagctgaatatagacctggtgacttccaactgtaatactatcacttataggtaatagtaataataataataataataataacatagcagtagtagcagcagtgacagtagtggttacatcttttgggtatatactgtgtctgcacggagctaaattctcattctatgttcactttccttgtttcttcctttttaaattgcccttcacccaaaacaaaatctggaattgagacatgatttgggtttagagatgaatataggactggcttcctatattcattattcagaatgagtgatttctaatccttattctgtcatctattagtggtggtgggagtagtaattgtaataaaagtaattataaaattagtagcagtagtagcaacaatgatagtgttgacaccttttggatgtatactctgtgcctattctatgctaaatactcttcataaattactttattatccttttacaaatgaaaaacatagaggctcagaaaaaagtgtcaaatagctgatgtgggcagggctggagctcgatgtgccccagctctctgtgcttccggggtctgtgtgtgctctttgcctctacatcacaccaagcatgacgttgtcaactacctttctggcccacacaaaagtctgagaacagattttttttttttctttcttctttttttttttttttttccgagacggagtctcgctctgttaccaggctggagtgcagtggcgtgatctcggctcactgcaccctccgcctcctgggttcaatcgattctcctgcctcagcctcctgagtagctgggattacaggtgcgtgccaccatgcctggcaaattttttgtgtttttagtagggacggggtttcactaggttggtcaggatggtcttgatctcttgacctcgtgatccgcccacctcggcctcccaaagtgctgggattataggcatgagccacagtgcccagcctggatctttttctttaagcttatgacctaaaatagaagcaactgatgactggatatctccacttctgtgcccaagcaacatctcaaacacacattatctaaaacaaaatttgcaatctcctatgcgttcctgtccggaagctactgctcctaccctatcccttgtctggtaaacactgcctactcagttgcactgacctgtaacttgtcatccctgggtgttgctctttttcctgcttgtacctcctgaattaagaatctctctgcacttgcacttcacttctgtcaatcccatcgcagcggccctcctagtggaggcctctgtatgtttcacctggactgcagacacattgcaactgctcttcctgtcccagtcttgcctccctctaatcctttctcatcaacaagtactgtgcaccctcgcccacctgaacaccctgcagtcctatgcccactgtcccgcatggactcccttctgttcaacctgaagtcttagtttagaagttaccacttctgagagcccttctcagaccctcataattctgggttacatgtcctttctcctcttcatagccctgacagccctatgtgaggcagaagttgcagtgagctgagattgtgccactgcactccagcctgggtggcagagccagaccctgtctcagacaaacaccccagcaaaaaaccaaatgaccaggctagacattgtataaagcaagtgatacagccactgctatctttaattgacaatgatttctgaaatgtacttgaaaaaatcagactagcattcttgcctctgggtactgtgttttaatgtggagttaattatcctctaccatagagtcttgtggaaacatcattagccttctttgtacatttggccatctgcagacaaatcaatggccagaaggcttcatgtgaacctagatatatgaggaaaaaagtactctagaacttcatgtccagtacaatagccactggccacatgtggctactgattactttaaatatggctagtctgaattgagtagactgtaagtgtaaaatatataccaaagacttagtaaaaacaaatcattaatattttatatctatcacatgtcaaaacaatagtttatagatatattggcttaaatgtgttattaaaattaatttcatatgtttctttttattttttaatgacacaatttaaaattagtatgtggcttgcgtttttggtttgggttatatttctattggacaggctacatacactaaggtggtgtcagtctcctaagtttcagagctttgatgaagtagggaggtctaggctccatcctggtacatccaaatgttgtttgattggatggcttcatggtctaatacagcaaatagaatttaccaaaatccttctgttttctgtgtctcttccaaagatccatgaattcatttttagcataagggccctgacgttgccctagttaaaactaggaggtgatggaagaggggtctcattccattcagagccccataggtctgctattgaggtttttatgaattcagccagcaaaaagggacaccttgtttctttctttctttctttctctctctctttctctttttctttctttctttctttctttctttccttctttctttccttccttccttccttccttctctctctctctctctctctttctttccttccttccttccttctctctctctctctctctctctctttctttctttctttctttctttctttctttctttctctttctttctttctttctttcttttctttctttcgtagtttcgctcttgtgtcccaggctggagtgcaatggcgtgatctcagctcactgcaacctccacctccttggttcaagtgattctcctgcctcagcctcctgagtagctgggattacaggcatgcgccaccacgcccaacagatttttgtatttttagtagagacggggttttgccatgttggccagggtggtctcaaactccagacctcaggtgatccacctgcttcagtctcccaaagtgccgggcgtcagccaccgcgcccggccaatactttgttttcttaacctagagtcctttagggatttgagagtagcagggagcagctgtaatatgaataacagtaacacagctggaatttcctattgtagtgaagtttttctgcacataagtgtttctcattttatctgataatttttgtcctaataagtacatgtaatacatcatgttttttggacattcaacaaatacttattgagcaccaactttgtgcctggcactattctagttcctagggatacttcagtgaataaaacagggcaaatggaactggcttcctagagacacaccctaatgctaatggagttggtatcctagagacataccctaatgctaccttgtaaatcacagggctatcacatggtgtatgatgtatcaagttaacctttgacttgtaagatattttatcttctcaaaggacttcagaatttgccctcttgctttcattatgtttattatttcctccagaaaagaggaaagggggcgtgtgtgatatagaaggaggaaggcaacattcaacgctttttattttcttagtctgcattgaacaggtaattttctcccacaggaaacctaggcatggaaacactttactaattggaagtgacttcgctgctgtaattagagtaattttggaagttaattttaatcaaaatatgcatcttactctgtaagagtaagtactttggtactcaaatatagatactataacatggaaacaatatatatgaaaaacttgctctctctctctctgtatatatatagatatctatatattatatatatattttatatatatctatatatattttatagatatatattttatatatatctatatatattttatagatatatattttatatatatctatatatattttatagatatatattttatatatatctatatatattttatagatatatattttatatagatctatatatattttatagatatatattttatatagatatatagatatatatatatcttatatatatatatagatttttttttttttgagacagtttcactcttgttgcccaggctggagtgcaatagcgtgatctcggctcaccgcaacctccgcctcctgggttccggttcaagcagttctcctgcctcagccttctgagtagctgggattacaggcatgcgccaccacacctagctaatttttgtatttttagtagagacggggtttcaccatgttggctaggctggtctcaaactcctgacctcgtgatccgcctgcctcggcctcccaaagtgctggggttataggcatgagccaccacgcccggcaaaacttgctatattttaaaaagtgttgtttttagtagtgctaaaattgtagaggatcgtattacacttctttgttagttttcatccattggttttaatgttttatatcaagggtcagcaatttatgacaagcatgtcacagagagtactcagctggatggggccaagtatatacttatccctttactaacaaggactctattgccttttttttttttttttttttttgagacggagttttcctcttgtcgctcagggtggagctcaatctcagctcactgcaatctccatctcctgggtgggttcaagggattctcctgtctcagcctcctgagtagctgggattacaggctcccaccaccacgcctggctaattttttgtgtttttagtagagatggggtttcaccatgttggccagtctggtctcaaactcctgaccttaagtgatctgcctgccttggcctcccaaagtgctgggattaaagatgtaagccaccgtgtctggtcttctatttctcttttataagagctagatgcgtagccacacttcccttcaaaggaatctacacagtacgtgtctatgtgcctgagtatctgtgaccctttctgtttccacgtccaagataaatggagtggaaacttacaccattgctattagtattgtatcagctctcttttattattcttggttttcctattctgtaaaataaatccatattattaattaatgtgttaaatttccgagaaccattttggttttttaaggagtagggaattgcttcttaatttacctttatcttcaataggtttctttttacctaaagagaagttatttctgatgctgccttatatcttttatgaatccatatgaaaagaaagtggaacatcttatatggcatttcatctaattggactttttctaccagtgaacaagaacttcagttactgaataactttaaacatccttgatatctgcctgcatttttacattaatattacaatatctttttcaggttttcaattcaaaaacagctgaactacttagtcatcatcaagtagaaataaaacaagagttcccaagagaagggtatgtttcctaatttaatatgtaaagacacattatgtttgttagtccatctcacccaacttgccctgtggatttgtaaagtaaacttggtcagacatcctcctgaaaacatttgaaaggttgttattagtcaagaaaatatgcaataacttggtatgtcttacatgtgaggaattgatggcttaggaattcagttaaagataaggaatgaataataaagtaataaagcaaaagagtattaaatatcagaaatttcacattaactttgaagtcatttagttttgtgttcctattattgcaaaaatgctgctttgctgatttgagtgtcaggtttgttttataataaaggtatctttttaaaaaagtattcacatatcttaacatctaatactaaaatcacatttttgggaatagtattcataagtagtaattgtgattaaatatgatgttaagtatattatttaaaatttaatgatttttatgatataaccactttgaaaaactgtgttgcaggttattgcaaagctaaccatacacctgcagcatttcactcttaggaatttacccaagaggaataaaagcatatgcccatcgaaagacttgcacatgaatgtttatagctactttattaaaagtcgccccaaactggaaaccacccaaatgtctgtcatcagtaagatggataacaatggaatgccatttagtaattttaaaaaagtggacagatacttgcaccaacacaagggaatgtcactggaaatatggaaaatgaaaaagttggatacaaaagagtatatactgcatgactccatttatctgaaattttataatagtctaaactaatctaggatgataggaatcagaaaagtggttgtctgtgaggtgtgtgattcacttgaaaggagcatgaaagaactttctgggttgctggaaatattttgtatcttgactggggtgttggttagatgggtatttccacttgtcaaaactcagcaaattgtgtgctttcgatttgtgcatttcactgtaaagtttacttcaatttaagaaagagagaaaaaaattgatgtgtttctaaattgtattgtcttcttcacatgaaaaaatgttctaattttttagagttcctttgtttaataataaaagttattgatatgttagaggcattagcatgactgtccacaagcctgaacccagtgcaatttgtaaagaagatacctgagtcttggctagatgaaaattataaatacacagaaggagactgggtttttaaaaataaattagagacgacttggcgcggtggctcacgcctgtaatcccagcactttgggaggccgaggcaggcggatcatgaggtcaggagatcgagaccatcctggctaacatggtgaaacctcgtctctactaaaaatacaaaaaattagccgggcgtggtggcgggcgcctatagtcccagctactcgggaggctgaggcaggagaatggcgtgaacccgagaggcggagcttgcagtgagccgagattgcgccactgcactccagcctggacgacagagcgagactccatctcaaaaaaaataaaaattaaaaaattaaaaaaaaattagttagagacagaattcaaagcccaggaaagggaagcatttagttaggcctgagaaaggcagagaagaaaggcagttggaattcccttgctacttctggatcctatggtagaatcattttagtttgtatcatttctacttttggacttcctcaaattaccatatttctcctaggcttctcacccttctcatttactattagcctttcatccttctgaggccctggtactttaccaaaattatactgagattgggtctgagaacttggaccaatcacttatctacatgaaatagttaaaaggagttttaaatttctccctaaattccaacaaaacattttgggaaaaaagtagcaaaaaagactagtatacttatttgacttttcagaattccttttgcttcccaaatatatcattctcaataataataaatatatttccatctacttagaaataatcagcgattagtgaaacatgcagataatttatcaaaattaattaaatctgcaggatataaagaaggggaactaatttcttattagacttggaaaaataattttaaaataggtagatatttgctgtttgtggcctgccattagtggcctccttgaaaatgattaattactatgtggagaataataaaattgtaaggaaataggcttttcttgaaatcatttctttaaaatgtggaatgtaatttgctttgcttaatctggttttctttaatgtatgcaccagccacaccctcataagttaacatttctatagaaaaaagttatatttgtgttgctttcttactaaccaaatgccttcttttgttcaaagatgggtggaacaggaccctaaggaaattctacattctgtctatgagtgtatagagaaaacatgtgagaaacttggacagctcaatattgatatttccaacataaaaggtattttagtagaatattttacccacataataagactctctcaatcaaattcattaatttattctttcagcttataattgagtgcctatgcagtgccaagcatttctatgagaacttgaggatacaacactaaagaggaagatttaagttcttgtcctcatggagcttttatttggatgggggcgagataataagagcagaaaaatataatttcaaatactaaaaagttccattccaaaaaataaaaaccaagtggtatggtgggttttgcctagaagggcttgctttagattaggtggccaggaaaagcctttctaaggatgtgacacttttgctgagctctcagagggcaaaaggggtcagccatgccagtgtctagaagagtgtttgaggaaaaggatgcagcacgtacaaaggccctgaagtgggaataagcctgggacatttccgggtcagaaagaaggccagtgtgtcaaaagaagactaaaaatgttgagcagtgagactgggtagggggtttcagtaggcgatcaaattgtggaagtgggtcgggcttcatcagccatatttaggattttggatgttattcttagtatcatagggagccatgagaaagtttaagcaaggcggcaagggatgacttgcagtttcaaggcaactttctgactgctgtgtggagagtagatggtaaaggcaaaagtgtggacacagggagactagtgcggaggctgctatggaagtcctgagagaggatggtggcttgaccaataatggtagcagtggaggtggagagaaagggccagaatttgctgatagactggatgttggggtaacagagagagtagtggggttgagggaagagattggtcaaaggtgatgctttggtttttgccagagctcctggatagatgaggatgccttttgctaaggagagaaagactagaggaatgagtaggttgtggggaaggggtatttggaatccaaactcttcacttctaaaatttccctgaaataattgcttgagggtgttagattgttatggatttctctgagaagtcctagtagttttttttttttttttgagatggagtctcgatcttgtccccaaggctggagtgcagtggcatgatctcggctcactgcaacttccacctcccaggttcaagcaattctcctgcctcagcctcccaggtagctaggattacaggcacacaccaccatgcccggctaattttttgtattttttgtagagacggggtttcaccatgctggccaggctggtctcgaactcctgacctcgtgacccgcccgcctcggcctcccaaagtgttgggattacaggcatgagccaccgcgcccagcgaagtcctagtagttttaattgaatatctatgtttggcttttcatcattcatatagggaaaaaaaatccagccacccaagattgatataatagcataaaaggtggaagcatagtgtggaagtttgctgtctactttatagcctaaaattttcaagtttaccattcaagggctctttttttcctccttaggtagtttgactatagatagagagaacatcaattggtggtggtggcttgattgccatcatcttggctttgatacttaccatcgctcctgagcctttcccctatttgtataaattaaaactcacttaaaaaaaaagactacaaatctatagagtgcctactatgtgccagatgtgctaaggatacaatggaggtaatgcttaagtgcagaaaacatgttaatctgataatcacaaataaatggaaatgcataaaataatagagttatttctgttattgcagattttttaaaagtataatttgatattttattaacaacttttaatactatgcacatattaatcctatcctccctttatccctacatctaagtggaagggcttcaaacttctcttagggttgtagtcctgaactttagatgagttgtgcattagtgattgttgttgatcatttccttgagctgttcttgcacttctcacagtctaaacagtgcaaacaaataataggcaatcagtagcacactcttgtcaaaattaccaaagacgtaagtaatccaggcagcttaaagccatgtttagaatgtagagtccagggtgattgaccatggctttgacatcattctacctcccttacaggtaaggtaggttgtgatgtgttggctttctggacccacttggatgctattcctttctcccttgtttttacggttatgtgaagatgacacacaactcctgcccaagtgatttgtcttccgtttgcactacctggtctaagaattgaacaggcagcttctctatactcctctgtgtctggccagtgtgaagtccacatctgagccaaactgacccagcacttccatctgtacaactaccatcctctggccacagaagagaacatcccacaagctcctccataccaggccagttgtactatttttttttttcccagaaaatttatccaattggcattgccaaggaccaagcttttgcttgcctgcatagaactctatatcacaaactgttaaagctgtaaaggaggctgggtgcagtggctcacacctgtaatcccagcactttgggaggctgaggtgggtggatcacgaggtcaggagttcgagaccagcctggccaacatggtgaaaccctgtttctactgaaaatacaaaaattagccaggcgtggtcgtgggcacctgtaatcccagctacttgggaggttgaggcaggagaatcgcttgaacccaggaggcagaggttgtggtgagccgagattgccccactgtactccagcctgggcaacagaacaagactttgtttcaaaaaaacaaaaccaacaaaaaaggctgggcgcacagtggctcacgcgtgtaatcccagcactttgggaggtcgaggcaggcagatcacctgaggtcaggagttcgagaccagcctggccaacatggtgaaaccctgtctctactaaaaatacaaaaaattagctgggcgtggtggcgcacacctgtaatcccagctacttaggaggctgaggcaggagaatctcttgaacctgggaggcagaagttgcagtgagccgagatggcgccattgcactccagcttgggcaacaagagcgaaactccatctcaaaaaaaaaaaaaaaaaaaaaaaacaacactgtaaaggatcttcagtcaactagaccagctccctctatctgcaaattagggaagaggacttaactgcaggttatgtagctttttagtggtagattaacattaaagcacagctcccctgactcctagaccagagttctttttcctgagccacactgatggtaatctcacaaaccacttctgtttttatttcttgtgtggcaagtaaattaactttgccaactgaagagtgatatcatttatagtcctacctgacagtcattaagagttcttcatgtctggtatttccttggcaaatttcaatttcattggttttgttatgcttatctgacagaaggtttgttgatttcaagtcactaggaacagtgcctccaaaattaaaattcactctccaactgagcagcacacactagctcaaggcaattaaatagactgcttctttccttctagcggtagagtcagctctgtttgcctgtcactgggctcaaggaattacaaagtataaagagttacagtagcaattccaaaatacaaagagttacggctgggcatggtggctcacacctgtaatcccagtactttgggaggccgaggcgggtggatcccctgaggttgggagttcgagaccagcctgaccaacttggagaaaccccatctctactaaaaatacaacattagctgagcatggtggctcatgcctgtaatcccagctactcaggaggctgaagcaggaaaaacgcttgaacccaggaggcagaggtagcagtgagccaagatcacgccgagccgagatcatgccattgtactccagcctgggcaacaagagcaaaactccatctcaaaaaaaaaaaaaaaaaaaaaaaaagagttacatattcattcatgtgatagaacgaaaacacaacataaactctttcaaaattgagagcataaaattctcagagattagattatcttgtatctaaaacaattatttccctgttagagaaaagggaaacccacatatccattcctccactgccttgccctacccaacatattcacacacatttctaccacctcttagactcatactgtcaggggcctctcaggggtttcaggaaggcacctcgttctccaaaatgtttccagcagcagccacatctcatttgcaatttttctaacccacctcaagtacacatcttccagagcctgttttaaaaagttttatcaggccgggcgcagtggctcacgcctgtaatcccagcactttgggagactgaggcgggcggatcacctgaggtctggagttcgagaccagcctgaccaacatggagaaaccccatctctactaaaaatacaaaaattagctgggcatggtggcgcatgcctgtaatcccagctactcgggaggctgaggcaggagaatcacttgaaccagggaggcagaggttgcggtgagccgagatcgcgccactgcactccagcctgggcaacaacatcgaaactctgtctcaaaaaaaaaatgaaaataaaaagctttatctctcttcccacatggtattcctttttgtagccagagaaccttcctctgaagctcttattattttgttctgtgtgtttttagttttctcctaaaaaatgtgttataattatatgttatgattttaattttaaaaaaggatgcatctcatccataattctaccaagacaacaattattaacatcctggagtattttcaaaggctcttttttctaaggtatattttcttaactgtgattataacttcacggaaaattttaagaaaaattaaccagggattttgagtgtagcttttaactagtttaattttactactgacattcagtgtagagaaaagtgcccccaaagagaatatgtgggtaaagtatgaagctggtaaatgcaagagcaatacgatatatgataatggttatgatgtccgtaaatgaaagactttgaggccaggaaatacatgttttatgcatgtgactttcatattatcttaaacagtgcacatgaggaggagtggagaattataaaacctgaatgtgttattccaagaaagaaggaattaaaattaggaaccattaggaatggcacatgtgctgagattagcagttggcaacgttttctttaaaaaacatagaggattttagggtaggaatgacaagacactggaacattgaaaaagttcagagataagttcacacataagacttgtgtgccctggggagaaataggtagtaaagacatgtttgtggctggcagagaatcctgggaagctgtttcactggactttgcctgcaagcaaagcaattttacttggcatgaaggaatccaattaagatagaagagaaaaaaggaatgcccagggaggaacccgtgactgaagaatcagattgaaatagctctaaattagattctgaagaaaagttaaaatgacctggtaaagataggtagcatgagaggcatagaatagtgactcaaggattgtgagtaagaaagtagccagcttattgatggtaaaattaacatagtgaggaggaataggagattttagttgactataagttcattgtgatcccatgttgtaaagttgtcacacgcacaaaaaaattacattcacaatatgtacccatagagctgctgcagaattcctttatttgccctccttagctcagtcccattctctgaaactgttactctactctcttctcaataataatgaccatggcagcagcagtaggtaacatttattgagtgcttactgtgtaccaggcatgtgttttaatatacattgactcctcactgtaaccctgtaaagttggaactattattctctccattttacaagacacaaaactgagacccagagtcacactgctaggaagcacaggaattggaatttgaatcccagctatctggcctcagagcctgagctctactgaatggtgccccaaactcttgccctgttttggcagataaccctacctcctgcttcatggagaaagttgagggtctgcggccttaaatcctcaccttcctgttgctgtgcttaatatctggatctcctgccaactttccttcatcacaagggcagcaatagccttctgccccacttggagctcctccctccacttgtgctggtaatccatcctctcctgtcactacatcagtcagaaccaagtccccattgattcccagccccatccatcccctcattctcctttctcttctttatttacttttataaacatttttgtcttacccagaatctcttccttataccctatgcctctaaatttctttggagtagaatctcaatcatctttgtatctctagaaaatattttttaaaaaatatatatatatataaacttttagatacagagggtacatgtgcaggtttgttatgtaggtatattgcatgatgttgaggtttggggtacagacccgtcacccagttagtgagcataccacccaataggtagttttagaaaagatgttgaataaagtaagtcaatctgcattggataaatagtattagaacaagggagctgatgttccccctcagctctgtgctggtcagaacattcctagagtattgtgttttattctggacgtacagtttgagtgatatggacatacacttgcatgttcctaggcgtggtgataaagggactttaaaccatgccatgtttaggtggggtcagttgaaggaaattggattgtttaggctacacagcagaagagaagacttgaggtacaaaagagctgcttcaagttttgaaagactggcatgtagaaggattacccttattctatatatctccaaagaatatgactaagatcgggaggtggaagctacacaaaaaatgatttttttttttttttgagacagagtcttgctctgtcacccaggcaggagtgcagtggcccgatttcggctcactgcaagctccgcctcccaggttcatgccattctcctgcctcagcctcccgagtagctgggactacaggcgcccaccaccacacccggctaattttttttgtatttttagtagagatggggtttcaccgtgttagccaggatggtcttgatctcctgacctcaggatccacccacctcggcctcccaaagtgctgggattacagacgtgagccaccgcacccggccacagaaaatgatttttattcttctttttttttttttttttgagacaggatctaactatgttgcccagtctggagtgcagtggcaccatcagagctcactgcaaccccaaactcctgggctcaagcaatcctcctgggtagctgggactacaggcgtgcaccaccatacccccctaatttttaaaatttttttttagaaacaaggtccaactatgttgcccaggctggtcttgaactcctgggcttaaggaatcctcctgagtagctgggactaaaggaacacaccaccacacctggctaatttttttttttgagatacagtctccctctgtcgcctaggctggagggcaatggcgcaatctcggctcactgcaacctccgcctcctgggttcaagggattctcctgcctcagcctcctgagtagctgggattacaggcacatgccaccatgcctggctaattttttgtatttttagtagagacagggttttgccatgttggccaggctgatcttgagctcctgacctcagatgatccacctgcctcggcctcccggagtgctgggattacaggtgcaagccaccacgccaggccatctggctaatttttaaaaatttttttatagagactgggttttgctacattgccgagggtggtcttgaacccctgggctcaagccatcctcctgcctcagccccgagtggctaggactacagttgtgtactgctgcatctggctaattattttatttttttgtagaggtgaggtcttgctacattttccagtctggtggatttacaaaaagaaaaaaagcaccaaagttgtccaatggagattgctctgccttgagagatgtagtgaatatcttgtcactagaagtgctatctggatggtcatatgacaggagattctagagaagatttgagcttgagaagtatttttgcttatacagcctttaaggtctgtcctaatcttaaattctggaagagctggatcctttggccaagtgtgttctatccaggatgcacattagaatcacctggggaagttttaggaacccataccaatgctcacatcccatcccaggtcagttacattggaatgttttgaccagggcttggtcattggtattttttaagagctcctcagttgattctaaagtacaatcaagtctgaaaacctccaatttagctcaaccaagctgaattgaataagatagtgtgggttagtgtttttttacactaaatatagtacttgttttatgtaggtcaatataatgtaaatgccattatatattatatttatgcctgattcaaattcttatgtattgtgacatattaaaaatacaggaataaaactgaatttctaacaaaccataatataaggatgctcagcatgaaggattttgtccatagctattttcttaaaatgtaggcatgtacatgtgcacacacacacacacacacaaatgcacacacatagggaggaaaatttcttgtagcaattggtaaacaaatgaatgagttgattattggtctgctcagaataataaattgggtattataaatttgtgaagttattgcattccttaaagcaaccagtgtgccttttatttgggtattgatctgggtccatcattgtgtgctagtagtaaagctggaaggagtatgtagaaatgaaaagaaacacttggcattgggtattgactttttctggagccactcaaagaaaataaactaatatcactacaaatgtttcaagtatttttttgatttgctatgtttagttgtgtctctagtaagatgagagctgttttcctgaagtagtttcctacttgttaaatttttgacttccttctgtttaactttctctttaaagctattggtgtcagcaaccagagggaaaccactgtagtctgggacaagataactggagagcctctctacaatgctgtgggtaagctgtcatgcatggatgtcaaatgtagggcctttcttcacattgcaaatgtggtcatattaaaatatcttgctaaaaaagcatgcagtcgccaggcatggtggctcacgcctgtaatcccagcacttcgggagactgaggtgggtggatcacgaggtcaggagttcaagaccagcctggtcaacatggtgaaaccccatctctactaaaaatacaaaaattagccaggtgtggtggcacacacctatagtcccagctactcgggaggctgaagcaggagaattgattgaacctgggaggcagaggttgcagtgagccaagaccttgccattgcactccagcctgggcaagagagtgagactccatctcaaaaaaaaaaaaagaaagaaaaaaaaaaacacatgcagtcatggtacctataatcttgatgggatgggcagaagagtctgctaagaaattaactgttgtatatttaccatttttggatcatacatattcacatagtgaattaactctcccatgctctctcctcttgcagattgtcttacaaatgagtgaatgtttgccaaattgttttataacccctgctgtttgtgacatctaaaagagatcttacctccttaccctcaaaaaattaaaattacgtgtgttcacagtcatttttctataaagtacttgtgtgtttgtctttccatctaggaatttgaattattcttctaaggttataaaaatagaatattcgaattttagctgcttcttctacaaatgtggctatttgagcagggatttaaaaaaccccaaatctcaaatataccacttttaggtatcacaacttattaggtgtaaatgatcctgagtatattttagcatcattattagcatgacagttgttgaacaccgaatgatactaccacttcctaaaaggaaaattttgttctaaattacaatcactaaaagacttcattgtgtcagaaagcaaagcacaattttttatcaattaaatactaagttgtgggatggggaatggaatcagaaattatcagagaggggataattttgggggaataatctttattaaaagttaaagtatttaatgttattgtattataagaaagtatttagtatgttttctgtatttatgataaaaaattaaattctcaaaaaatttgaaagaattacaactaaagatccttttagtacatctttttctgtggtgttttttttttttttctttcctctgtttttttttttttgagacagtcttgctgttgcccaggctggggtgcaatgacacaatctcggctcactgcaacctccacctcctgggttcaagcgattctcctgcctcagcctccccagtagatgggatcacaggcgcccaccaccatgcccagctatttttttttttttttttttgtatttttagtagagatggggtttcaccacgttggccaggctggtcttgaactcctgacctcaagtgatccacccatctcagcctcccaaagtgctgggattacaggtgtgagccaccacacccagccagaagtacatgttttaaatgtttattttgttctcattctcatgagtaattcattttgaatataagacagactatttaatgactagtatttaggagagtatcctttgatagatcaatgttagctaacttcctgaactagttaaggttttactttcttttgttttcttaatgaaaggaagagcctactcaggcaaaccagaaagttccagttaaattctgagctttttttttttttttctttttttgagacagagtcttctctttcactcaggcaggagtgcagtggtgcaatctcggctcgctctatctcccaggttcaagtgattttcgtgcctcggcctcccaagtagctgggattataggtgtgcaccattatgcccggctaatttttgtattttcagtagagacagggtttcaccatgttggccggactggtctcaaactcccgacctcaggtgatctgcccaccttggcacgcccggctagttccagttatattctaaacattgaattgtaaaaatggaactttggactttggattgttatttttcaaataatgcaactaggtaagctgaagttatgcttacagtaaagatttaagtaaatgttttactagaaaatctttctgtgatgttcttatttacttatttccttctcttctgcctgtgtccctctgcacccctcccccattctacgtgctttgcagtattaattcaaatgttcataggatatgaggaactcttttcttctatcctgagccacatacatgttttgagaacctcttacatgtttgatgttatcttgggtactataaaggatacaaattatattggctgtttttttaagcactttataatctagttttggaaagagaaaactagattagggaacaatccataaaacaaaattagggaatagttgataaatcatgtgttgataggttgaaaaggacttagagcaagtacatatcagtatggattttgaaattttagcatacttttcacagtggaggttgaacttcacttgggccttgaagcgtatattggattgcgttaggaaaagagaaaattgaggaataatgtgaacaagctatgaaggtgaaaatgtgtacacatattttgccagagtaaagaaatggatgagtttcatgcataggttgactcatttttttttatttttagtagaactagcagcgataataatactcagtaagtgctaactgctattactttgggattgtgctaagtattttacccatattatttaatctcactgaccctgtgaaacagattttactacccctattttataaattaattgtggaaaagctctataacttgtccaatggcatgtagctataagtagagtaaagccacagtttaaacatgaacactctccaaccttaaagcttgtgttctaatttgggtagacaggggttggtgaggatatagagggggctgaaagccatgcagtgtagtgtagacttaaaacacggggcagcttgaggcaaaacagatgataaaggagagtttagccatcccatgatggtggaatgggttgtttcaaacacaccagtatgcggagaacaaccagaaaagctggatgaaaatgaaataaaattctgaagaactggaaggctaccaaggcagtgaggacagaaggaaagcccagagacataagcctagcatttggcattgcttatctcctggagatatcggtaggttctgaaaggagtatctgacaggctaagccacacttctgcaggtccataaagataaggaggcaaaaggtgaagtcaagggctgccaagggtggggatgagtgttggtaaaatcccagactttggactgggactgtgaaaggtcaaatcctggaagtgaggtaaactgaaaataaaccaaccctcacaggaattgaagcccagattcaaatgatctttaacactaattggattaagatgatctgagattgctaatgctagtggcctaacttcctttcagaaataagagtaaatcctttctggaggaagacaacatcatctagagcctcaaataatctctagaatttttcatacgcattatctagttttctatttaaaaaaaccatgcatacaaaacaaaacgtgactgaaaagcaacagaaacaagtgacattagaaacagactcaagaaattcagatattagagtttttagagtttaaaatagccataattaatatgttcaaggaattaattgacaagattgagattgataatcttggcaaagaattggaagtccagtttaaatggacattctaaaactgtattaagaactcaattgatggggttttaccatcagaggagacatagctgaagatgaatttgtgagctggaagataaatcagaactgggagagagagtaaaatatttagactgaagcacagagaaacaaaagtttagaaaaggcacaaaagaatctaagagaaatatgggaaaaggtgaagaagtttaatatatttgtaattggacttccagaaggaaaggaatgagaaaaaacgaggcagaaataacattagacagataatgggagaaagtttttcaaaactgatgaaagatagcaagctgtagattcaataagcactataatccctaggcaagataaatatacagaagaccatacttatgctgggatatgaagatataaagttttgaagtagctgaggaaaaaagatatataaccttcaaaagagtgaccctaagactttcagctaagttatcagtggaaacaaaggaagtcagaatgcgatggaatgaaacctttaaagtactcaaagaaagtaacttccacatacagttctatatccagtgaaaaaattattaagaaatgaaagtgaaatatactaggagttggtgaggatatagaggtcaccaaaagctatgcagagtagtgtagacttgatacactaggcagctaacccattctcttagtccattctggttactataacaaaataccctagattggataatttataaacaacaaaaattttattgtttatacattggatagggcataaggaggagggagaaaataaagcaggcctgtgagattttcagcctgagagaacagaaagaaattaaataatatttagggggtaccaacctgagagaaaaaatggccttgttttcgacaaagtgagtgttgaacttgtaatagaagctaattctgggcaatgagaaattagatggttccaaatgtagacttgaaaattgataacatagatgtgataatctcaatttattatggatgaactcactatagtaattaatataaaattaattcaatgaaagaataggtgcctttctgtgttctaggttttgtgataacccttggcatatagtgacaaaccaggaagaccttgtacttgactttctgctacagaaactaaggatagaagtttggaagctagaaggagaaagggaaataggaaaggaggagagccactaagaaatgacaaggatagattctgccttcagttttatttcatccaggaaaactctaaagtgtcatatctccatgtaggtcttcagttgaaaatatcaacataatattaaatctttagcagttttattctaaagcaacacaaggtaggatggatggaaacaatgagattttcacgtatatttgtctttgaacttcttttgctttgtttatatcacagtctgcaggttttatacttttttctctgtctcggttcaggctgctttaacaaaaatatcatagactgggtggcttatagattagaaatttatttctcacatttctggaagctagaagttcaagatcaaggtgcttacccatctggtgtctagtgaggaccttcttcctggtttgcagatgactgtcttctcatcctcatatggcagacagtgataaaaagaaagtaagctctctctttttatgagggtactgatctcaatgagggctccaccctcatggcctaatttatctctcaaaggtcccatctctaataccatcatattaggggttaagattttaacatacgaatttggaagagacacatacattcagtccatagcattctctttgtatgttttcttccttcgttgtctatttctcttgtaaatctctgtaactctatgcctgtccttctcctctttatttctgtcttactaaattatacaacagatgatatatgcatatatatatacagctgtatataaatatatatattttaaatacagatagggtctcgctgtgttgagtaggctggtcttgaactcctggcctcaagtgatcctcccatctcggcctcccaaagtgctgggattacaggtgtgagccaccatacccggccagatgagcaatatttattacaaacaagcatatgagaggagcacattatgtttccctttttaaaaacttctatgtggcctcctttgtttatggctcagggacacttgataagcaataattcactcacccccactacggtaacagaaaaaccaagataggagaacttcaggatatcattggtggccacggcataggcttgatgaaggtaaagactgagaagggctatttgtttttgcttgcaataaaggtgtgtttgtttattgacatcttttctatcagatacaattataaacagaaaaaaatttaaatgggtccattgaggaagagatggcctaatttacaagttctatgtatttttagaatttatctgttaattatgtgattaataaggtaaacattaatgtgatatctaaaatgggaaagtgttactttgcatcactgctttccagccactgtgccatgatgcaggcatttacaataatgacctcattggtggatcagcaagagctttgtggccctggaaccaaagcaggccttgggcttctcttgcctctcttcagttgccctagtcttcctggtacttctctctttcccttttagcattatcttcaatattcccttccacggggtttcctctacccacccatttttctaagccttttccttccaaaagcagcttttattaatggtctacataactggttgtcttctattattgaaaaagtaaataagccacagactaaactgaccaagaagcacaaaactacccaagtagttaaaatgtgaagcgggagaaggcttgaatcagtgatgtttagtatgtttacacacacattttactgatgctaccagggaaatgttctgtccaaactagaatggcctagctgtatttccccctaattggccaagtttgctcactcaccactgcagttgattggtatgtatggtaagtatagagcaatatgaccctcactctggtagctttctgtagagcacaattcttgatttaatataaaaataccattcataggccaggcgtggtggctcacgcctataatcccaacactttgggaggcccaggtgggcggatcacctgaggtcgggagtttgagaccagcctgaccaacatggagaaaccccgtctctactaaaaatacaaaaattagctgggcgtggtagcgcgtgcctgtaatcccagctactagggaggctgaggcgggagaatcgcttgaacccgggaggcggaggttgcagtgagctgagatcgcgccattgcactccagcctgggcaacaagagcaaaactccatctcaaaaaaaaaaaaaaaaaaaaaaaaaaaagcattcacagtagggactaatccagcaaggcaagagtccctggcttaacacttttaggatattaaagaaaaccacccacaaaaaatatttcgttgtccctgaaacatttttctatatttaaatggtagtgcaaacatttttttctaagatgttatatttaaagttcccaatggcacacataactctttatggagagtgttgcaattttaaagattggttatcgtttttacatttttttaacatactggttaatactgggccaattattaaacctatgtgatcatgagttgagatctgaaccttgagctcaatccttttatcttttctggaactggcttatgtttcaaagaatcagcagaaaagaaaaccatagatgacaaaccacctaaaacgcctaagcacacttaactttaaacaataaagtattttttttctttttttttttctttttttttgagacggagtctcgcactgtcgcccaggctagagtgcagtggcgcgatctcggctcaccgcaagctccgcctcccgggttcacgccattctcctgcctcagcctcccgaatagctgggactacaggcgcctgccaccgctcccggctaattttttttgtatttttagaagagacggggtttcaccgtgttagccaggatggtctcgatctcctgacctcgtgatccgccggcctcggcctcccaaagtgctgggattgcaggcttgaaccaccgcgcctggctaaaagtattttttttcaattagttctttgtgggagaaggtttttcacttttgtaaaatctagaattttcagctttattaagatccacttattttccgttaaaaaaattccattattacaggattctttgaaaaccttacatctccctcaatcctgggtaaagaaatactgctgtatttattttgcagtgattgaattattcaaatctggccaaataaaaagaaactgacttagttttcaactttgagttctccaatctttaataattatttttatcccgttaagactgtgacgtcatcatggctatacctacctagaggtttaattctagattcaggttctgggttcagatcctagcttttccacttcctaccattctgtgcctgttaccttgacagttaaactggggagatgaaaagtgtagacctcatagacttgaggtgtagatcagtgagttaatccatgtaggatacttaagccagggcctgacggactataaggcttcagtaattgttagctagggccactgttctgaattggctgatagcctttttcatccagtaatgccagatgaaatgattggtttatacatgataggtgttcctaggggaaatgcagagcctacctaggatcacccacactcaagtcagtcattgatattttggcattttatacccaagagctgaaattggcttcagcccccgccttttggcatatatgtaaatcaatctttccttcccaactctgttttacttttggccccacctgtttctgagaatgtcatcaggtgaggggcagccatcaatatagtctcttccaccttgcaaatgaccacttacccagcttaattaatagcttagcttttgacaaatagtaaaatgccataactaaatctgttttactatcatgtctcttgtgggagaaacaacccaataacactttgtataactgtcagcagtctgtgcttaggatgtgttccataacctggagcctcaccttcacctcacttcctatcaccctagcagctcatgacagaccatctcagagaagatttattatttgcctgtttctagtcaaatggaaatcagctagatgattttagtggggtttttttttactttattttgtttttccttctattgtcatgactaacgaaaaactggaaagttatgaggttttattattctaaatatttaaaaaataatttattcctctgtactgtttgttactatgtcactaactctagcccatggggattgaggcaactacatttatcttcactcttcaaactttttttttccagaacaaactaaatctaccagacagattggatgtgactttatttaatacaaataagttcagatcatccaagttatttttattaacttacttatttgatgggcttgaccatttacttctgctttacttggtgtagataaggggagggacataccttctagaagtgggctgtctagtgttctggactccctagcatcaattttccttctatttttttcctaattactttggaagttagcaatcccctgttccctctagacacgttgctcccttctgtgaaggtgccctttactcccagctatcttaccaggaaagtgctttcttggggacctgccttcccaaagcagccctttcatgtcttaatgtagatggccacaacacagactgtagcatgctccttgccattcctttctaacatcctctaggattgtgctccctcagtacatcatccatcatttcaatttagtggttgaatgagtagtcagttaccacctgagccacttttctaattaggatgcatatatgttgccagatagagaagagtcatcctaaacaagaagcaggtatttacctggtcttcatccaaatggaaatattattgaatcagagattcatactggacttcctttgttccctttctgctccctgcctcttccttttctttttctacaccaatgtgtagaaaaagtgttcattctgataaacttgcccaagtgatctaccatttcctaaatggtcaacaagagaccttgaacctggccatctctagcgtgaattgcccttatttcttctaatgctccagctgctccagtttctcctggcccttcagttccagttgccgttgttccctctggctcttcagttccagctcctggtacttcctcaggtattggtgctctggctattgctcacttcccagcctcccaagtcctatatgttgggggaaattgacttctgctgccagatctggatctgtcattccttttgattgttctcagagattacctacacaaggggcttagtcctccagcttgggagtcttctctttggcttttggtctctctgcaaatctaattctgccatcttagcttctttaataagttttctaatttttttgttcttaattcaattaattttgagcatttgtgaattgcttggtagtgtaccaaccactgatatttttctctttggcagttttactaatgcattccatgtattctaactgccttaatgtctgtctataaaaacacagtaattattatgacaggtttctatgatcatggaacaatggaaggagaaagactttagagaccatctagtccagcctccttattttatatttagagaatccagaccaagaagggtaaaatgagttgcctaaatcacatagcttattggtggcaaagccaaacattgaattttggtctccctgatttcacatccagtgttttgattctttgtggtaaggatttaactctgtgtttaccactattgtcagtcacagctgcaaactttcaagtgaggaataaagtgcctaagtggtccttgccaaggagcaatagaatcacagggccactgggacttggagaaccatctgattatcgggggggttctttagatttttttaaacatataattggaacacacctagtattttaaagaatatgctcttgaaaagatgaaaagagtttctcccgggaggcggaggctgcagtgagccgcgatcgcatcactgcactccagactgggtgacagaaagagactctgtctcaaaaaaaaaaaaaaaaaaaaagggagagagagagaaagaaaacaggtcctcatgttttagtattatactgaattacttgagacacttttaacaaaagtacagaggctcagagctcaggccttgcctagacctgcaaccagaatcatgcaaggtagggcctgaattttaaggttttccaggtagtcctggtatgctttataggaaagaaccactgccgtgaagtctagcagtgtttctcaaaatggggcacctatttaaaagtcagatttctgggcctcattcccagaactactgtcctagaatttatggggatggagcccatctttaagctcccttgtgaatgttatgtccattaaaatatgaaaaaacacggtctagaatattttaagtcattaaccaaaaaagcctggggcagtggctttcaaatgtatttgttcatgccccttggtaagaattacattttacataatgatccagcaaatccacataactaaaacaaaagtttcacaaatcaatatttatcttacccagtgcactgaactctgatattttccattctaattcatcctatttcaatttttaaagtaggtaatcaaaactcactaaattcatttttaaactcatagctcactgtattttgaaacactgagtattgagatgtgcttgttaattttacctatcatagatttaaaacttttctaattcttctactttttctagttatttctgtgagccaataacacctgctaggattgcttacctgtaaggaaggtccacatttgtcacagtcatacagtactgccactgtgtaaaagtagactgcccttgttccctgggcatgggagatcttgccacctccatgatgatgtcactaatggcttgtatcaatcacagtgtaaataatagaaaattctatttcaactaaatgaagtttaaagcagggggcagttcttttgctcttggaagcagcagtgcaagggtagctaagttcaggtgctgtttgattccagactcagacagtatcacctgcatccccctcaagcctgccttttctgggatggctcctgatgtggcatattcaactcccacttcatgagggcagcaggcccaagccacacactgccaaggtcagctgagaagagggactcttgcagactgagcacaaatctctttgaccacatgtttcctgatccagtcactggggcccagacccattcctggagctgggagtaagatcaaatctcaggtacactacatggctgagggtgagggtggaacgatttcctaaaaagaattcgaaatacctctccccaacagatgcaggaggagtagatactgggcagcaaatgcagatgttatctattataggccatctattttcatggtctttctcttttccctcctgttttcttggttgtggtgagtcttttcttgctgcttttcccacctacagaaacccgtatcttgtcctgaagtccccagtttaagtcttgtggaaagtagccactgtcaaaatgaagtgcagggccctccagggaaatgacagcataagtaattagaaagaattgattaaaatttactacaggaaataactgctttttagtgaagagaatggagtaatatagaagagttaaccaaactgcacaatgattgctagcattcaaatatgtggtagtgggcaagcttgtatagtcttccctggagtcctttaaatagactatgaaactgagtcttttcaggaggtatctgagcagtcagtgtcctaaaaatatcaaatgaccacaaatagattaaaagttatcgaagtttaagtacaaaacttaaatctggcaaataaagcttagctgattctattggctgcctttcacaattactttatgtactatttagtgtttcctcttcctcaagcctactaacatgaagtaaaacagaaatcgtttccaccagggggttagaaagtagataatagctacttagtaaagataatgttgatccattaaaatggagattttttttttttatactccagcagagagaaagaatggtgcctttaaaaggattctaatgattccgggtctagcatacttggaaagatttcaatgtaaataagcatttcatacataacagacggaatcttttgtttcctgaataacagaatcaagttatctactttgtcttagtcacaaattgctccctagtttgttaagatgcacactttatatatggtatgatgatcctgggttttgcattttgtgctaccaactagcctgcctagcttttagatattctctggcctcatgtatacttagaaaatctatattccaaatattttttgtagttttgttctataaaaataatacaaaataagcactctaaggtttgtattattctcctaacttggtctgtaattttgcataaaagctttaaatcctctcataaatttatttttatctaacaatatgcccattcatttctaattttctaatttctatctcttaaaagctatagaattttaattccttatagaaactaatcagtcttttatccttgatagtgatttcagtaagttcttattttttaaatgaagtttttcatgtatattattttattttggtctatagtgtggcttgatctaagaacccagtctaccgttgagagtcttagtaaaagaattccaggaaataataactttgtcaaggtaagaatttcttcagaagtatactataagaatgtttctttttttaaaaaaagtttgcagatttcactagaaagaagcatcttatggtacaatagttatttgatacaatttatagaatctttttcccggataattgaggccaactcaagtctttaccttcccgtctttcttgctctgtggtggattggaacaataataacacaaaattgacaggctggaagagattataatgcgtcccagtggcttaagtcacacttcccaaggggtgctttttttttttttttttttttgagacggagttttatgcttgttgcccaggctggagtgcaatggtgtgatctcggctcaccgcagcctctgcctcctgggttcaagcaattctcctgcctcagcctcccgagtagctgggactacaggcacgtgccaccatgcccggctaattttttgtatttttagtagagatggggtttcactgtgttagccaggatggtctcgatctcctgacctcatgatccgcccacttcggcctcccaaagtgctggtgggaggggtgctttctataattgaactatgttttccaaatctatccctattttttctactgcccatcaaagaatgttctggctgcttttgagtttttaagcatctggattcagggagagagaaagtaaaagacactctagccctttattgaacccctcttccactttgttcatatgaagaaggctaataaaactgcctaattttcagtccttgtatagatccctcttcacataaaggaagggagagtgaatttttaaaataggtgaggaattttttttagcaaggtcaaggccaagttcttctagcgtctaaaaggaagttccctttttctgtttttgttttttgtgttttgttgttgtttatcccgtttttatttgtcagtgggatgcttgtatcattttcttctaaaactattgttgaaatcccattaattgcagtaatctgaccattccgtccccccacaataacttcagacttgtcctgaataaatcattttctattccgttcccttcatcaccctgcccaatcctcatcctcacctccagctgcactctgcttcgagggatgcatgcttttctctccgatgtcattttaggcaacttttacactttctacccccatgatgaaaataagatattatgtactacctcgctattgactttgtgagatcttcccaggtcatcttttgggatgacccttgttccttcaaattaaataatatttccataaaatatctccttccattttttttttcgagacagggtctcactctgttgcccaggctggagtgcagtggcacaatctctgctcactgcaacctctgcctcctgggttcaaatgattctcctgcctcagcctccccagtggctgagattacaggcaagcaccaccaagcccggctaatttttattctatttttagtggccaggctggcctcaaactcctgatctcaggtgatctgcccgcctcagcctcccaaaatgctgggtttacagacgtgagccaccgcgcccggcctccttccattatttttgtgcattgattttttttttttaaagaaagctagaaaaccttgagttaagatttttaatttacaggttgcattaaagtattaaatcctttggtttgagttttcttacaaaaccatactcatatgagataggagggaaaaagttatcactttctgtagttaggtgataaataagaatacagatggggaggggaatcatagttgcattatttttgtgtatgtattttctttttcttttctttttttttttttttttttttttgagacggagtctcgctctgtcacccaggctggagtgcagtggcgtcatcttggctcactgcaagctccgcctcccgggttcatgccattctcctgcctcagcctcctgtgtagctgggactacaggtgcccgccaccatgcctggctaattttttgtatttttagtagagacggggtttcaccatgttagccaggatggtctccatctcctgacctcatgatccgcccacctcagcctcccaaagtgctgggattacaggcatgagccaccacgcctggcgtattttcttaactagttaactttaatcagcctttatatacatttagtgtttaatatactaaccacaaatgagttgggtttgacccattctcaaggaagattggtaagcacatatgtgtttcatttttgcccattaatctttcttcagttcacattccctctgtttaatatatttgctaaatttaggcaactgctgttttagatagagtaattctgtgttgctttatttattttttattttttattttttttgagacagagtctcgctctgtcatccaggctggagtgcagtggtgcaatctcagctcactgcaacctctgcctcccaggttcaagcgattctcttgtctcagcttcccaagtagctgagattgcaggtgtgtgctactatgcccagctaatttttatatttttagtagagacggggtttcaccatgttggccaggttggtttcgagctcctaacctcaagtgatccacctgcttcagcctcccaaagtgttgggattacaggcatgagccaccacacctggccctgtgttgctttaatttggcatgtctttgagctctactttagtgtctactaatttcatgttatgttatttgaacttgtgtgtgtatatatgtaaaatatattattaagtcttattgttttaaaagttttctggttatgatcattagtttatgatttggtatactctctggtttttaatagtttaaatgtcatttttatggaatataaaataaacagcatagttttgggctaggttctacatacaatactaatttattgcaaaaatcaacatctacattgtcactatctaattacaggatgttgtgtcatttaattttctctttaccttgctacgtggatgccctttgaactgtaaacatgtcaccctaatctttgttcatgaacatgctttcctgtgccatgagacaggaaaagtatttttattcataatactatgggattgccttcagggtctttgaatattttgtgatttgttgagttcttttgtttggtggttttgttttaaactgttacacttttcatttgctaactgaacttcacaactgttttagtccaagacaggccttccacttagcacttacttcagtgcagtgaaacttcgttggctccttgacaatgtgagaaaagttcaaaaggccgttgaagaaaaacgagctctttttgggactattgattcatggcttatttgggtatgtttaaatataatggatatatggagaattttttcagaaattttttctagactgccttgcctattgtttctactagcaggtcagactttttaattagcagcattatgaagaaaaaccactcaaaaagcaacaggagaagttttcagcttccattcgagaagcatttttgcctacttcctctttattttttcttgtcttacttcagtgaaaatgaaggataattaccaaaactgtatctaatatctattatctttaggatgagtaatttagataccctttccctattgtctgttatatactcctttcccactagccatgtcttagacgaaataactatttagcaggataaaatacctagagtacttttatcttttgctttcaacattacataactgtctcttgtataatcaagccataatatgaaactaaatcatagtggaaatttctatttagaatctttttgcctaagctgaatacacagcaatcatcaacctatggccaatcttatttctactatactcacatattctttctccccacagataattttaaaacaaatgccagacatttcattttatttgtaaatatttcagtaagtatgtaatgatcttttttaacattcaagggaatgtcaaggaaatattgtccccactctcacttgacagatccacagagcaggtctttcagaacccatatcagaaagaggcaccttcttcacctctccatgtgcttggccagggcagaatgtgctttgtgttcatggccagccattttcacgtgtgtcagtcacagttgaatgagtacctttgacaattgcatcgaaccagagtaaggcaagatgtggaaactgtgagctgcaggagactcaagggagcacattttggctatatcccactggatgctgtttattgacctttgttcctttcctacctcttattgcttccatgtaaaggaaagcagcagtgccttcagttcaggcatgtgggtacacctgagaaagaaagtttaaaactctcctttcaggatatatgcttaggtgagtgtagatagcataatgcgaattgttatttaaacaacaacagcaacaacaaaaaaaaccaaagagataacaacaacacacaattctctaataatccttatgaggcagatatttccatttatttcatctcgccgaatttaataagactctgagttttctcaacataataggatgaaaacaaaaccgattttttatttatccatcaagtaactggaattgtgctgataaggtggccactagccacatttggctattgagcacttgaaacatgatcaaattgaggtttgctgtaagcatggaatatacaccagatttcaaagacttagtacagaaaaaagaaggtaaaaaaatgtaatgttccgttcttttgctttatgtgctctgctgattatgacccttaacaatatgtaaattaaattgccaataagtacaaatttaacctgatttttttactctgcctagagtttgacaggaggagtcaatggaggtgtccactgtacagatgtaacaaatgcaagtaggactatgcttttcaacattcattctttggaatgggataaacaactctgcgagtaagttctgttttgctctaaatatagttttcccaatacactacctatttataaccgaaatcttaatattttcagatgtcagtggagcaccaaaatttaactgttgatatttcaactacaatatgcaaatctatgttatgtgttttttaaagagagactattattgcatttataataaacaggccaaattaattattcttcacggaagtttaggttcctttataaaagtactttggtttctgtgtgctttctaatttttattgattggcttgcataaagttagaatgttaaatatctaagaatacagctatgttctgttggcttacgtatttattgctatctaactccatgctcaaaaacatccatttctaattgttatttatgctttttgcatttaaatacatataaatgtttctagatgtctatttaaaacagtgttaaatacccaatcttcttgtttttcagattttttggaattccaatggaaattcttccaaatgtccggagttcttctgagatctatggcctaatggtaaaaaacaaacaaacaaacaaaaaacacaccaaaaaaccaaaaaacaaacaaaaaaaaacctaataattaaagtttttttattacaaaacaagtttactattcataattcaaaagtcaactgtgttatgttttgtgacttaaaaactttacagtcctttttacaatggatttgcatttataaactttaattggtttttctttgagtattattatttttaaagaattgatgggatactctaactttagatgttggcatgagccaatttattctttgaatccaaataactgtttagtggttgtgatgtctgcttttaatttagcggagagactctgcatatttagtagtgttctttttcccgttgaatcttttttatggccaagctatgttatatattagattctttgcctgagcaaaatttagcaaagaaactgaaagcaaagagtctgtttctgatttgggattgctaattaaactagtttctgtaatggacatttttacttttgatttcactgaaatccagtaaagacatagcttcagcaaaagtgtgcctagcatcattaagagtctgtggttaaacatcaggaatgaaaacctctaggaggatttgcactggtgtttgagcacaaaaatctggaatttatgataagactcaggaataagtctgataaattacaaaaagtattgcttagacatttcatgaaagatatgagaaacttcacttacaaagttaataataatatagatgaacactaagtgctctggataaagcttgagcaagaatttttaactgttttatttataataaagctttttaaggcaacatagaatttcttaaggaagccatagtcactgcttatctacagtaaaagtgctttgatcatttcatagctgtctgcaaactgacttgggtcaaggaaaaagaaacgatgcttgagaaatagtttcacaggatggttagaaaaaaaaacgtggaactggcctagttttctcttgtatttaaaatattatgcttctatccttctctctcccccttgctgactatagaaaatctctcatagcgtggtgagtaggttgcccgccaattatgtacccattcatttggaaaagatacagtgcacttccatttatttttagacaagcagaagtccatttactaaacatatatatctagaatttccgtgaccttccaaattattataagctctagtcagattttaatttttacaaaaacttaatcttgtttgtttttaaagagtaatgttctaaaataaaagactaaggtagtttcctggaatgagagattctgatattctcataaagtacaactgtgatgtgctttgggctttaccataatagggcaattagatagatacagtttgaaatgtctattttaaatgatatattgaccacctttccagaccagttagttggaaatgcactgttactttttctgcatgcttcatcaaggatgctccaggaggagcatcagaggtccctccctctgaagaaaaaagagcactttacatgcctgaacacacatagtagatcctgttgatagtttgttaattttgaaagtataagcaaagacttcttgtaatacttaaatatatcaagatatatagcctctaggtttcctatagattcactttaagccttttatgaaatttaccctttacttaatatccaggttcagattttcaaagaatatatacagtaaatgaaaatagcaggttttgctgggcacggtggctcacgcctgtaatcccagcactttgggaggccgaggcgggcggatcacgaggtcaggagatcgagaccatcctggctaacatggtgaaaccccgtctctactaaaaatacaaaaaaattagccgggcatggtagcgggtgcctgtaatcccagctacttgggaggccgaggcaggagaatggcgtgaacctgggaggcggagcttgcagtgagccgagatcgcgccactgcactccagcctgggcgagagggagactccgtctcaaaaaaaaaaaaaaattagccgggtgtgctggcacatgcctgtattcccagctactcgggaggctgaggcaggagaatcacttgaacccaggaggcggaggttgtggtgagccgagatggtgccattgcatgccagcctgggcaacaagagtgaaactccatctcaaaaaaaaaaaaaaaaaagaaaagaaaatagcaggttttgaattaaccagaaaacaagaaagaaataaaatgataccagctatctagaggacattttctattttgtaaagggtttctacatttatgctattatttcttcattatcatagctatgtgaggtgaattctattcttgccctcactttaacagacgggatatctaaagctcccagagcctgggagacttgctcatacatggcagaccaaggagtcaggtccaaagctttagtttggtgctcatcctagtacatcacccctacttcagggattttatatatatatatatgttttatatatatgttatatatatacatgttatatatacatgttatgtataacatgttatatatacatgttatgtataacatgtatatatacaacatgttatacataacatgtatatatataacatgttatatatatatatacacacatacgttttatatatatatatacacacacactttttttttttttttgagacggaggctcactctgtcacccaggctggagtgcaatggcatgatcttggctcactgcaaccccgcctcctgagttcaagtgattcttccacctcagcctcctgagtagctgggattacaggtacccgccatcatgcccggctaattttggtatttttgtggagatggggtttcaccatgttggccaggctggtcttcaagtcctgacctcaggtgatcctcccacctcggcctcccaaagtgctgggattacaggcaggaggcacagtgcccggctggggatcctatttcttagttctcctaattccttaatatcattaaatattgccttgagttaatgtgtctttttttaaaattaaggttgtcaagtctacaatcagccacttaaatctcatttttcttcctagaatgctggccatcatgatcaaaataaaaaccagtatttatgacataaattaactgttgcttatctaaatttgaagaaagatgtttgctatgaacaaataatatacaatacctgaacactcttgtgtttagagcagcttgagtagaaagaaaagttgctaaaatatggccttgcaaaataaatgtgtttcatactggtttgatagctattggaagaatatattagtcatttcttaataatggcaataatagcaaagtactaatgaacttgagcaatcacgtagcccaatctccattttgtagagaaataatgtgatgtattgagaggtttcaacagcctgctagtagattaatactaactaactaaccaagagtagagccctcatttactggctcccagtctaacgttttatgttcattctccagtgccacatctcttcctgtcattctaggaatacttgtagtatctgtctctttatcattcatttagttgaaatgctttctttgtcttgtctgcccacatcctctggcacattgctacttgtgttcactcttgttgcagctatgttagtagagccaaaattttgtgactattcataatcctttttttaaattttattagaaagctggggccttggaaggtgtgccaatatctggggtaagtttcatcaccaagtgtctccccatccccacccttccccatgttatggctttcctcctcttagttcatcagtgtgcctctttttaaactagggaaaacaagtaaaagttgcaaaattggctaattcttgttcttacatgtcatactgtgggccattgagaatcttttgaataaattaattttaactctcccttcccatacctattatcttacatattaacaaatggtattaacaaatggggaaaatggccaaatggagaaaatgcaaggaaatagacagttcattctttgataaataaaaaatgaaaaatcctatggctcttctaaaaagaaagttaatactattgtattagtcagtgttctttattgtcatttatactttcagtgtttaggggaccagtctgctgcattggtgggacaaatgtgcttccagattggacaagccaaaaatacgtgagtttaagaaacagacttaaaaaccaatgctgttttgttttttctacttggtgctttgaataaggaaaagcttttgaagttcatccaggatgaaaatcaatagcttaatagctccaatatgcatatatacactttttaccatttttttatatctttaaataaaatacaaaatgccatatatatgcacactgatgaagcttataaagacctaaatttgtaggctgggcgcggtggctcacgcctgtaatcccagcactttgagtggccgagacaggtggatcacctgaggccgggagttagagaccagcctgaccaacatggagaaaccccatctctactaaaagtacaaaattagccgggcgtgttggtgcatgcctgtaatcccagctactcgggaagctgaggcaggagaatcgcttgaacccgggaggtggaggttgcggtgagccgagatcacgccattgtatgccagcctgggcaacaagagtgaagctctgtctcaaaaacaaacaaataaacaaaaccttaatttgtaaaattcattaccttttatatcctaaaaactaaattttggttcaaagtattcttgcctttttggggagattggtggggtggtgagaggggtgggaagaagtgaggaagagctgtaatatatagtttttggcatattaagtctttctcactaactgtaaagttatatttttgtgggattttcaaggttattttcctggcattgtgctttctctccattatctgaagtttcgcctttcctggcattgtgctttctctccattatctgaagtttctcctttgacaagaagcagaaagaatgatagaagtagagatttggtatatttttctctcaatctcatcttcttactactcacacatgcagaatctggaacaagccccatatctaagagtaataagaagatgactcccactttaggataagaaaatggatactcaaggagcttgcctaaggtcatagccttgacacaaaagcagaaccagatctcaaggccatgccttctgagtctgaatctggcactctttctttctgttcccaccaatcactatatttatttgaaggtaatctttttatttatttatttatttttactttttatttttatttattttttttttttgagatggagtttcgttcttcttgcccaggctggagtgcaatggcgcgatctcggctcactgcaacctccgcctcccaagttcaagctattctcctgccttagcctcccgagtagctgggattataggcatgcgccaccacgcccagctaattttgtatttttagtagagacggagtttctccatgttggtcaggctggtctcaaactcctgacctcaggtgatctgcccgccttggcctcccaaagtgctgggattacaggcgtgagccaccactcctggccaaggtaatcttttaaatattaaaaaatctacctgccaattatacgtattcatgaacaaaattaaatatgcctcaaaagctgaattaatactaacaattataacacaagcttagccaatggctattgtgttacctataatgtttcatgtgctttaaacacatgatatcatttaatccacatatagatcctattattcccattttatagatcaagaaactgagaattaaagaaaaaaatttatgcaacagcacacaactagtaagtgggagatgcaatatttgcacccagatccatgtcattccttagccagggttcttaacctgtgtactgtactacctcctgtatggaaaagatttccatataactggcaagaggctacatttaattgctattttcttgaggatttcctaattatctcatcgattttaacttcagtggttaagttcttcctttgtgaataatggaatgtgtaacatttctagattaaacgttcttgtagtctagcagggtcagtggctctcatgcaagagtgtgacattatttgtgtgagagttttttgaggaggagggatgtgggaattctttgcaggtcatggtaatctgaggttacatgaccaagagcatctgagtcagcctgagtctggaaacattcttggaatctgggttccaggcagctggaatcaagtgccatgagaaactttgaagcaaagctgttgggtttcaatgggaggatagaaaagtcacaaaagattatcttagtaatgagatgctttgaaaaatgagcagtattggagggtacagggaacattgaacaaagatacgtatggggaaatagaagactttgtttagagaatgtagagaacattagagtagggaagtgacaaaaaatataaagctaggatcatgttgtgaagccctatatttcaggctaaggagcttttcttgataggcaataggaaacttttgaaggtttataagctggtgttcagagatgactggagttgtcagtagcagtcttgggtgaaagtgaggaaagactagaggccaagatgccatggaggaagccaccatagtgtcccggtaatgagcacatgggctcagaaggatggagacagagagggaggccatgagtgaatgtgcatggcactgcagaggagaaagggaggggaagtaggtatgtcatctaggtacctggaccctgtggttaggcttagccaaagtaaggaaagggtctgagtggaagaatttctgttcagagcgtgtttgtggtgctggcaggctgtatgttgcacacatttggaaatgtggaataagttcagtataaaaatagaaatttttggccaggcacagtggctcatacctgtaatgccagcactttgggaggccaaggcaggtggatcacttgaagtcaggagtttgagaccagtctggccatcatggcagaaccctgtctctactacaaacacaaaaattagctgggtgtggtggtgagtgcttgtaatcccagctactcagaaggctgaggcatgaaaattgcttgaacctgggaggtggaggctgcagtgagccgagattgcatcactgcactccaacctgggtgacagagagactgcctcaaaaaaaaaaaagatggaaattttagaatttccctagatagaggggattttgaagcaacagaagtagatgaaattaccaagaaaaaatatacaagtagaggagatatttacacaagtagaagtagcaggcacggggatggagaagtcagaaaaacaatgcagttattcattttatatatatatatatatatatgagatagggtcttgctctgtcacttaggctggagtgcagtagtgagatcccagcatactgcaaccttgacctcctgggctcaagtgatcctcccctctcagcctcctgagtagctgatactacaggtgcatgccaccacactcagctaatttttaaattttttgtagagatagggtcttactatattgcccaggctgtgtcaacttcctgggctcaagcaatcctcctgcctcagcctcccaaactactgggattataggcatgagccactgcacctagcctgaaattattcattagtgtggaaatccagggtagacatatttatgagggaggcatggtcagtagcgcaaaacattactaagaggtcatggaggctgagtaccaagaatggaccattatacatagaaattaggtcttcgtttggtgactttttttttttttgagatggagtctcgctctgtcaccaggctggagtgcagtggcatgatctcaactcactgcaacctctgcctcccaggttcaagcagttctcctgcctcagccccccgagtagctgggactacaggcgcccgccaccacacccagctaatttttgtatttttagtagagacggggtttcaccatgttggccaggatggtctcgatctcttgacctcatgatctgcccacctcagcctcccaaagtgctgggattacaggcgtgagccaccgcgcccagccgttttgtgactttcaagagtgaagttgtactagaatgctcaagatagaagcctggttgcaaatggtcaaaagagatgtaagcaggtaggaaatcgaagacatgtgctttgcaaaaatacaaccatccaggaatggtgagagaaggacatagtttgtgaggttaacaggattatgtaacattttgggaattttgtttgattttgtttgtaagttatggtaagaccagagaatgtttctttggagtctgagcggagaacagatgaaagttgtaaaataaatgggggataagtgatggacaagaccaagtaagaggttagagagattgggattgaaaatttagttaatttctcccaacctcagcagggagaaaatgacagtcagctcagaattcaatgaaaagcccatctctgtttcagagtgggggaagaaattatggatgattctaatttttctttcagcttagctgtattttccaatttttctagaatgtaaaaattatttgaacattaaattttatttttctgaaagagcacatgagatagctgtctcatttgtccagtagtgctgactgggtgtgacagagttttttacctccctcacagcttcctctggggtcaacccccctgcccctatgcgccatcttcgtcacacctctctgggctgctcagtcctgatctgatagtcatgaaggagagcaagcaacgtttacctttgtagaagttagaaaagtgagacatctttctgctatgtttgaacacagtacagtgttctgtgagtacaatgtacaatgaggaaggcgaggtagatcatgtaaatgctgaaagctccatatgtgcttgatgactgggaagaaagaacaataaaatttaagaggaaaatacttgcctgtgtactgctttaaaagctgtggcctaagtatagcaaagaagtctcttcatatttgctaatactcattaattgcttattaagtatactcacttaagaattcacttttattaagtaccttcagtcttctcatcagttttgcactaagacgcgtacgctactgttcagtatagtgtttatatggatgctaaattggtacagatttctcctttaaaaagcatgaaatagataattaacttccatttttatgaatatttatcacagtagattaacttgaaacatgtagctttttcagtgtgcggcaataaaacggtatagtgattttgtgttttagtttgtaaatgtattacctgtacctagtgttatttgacaagtatctttacaaaattagatattagtcccatgctccttgaatttgtcacctgctcatcaagcaggccaagaatatatttgggtgagaagagatagactatcctaggctaatccttatggtaacaatggtacctggaaaaatgtcggaaaacaatttcccttggttttgtgtttgttgcacaatcaaaatgcagctgatgggatctgttgagttagtgctgactggtggtagcttcttctgggatccttctgccagctcctggactgagcactgtcccatctttcagttgctggaatgtcaccagcacagttagaaccctggtggtgcagggcacagcagcaaggcccacggggaaggaatgcccagcttgggcagagccaagcaagggtgactgtagcaaccttgttaccccaagcttaactgttcctctgtgacccttactggtatcactttgggccacttatctgcctggcacatgtcaaaactacctattaatgtccaagggccagacttgctgcagaatccaaagtttatattgataaggctgccacaaaataaattcagttcttctgtatcagccatgttacattctggctctgattatcaaaggtagaccttaaattgccttccgttccatgccactcttgtcctagctttccaactacaccctcccacactctgtatccagcctccccaccctgccagaaggtagtggtgtttctcattttatgactgtattaatgatagagctaagctggctgtcagtcatgatgcttcactccacatggattagtagtaacataactatgacagaacttagaatttgttgtaattcagtggtattttataaacacagccctggcctaggactgactaaacactaaatactatatctgcatttttctattaagattgcaatggccaggcacagtggcttaaacgtctgtaatcccagcactttgggaggctgaggtgggtggatcacgaagtcaggagatcaaggccatcctgactaacacggtgaaaccccgtctctactaaaaatagaaaaaattagctgggcgtggtggcacatgcctgtagtcccagctacttgggaggctgaggcaggagaatcgcttgaactcgggaggcggaggttgcaatgagccaagatcgcgccactgcactccagcctggtgacagagcaagactccatctcaaaaaaaaaaaaaaaaagattgcactaagtacattttcttctaggctgatttctaaaacattattccaggaagatatatgatttttgttaactttaggaacttttataaaactataatgacttttttggactaaattatatgtcagttttgatcatttgtgttattaatgtttcattatttgctttcaataaaattgtcttactattcattctcccttcaaccataggtatggaacaggatgtttcttactatgtaatacaggccataaggttggttttttaaattaaaaaattgatttaaaagtctaagttcatctaaataatgcttgaacataatttactattaaacaacttttagtctttagcttttacttaatctttatcagggtttaatttagagctcaatacaaaatttgaatcgttctaataagaaccattttagactctttgaattttatatgtgtgtttttaattgtgctggtgggaaatctagactgagacctcatcaaattcttaatgcaaatctaatttgaaacaaggaataaactttttatacagcttaaatgtgttcttaattctgatcgttttgactgtaaggatttattttaaaaattggtttattgattgcattattttgtacctatgttattttaactttaaaaaaaagttctcatgttatcttttcattttccactactgaaatcttttttttttctttcttacagtgtgtattttctgatcatggccttctcaccacagtggcttacaaacttggcagagacaaaccagtatattatgctttggaagtaagttctttttaatcaatatggataatatgacaaacattcaaagctaataaaaattacagtgttttctaacacttttctggtaaatcttaatacagaggactcaaaaagttctgctttcttggcatttgattgagttgaaggaacctgaaactgatctgggtgtcaggactcacaggagaccttgattagattggttcctcagttcttatgccaattaatcatgtcaccttaggcatattacttgagagctctacaatgtaaggttttttttttttttatctctaaagtttaatcggattaacgtgctctctaacatttctttcatcttgaaaattctttgattttataaataaaatgctccagtgttccaaagagaaccctgggcacaaataggcagaacaactctcttcacttgtctcctcataaaaataaattttgtgtaacattttgatatagaaaagaaagtgaggagatttatgccacttatcactggaaacatttgtttcaaacatttttgtatgttatagtaggaatatgccagcctaagcctataggatatggtaagttagtgttagaaatatttatttataaagtcaaagaaataatattctttttgtaaaattagatacatttcttataagcatttctatataattaattttgaaatggctaccttataatgcacaagtatacacttgatctgcagactcattgaggctcattttttggagtgcctgataataatttggtcacaagttaaagacttctagttagagttaaaacattttattagtcattatgcctagcacatgaggaatattagtttatttctatttttctcccttccccaccccataaacactataatatttctccccagctccttttctatggatggaagcatttgtgaaaacttagtctgtatattaaatgtatcttaacacttctcagaacttaaaatcctacaagccctctccctctctactttccctctgtggagagtgcatagcacaacactaggcacatagaatatgcacttgataagtgttacctataatataataagaatatgattctgctttttttcttcttgcatgggaaacaatcagtgctttagaatacaggtgccttagacctgggacaggcctcagggacaggggtcactcggtcttaactcccctcccaatgtgaaaaaccttctcctgtctcctttaccagtagccatccaacttctatctgaagacagcacccaaagttgcttcttaataacacctctagcattggacctgcattggttgtcaaaagtgttccaacattagaggctgcggtcagtttctctgggtcttcctcctccagggtaaactgacccaatgccttgatctcacatggtttctggatgctttatagttctgagctcccttcattgggtgcattgcaattcatgtcgtccagaatggaatataacattctacatctaatctgacctgtactcaatcaataggatgatttgtgcctctcctaccataagcactacttttgctcctctagcctgagagttcattaatttagactaatatttattaaattaatatttattaattaaaataattaatattaatttagacttcatattattggccctgggagcatatgctaaaaaacctagctcgttttcaaatgaatcattgtcaaaccaagtctgctctgttctgtatttgtgtagtttttttgttaaatctaaattcaggtctttgtttcttcctgtttaatttcataatagtgattttagcctattcctatatagtctgaattcgttttcactctttactgttactctttcagttttgtctcatctagagatttaacaagtatatgctttatgattttgtttcaatttatgtaatgcttttagatgcttagaattgtaaaagctcagagagacgctagatcatatgacaatataccctcctatccccttgttttacacgtgaggaaaccgagattagaaaagtgaaattggagtcccttggccaagtaacttttgacaacagtaagtagcagatccagatgcttggacatcaaagccttgatgcctaggccaccctgctgtaccatttccttccttgtaagtctgaaagttctgggctccagtctcccaagtccagtgttgttgtcactgcatctagcttatgtcccttccttcatctgctaacctagcggtctcagcaacaacaacaacacacatacgcatactaatatgttaacggtgtagttagaatttttttctttgttttcttaatttttttttacaattaacaaacatttaaaaaaaattaaattaaaccaaaccaaaaaacaagggtggggaataatgctagactggtaaaactttttatcagtaaacacatgctaatttcacttggtcatactaattcctttttttgtaaatgcttacaaagtatatatttaataatattgtctttcatttgatcaattgttgttaggcttagaagttggagataggaaaattttagtctttatgctctttaaaacctaaaactatagctacccatcttcagtcttttagtctttttccattcttcctctgctgatttgggaacaataagatacatttctatgtttttattttggtgattttttttcttttgcgtataccctcagatttttaagatattgtttaaccatatatttttctaagagtgtatgtcattttttggtatttttaatctcccgaccatgataaggaactctaatattttattctaccgcctccatcaccaattgtgttattttgtttaaagctttcatttcccccattttgttcaacatgtaataattactgttgttttctttgcagtccacagtaaatcatatttattgacttatttttcttagtttgtgtccagtatcatttctttggtctcacaccttttttattcccacctacttttttcctttttttcttcttctttttttttttgctgaggggcatccttctatagttcttttagttttagtgtgggatagtaagcctattctttttaggtttgtctttgttttgccctcactctgaggatgagtataaaagcctatattaacaattgtttttcccacatcccttctggccattttcgatgttgatgagacctctgctgtcaatatgtggttcatttgtagataatctggtttattgtctgggagtttctaacattatctctttatcattgatgttctgtagttttactatgatatgcctgtgtttggatttatttttatttatcctgttaggtacttggatccaagtctgtcttcagatctggaaagttctcagcaattatctcttcaaatattgctcctctaccattacctccatcctcttctggaattgctattggatgaatattggaacctttcaacccatcatccatgtctcttaactgcccttttatatttttttaatctctttgtttctctgtgctgcgtccctggtgagtttctcagtatctaccttccatttccaaatcctctctttaaaacaaacaagacaaatcataaaagccttttttgtattgtgaaatataagacacatagagaaaaatgcattaaatatcaatgtacaacttgaaaaattattataaaggctcatgtaacttgttcatagaacgccgccaatcccaagaacctctatttgccccacgatcacaacttcctccctctccctgagataaacatcagcctgacttttatcataatcacttccttacttttctttgtagttctaacacttaaatgtgcagccctgaacaccagagtttagttttgcatgtgtttaatatttgatatattaaaaatataaaagaaaagagagagagagcatgtgcatgcatatctgagtcacttagtatgtatttttttgtattttttgatctggcttctttcactcaacattatgtttgtgagattcatccacagtattatacatagctgtttttttcattgcttcttattgctatatgaaattattgaagtttagtatttattcagctgttgatgacattcgagttgttttcagtatttggctattatgaaaaatgctgctatgaacatttttgtatatgcctcctgatgtaaatgtattcacctttctgtaggagtagaatttctaggccatagattatgtgtatcttcactttgagtagatagtgcaaaccatttttcacagtagatgtgtcaagttacactcctaccagcaatatgggggaatgctagtttactcatcctctctatctagtctagagtttaccccatctagtacatttttcatcttatttaatattttcatttctatagtttttatttggttatttttcacatccacctgattttgtttcagttctcttttttttttattcttagtttcatgtttgtttgtttttaaaatggaagtcatttcctaatttatctccgaatacttaaaacatatgtattttaaaatctgtgttaggccggaatgaactctagtccagctattaagtttgttggatttcttttttcttttctttttttttttttttttttttttttgagatggagtctcgctctgtcgcccaggctggaattcagtggcctgatctcggctcactgcaagctctgtctcccaggttcacgccattctcctgcctcagcctcccgagtagctgggactacagatgcccaccaccatgcccggctaattttttgtatttttagtaaagactggaaataacgaagtttcaccgtgttagccaggatggtctcgatctcctgacctggtgatccgcccgcctcggcctcccaaagtgctggaattacaggcgtgagccaccgcgcccggccttgttggatttcttaatacaagatttcttcgtatagtttagaattgtcacttccagccttgtcttccattaagccatatagcctcagtcagcaaatacacagttgcttgtttttctagcatccctacacaagtaagagagcgccacctagctcctggcttcaagcattgagcctgattctattccctgtcttgcgcaaaacattttggacccctttcttctggaggaaccagttcccagccaccactcctactccctgacacatatagaaaaataaatcagaagccatcatgcttgtggcttcagtcctgtttggttatgtgtttccgtgtctgtccacatagatgttattctgtatttgagtcagcatgttgtttcagttttctcttttatatcgtgtctgttatcctctgtggttagaacaaaggggatttttgaagtacaaactcattatttctgctcatgtaagcatctgcatcttctttttcatcaccaagagaactctttttctctccctgaagcccctggcaggtgatagtaaggcctgacattttaatacctctaaattctcattttcattatttgtaaaaagaaataggtgttcatgatccttaagttgttctgtgacattaaactcatattaaactggttaaatttgtcccaccctttctagttggaaaatatttctcagtagtggaagagactggagcaaaatagagccattgagtggttctgccttccctctggcatccttgttcctcttctttttccaaatactgtttcacaaaacaaaaatccttttgggaacttttaatatgagtatgaacctgagcttacttatgacttgagacttccatgttccgtgttttgtcactagaatatagatttcctgaggccagggtacttgtctatcttgtttaccactctgtcccagcaggctggcagataatacatacccattaaatattgttcaaataccgaatcctatgttaggccatttttttctttttaaatatgagcttcaaagagggttccctatattgcctccctggtttctttaaatatctcttcccctatcttttctttgttatggtttaacgattatagcgttaagatttcctttttagagtttttcatccttcttgagctaaatccctattttaggtataaacctatgtaatagattatctattgctgtgtaacaagattaccacaaacttaagtggcttaaaacaacacatttattgtttctcagttcccatgggttcagaatccaggcacagcttagctgggtaccctgctcagagtctcacagggctgcagtcaagatgttgactgaggctctgctgtcatctgaggtttaatctgcttccaggttcattcaggttattggcaaaattcagttccttgtggttgtggaactgaggacttcagtttcttgctacctgtcagatggaggccaccctcagctcctagggctacctgcagttccctgctatctgagggacccccagtggttctctgcttccttaaagtcaggaagggagggaatatctccagcaagacaggcacagtaaatcatgtaatggaagcacgtacacatcaccacacatatcccatcacttttgacatgtactgttgggtagaagaaagtcacagatatcaccacgctcaagaggcgaggattatgcaagggtatgcacatcaggaggcagggatcatgggagccaccttaattaaaagtctatctgccacaagcatataaacattgtttatgaacttttataatgttctttcttgaaaagtatactttctgagcaataaatgcttttaattttagttccccaacttgttactgaagtattaatgaaatctgttacatttcaaaaataatgttgctccaattcaactcttccctttctctatgcaattaaaaatgctatagagttagacactgcatttgtaatctaatatatacaaattaactacattataaatcatatacgtacagatacatagcactgtagtatacacaaaactgtgtttgctatgcctgatgaatgattgtaagcaatttagggtaatctttactttacctgatttttctccatactcaccaattttcaccctaattgccttgtaagctacaattctactgcatcctgaaatatcctgctttatttttatactgtttgtggcagtggcattcatgtcaaggagcttttgaagaaaaatgtatttgcctgctatgacattacatcagatctacttgattatttttaattcaatcttcctatagcctgtttattagcctttcactttccaggctacatgtctagttttaaaataatttattcctcttgccctgttataatttaatttattattctttacaccctctcactttcattgcatctcccttagtgtacaactattaagcttgcatgcatcttttccagggaatcataacctagaacaagggctgattcaaatttgtagatgatatactaaagtattggatctttatacttagggtgtaatttatggtaacttaactgataacaagtagacagtcaccttcttttatcattttaggttttggctgctatactcttttcctgtccagctttgaaacattattaccatcttccattttatttcctgcctctgaattcagaagaccacatgtcttttgtgaattagagatgtctctcatttttatttctttaaaagctaaatcataccatgtattatatcctgacagcaaaattatttacttttttcagataagtgtttttatctaccttttattgtgttatattgaatctagtttttcaatcacaacaaaacacttctgtgtattcctgatgacagaatttaaaacagttatctcctggagccttaacagtgactatgtattttttttcttttgttttaatctaaataatactctgattctcaactaattacctctaatcaaaaccttgattttccttttgctaaaatcatattgctttctcttaaaaatatggtgtaagcatgtaacatcctatctttttcaatggaaatgaggtatatcagcacgtggtttcctagagtataaagtcccaccagctgtgccacaaaatcactttactagactcctagcacagtggcttctaaaaattcgcagtttaactgtacttgcctaaaacaattatgtatgcatttcttggttagatgctatttaaggacagtgtctttgagagtataaggaggagggacacctgtttttgtttttctttttcaattaggtctagaattatactgcccatggcagccatggccacatgcagctattgagcactggaaatgtggctagtctgaattgagatgtgctgtaagtgtaaagtatataccagatttcaaagatagtacaaaaaaaaatctcaataatttaatattgatttcatgttgaaattttttttaatacattgggttaaataaaatattaattttaccttccttttacctttttaatgtggcaaaaatataaattacatatgtgactcactttatatttctgttggacagcactggtctagaaactcttacatatttactagtatttggcagctgctatctctgaattgtctgtttccaaaggaaatttgaatcttaaatctctttaaaccaaaattttacttagttctcttgaatgatcccactaagtacctaaatatgtaaatgtgtcaaacttaatacaacaacttattttaggcagggaatgagctgtgttagagtcccttgtaaggtatttcttgaattgtttttgtcccatttttaaagccttgtcatatttgcacagctatgccagatctgttcctcaaatacttcctgtggttaaaaagccattttatatatgtaatgatacagagtactgtatgtatgtctacatatataaaaatgtataaacagaacaattgtggcattctgtagctttgcagtaacatagtaacttctcatagaagctatgaatgatggaatataccagcatattcattctctagtttacttacattttgacaactgacaacaagaaggcatgaccatttgtaattcagttaatagaactgaggacaggtccctacatttaatattacctgacgtttggtttggagtgactctgtggaagtaatttacattaataatctatatgaatgaactatcagagctaaaaaaaatttcttggtattcctaatggttcgtgctgatacttctttttttttttgccttcaggatctttttataatagctttattgagatatagttcatattccacacaatttacccttttcaaatatacagttcaatggtttatagtaatactatatttacagatttttacaaccatcaccacaatctaactttagaacattgtcaccaccccaaaaagaaaccccataaccaccccctatcccccagcccaggcaaccactaatctactttctgtctctatggatttgtctgttctggacatttcatatgaatgggatcgtacaatatatcgtcttctgtgcctggcttctttcactttgcataatgttttcaatgctcatccatgttgtagcatgtattaagacatcattccttttcatagtccaataatactccattgtgtagacatactgcgttttatctattcatcagtcagtgatatttggctgatacttttttaacattaaagaaattaatgaagtcaatatttacatttagtaagaaccttcacatatattctcatattgagcctcacagtaatttgtttaggtaagtgttgtcatagtcatcattttataggtgaagaaatggaggctcagaaagcctaagtaacttaggcaagttacttagatgaacttgctaagattaacttactaagttacttagattagttactaagattacacagcaattaagtactagaactgggactcaaagccagtttatccaactctgaaatatgtttttattgttattgccacagctctaggtgattttgttttaaagaaaaattacttactagctagcttctttgctttttgttttcttgatttactatactgttagatatgggaaacagacttgaaaaaacttttaatgtggcctctcccaataattttatgaacaatatggcaatatatttctaagtgataacatacctcagtagcttagcaacagacagaaaattgttcaagaagcaaactgatcaaagatcaatgtccacctatggggacaaatccaagggtgtgctggaaagctcacttcttttcctcatcccgtgaaaaacttttattagtgacttagataaaactatgtttgtattagaagacctagtttacatatttgtcggagtctcaaaatggaaactgaattctgtccatctgattgtgtcatacacagaatatgctcaataaaaaccttggatagtgataaaatatattctgtcttgaattcctttttttctttagggttctgtagctatagctggtgctgttattcgctggctaagagacaatcttggaattataaagacctcagaagaaattggtgagtgtgttctaacaaaaggttagaaaatctgaaaaatgacacatttcagtattttatctctgcaaagtaaatacttatgctttgccccaaatgtgatccataaattatatggatccctattatgagtttgacttatgcaaaagactatcttgtgaagatttataaaacaaggaattgacataattagtggtggttgttaataaactggcaatgtagggcataaaaattacccaagtgtaaaattgaacactggagattgccagaacctgcagatagagaagttgagttaaatttatctgatgagaaagagctttaactcttagattagagtgagcattaaaactctggtacctataatttaagtattaatacggctgttttcagtctatagataattagtttgaacttacctactcactctttcatccacttgcttaactttgcctgaaggtgagacaatcagaaatacatttctgattagggacacactagaggccactttttcatctcctagtcagcaaccttaaaaatagtggaaatgagctaaaataccttaaataaatgaatctggttccttgatttcttgagctaggctacattttagtggggggtatttaatgtgagagaaactcatttctgttgatcctagcatactactgtagttagcaacattttgctctaccaatgaattggaaaccaaaacccctgtcctaatttttctaatttttaaaataggtatgcttatataataatacacaatatttgtgtgatttttgttttgttttgtttttaatgttagaaaaacttgctaaagaagtaggtacttcttatggctgctacttcgtcccagcattttcggggttatatgcaccttattgggagcccagcgcaagagggtaagtattgaaaatatggagtgcttttggggatcttgatttatttaccaaagtcgttaataacttattagtttcttatctattttcaaataattataatgtgttgagaaaaccttttctttttggagaatataatttcagaaactttaagctccaagaagttatgaatcagctgacaataacccctgccatatccgtattcatgttatcttttatcttcatgatgtctgtaagttgtatagtgaagggacatcatcataatgaatactgattcagttttatgatgccatcatcttttcaaatgtgtcatgaattttttcatacatgaatgcagaattgtgaaatataaggactttctgagttacttaatgattatgtccaattttctcttcctggacatttctgtctaccaaatttgaccttttcatatttgagatatttcaaattgattggtttatatcattctaatctgaaaatctttgtgcgtatttttaggataatctgtggactcactcagttcaccaataaatgccatattgcttttgctgcattagaagctgtttgtttccaaactcgagaggtaacaaatatgggcctgttttcttgtacttagttcacttttatcactcttaagttatatgttaacacccgagatttattcagtactgaaaatgtagttaatcaaatattaaggctgcctaaatactaatctaaatataagcagggttttccccctttttccagctgtcattaccttctaagttcctgttccctgtcaggcactgggaattttatggttgtggggaggctgagtggcacacattaggcaaaggaaacagcacaaacataggcatcaaggcagaaaaacagggtgcaaaatagagttgtatagcttagctgaatatcaaggtgaatgcagaggtgtagtgagagaaaaggttggctgtgaccagatcaaagagggcttagaagaccagaataagaagtctcaatttattccataggctcttggaagctcttgagagtttctgagtggaggattgccattttcagagatgttactatgaaatagatttataacattaattgcactggtttatttaagattttggatgccatgaatcgagactgtggaattccactcagtcatttgcaggtagatggaggaatgaccagcaacaaaattcttatgcagctacaagcagacattctgtatataccagtaggttagtaagtcttcattcctttaaactcccagagtaatgtttcttgtggaataactagttctttgggcatatgtaaccacaaagatattgatggaactctctctcctcagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggagggtacatttaaagaatgaaatgttcagtgatatactgtgaaaacgaccttagtgcacgggagttttgtttttctgtttagttaaaagttaaggaaccaagtaaaatagtaaatgttatcattgcagattcggctgccaagcatattgggctttactgaataaatgtgaatgagagaaatcgttgcttatcaaaagaacttctaaaatcactttttaaaaatcatttgcttttactgtttatggtcctttagtgtaggataataatactgccacactgtcaggtatagctagttagaatagcctttttttttttttgagacggagtctcactttgttgcccaggctggagtgcagtggcacaatctcggctcactgcaagctccgcctcccgggttcatgccattctcccgcctcagcctcccgagtagctgggacaacaggtgcccaccactacgcccgcctaatttttttttttttttttttgtatttttagtagagacagcatttcaccgcgttagccaggatggtctcgatctcctgacttcgtgatccgcccgccttggcttcccaaagtgctgggattacaggcgtgagccaccgcgcccggccatagccttttttaaagtgagaaggaagatatatcagccactcatccctaatgtctacaccagatcatctttggtgccagtggcccagttttaggacataattagctgggttaagagacactctggtaacttttaagcacagcaggactaacctgatgaaggcagcaacaatttaagtaagtgaacattagatatctgattcactgtgctaactaagctaagccacaagctgtgatcagcacttttactaaaatgtagtgatgcggttcttaaatttaaataaatgtagaaaaataaggttttatatattagaattggttttataactttttagaaacctatgcataaaatagcatcagctgggaatggtaatttgtgcctatagccccagctacccaggaggatctcttggcttgggcccaggagttcgagtccagcctaggcaacataatgagacccctgtctctaaaaaaacaaaaggaaaaaaaaagcatcaaagtggattttgaggtattgggaataagctttcaaatgcatttttgtttggttttctgggagaatataccagtgtttctcaattttattcattcttttaacatataagaaaatgaattataatactagtaattttatagtcagattataccatgtaccttgatttagaaatgtatttcaccatctgatattctgtcatttttaacttttgcaatactggataaaatatgaagttcaaaaaatttttctacttttcaaaaaaaatcaactttataatatgcaaataatgtccagagcgggtatatggcctctaaatgccaatctcactcttaaagcaaggaagttctgtgccaagagagccatctccattcttaggggagccatctttgctggtgttgaaggccttagcctggggttgatcagtcatgccctattgtcctccctctcaccagccctcactcctccccataaacgaatgggcacctaggcatagatagtacattttgccagcaaacagttgtttatagccaaccacaggccagagactgtactgatgtggggatatagagatgaataaggccttatcttcttatcttcttttgcccttcagaagattagagtatattgggagcagaagacaaaaccataaaaatttggtagctgacatcctggggtgtgtgtgaagagagagggggggatagaaatggggcactggaaagctttctgaagtgagtgattcttgagccttctctcctgggtgttgcaggcctcaggtgctatggaaagtctgggaggcttgagagaaaggtagccccacatggggttcagcacccttagaagtgtacaacatcaagctcatttttgtttagactttctattgtggatttccacctttaaaaaatcttgctttaagatgctggggttggggggcatggggctgtctcagaggaatgcaattcaaatcttatgagaaatcagtatttgttaaatcctgtgactgaaataaaaacgtctcctgcggggcgtggtggctcacgcctgtaatcccagcactttgggaagccgaggcgggcggatcacgaggtcaggagatcaagaccatcctggctagcacggtgaaaccccatctctactagaaatacaaaaaattagctgggcgtggtggtgggcgcctgtagtcccagctaccggggaggctgaggcaggagaatggcgtgaacccgggaggcagagcttgcagtgagccgagatggcaccactgcactccagcctgggcgacagagcgagactcagtctcaaaaaaaaaaaagaaataaaaatgtctccttctagtcttcccacattacagcatacccttttcctcgtaccctttccccccaaaaagaagagaaaacagatcaaatgggattcccctttctaattcattaccacttgtttgtgagtggcccagtctgcatagcaggcagtctgtctgccaatctccctttaccctgctgaatttcccctatcctgtttttgtttgtttgtttgtttgtttgtttttgggaccgagtcttgctctgtcacccaggctagagtgcagtggtgtgatcttggctcactgcaacctccacctcccaggctcaaatgatcctcctgcttcagcctcccaggtagctggtactacaggcagggttttaccacattgctcaagctggtctcaaactcctgaggtcaagccatcctccctcctcaccctcccaaaatgctgggattacaggcatgagccactacacccagcctccctgtgtcctgtttcactccaacttccaagcaagcatgtcttccagtcactggcagtcatcagcaaccatgtgctttcaaatctgagtcctgctaaagccctactgcagtttaatgtgtgcaataatttgtcaagaatgttgagtgatcataagtatggtactaagaacatctcagcaaactacctttcgttatgtgttttttctaccttctaattctagaaagtgaaattcgttattctacatggaagaaagctgtgatgaagtcaatgggttgggttacaactcaatctccagaaagtggtaaaaatgtttttgtttattattgtcacattttcttagtatattaaatagttatttaagtatctaggcatttacacatagccaggctgctctgaagaaaagcattatcatatgtccagagattctgacattttgaaaacactttaaagttctaaacacaaaatgtaaattatcaggttgatatacatactttaactttatcctgccatatctttccttattagtttattcttggtacttcaattgacaacttagtcttccaagagtaaaattatttctagtttcttcttaatgaaaaaaaaaaatcaactagagtcttcatttttttcccctctcctcttactttacctttttggggggctgtctttatgacctgaaccaactgaaagctgtattaatttcagaatatattctgctacttcctaggctgattccaagtacataatgggaattcctttggaatcagagaaagaaatataccaaacatagtaaattcgaactcttataaatagattgggaagtgctcttagcagaaaaaatagtggactattctacctttcagtcacttaggaaggtcaagagcttaagtaaaccatttagatttaaacagccttaagatgcatagtattattattttttgctaaatgcaagatgtggagcataatgaatggaacaatggcagataatttattgaagcatatacttttttttttttttgagacagagtctcgctccgtcacccaggctagagtgcagtggcacaatcttggcccactgcaacctccgcctcctgggtttaaatgattttcgtgcctcagcctcccaagtagctgggattacaggcgcccaccaccatgcccagctaatttttttgtatttttaggagagacggggtttcaccatgttggccaggctggtctggaactcctgacctcaagtgatccgcccgccttggcttcccaaagtgccaggattacaggtgtgagccactgcacctggcttgagcatatactttaatggggaagagttgacaaatgaaataatacctgccttccaaccccaaagttaatgtatctgttttttaggagaagcttccagaactatctactgccacagataactgtggtctgtattttcagtcccggatgttcctatttgaagcttttgtttttctcctaaataagcttaatatcttttgttgtgagactcagcttcattttccaagatggtggcaacgtttttcttgctaagactgtaattttgagagaccctttacaactaaacttctcaatcataagtacttttctagcacagtgctagttgctgtgtgagatataacagacgtaagccttgacttcttttctagttgcccttaattattgcttataggaaattgagttacattatttctttaactagctggatgttttaaaatggcactttaaatggcatgtttaaaatgacattttgttttgttttttgttttttgagatggagtctcactctgttgcccaggctggagtgcagtggtgggatctgtgctcactgcaacctctgccctccgagttcaagcgattctcctgcctcagcctcctgagtagctgggattacaggtgcctgccaccgtgcccggctaatttttttgtatttttagtagagacgggggtttcaccatcttggccaggctggtcttgaactcctgacctcatgatccacccgcctcagcctcccaaagtgctgggattacagacatgagccaccgcgcctggccttaaaatggcattttaatcctcctgtctccctccctccaaccccatgccttacacacagatacacagttctcctcactagcggttgaggatgtaattttaactgcaaaattcccacaaaatcaactgatcatttttcccttgtttgtgtactttactatcaatgaatttaaaatactaagaaaaagttgataaaacaaacaaaaaaagatatcattgctccaatttctgctatcagcattaatgataaaagtaatttgatcttttgagagttttatattttaaagaactttgtttttgtttcagttaggctgcagtggatttaagccagtttgattttttttttttttttttgagatggagtttcgctcttgttgcccaggctggagtgcaatggcacgatctctgctcaccgcaacctccacctcccgggttcaagcaattctcctgcctcagcctcccgagtagctgggattacaggcatgcgccaccatgcccggctaattttgtatttttagtagagatggggtttctccgtgttggtcaggctggtctcgaactcccaacctcaggtgatccgcccacctcagcctcccaaagtgctgggattacaggcgtgagccactgcacccggcctgaaaatgttttttgaatagatttatgaaaaacactctaatatttaatattttgggggtctctaagctgtataataagcttggaatagtaataaaatgctagttgtattcctttaagcaatctaagctatataactatataagttatatgataatagcaatatagatagaatcctattttgataaacttgagaggatattagaattgctacctgtatcttaacctatgggaagaatatcaggcttgcttaagtttcaaagcaatttgccaattttgaagcaatcataattattttcttgtttgtgactatatttgaatgctttgtaaacaatttttaacatacttttcatatgtgtttaaaatgtattgtcaggtgcattttgttacgcaccaaattctattaaaaaaataaaactgaactaatattttagcaaacatagggttttaaattcatcttaggacactaatataactcttctctcatggccaaaagagaactataatttgaacttaggtggaattaaatagatcatttaatatatttgggggaagaatcaagaaagctaaaattaacagcctcccaaaaagttatccataggctcactctggctttgccagtggaaggctaatgttagtctatatgtattatgttcttggctgtgtggcatgctatctgtattgtttgttaactgtcataaaccttcaatattgattatatttttgatttgaagtaataactctttgctagcttttatgaatatactatttttatagcttattttgttttgctatcttgtgattcttaacacaaatattgtaattatgtgtctctcttttggtttgcttgactggaattctcttctgcttggatgaccacaggtgaccctagtatcttctgtagtctgcccttgggcttttttatagtgagtagcatggtaatgttaatcggagcaaggtacatctcaggttagttactctttaaattagacaactctattagttagctttaatgttttcgtgtataacttagcagaaatttttcagtgtttttcattctttctgtgtctaggaagctggaaaatcaataaaaggtctaattagttagaccaattaatctttgggggcagttagaagtaagaactgtgactctgcttaccctttttaaatttttaatgtgatgacttctttaagagggactacattctgctgtcagctgcagcaataagcaaaagtgaaaatactaatatttaaatgaaaggactttcagactgactgctgaaagttaaagtatacttttgacattaattaaattgtctttcaaatgtatataaattatttttcataatcctgaaaatttgctaagcaagtcttaacttttcaattctggcaagtttcagccagagcatgtccacagagttcctgtaaaaccctaaaaccagggaagatttatagttactcttattttagttaaaagaatatcttttatgaactgaagttttaaaaatgattccttaaatgaaggggttgaaatgaaaacagaattatttttccacattaatttatactgaataatctttttttaataaaagtaaaatggctcagcatgttatggaatatattgcataatcttattaatttataatagccatttgtggaagctgctcctggtgatagctcaatttttcttaaaattactggcttaaatggaaatgatgcttcttattctgtatgttcccatgaaagtgaaacttaaaaaaaaaattcatgattagggtttcatgaaaaggccttgtttctatgaaaattgagacaggttgcatctctctaagctaaaagatgggctatgtgtctagagtcttagacttctaaaatgcatgtggtcactatatgtaggttatctcttcggtgacatacactgcaatttgagagggctggaaattgtttgccttggtaaacgattagcaacagtggcaatatttgttaattttggaattggccctgtttgttgcattttaattgtgaggcatgatttagaaatcatatggactttctagcttaataaatgattgaatcatctgcattgctttaactcctgaattgtatgcatgtattattgacatatatggtttttgttccccatttcaggtattccataaaacctaccaactcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctatagaaatatttggtggttttttttttttttaaacatccacagttaaggttgggccagctacctttggggctgaccccctccattgccataacatcctgctccattccctctaagatgtaggaagaattcggatccttaccattggaatcttccatcgaacatactcaaacacttttggaccaggatttgagtctctgcatgacatatacttgattaaaaggttattactaacctgttaaaaatcagcagctctttgcttttaacagacaccctaaaagtcttcttttctacatagttgaagacagcaacatcttcactgaatg

SEQ ID NO: 5560 - DNA, 75760 bp, human; identical to SEQ ID NO: 5559

SEQ ID NO: 5561 - DNA, 75942 bp, human
ggaaaccggccgcaatcgccggccgacctgaagctggtttcatggcagcctcaaagaaggcagttttggggccattggtgggggcggtggaccagggcaccagttcgacgcgctttttggtgagcccggggtgacatgtgaagaggcgctgagccggggcgggagtcgggggacggagggggtggctgttgtgtccccatcccgcatctctccggcccggtgccccggccgctgggcaaggagggaggccggaacgggacctgccacactggggatgccccagccaggcctgggggacctcggcctctcatgacccccatggccgagttgaacagtcgcagttttggtggcggagctgggtcacctactaatggggtgactcttcccccaaagggagcagggactctccgagcatccgcgcagagcggcccgcttgcagtaggggacaggtggccacattgacggctaccgcggtcttccccaggaacatttggcctgcgagacacaggacgtccttggatggggggaaagctgtgtcacggctgtggtagctaacacagcgtcctttccagcagtagaacgaataaagtattggagtgatgatgcgttgtcatcctctcccataaaaattgcagagggttgaatactggggagggtggcagaacaaattaggaaacagtcacactacactggttttgccataatctttatttaattccgaagactcgcaaatttcagttctgagactttgcccattacaaacaaatgattgtccttactgtgcttcacagcataatgcgacacggaaattctgtttctctttttatttaccatgtgtgacagcacagttttaccacaaaagattgctatttaagtgactgctgattaatttttgtgcaattagtaaacttgctcttaaagtgacctagcacagagttcagtaagataatttaaaagtaattgaggccgggcgcggtggcttacacgtgtaatcccaacagtttgggaggctgaggcgggtggattacctaaggtcaggagttcgagaccagcctggccaacctggcataacaaaaattagctgggcgtggtggcgggcgcctgtaatcctacttacccgggaggctgaggcaggagaatcacttggacccgggaggcggaggttgcagtgagcagagatcacaccactgcactccagcctgggcaatccagcctagccaacagagcgagactctgtctcaaaaaaataaaaataaataaaaaataaataaaagtaattgaaatgaatgcctgctgataaaagcccatgctttcaatggatatttgactaacttggcaagttgatgtaaatatttaatgattatttagctcttcactttaccgcaaatcatgttttcctgtgttatttagtatgtatatatctgtacatatatacacatatgtgtatatttatacataggcattatacatacaatgtatatattttttcaaagttctgtcagagctggcacttgactaaaaactgcatttgtgctttgatcctgacatatctttttttgtctaaagtgagaagctttcagtctaattttggtttgaatcttatttaatgacttaccctggtttgagctgccaagcatagttccactgtctcttgcactgtttatcttttgatcacccagggcaggtttcactttgtcttatattcatagaaatgtttatagagtaatcctgaatcataagaaagtttgcttaactggatttgattaatacataatatacacgatcatcatcttcccaacttaagaaagaccattaagacatgtgccaactaactgtgggttgatgtttaaagccatattcaagaattgcccacacaaatgcctgcagggaccaggcaggtagaagggggaaggcagactagagagatatccaggtcaaggggacagctagtagctgccaagcaggaacacaagcccagtgctgccagatcgtcagattaaaagcaggtagtctagagttttcaatgaaatctttcaattcttaaatgttggcaattagtttataaagcactgtgggggccaaaccaagcatggcagatgttctcaagtttatacagcctttgctcaatatgaaaatgggtaaaatatttcataactttgtaggcttcctttaggagtcagcttgaactgtccatgccttctttttgactgttcattattgctgtccatgtagcccagcaatcttctttattcactacaggttgttcttggtccctcaggttttgttgcctaaaagacatctttctacatcaatgaagaagaacttgatcaacttcatattaccacaattaattgttcagtctgtaacatgaacaacatgagccttcaaaaattggctcctgtttactgggttctgtgaggcctcgtctcattgcatgtaagctaagatgcaaattcagaagattcttatcctgcttagagaatgattttataaaagttgatcagtaaaattgtcctctccttgagaaacaactatgaaagcatgctctagaggcaaataaaaaaaccgtagagatcctgtgtgaagtagtgaaaaacttaggaatggtttagcaaggtgttttttcctttgtttataaggagagagattgctaaaccactccctgcaaaatgcagataaaagatttgctgaataagtgcttcaatcacaagatgattcccgggagttattccagtcatattactccacgttgtaattatgactgaaaaataattgcttacctctcaggaaagaatacagtggataagaactgtcataaggaagcttataaaattaaagatatttaagtaatttcctattattcattaaatttgcatatttaacttgactttcctgagaccaataatctctgcaagctttcttcttcttttttctctgttagcaatattagctttctcccataaggagaaaaggctttatctgtgctctttcatcccagggaaatgcctccacctctatcccacatatccgcttctctacctctaaatagtggctcaactgccaccttttagtgtaagtcttcctcaaaccgttattcagaattccccccccttcctacagcacttttaaaaatacttctattaatagctcttattaccttcccccttgtattataatcgtatacctgctgtacttgggagcagggtcctccttttaagctatttgtcatgttgaccaagatgttttatgaaatacaaagatgaacagcacttaaagactgttcagagagtgttttatacatgtttattgagtagatttttatttctctttaataagttaactgaattattttttattttattttatttttttgagacagaatctcgctctgtagcccaggctggagtgcagtggcatgatctcggctcactgcagcctctgcctcccaggctcaagtgattcttctgcctcagcctcctgagtagctgggattacaggcatgcgccaccacgcccggctaatttttacatttttagtagagacggggtttcaccatgttggtcaggctggtctcgaactcctgacgtcgtgatccacccacgttggcctcccaaagtgctggtattacaggcgtcagccaccgtgcccagccaagttaactgaattttaattctggttttctttcttacctcttaaaacattcttgggtacgtttggttacttaatttcttcttacattttagtagtagacatacaatagaacatgttcatttcctcatcaaattgtcaaagaattaatcttgggaccccatgcatatgctttgtacaagcggaaaatttccaacttatctgataggaaagtgaattggggttggcacatggtaactcagattgcagagtaggaacttcttggaaagagaattagtgtaacaggttttaaggaggggccatttctttgtaagacaaaagtttcagcttaaacaatcaacttccttctttaatttggtaacttaattttttccccactatgatgattttttaaaagacttgtaatgtgttgtggcttgaaatgtgtcaggtactatgttgaagacttttccagcattatctcatttaatcctcataactctgtgatgtagatcgtattagtaagcttctttacacaggtgattagactgtggctgaggattgtgcccaaggtcacagagtaactggtggagctaggattcaagtccaggtctgttatactctgaaaccagtcctcctgactactgccttgggttccccagctgtgtagagtactgtgaaggggaaatgagagaagggggaggccaccttctcacctattaatcaagtgtcagttctgattatcatcacgaatgaatcttcaccaagaaaaacatacttataaattggttttgcaatctataaaaaatattgcctttgaatgagtactgtgggttatgatcatcttgtgactcaaattcagtgggtcctaggcagggctcaggtgtgtcactgtggataatggttgcatcatcattttgtttcaaccgacaatacatataaagaatgactagaattgtagctcagtgcttgttttggcaggaagcattcccttggccccagctgtcccatcatacttagagatctcataaggcttacagatggatttcctctttccttcatttatgtattcaacacatttattaagcacccattatgggccagggactaatgaacaataaattttggtaaaactgatttggctcacagttggaatgaggccactcttgtgataagtagagttgtgattctttttgttttttttttttctgagacggagtctcactgtgttacccaagctggagtgcagtggcacgatctcagctcactgcaccctccgcctcccaggttcaagcaattctcctgcctcagcctactgagtagctaggattacaggtgtgcgccaccatgcccagctaatttttttgtatttttagtagagacggggtttcaccatgttggccaggctggtcttgaaatcctgacctcatgatccgcctgccttggcctcccaaagtgctgggattacaggcgtgagccaccacgcccggccaagttgtggttcttttgttgtttctttctttctccactacatttgcttgtttccttgcccatcacattacacaagtaccaggaacacattctcaacagagagctgccacccactcttgtcttgtctgtcacaagactaagtggtaagagctttcaattttgagcttcttgagggatagaaccatgtcctttttcttccccaaagcctgacacagcatctggcatgtggtagacacatgttacatgaaccaacattagcagcaagggacctgcaaggactcaagtgtgttgactggaacacttggattagaatagaccgataaaacttgaggcatcttggaaaaagtcaaaatcagaaactatagctctatttgatgtatgtatatgccatttactacaatttctttctttctttctttcttttcctttttgagacagagtttcactcttcttgttgcccaggctggagtgcaatggcgtgatctcagctcacggcaacctccgcctcctgggttcaagcgattcccctgcctagcctccccgagtagctgggattacaggaatgtgccaccacatctggctaattttttgtatttttagtagagatggggtttctccatgttggtcaggctggtctcaaactccctacctcaggtgatctacccgcctcggcctcccaaagtgctgggattacaggcgtgagccaccgtgctcggccaatttcatttttaagaaaaacataatttcatttgctatgttttctttacttctgtggcttgttggaagatgccttttctagtcaaatttggcatggaacatatttgtggctaatatttttattttcagtcactcacatttacgtagtatcatggtgttctcaagaggaagtttacatttctgaataatgtcttatcacatggtaaagtttagtgtgtcataaaagagtagactagtggggaaatcacatggggagggaaatgaatgtgcacatttatgataggacagatgaattagtcataggatgagtgaggcaagcctacaggacagttacttagtaaagagagcatttcagctccccagaagtctcattcttataaggcagagaatacatgtgttgtttcagaagctaatttttaaatattttttgtttttgagacggagtcttgctctgttgcccaggttggagtgcagtggtgtgatctcagcttactgcaacctccacctcctgagttcaagtgattctcccacctcagcctccccagtagctgggattataggtgtgcaccaccacacccagctaatttttgtatttttagtggagatggggttttaccatgttggccaggctggtcttgaactcctgacctcaggtgatccacccacctcggccttccaaagtgctgggattacaggcgtgagccaccgggcctggccaaacacttttttataaaaacaattttccttgttttttcagtttttaattactctcctcctccaaatctggaattgagtcatagtttgcgcatagagctgaatatagacctggtgacttccaactgtaatactatcacttataggtaatagtaataataataataataataataacatagcagtagtagcagcagtgacagtagtggttacatcttttgggtatatactgtgtctgcacggagctaaattctcattctatgttcactttccttgtttcttcctttttaaattgcccttcacccaaaacaaaatctggaattgagacatgatttgggtttagagatgaatataggactggcttcctatattcattattcagaatgagtgatttctaatccttattctgtcatctattagtggtggtgggagtagtaattgtaataaaagtaattataaaattagtagcagtagtagcaacaatgatagtgttgacaccttttggatgtatactctgtgcctattctatgctaaatactcttcataaattactttattatccttttacaaatgaaaaacatagaggctcagaaaaaagtgtcaaatagctgatgtgggcagggctggagctcgatgtgccccagctctctgtgcttccggggtctgtgtgtgctctttgcctctacatcacaccaagcatgacgttgtcaactacctttctggcccacacaaaagtctgagaacagattttttttttttctttcttctttttttttttttttttccgagacggagtctcgctctgttaccaggctggagtgcagtggcgtgatctcggctcactgcaccctccgcctcctgggttcaatcgattctcctgcctcagcctcctgagtagctgggattacaggtgcgtgccaccatgcctggcaaattttttgtgtttttagtagggacggggtttcactaggttggtcaggatggtcttgatctcttgacctcgtgatccgcccacctcggcctcccaaagtgctgggattataggcatgagccacagtgcccagcctggatctttttctttaagcttatgacctaaaatagaagcaactgatgactggatatctccacttctgtgcccaagcaacatctcaaacacacattatctaaaacaaaatttgcaatctcctatgcgttcctgtccggaagctactgctcctaccctatcccttgtctggtaaacactgcctactcagttgcactgacctgtaacttgtcatccctgggtgttgctctttttcctgcttgtacctcctgaattaagaatctctctgcacttgcacttcacttctgtcaatcccatcgcagcggccctcctagtggaggcctctgtatgtttcacctggactgcagacacattgcaactgctcttcctgtcccagtcttgcctccctctaatcctttctcatcaacaagtactgtgcaccctcgcccacctgaacaccctgcagtcctatgcccactgtcccgcatggactcccttctgttcaacctgaagtcttagtttagaagttaccacttctgagagcccttctcagaccctcataattctgggttacatgtcctttctcctcttcatagccctgacagccctatgtgaggcagaagttgcagtgagctgagattgtgccactgcactccagcctgggtggcagagccagaccctgtctcagacaaacaccccagcaaaaaaccaaatgaccaggctagacattgtataaagcaagtgatacagccactgctatctttaattgacaatgatttctgaaatgtacttgaaaaaatcagactagcattcttgcctctgggtactgtgttttaatgtggagttaattatcctctaccatagagtcttgtggaaacatcattagccttctttgtacatttggccatctgcagacaaatcaatggccagaaggcttcatgtgaacctagatatatgaggaaaaaagtactctagaacttcatgtccagtacaatagccactggccacatgtggctactgattactttaaatatggctagtctgaattgagtagactgtaagtgtaaaatatataccaaagacttagtaaaaacaaatcattaatattttatatctatcacatgtcaaaacaatagtttatagatatattggcttaaatgtgttattaaaattaatttcatatgtttctttttattttttaatgacacaatttaaaattagtatgtggcttgcgtttttggtttgggttatatttctattggacaggctacatacactaaggtggtgtcagtctcctaagtttcagagctttgatgaagtagggaggtctaggctccatcctggtacatccaaatgttgtttgattggatggcttcatggtctaatacagcaaatagaatttaccaaaatccttctgttttctgtgtctcttccaaagatccatgaattcatttttagcataagggccctgacgttgccctagttaaaactaggaggtgatggaagaggggtctcattccattcagagccccataggtctgctattgaggtttttatgaattcagccagcaaaaagggacaccttgtttctttctttctttctttctctctctctttctctttttctttctttctttctttctttctttccttctttctttccttccttccttccttccttctctctctctctctctctctttctttccttccttccttccttctctctctctctctctctctctctttctttctttctttctttctttctttctttctttctctttctttctttctttctttcttttctttctttcgtagtttcgctcttgtgtcccaggctggagtgcaatggcgtgatctcagctcactgcaacctccacctccttggttcaagtgattctcctgcctcagcctcctgagtagctgggattacaggcatgcgccaccacgcccaacagatttttgtatttttagtagagacggggttttgccatgttggccagggtggtctcaaactccagacctcaggtgatccacctgcttcagtctcccaaagtgccgggcgtcagccaccgcgcccggccaatactttgttttcttaacctagagtcctttagggatttgagagtagcagggagcagctgtaatatgaataacagtaacacagctggaatttcctattgtagtgaagtttttctgcacataagtgtttctcattttatctgataatttttgtcctaataagtacatgtaatacatcatgttttttggacattcaacaaatacttattgagcaccaactttgtgcctggcactattctagttcctagggatacttcagtgaataaaacagggcaaatggaactggcttcctagagacacaccctaatgctaatggagttggtatcctagagacataccctaatgctaccttgtaaatcacagggctatcacatggtgtatgatgtatcaagttaacctttgacttgtaagatattttatcttctcaaaggacttcagaatttgccctcttgctttcattatgtttattatttcctccagaaaagaggaaagggggcgtgtgtgatatagaaggaggaaggcaacattcaacgctttttattttcttagtctgcattgaacaggtaattttctcccacaggaaacctaggcatggaaacactttactaattggaagtgacttcgctgctgtaattagagtaattttggaagttaattttaatcaaaatatgcatcttactctgtaagagtaagtactttggtactcaaatatagatactataacatggaaacaatatatatgaaaaacttgctctctctctctctgtatatatatagatatctatatattatatatatattttatatatatctatatatattttatagatatatattttatatatatctatatatattttatagatatatattttatatatatctatatatattttatagatatatattttatatatatctatatatattttatagatatatattttatatagatctatatatattttatagatatatattttatatagatatatagatatatatatatcttatatatatatatagatttttttttttttgagacagtttcactcttgttgcccaggctggagtgcaatagcgtgatctcggctcaccgcaacctccgcctcctgggttccggttcaagcagttctcctgcctcagccttctgagtagctgggattacaggcatgcgccaccacacctagctaatttttgtatttttagtagagacggggtttcaccatgttggctaggctggtctcaaactcctgacctcgtgatccgcctgcctcggcctcccaaagtgctggggttataggcatgagccaccacgcccggcaaaacttgctatattttaaaaagtgttgtttttagtagtgctaaaattgtagaggatcgtattacacttctttgttagttttcatccattggttttaatgttttatatcaagggtcagcaatttatgacaagcatgtcacagagagtactcagctggatggggccaagtatatacttatccctttactaacaaggactctattgccttttttttttttttttttttttgagacggagttttcctcttgtcgctcagggtggagctcaatctcagctcactgcaatctccatctcctgggtgggttcaagggattctcctgtctcagcctcctgagtagctgggattacaggctcccaccaccacgcctggctaattttttgtgtttttagtagagatggggtttcaccatgttggccagtctggtctcaaactcctgaccttaagtgatctgcctgccttggcctcccaaagtgctgggattaaagatgtaagccaccgtgtctggtcttctatttctcttttataagagctagatgcgtagccacacttcccttcaaaggaatctacacagtacgtgtctatgtgcctgagtatctgtgaccctttctgtttccacgtccaagataaatggagtggaaacttacaccattgctattagtattgtatcagctctcttttattattcttggttttcctattctgtaaaataaatccatattattaattaatgtgttaaatttccgagaaccattttggttttttaaggagtagggaattgcttcttaatttacctttatcttcaataggtttctttttacctaaagagaagttatttctgatgctgccttatatcttttatgaatccatatgaaaagaaagtggaacatcttatatggcatttcatctaattggactttttctaccagtgaacaagaacttcagttactgaataactttaaacatccttgatatctgcctgcatttttacattaatattacaatatctttttcaggttttcaattcaaaaacagctgaactacttagtcatcatcaagtagaaataaaacaagagttcccaagagaagggtatgtttcctaatttaatatgtaaagacacattatgtttgttagtccatctcacccaacttgccctgtggatttgtaaagtaaacttggtcagacatcctcctgaaaacatttgaaaggttgttattagtcaagaaaatatgcaataacttggtatgtcttacatgtgaggaattgatggcttaggaattcagttaaagataaggaatgaataataaagtaataaagcaaaagagtattaaatatcagaaatttcacattaactttgaagtcatttagttttgtgttcctattattgcaaaaatgctgctttgctgatttgagtgtcaggtttgttttataataaaggtatctttttaaaaaagtattcacatatcttaacatctaatactaaaatcacatttttgggaatagtattcataagtagtaattgtgattaaatatgatgttaagtatattatttaaaatttaatgatttttatgatataaccactttgaaaaactgtgttgcaggttattgcaaagctaaccatacacctgcagcatttcactcttaggaatttacccaagaggaataaaagcatatgcccatcgaaagacttgcacatgaatgtttatagctactttattaaaagtcgccccaaactggaaaccacccaaatgtctgtcatcagtaagatggataacaatggaatgccatttagtaattttaaaaaagtggacagatacttgcaccaacacaagggaatgtcactggaaatatggaaaatgaaaaagttggatacaaaagagtatatactgcatgactccatttatctgaaattttataatagtctaaactaatctaggatgataggaatcagaaaagtggttgtctgtgaggtgtgtgattcacttgaaaggagcatgaaagaactttctgggttgctggaaatattttgtatcttgactggggtgttggttagatgggtatttccacttgtcaaaactcagcaaattgtgtgctttcgatttgtgcatttcactgtaaagtttacttcaatttaagaaagagagaaaaaaattgatgtgtttctaaattgtattgtcttcttcacatgaaaaaatgttctaattttttagagttcctttgtttaataataaaagttattgatatgttagaggcattagcatgactgtccacaagcctgaacccagtgcaatttgtaaagaagatacctgagtcttggctagatgaaaattataaatacacagaaggagactgggtttttaaaaataaattagagacgacttggcgcggtggctcacgcctgtaatcccagcactttgggaggccgaggcaggcggatcatgaggtcaggagatcgagaccatcctggctaacatggtgaaacctcgtctctactaaaaatacaaaaaattagccgggcgtggtggcgggcgcctatagtcccagctactcgggaggctgaggcaggagaatggcgtgaacccgagaggcggagcttgcagtgagccgagattgcgccactgcactccagcctggacgacagagcgagactccatctcaaaaaaaataaaaattaaaaaattaaaaaaaaattagttagagacagaattcaaagcccaggaaagggaagcatttagttaggcctgagaaaggcagagaagaaaggcagttggaattcccttgctacttctggatcctatggtagaatcattttagtttgtatcatttctacttttggacttcctcaaattaccatatttctcctaggcttctcacccttctcatttactattagcctttcatccttctgaggccctggtactttaccaaaattatactgagattgggtctgagaacttggaccaatcacttatctacatgaaatagttaaaaggagttttaaatttctccctaaattccaacaaaacattttgggaaaaaagtagcaaaaaagactagtatacttatttgacttttcagaattccttttgcttcccaaatatatcattctcaataataataaatatatttccatctacttagaaataatcagcgattagtgaaacatgcagataatttatcaaaattaattaaatctgcaggatataaagaaggggaactaatttcttattagacttggaaaaataattttaaaataggtagatatttgctgtttgtggcctgccattagtggcctccttgaaaatgattaattactatgtggagaataataaaattgtaaggaaataggcttttcttgaaatcatttctttaaaatgtggaatgtaatttgctttgcttaatctggttttctttaatgtatgcaccagccacaccctcataagttaacatttctatagaaaaaagttatatttgtgttgctttcttactaaccaaatgccttcttttgttcaaagatgggtggaacaggaccctaaggaaattctacattctgtctatgagtgtatagagaaaacatgtgagaaacttggacagctcaatattgatatttccaacataaaaggtattttagtagaatattttacccacataataagactctctcaatcaaattcattaatttattctttcagcttataattgagtgcctatgcagtgccaagcatttctatgagaacttgaggatacaacactaaagaggaagatttaagttcttgtcctcatggagcttttatttggatgggggcgagataataagagcagaaaaatataatttcaaatactaaaaagttccattccaaaaaataaaaaccaagtggtatggtgggttttgcctagaagggcttgctttagattaggtggccaggaaaagcctttctaaggatgtgacacttttgctgagctctcagagggcaaaaggggtcagccatgccagtgtctagaagagtgtttgaggaaaaggatgcagcacgtacaaaggccctgaagtgggaataagcctgggacatttccgggtcagaaagaaggccagtgtgtcaaaagaagactaaaaatgttgagcagtgagactgggtagggggtttcagtaggcgatcaaattgtggaagtgggtcgggcttcatcagccatatttaggattttggatgttattcttagtatcatagggagccatgagaaagtttaagcaaggcggcaagggatgacttgcagtttcaaggcaactttctgactgctgtgtggagagtagatggtaaaggcaaaagtgtggacacagggagactagtgcggaggctgctatggaagtcctgagagaggatggtggcttgaccaataatggtagcagtggaggtggagagaaagggccagaatttgctgatagactggatgttggggtaacagagagagtagtggggttgagggaagagattggtcaaaggtgatgctttggtttttgccagagctcctggatagatgaggatgccttttgctaaggagagaaagactagaggaatgagtaggttgtggggaaggggtatttggaatccaaactcttcacttctaaaatttccctgaaataattgcttgagggtgttagattgttatggatttctctgagaagtcctagtagttttttttttttttttgagatggagtctcgatcttgtccccaaggctggagtgcagtggcatgatctcggctcactgcaacttccacctcccaggttcaagcaattctcctgcctcagcctcccaggtagctaggattacaggcacacaccaccatgcccggctaattttttgtattttttgtagagacggggtttcaccatgctggccaggctggtctcgaactcctgacctcgtgacccgcccgcctcggcctcccaaagtgttgggattacaggcatgagccaccgcgcccagcgaagtcctagtagttttaattgaatatctatgtttggcttttcatcattcatatagggaaaaaaaatccagccacccaagattgatataatagcataaaaggtggaagcatagtgtggaagtttgctgtctactttatagcctaaaattttcaagtttaccattcaagggctctttttttcctccttaggtagtttgactatagatagagagaacatcaattggtggtggtggcttgattgccatcatcttggctttgatacttaccatcgctcctgagcctttcccctatttgtataaattaaaactcacttaaaaaaaaagactacaaatctatagagtgcctactatgtgccagatgtgctaaggatacaatggaggtaatgcttaagtgcagaaaacatgttaatctgataatcacaaataaatggaaatgcataaaataatagagttatttctgttattgcagattttttaaaagtataatttgatattttattaacaacttttaatactatgcacatattaatcctatcctccctttatccctacatctaagtggaagggcttcaaacttctcttagggttgtagtcctgaactttagatgagttgtgcattagtgattgttgttgatcatttccttgagctgttcttgcacttctcacagtctaaacagtgcaaacaaataataggcaatcagtagcacactcttgtcaaaattaccaaagacgtaagtaatccaggcagcttaaagccatgtttagaatgtagagtccagggtgattgaccatggctttgacatcattctacctcccttacaggtaaggtaggttgtgatgtgttggctttctggacccacttggatgctattcctttctcccttgtttttacggttatgtgaagatgacacacaactcctgcccaagtgatttgtcttccgtttgcactacctggtctaagaattgaacaggcagcttctctatactcctctgtgtctggccagtgtgaagtccacatctgagccaaactgacccagcacttccatctgtacaactaccatcctctggccacagaagagaacatcccacaagctcctccataccaggccagttgtactatttttttttttcccagaaaatttatccaattggcattgccaaggaccaagcttttgcttgcctgcatagaactctatatcacaaactgttaaagctgtaaaggaggctgggtgcagtggctcacacctgtaatcccagcactttgggaggctgaggtgggtggatcacgaggtcaggagttcgagaccagcctggccaacatggtgaaaccctgtttctactgaaaatacaaaaattagccaggcgtggtcgtgggcacctgtaatcccagctacttgggaggttgaggcaggagaatcgcttgaacccaggaggcagaggttgtggtgagccgagattgccccactgtactccagcctgggcaacagaacaagactttgtttcaaaaaaacaaaaccaacaaaaaaggctgggcgcacagtggctcacgcgtgtaatcccagcactttgggaggtcgaggcaggcagatcacctgaggtcaggagttcgagaccagcctggccaacatggtgaaaccctgtctctactaaaaatacaaaaaattagctgggcgtggtggcgcacacctgtaatcccagctacttaggaggctgaggcaggagaatctcttgaacctgggaggcagaagttgcagtgagccgagatggcgccattgcactccagcttgggcaacaagagcgaaactccatctcaaaaaaaaaaaaaaaaaaaaaaaacaacactgtaaaggatcttcagtcaactagaccagctccctctatctgcaaattagggaagaggacttaactgcaggttatgtagctttttagtggtagattaacattaaagcacagctcccctgactcctagaccagagttctttttcctgagccacactgatggtaatctcacaaaccacttctgtttttatttcttgtgtggcaagtaaattaactttgccaactgaagagtgatatcatttatagtcctacctgacagtcattaagagttcttcatgtctggtatttccttggcaaatttcaatttcattggttttgttatgcttatctgacagaaggtttgttgatttcaagtcactaggaacagtgcctccaaaattaaaattcactctccaactgagcagcacacactagctcaaggcaattaaatagactgcttctttccttctagcggtagagtcagctctgtttgcctgtcactgggctcaaggaattacaaagtataaagagttacagtagcaattccaaaatacaaagagttacggctgggcatggtggctcacacctgtaatcccagtactttgggaggccgaggcgggtggatcccctgaggttgggagttcgagaccagcctgaccaacttggagaaaccccatctctactaaaaatacaacattagctgagcatggtggctcatgcctgtaatcccagctactcaggaggctgaagcaggaaaaacgcttgaacccaggaggcagaggtagcagtgagccaagatcacgccgagccgagatcatgccattgtactccagcctgggcaacaagagcaaaactccatctcaaaaaaaaaaaaaaaaaaaaaaaaagagttacatattcattcatgtgatagaacgaaaacacaacataaactctttcaaaattgagagcataaaattctcagagattagattatcttgtatctaaaacaattatttccctgttagagaaaagggaaacccacatatccattcctccactgccttgccctacccaacatattcacacacatttctaccacctcttagactcatactgtcaggggcctctcaggggtttcaggaaggcacctcgttctccaaaatgtttccagcagcagccacatctcatttgcaatttttctaacccacctcaagtacacatcttccagagcctgttttaaaaagttttatcaggccgggcgcagtggctcacgcctgtaatcccagcactttgggagactgaggcgggcggatcacctgaggtctggagttcgagaccagcctgaccaacatggagaaaccccatctctactaaaaatacaaaaattagctgggcatggtggcgcatgcctgtaatcccagctactcgggaggctgaggcaggagaatcacttgaaccagggaggcagaggttgcggtgagccgagatcgcgccactgcactccagcctgggcaacaacatcgaaactctgtctcaaaaaaaaaatgaaaataaaaagctttatctctcttcccacatggtattcctttttgtagccagagaaccttcctctgaagctcttattattttgttctgtgtgtttttagttttctcctaaaaaatgtgttataattatatgttatgattttaattttaaaaaaggatgcatctcatccataattctaccaagacaacaattattaacatcctggagtattttcaaaggctcttttttctaaggtatattttcttaactgtgattataacttcacggaaaattttaagaaaaattaaccagggattttgagtgtagcttttaactagtttaattttactactgacattcagtgtagagaaaagtgcccccaaagagaatatgtgggtaaagtatgaagctggtaaatgcaagagcaatacgatatatgataatggttatgatgtccgtaaatgaaagactttgaggccaggaaatacatgttttatgcatgtgactttcatattatcttaaacagtgcacatgaggaggagtggagaattataaaacctgaatgtgttattccaagaaagaaggaattaaaattaggaaccattaggaatggcacatgtgctgagattagcagttggcaacgttttctttaaaaaacatagaggattttagggtaggaatgacaagacactggaacattgaaaaagttcagagataagttcacacataagacttgtgtgccctggggagaaataggtagtaaagacatgtttgtggctggcagagaatcctgggaagctgtttcactggactttgcctgcaagcaaagcaattttacttggcatgaaggaatccaattaagatagaagagaaaaaaggaatgcccagggaggaacccgtgactgaagaatcagattgaaatagctctaaattagattctgaagaaaagttaaaatgacctggtaaagataggtagcatgagaggcatagaatagtgactcaaggattgtgagtaagaaagtagccagcttattgatggtaaaattaacatagtgaggaggaataggagattttagttgactataagttcattgtgatcccatgttgtaaagttgtcacacgcacaaaaaaattacattcacaatatgtacccatagagctgctgcagaattcctttatttgccctccttagctcagtcccattctctgaaactgttactctactctcttctcaataataatgaccatggcagcagcagtaggtaacatttattgagtgcttactgtgtaccaggcatgtgttttaatatacattgactcctcactgtaaccctgtaaagttggaactattattctctccattttacaagacacaaaactgagacccagagtcacactgctaggaagcacaggaattggaatttgaatcccagctatctggcctcagagcctgagctctactgaatggtgccccaaactcttgccctgttttggcagataaccctacctcctgcttcatggagaaagttgagggtctgcggccttaaatcctcaccttcctgttgctgtgcttaatatctggatctcctgccaactttccttcatcacaagggcagcaatagccttctgccccacttggagctcctccctccacttgtgctggtaatccatcctctcctgtcactacatcagtcagaaccaagtccccattgattcccagccccatccatcccctcattctcctttctcttctttatttacttttataaacatttttgtcttacccagaatctcttccttataccctatgcctctaaatttctttggagtagaatctcaatcatctttgtatctctagaaaatattttttaaaaaatatatatatatataaacttttagatacagagggtacatgtgcaggtttgttatgtaggtatattgcatgatgttgaggtttggggtacagacccgtcacccagttagtgagcataccacccaataggtagttttagaaaagatgttgaataaagtaagtcaatctgcattggataaatagtattagaacaagggagctgatgttccccctcagctctgtgctggtcagaacattcctagagtattgtgttttattctggacgtacagtttgagtgatatggacatacacttgcatgttcctaggcgtggtgataaagggactttaaaccatgccatgtttaggtggggtcagttgaaggaaattggattgtttaggctacacagcagaagagaagacttgaggtacaaaagagctgcttcaagttttgaaagactggcatgtagaaggattacccttattctatatatctccaaagaatatgactaagatcgggaggtggaagctacacaaaaaatgatttttttttttttttgagacagagtcttgctctgtcacccaggcaggagtgcagtggcccgatttcggctcactgcaagctccgcctcccaggttcatgccattctcctgcctcagcctcccgagtagctgggactacaggcgcccaccaccacacccggctaattttttttgtatttttagtagagatggggtttcaccgtgttagccaggatggtcttgatctcctgacctcaggatccacccacctcggcctcccaaagtgctgggattacagacgtgagccaccgcacccggccacagaaaatgatttttattcttctttttttttttttttttgagacaggatctaactatgttgcccagtctggagtgcagtggcaccatcagagctcactgcaaccccaaactcctgggctcaagcaatcctcctgggtagctgggactacaggcgtgcaccaccatacccccctaatttttaaaatttttttttagaaacaaggtccaactatgttgcccaggctggtcttgaactcctgggcttaaggaatcctcctgagtagctgggactaaaggaacacaccaccacacctggctaatttttttttttgagatacagtctccctctgtcgcctaggctggagggcaatggcgcaatctcggctcactgcaacctccgcctcctgggttcaagggattctcctgcctcagcctcctgagtagctgggattacaggcacatgccaccatgcctggctaattttttgtatttttagtagagacagggttttgccatgttggccaggctgatcttgagctcctgacctcagatgatccacctgcctcggcctcccggagtgctgggattacaggtgcaagccaccacgccaggccatctggctaatttttaaaaatttttttatagagactgggttttgctacattgccgagggtggtcttgaacccctgggctcaagccatcctcctgcctcagccccgagtggctaggactacagttgtgtactgctgcatctggctaattattttatttttttgtagaggtgaggtcttgctacattttccagtctggtggatttacaaaaagaaaaaaagcaccaaagttgtccaatggagattgctctgccttgagagatgtagtgaatatcttgtcactagaagtgctatctggatggtcatatgacaggagattctagagaagatttgagcttgagaagtatttttgcttatacagcctttaaggtctgtcctaatcttaaattctggaagagctggatcctttggccaagtgtgttctatccaggatgcacattagaatcacctggggaagttttaggaacccataccaatgctcacatcccatcccaggtcagttacattggaatgttttgaccagggcttggtcattggtattttttaagagctcctcagttgattctaaagtacaatcaagtctgaaaacctccaatttagctcaaccaagctgaattgaataagatagtgtgggttagtgtttttttacactaaatatagtacttgttttatgtaggtcaatataatgtaaatgccattatatattatatttatgcctgattcaaattcttatgtattgtgacatattaaaaatacaggaataaaactgaatttctaacaaaccataatataaggatgctcagcatgaaggattttgtccatagctattttcttaaaatgtaggcatgtacatgtgcacacacacacacacacacaaatgcacacacatagggaggaaaatttcttgtagcaattggtaaacaaatgaatgagttgattattggtctgctcagaataataaattgggtattataaatttgtgaagttattgcattccttaaagcaaccagtgtgccttttatttgggtattgatctgggtccatcattgtgtgctagtagtaaagctggaaggagtatgtagaaatgaaaagaaacacttggcattgggtattgactttttctggagccactcaaagaaaataaactaatatcactacaaatgtttcaagtatttttttgatttgctatgtttagttgtgtctctagtaagatgagagctgttttcctgaagtagtttcctacttgttaaatttttgacttccttctgtttaactttctctttaaagctattggtgtcagcaaccagagggaaaccactgtagtctgggacaagataactggagagcctctctacaatgctgtgggtaagctgtcatgcatggatgtcaaatgtagggcctttcttcacattgcaaatgtggtcatattaaaatatcttgctaaaaaagcatgcagtcgccaggcatggtggctcacgcctgtaatcccagcacttcgggagactgaggtgggtggatcacgaggtcaggagttcaagaccagcctggtcaacatggtgaaaccccatctctactaaaaatacaaaaattagccaggtgtggtggcacacacctatagtcccagctactcgggaggctgaagcaggagaattgattgaacctgggaggcagaggttgcagtgagccaagaccttgccattgcactccagcctgggcaagagagtgagactccatctcaaaaaaaaaaaaagaaagaaaaaaaaaaacacatgcagtcatggtacctataatcttgatgggatgggcagaagagtctgctaagaaattaactgttgtatatttaccatttttggatcatacatattcacatagtgaattaactctcccatgctctctcctcttgcagattgtcttacaaatgagtgaatgtttgccaaattgttttataacccctgctgtttgtgacatctaaaagagatcttacctccttaccctcaaaaaattaaaattacgtgtgttcacagtcatttttctataaagtacttgtgtgtttgtctttccatctaggaatttgaattattcttctaaggttataaaaatagaatattcgaattttagctgcttcttctacaaatgtggctatttgagcagggatttaaaaaaccccaaatctcaaatataccacttttaggtatcacaacttattaggtgtaaatgatcctgagtatattttagcatcattattagcatgacagttgttgaacaccgaatgatactaccacttcctaaaaggaaaattttgttctaaattacaatcactaaaagacttcattgtgtcagaaagcaaagcacaattttttatcaattaaatactaagttgtgggatggggaatggaatcagaaattatcagagaggggataattttgggggaataatctttattaaaagttaaagtatttaatgttattgtattataagaaagtatttagtatgttttctgtatttatgataaaaaattaaattctcaaaaaatttgaaagaattacaactaaagatccttttagtacatctttttctgtggtgttttttttttttttctttcctctgtttttttttttttgagacagtcttgctgttgcccaggctggggtgcaatgacacaatctcggctcactgcaacctccacctcctgggttcaagcgattctcctgcctcagcctccccagtagatgggatcacaggcgcccaccaccatgcccagctatttttttttttttttttttgtatttttagtagagatggggtttcaccacgttggccaggctggtcttgaactcctgacctcaagtgatccacccatctcagcctcccaaagtgctgggattacaggtgtgagccaccacacccagccagaagtacatgttttaaatgtttattttgttctcattctcatgagtaattcattttgaatataagacagactatttaatgactagtatttaggagagtatcctttgatagatcaatgttagctaacttcctgaactagttaaggttttactttcttttgttttcttaatgaaaggaagagcctactcaggcaaaccagaaagttccagttaaattctgagctttttttttttttttctttttttgagacagagtcttctctttcactcaggcaggagtgcagtggtgcaatctcggctcgctctatctcccaggttcaagtgattttcgtgcctcggcctcccaagtagctgggattataggtgtgcaccattatgcccggctaatttttgtattttcagtagagacagggtttcaccatgttggccggactggtctcaaactcccgacctcaggtgatctgcccaccttggcacgcccggctagttccagttatattctaaacattgaattgtaaaaatggaactttggactttggattgttatttttcaaataatgcaactaggtaagctgaagttatgcttacagtaaagatttaagtaaatgttttactagaaaatctttctgtgatgttcttatttacttatttccttctcttctgcctgtgtccctctgcacccctcccccattctacgtgctttgcagtattaattcaaatgttcataggatatgaggaactcttttcttctatcctgagccacatacatgttttgagaacctcttacatgtttgatgttatcttgggtactataaaggatacaaattatattggctgtttttttaagcactttataatctagttttggaaagagaaaactagattagggaacaatccataaaacaaaattagggaatagttgataaatcatgtgttgataggttgaaaaggacttagagcaagtacatatcagtatggattttgaaattttagcatacttttcacagtggaggttgaacttcacttgggccttgaagcgtatattggattgcgttaggaaaagagaaaattgaggaataatgtgaacaagctatgaaggtgaaaatgtgtacacatattttgccagagtaaagaaatggatgagtttcatgcataggttgactcatttttttttatttttagtagaactagcagcgataataatactcagtaagtgctaactgctattactttgggattgtgctaagtattttacccatattatttaatctcactgaccctgtgaaacagattttactacccctattttataaattaattgtggaaaagctctataacttgtccaatggcatgtagctataagtagagtaaagccacagtttaaacatgaacactctccaaccttaaagcttgtgttctaatttgggtagacaggggttggtgaggatatagagggggctgaaagccatgcagtgtagtgtagacttaaaacacggggcagcttgaggcaaaacagatgataaaggagagtttagccatcccatgatggtggaatgggttgtttcaaacacaccagtatgcggagaacaaccagaaaagctggatgaaaatgaaataaaattctgaagaactggaaggctaccaaggcagtgaggacagaaggaaagcccagagacataagcctagcatttggcattgcttatctcctggagatatcggtaggttctgaaaggagtatctgacaggctaagccacacttctgcaggtccataaagataaggaggcaaaaggtgaagtcaagggctgccaagggtggggatgagtgttggtaaaatcccagactttggactgggactgtgaaaggtcaaatcctggaagtgaggtaaactgaaaataaaccaaccctcacaggaattgaagcccagattcaaatgatctttaacactaattggattaagatgatctgagattgctaatgctagtggcctaacttcctttcagaaataagagtaaatcctttctggaggaagacaacatcatctagagcctcaaataatctctagaatttttcatacgcattatctagttttctatttaaaaaaaccatgcatacaaaacaaaacgtgactgaaaagcaacagaaacaagtgacattagaaacagactcaagaaattcagatattagagtttttagagtttaaaatagccataattaatatgttcaaggaattaattgacaagattgagattgataatcttggcaaagaattggaagtccagtttaaatggacattctaaaactgtattaagaactcaattgatggggttttaccatcagaggagacatagctgaagatgaatttgtgagctggaagataaatcagaactgggagagagagtaaaatatttagactgaagcacagagaaacaaaagtttagaaaaggcacaaaagaatctaagagaaatatgggaaaaggtgaagaagtttaatatatttgtaattggacttccagaaggaaaggaatgagaaaaaacgaggcagaaataacattagacagataatgggagaaagtttttcaaaactgatgaaagatagcaagctgtagattcaataagcactataatccctaggcaagataaatatacagaagaccatacttatgctgggatatgaagatataaagttttgaagtagctgaggaaaaaagatatataaccttcaaaagagtgaccctaagactttcagctaagttatcagtggaaacaaaggaagtcagaatgcgatggaatgaaacctttaaagtactcaaagaaagtaacttccacatacagttctatatccagtgaaaaaattattaagaaatgaaagtgaaatatactaggagttggtgaggatatagaggtcaccaaaagctatgcagagtagtgtagacttgatacactaggcagctaacccattctcttagtccattctggttactataacaaaataccctagattggataatttataaacaacaaaaattttattgtttatacattggatagggcataaggaggagggagaaaataaagcaggcctgtgagattttcagcctgagagaacagaaagaaattaaataatatttagggggtaccaacctgagagaaaaaatggccttgttttcgacaaagtgagtgttgaacttgtaatagaagctaattctgggcaatgagaaattagatggttccaaatgtagacttgaaaattgataacatagatgtgataatctcaatttattatggatgaactcactatagtaattaatataaaattaattcaatgaaagaataggtgcctttctgtgttctaggttttgtgataacccttggcatatagtgacaaaccaggaagaccttgtacttgactttctgctacagaaactaaggatagaagtttggaagctagaaggagaaagggaaataggaaaggaggagagccactaagaaatgacaaggatagattctgccttcagttttatttcatccaggaaaactctaaagtgtcatatctccatgtaggtcttcagttgaaaatatcaacataatattaaatctttagcagttttattctaaagcaacacaaggtaggatggatggaaacaatgagattttcacgtatatttgtctttgaacttcttttgctttgtttatatcacagtctgcaggttttatacttttttctctgtctcggttcaggctgctttaacaaaaatatcatagactgggtggcttatagattagaaatttatttctcacatttctggaagctagaagttcaagatcaaggtgcttacccatctggtgtctagtgaggaccttcttcctggtttgcagatgactgtcttctcatcctcatatggcagacagtgataaaaagaaagtaagctctctctttttatgagggtactgatctcaatgagggctccaccctcatggcctaatttatctctcaaaggtcccatctctaataccatcatattaggggttaagattttaacatacgaatttggaagagacacatacattcagtccatagcattctctttgtatgttttcttccttcgttgtctatttctcttgtaaatctctgtaactctatgcctgtccttctcctctttatttctgtcttactaaattatacaacagatgatatatgcatatatatatacagctgtatataaatatatatattttaaatacagatagggtctcgctgtgttgagtaggctggtcttgaactcctggcctcaagtgatcctcccatctcggcctcccaaagtgctgggattacaggtgtgagccaccatacccggccagatgagcaatatttattacaaacaagcatatgagaggagcacattatgtttccctttttaaaaacttctatgtggcctcctttgtttatggctcagggacacttgataagcaataattcactcacccccactacggtaacagaaaaaccaagataggagaacttcaggatatcattggtggccacggcataggcttgatgaaggtaaagactgagaagggctatttgtttttgcttgcaataaaggtgtgtttgtttattgacatcttttctatcagatacaattataaacagaaaaaaatttaaatgggtccattgaggaagagatggcctaatttacaagttctatgtatttttagaatttatctgttaattatgtgattaataaggtaaacattaatgtgatatctaaaatgggaaagtgttactttgcatcactgctttccagccactgtgccatgatgcaggcatttacaataatgacctcattggtggatcagcaagagctttgtggccctggaaccaaagcaggccttgggcttctcttgcctctcttcagttgccctagtcttcctggtacttctctctttcccttttagcattatcttcaatattcccttccacggggtttcctctacccacccatttttctaagccttttccttccaaaagcagcttttattaatggtctacataactggttgtcttctattattgaaaaagtaaataagccacagactaaactgaccaagaagcacaaaactacccaagtagttaaaatgtgaagcgggagaaggcttgaatcagtgatgtttagtatgtttacacacacattttactgatgctaccagggaaatgttctgtccaaactagaatggcctagctgtatttccccctaattggccaagtttgctcactcaccactgcagttgattggtatgtatggtaagtatagagcaatatgaccctcactctggtagctttctgtagagcacaattcttgatttaatataaaaataccattcataggccaggcgtggtggctcacgcctataatcccaacactttgggaggcccaggtgggcggatcacctgaggtcgggagtttgagaccagcctgaccaacatggagaaaccccgtctctactaaaaatacaaaaattagctgggcgtggtagcgcgtgcctgtaatcccagctactagggaggctgaggcgggagaatcgcttgaacccgggaggcggaggttgcagtgagctgagatcgcgccattgcactccagcctgggcaacaagagcaaaactccatctcaaaaaaaaaaaaaaaaaaaaaaaaaaaagcattcacagtagggactaatccagcaaggcaagagtccctggcttaacacttttaggatattaaagaaaaccacccacaaaaaatatttcgttgtccctgaaacatttttctatatttaaatggtagtgcaaacatttttttctaagatgttatatttaaagttcccaatggcacacataactctttatggagagtgttgcaattttaaagattggttatcgtttttacatttttttaacatactggttaatactgggccaattattaaacctatgtgatcatgagttgagatctgaaccttgagctcaatccttttatcttttctggaactggcttatgtttcaaagaatcagcagaaaagaaaaccatagatgacaaaccacctaaaacgcctaagcacacttaactttaaacaataaagtattttttttctttttttttttctttttttttgagacggagtctcgcactgtcgcccaggctagagtgcagtggcgcgatctcggctcaccgcaagctccgcctcccgggttcacgccattctcctgcctcagcctcccgaatagctgggactacaggcgcctgccaccgctcccggctaattttttttgtatttttagaagagacggggtttcaccgtgttagccaggatggtctcgatctcctgacctcgtgatccgccggcctcggcctcccaaagtgctgggattgcaggcttgaaccaccgcgcctggctaaaagtattttttttcaattagttctttgtgggagaaggtttttcacttttgtaaaatctagaattttcagctttattaagatccacttattttccgttaaaaaaattccattattacaggattctttgaaaaccttacatctccctcaatcctgggtaaagaaatactgctgtatttattttgcagtgattgaattattcaaatctggccaaataaaaagaaactgacttagttttcaactttgagttctccaatctttaataattatttttatcccgttaagactgtgacgtcatcatggctatacctacctagaggtttaattctagattcaggttctgggttcagatcctagcttttccacttcctaccattctgtgcctgttaccttgacagttaaactggggagatgaaaagtgtagacctcatagacttgaggtgtagatcagtgagttaatccatgtaggatacttaagccagggcctgacggactataaggcttcagtaattgttagctagggccactgttctgaattggctgatagcctttttcatccagtaatgccagatgaaatgattggtttatacatgataggtgttcctaggggaaatgcagagcctacctaggatcacccacactcaagtcagtcattgatattttggcattttatacccaagagctgaaattggcttcagcccccgccttttggcatatatgtaaatcaatctttccttcccaactctgttttacttttggccccacctgtttctgagaatgtcatcaggtgaggggcagccatcaatatagtctcttccaccttgcaaatgaccacttacccagcttaattaatagcttagcttttgacaaatagtaaaatgccataactaaatctgttttactatcatgtctcttgtgggagaaacaacccaataacactttgtataactgtcagcagtctgtgcttaggatgtgttccataacctggagcctcaccttcacctcacttcctatcaccctagcagctcatgacagaccatctcagagaagatttattatttgcctgtttctagtcaaatggaaatcagctagatgattttagtggggtttttttttactttattttgtttttccttctattgtcatgactaacgaaaaactggaaagttatgaggttttattattctaaatatttaaaaaataatttattcctctgtactgtttgttactatgtcactaactctagcccatggggattgaggcaactacatttatcttcactcttcaaactttttttttccagaacaaactaaatctaccagacagattggatgtgactttatttaatacaaataagttcagatcatccaagttatttttattaacttacttatttgatgggcttgaccatttacttctgctttacttggtgtagataaggggagggacataccttctagaagtgggctgtctagtgttctggactccctagcatcaattttccttctatttttttcctaattactttggaagttagcaatcccctgttccctctagacacgttgctcccttctgtgaaggtgccctttactcccagctatcttaccaggaaagtgctttcttggggacctgccttcccaaagcagccctttcatgtcttaatgtagatggccacaacacagactgtagcatgctccttgccattcctttctaacatcctctaggattgtgctccctcagtacatcatccatcatttcaatttagtggttgaatgagtagtcagttaccacctgagccacttttctaattaggatgcatatatgttgccagatagagaagagtcatcctaaacaagaagcaggtatttacctggtcttcatccaaatggaaatattattgaatcagagattcatactggacttcctttgttccctttctgctccctgcctcttccttttctttttctacaccaatgtgtagaaaaagtgttcattctgataaacttgcccaagtgatctaccatttcctaaatggtcaacaagagaccttgaacctggccatctctagcgtgaattgcccttatttcttctaatgctccagctgctccagtttctcctggcccttcagttccagttgccgttgttccctctggctcttcagttccagctcctggtacttcctcaggtattggtgctctggctattgctcacttcccagcctcccaagtcctatatgttgggggaaattgacttctgctgccagatctggatctgtcattccttttgattgttctcagagattacctacacaaggggcttagtcctccagcttgggagtcttctctttggcttttggtctctctgcaaatctaattctgccatcttagcttctttaataagttttctaatttttttgttcttaattcaattaattttgagcatttgtgaattgcttggtagtgtaccaaccactgatatttttctctttggcagttttactaatgcattccatgtattctaactgccttaatgtctgtctataaaaacacagtaattattatgacaggtttctatgatcatggaacaatggaaggagaaagactttagagaccatctagtccagcctccttattttatatttagagaatccagaccaagaagggtaaaatgagttgcctaaatcacatagcttattggtggcaaagccaaacattgaattttggtctccctgatttcacatccagtgttttgattctttgtggtaaggatttaactctgtgtttaccactattgtcagtcacagctgcaaactttcaagtgaggaataaagtgcctaagtggtccttgccaaggagcaatagaatcacagggccactgggacttggagaaccatctgattatcgggggggttctttagatttttttaaacatataattggaacacacctagtattttaaagaatatgctcttgaaaagatgaaaagagtttctcccgggaggcggaggctgcagtgagccgcgatcgcatcactgcactccagactgggtgacagaaagagactctgtctcaaaaaaaaaaaaaaaaaaaaagggagagagagagaaagaaaacaggtcctcatgttttagtattatactgaattacttgagacacttttaacaaaagtacagaggctcagagctcaggccttgcctagacctgcaaccagaatcatgcaaggtagggcctgaattttaaggttttccaggtagtcctggtatgctttataggaaagaaccactgccgtgaagtctagcagtgtttctcaaaatggggcacctatttaaaagtcagatttctgggcctcattcccagaactactgtcctagaatttatggggatggagcccatctttaagctcccttgtgaatgttatgtccattaaaatatgaaaaaacacggtctagaatattttaagtcattaaccaaaaaagcctggggcagtggctttcaaatgtatttgttcatgccccttggtaagaattacattttacataatgatccagcaaatccacataactaaaacaaaagtttcacaaatcaatatttatcttacccagtgcactgaactctgatattttccattctaattcatcctatttcaatttttaaagtaggtaatcaaaactcactaaattcatttttaaactcatagctcactgtattttgaaacactgagtattgagatgtgcttgttaattttacctatcatagatttaaaacttttctaattcttctactttttctagttatttctgtgagccaataacacctgctaggattgcttacctgtaaggaaggtccacatttgtcacagtcatacagtactgccactgtgtaaaagtagactgcccttgttccctgggcatgggagatcttgccacctccatgatgatgtcactaatggcttgtatcaatcacagtgtaaataatagaaaattctatttcaactaaatgaagtttaaagcagggggcagttcttttgctcttggaagcagcagtgcaagggtagctaagttcaggtgctgtttgattccagactcagacagtatcacctgcatccccctcaagcctgccttttctgggatggctcctgatgtggcatattcaactcccacttcatgagggcagcaggcccaagccacacactgccaaggtcagctgagaagagggactcttgcagactgagcacaaatctctttgaccacatgtttcctgatccagtcactggggcccagacccattcctggagctgggagtaagatcaaatctcaggtacactacatggctgagggtgagggtggaacgatttcctaaaaagaattcgaaatacctctccccaacagatgcaggaggagtagatactgggcagcaaatgcagatgttatctattataggccatctattttcatggtctttctcttttccctcctgttttcttggttgtggtgagtcttttcttgctgcttttcccacctacagaaacccgtatcttgtcctgaagtccccagtttaagtcttgtggaaagtagccactgtcaaaatgaagtgcagggccctccagggaaatgacagcataagtaattagaaagaattgattaaaatttactacaggaaataactgctttttagtgaagagaatggagtaatatagaagagttaaccaaactgcacaatgattgctagcattcaaatatgtggtagtgggcaagcttgtatagtcttccctggagtcctttaaatagactatgaaactgagtcttttcaggaggtatctgagcagtcagtgtcctaaaaatatcaaatgaccacaaatagattaaaagttatcgaagtttaagtacaaaacttaaatctggcaaataaagcttagctgattctattggctgcctttcacaattactttatgtactatttagtgtttcctcttcctcaagcctactaacatgaagtaaaacagaaatcgtttccaccagggggttagaaagtagataatagctacttagtaaagataatgttgatccattaaaatggagattttttttttttatactccagcagagagaaagaatggtgcctttaaaaggattctaatgattccgggtctagcatacttggaaagatttcaatgtaaataagcatttcatacataacagacggaatcttttgtttcctgaataacagaatcaagttatctactttgtcttagtcacaaattgctccctagtttgttaagatgcacactttatatatggtatgatgatcctgggttttgcattttgtgctaccaactagcctgcctagcttttagatattctctggcctcatgtatacttagaaaatctatattccaaatattttttgtagttttgttctataaaaataatacaaaataagcactctaaggtttgtattattctcctaacttggtctgtaattttgcataaaagctttaaatcctctcataaatttatttttatctaacaatatgcccattcatttctaattttctaatttctatctcttaaaagctatagaattttaattccttatagaaactaatcagtcttttatccttgatagtgatttcagtaagttcttattttttaaatgaagtttttcatgtatattattttattttggtctatagtgtggcttgatctaagaacccagtctaccgttgagagtcttagtaaaagaattccaggaaataataactttgtcaaggtaagaatttcttcagaagtatactataagaatgtttctttttttaaaaaaagtttgcagatttcactagaaagaagcatcttatggtacaatagttatttgatacaatttatagaatctttttcccggataattgaggccaactcaagtctttaccttcccgtctttcttgctctgtggtggattggaacaataataacacaaaattgacaggctggaagagattataatgcgtcccagtggcttaagtcacacttcccaaggggtgctttttttttttttttttttttgagacggagttttatgcttgttgcccaggctggagtgcaatggtgtgatctcggctcaccgcagcctctgcctcctgggttcaagcaattctcctgcctcagcctcccgagtagctgggactacaggcacgtgccaccatgcccggctaattttttgtatttttagtagagatggggtttcactgtgttagccaggatggtctcgatctcctgacctcatgatccgcccacttcggcctcccaaagtgctggtgggaggggtgctttctataattgaactatgttttccaaatctatccctattttttctactgcccatcaaagaatgttctggctgcttttgagtttttaagcatctggattcagggagagagaaagtaaaagacactctagccctttattgaacccctcttccactttgttcatatgaagaaggctaataaaactgcctaattttcagtccttgtatagatccctcttcacataaaggaagggagagtgaatttttaaaataggtgaggaattttttttagcaaggtcaaggccaagttcttctagcgtctaaaaggaagttccctttttctgtttttgttttttgtgttttgttgttgtttatcccgtttttatttgtcagtgggatgcttgtatcattttcttctaaaactattgttgaaatcccattaattgcagtaatctgaccattccgtccccccacaataacttcagacttgtcctgaataaatcattttctattccgttcccttcatcaccctgcccaatcctcatcctcacctccagctgcactctgcttcgagggatgcatgcttttctctccgatgtcattttaggcaacttttacactttctacccccatgatgaaaataagatattatgtactacctcgctattgactttgtgagatcttcccaggtcatcttttgggatgacccttgttccttcaaattaaataatatttccataaaatatctccttccattttttttttcgagacagggtctcactctgttgcccaggctggagtgcagtggcacaatctctgctcactgcaacctctgcctcctgggttcaaatgattctcctgcctcagcctccccagtggctgagattacaggcaagcaccaccaagcccggctaatttttattctatttttagtggccaggctggcctcaaactcctgatctcaggtgatctgcccgcctcagcctcccaaaatgctgggtttacagacgtgagccaccgcgcccggcctccttccattatttttgtgcattgattttttttttttaaagaaagctagaaaaccttgagttaagatttttaatttacaggttgcattaaagtattaaatcctttggtttgagttttcttacaaaaccatactcatatgagataggagggaaaaagttatcactttctgtagttaggtgataaataagaatacagatggggaggggaatcatagttgcattatttttgtgtatgtattttctttttcttttctttttttttttttttttttttttgagacggagtctcgctctgtcacccaggctggagtgcagtggcgtcatcttggctcactgcaagctccgcctcccgggttcatgccattctcctgcctcagcctcctgtgtagctgggactacaggtgcccgccaccatgcctggctaattttttgtatttttagtagagacggggtttcaccatgttagccaggatggtctccatctcctgacctcatgatccgcccacctcagcctcccaaagtgctgggattacaggcatgagccaccacgcctggcgtattttcttaactagttaactttaatcagcctttatatacatttagtgtttaatatactaaccacaaatgagttgggtttgacccattctcaaggaagattggtaagcacatatgtgtttcatttttgcccattaatctttcttcagttcacattccctctgtttaatatatttgctaaatttaggcaactgctgttttagatagagtaattctgtgttgctttatttattttttattttttattttttttgagacagagtctcgctctgtcatccaggctggagtgcagtggtgcaatctcagctcactgcaacctctgcctcccaggttcaagcgattctcttgtctcagcttcccaagtagctgagattgcaggtgtgtgctactatgcccagctaatttttatatttttagtagagacggggtttcaccatgttggccaggttggtttcgagctcctaacctcaagtgatccacctgcttcagcctcccaaagtgttgggattacaggcatgagccaccacacctggccctgtgttgctttaatttggcatgtctttgagctctactttagtgtctactaatttcatgttatgttatttgaacttgtgtgtgtatatatgtaaaatatattattaagtcttattgttttaaaagttttctggttatgatcattagtttatgatttggtatactctctggtttttaatagtttaaatgtcatttttatggaatataaaataaacagcatagttttgggctaggttctacatacaatactaatttattgcaaaaatcaacatctacattgtcactatctaattacaggatgttgtgtcatttaattttctctttaccttgctacgtggatgccctttgaactgtaaacatgtcaccctaatctttgttcatgaacatgctttcctgtgccatgagacaggaaaagtatttttattcataatactatgggattgccttcagggtctttgaatattttgtgatttgttgagttcttttgtttggtggttttgttttaaactgttacacttttcatttgctaactgaacttcacaactgttttagtccaagacaggccttccacttagcacttacttcagtgcagtgaaacttcgttggctccttgacaatgtgagaaaagttcaaaaggccgttgaagaaaaacgagctctttttgggactattgattcatggcttatttgggtatgtttaaatataatggatatatggagaattttttcagaaattttttctagactgccttgcctattgtttctactagcaggtcagactttttaattagcagcattatgaagaaaaaccactcaaaaagcaacaggagaagttttcagcttccattcgagaagcatttttgcctacttcctctttattttttcttgtcttacttcagtgaaaatgaaggataattaccaaaactgtatctaatatctattatctttaggatgagtaatttagataccctttccctattgtctgttatatactcctttcccactagccatgtcttagacgaaataactatttagcaggataaaatacctagagtacttttatcttttgctttcaacattacataactgtctcttgtataatcaagccataatatgaaactaaatcatagtggaaatttctatttagaatctttttgcctaagctgaatacacagcaatcatcaacctatggccaatcttatttctactatactcacatattctttctccccacagataattttaaaacaaatgccagacatttcattttatttgtaaatatttcagtaagtatgtaatgatcttttttaacattcaagggaatgtcaaggaaatattgtccccactctcacttgacagatccacagagcaggtctttcagaacccatatcagaaagaggcaccttcttcacctctccatgtgcttggccagggcagaatgtgctttgtgttcatggccagccattttcacgtgtgtcagtcacagttgaatgagtacctttgacaattgcatcgaaccagagtaaggcaagatgtggaaactgtgagctgcaggagactcaagggagcacattttggctatatcccactggatgctgtttattgacctttgttcctttcctacctcttattgcttccatgtaaaggaaagcagcagtgccttcagttcaggcatgtgggtacacctgagaaagaaagtttaaaactctcctttcaggatatatgcttaggtgagtgtagatagcataatgcgaattgttatttaaacaacaacagcaacaacaaaaaaaaccaaagagataacaacaacacacaattctctaataatccttatgaggcagatatttccatttatttcatctcgccgaatttaataagactctgagttttctcaacataataggatgaaaacaaaaccgattttttatttatccatcaagtaactggaattgtgctgataaggtggccactagccacatttggctattgagcacttgaaacatgatcaaattgaggtttgctgtaagcatggaatatacaccagatttcaaagacttagtacagaaaaaagaaggtaaaaaaatgtaatgttccgttcttttgctttatgtgctctgctgattatgacccttaacaatatgtaaattaaattgccaataagtacaaatttaacctgatttttttactctgcctagagtttgacaggaggagtcaatggaggtgtccactgtacagatgtaacaaatgcaagtaggactatgcttttcaacattcattctttggaatgggataaacaactctgcgagtaagttctgttttgctctaaatatagttttcccaatacactacctatttataaccgaaatcttaatattttcagatgtcagtggagcaccaaaatttaactgttgatatttcaactacaatatgcaaatctatgttatgtgttttttaaagagagactattattgcatttataataaacaggccaaattaattattcttcacggaagtttaggttcctttataaaagtactttggtttctgtgtgctttctaatttttattgattggcttgcataaagttagaatgttaaatatctaagaatacagctatgttctgttggcttacgtatttattgctatctaactccatgctcaaaaacatccatttctaattgttatttatgctttttgcatttaaatacatataaatgtttctagatgtctatttaaaacagtgttaaatacccaatcttcttgtttttcagattttttggaattccaatggaaattcttccaaatgtccggagttcttctgagatctatggcctaatggtaaaaaacaaacaaacaaacaaaaaacacaccaaaaaaccaaaaaacaaacaaaaaaaaacctaataattaaagtttttttattacaaaacaagtttactattcataattcaaaagtcaactgtgttatgttttgtgacttaaaaactttacagtcctttttacaatggatttgcatttataaactttaattggtttttctttgagtattattatttttaaagaattgatgggatactctaactttagatgttggcatgagccaatttattctttgaatccaaataactgtttagtggttgtgatgtctgcttttaatttagcggagagactctgcatatttagtagtgttctttttcccgttgaatcttttttatggccaagctatgttatatattagattctttgcctgagcaaaatttagcaaagaaactgaaagcaaagagtctgtttctgatttgggattgctaattaaactagtttctgtaatggacatttttacttttgatttcactgaaatccagtaaagacatagcttcagcaaaagtgtgcctagcatcattaagagtctgtggttaaacatcaggaatgaaaacctctaggaggatttgcactggtgtttgagcacaaaaatctggaatttatgataagactcaggaataagtctgataaattacaaaaagtattgcttagacatttcatgaaagatatgagaaacttcacttacaaagttaataataatatagatgaacactaagtgctctggataaagcttgagcaagaatttttaactgttttatttataataaagctttttaaggcaacatagaatttcttaaggaagccatagtcactgcttatctacagtaaaagtgctttgatcatttcatagctgtctgcaaactgacttgggtcaaggaaaaagaaacgatgcttgagaaatagtttcacaggatggttagaaaaaaaaacgtggaactggcctagttttctcttgtatttaaaatattatgcttctatccttctctctcccccttgctgactatagaaaatctctcatagcgtggtgagtaggttgcccgccaattatgtacccattcatttggaaaagatacagtgcacttccatttatttttagacaagcagaagtccatttactaaacatatatatctagaatttccgtgaccttccaaattattataagctctagtcagattttaatttttacaaaaacttaatcttgtttgtttttaaagagtaatgttctaaaataaaagactaaggtagtttcctggaatgagagattctgatattctcataaagtacaactgtgatgtgctttgggctttaccataatagggcaattagatagatacagtttgaaatgtctattttaaatgatatattgaccacctttccagaccagttagttggaaatgcactgttactttttctgcatgcttcatcaaggatgctccaggaggagcatcagaggtccctccctctgaagaaaaaagagcactttacatgcctgaacacacatagtagatcctgttgatagtttgttaattttgaaagtataagcaaagacttcttgtaatacttaaatatatcaagatatatagcctctaggtttcctatagattcactttaagccttttatgaaatttaccctttacttaatatccaggttcagattttcaaagaatatatacagtaaatgaaaatagcaggttttgctgggcacggtggctcacgcctgtaatcccagcactttgggaggccgaggcgggcggatcacgaggtcaggagatcgagaccatcctggctaacatggtgaaaccccgtctctactaaaaatacaaaaaaattagccgggcatggtagcgggtgcctgtaatcccagctacttgggaggccgaggcaggagaatggcgtgaacctgggaggcggagcttgcagtgagccgagatcgcgccactgcactccagcctgggcgagagggagactccgtctcaaaaaaaaaaaaaaattagccgggtgtgctggcacatgcctgtattcccagctactcgggaggctgaggcaggagaatcacttgaacccaggaggcggaggttgtggtgagccgagatggtgccattgcatgccagcctgggcaacaagagtgaaactccatctcaaaaaaaaaaaaaaaaaagaaaagaaaatagcaggttttgaattaaccagaaaacaagaaagaaataaaatgataccagctatctagaggacattttctattttgtaaagggtttctacatttatgctattatttcttcattatcatagctatgtgaggtgaattctattcttgccctcactttaacagacgggatatctaaagctcccagagcctgggagacttgctcatacatggcagaccaaggagtcaggtccaaagctttagtttggtgctcatcctagtacatcacccctacttcagggattttatatatatatatatgttttatatatatgttatatatatacatgttatatatacatgttatgtataacatgttatatatacatgttatgtataacatgtatatatacaacatgttatacataacatgtatatatataacatgttatatatatatatacacacatacgttttatatatatatatacacacacactttttttttttttttgagacggaggctcactctgtcacccaggctggagtgcaatggcatgatcttggctcactgcaaccccgcctcctgagttcaagtgattcttccacctcagcctcctgagtagctgggattacaggtacccgccatcatgcccggctaattttggtatttttgtggagatggggtttcaccatgttggccaggctggtcttcaagtcctgacctcaggtgatcctcccacctcggcctcccaaagtgctgggattacaggcaggaggcacagtgcccggctggggatcctatttcttagttctcctaattccttaatatcattaaatattgccttgagttaatgtgtctttttttaaaattaaggttgtcaagtctacaatcagccacttaaatctcatttttcttcctagaatgctggccatcatgatcaaaataaaaaccagtatttatgacataaattaactgttgcttatctaaatttgaagaaagatgtttgctatgaacaaataatatacaatacctgaacactcttgtgtttagagcagcttgagtagaaagaaaagttgctaaaatatggccttgcaaaataaatgtgtttcatactggtttgatagctattggaagaatatattagtcatttcttaataatggcaataatagcaaagtactaatgaacttgagcaatcacgtagcccaatctccattttgtagagaaataatgtgatgtattgagaggtttcaacagcctgctagtagattaatactaactaactaaccaagagtagagccctcatttactggctcccagtctaacgttttatgttcattctccagtgccacatctcttcctgtcattctaggaatacttgtagtatctgtctctttatcattcatttagttgaaatgctttctttgtcttgtctgcccacatcctctggcacattgctacttgtgttcactcttgttgcagctatgttagtagagccaaaattttgtgactattcataatcctttttttaaattttattagaaagctggggccttggaaggtgtgccaatatctggggtaagtttcatcaccaagtgtctccccatccccacccttccccatgttatggctttcctcctcttagttcatcagtgtgcctctttttaaactagggaaaacaagtaaaagttgcaaaattggctaattcttgttcttacatgtcatactgtgggccattgagaatcttttgaataaattaattttaactctcccttcccatacctattatcttacatattaacaaatggtattaacaaatggggaaaatggccaaatggagaaaatgcaaggaaatagacagttcattctttgataaataaaaaatgaaaaatcctatggctcttctaaaaagaaagttaatactattgtattagtcagtgttctttattgtcatttatactttcagtgtttaggggaccagtctgctgcattggtgggacaaatgtgcttccagattggacaagccaaaaatacgtgagtttaagaaacagacttaaaaaccaatgctgttttgttttttctacttggtgctttgaataaggaaaagcttttgaagttcatccaggatgaaaatcaatagcttaatagctccaatatgcatatatacactttttaccatttttttatatctttaaataaaatacaaaatgccatatatatgcacactgatgaagcttataaagacctaaatttgtaggctgggcgcggtggctcacgcctgtaatcccagcactttgagtggccgagacaggtggatcacctgaggccgggagttagagaccagcctgaccaacatggagaaaccccatctctactaaaagtacaaaattagccgggcgtgttggtgcatgcctgtaatcccagctactcgggaagctgaggcaggagaatcgcttgaacccgggaggtggaggttgcggtgagccgagatcacgccattgtatgccagcctgggcaacaagagtgaagctctgtctcaaaaacaaacaaataaacaaaaccttaatttgtaaaattcattaccttttatatcctaaaaactaaattttggttcaaagtattcttgcctttttggggagattggtggggtggtgagaggggtgggaagaagtgaggaagagctgtaatatatagtttttggcatattaagtctttctcactaactgtaaagttatatttttgtgggattttcaaggttattttcctggcattgtgctttctctccattatctgaagtttcgcctttcctggcattgtgctttctctccattatctgaagtttctcctttgacaagaagcagaaagaatgatagaagtagagatttggtatatttttctctcaatctcatcttcttactactcacacatgcagaatctggaacaagccccatatctaagagtaataagaagatgactcccactttaggataagaaaatggatactcaaggagcttgcctaaggtcatagccttgacacaaaagcagaaccagatctcaaggccatgccttctgagtctgaatctggcactctttctttctgttcccaccaatcactatatttatttgaaggtaatctttttatttatttatttatttttactttttatttttatttattttttttttttgagatggagtttcgttcttcttgcccaggctggagtgcaatggcgcgatctcggctcactgcaacctccgcctcccaagttcaagctattctcctgccttagcctcccgagtagctgggattataggcatgcgccaccacgcccagctaattttgtatttttagtagagacggagtttctccatgttggtcaggctggtctcaaactcctgacctcaggtgatctgcccgccttggcctcccaaagtgctgggattacaggcgtgagccaccactcctggccaaggtaatcttttaaatattaaaaaatctacctgccaattatacgtattcatgaacaaaattaaatatgcctcaaaagctgaattaatactaacaattataacacaagcttagccaatggctattgtgttacctataatgtttcatgtgctttaaacacatgatatcatttaatccacatatagatcctattattcccattttatagatcaagaaactgagaattaaagaaaaaaatttatgcaacagcacacaactagtaagtgggagatgcaatatttgcacccagatccatgtcattccttagccagggttcttaacctgtgtactgtactacctcctgtatggaaaagatttccatataactggcaagaggctacatttaattgctattttcttgaggatttcctaattatctcatcgattttaacttcagtggttaagttcttcctttgtgaataatggaatgtgtaacatttctagattaaacgttcttgtagtctagcagggtcagtggctctcatgcaagagtgtgacattatttgtgtgagagttttttgaggaggagggatgtgggaattctttgcaggtcatggtaatctgaggttacatgaccaagagcatctgagtcagcctgagtctggaaacattcttggaatctgggttccaggcagctggaatcaagtgccatgagaaactttgaagcaaagctgttgggtttcaatgggaggatagaaaagtcacaaaagattatcttagtaatgagatgctttgaaaaatgagcagtattggagggtacagggaacattgaacaaagatacgtatggggaaatagaagactttgtttagagaatgtagagaacattagagtagggaagtgacaaaaaatataaagctaggatcatgttgtgaagccctatatttcaggctaaggagcttttcttgataggcaataggaaacttttgaaggtttataagctggtgttcagagatgactggagttgtcagtagcagtcttgggtgaaagtgaggaaagactagaggccaagatgccatggaggaagccaccatagtgtcccggtaatgagcacatgggctcagaaggatggagacagagagggaggccatgagtgaatgtgcatggcactgcagaggagaaagggaggggaagtaggtatgtcatctaggtacctggaccctgtggttaggcttagccaaagtaaggaaagggtctgagtggaagaatttctgttcagagcgtgtttgtggtgctggcaggctgtatgttgcacacatttggaaatgtggaataagttcagtataaaaatagaaatttttggccaggcacagtggctcatacctgtaatgccagcactttgggaggccaaggcaggtggatcacttgaagtcaggagtttgagaccagtctggccatcatggcagaaccctgtctctactacaaacacaaaaattagctgggtgtggtggtgagtgcttgtaatcccagctactcagaaggctgaggcatgaaaattgcttgaacctgggaggtggaggctgcagtgagccgagattgcatcactgcactccaacctgggtgacagagagactgcctcaaaaaaaaaaaagatggaaattttagaatttccctagatagaggggattttgaagcaacagaagtagatgaaattaccaagaaaaaatatacaagtagaggagatatttacacaagtagaagtagcaggcacggggatggagaagtcagaaaaacaatgcagttattcattttatatatatatatatatatatgagatagggtcttgctctgtcacttaggctggagtgcagtagtgagatcccagcatactgcaaccttgacctcctgggctcaagtgatcctcccctctcagcctcctgagtagctgatactacaggtgcatgccaccacactcagctaatttttaaattttttgtagagatagggtcttactatattgcccaggctgtgtcaacttcctgggctcaagcaatcctcctgcctcagcctcccaaactactgggattataggcatgagccactgcacctagcctgaaattattcattagtgtggaaatccagggtagacatatttatgagggaggcatggtcagtagcgcaaaacattactaagaggtcatggaggctgagtaccaagaatggaccattatacatagaaattaggtcttcgtttggtgactttttttttttttgagatggagtctcgctctgtcaccaggctggagtgcagtggcatgatctcaactcactgcaacctctgcctcccaggttcaagcagttctcctgcctcagccccccgagtagctgggactacaggcgcccgccaccacacccagctaatttttgtatttttagtagagacggggtttcaccatgttggccaggatggtctcgatctcttgacctcatgatctgcccacctcagcctcccaaagtgctgggattacaggcgtgagccaccgcgcccagccgttttgtgactttcaagagtgaagttgtactagaatgctcaagatagaagcctggttgcaaatggtcaaaagagatgtaagcaggtaggaaatcgaagacatgtgctttgcaaaaatacaaccatccaggaatggtgagagaaggacatagtttgtgaggttaacaggattatgtaacattttgggaattttgtttgattttgtttgtaagttatggtaagaccagagaatgtttctttggagtctgagcggagaacagatgaaagttgtaaaataaatgggggataagtgatggacaagaccaagtaagaggttagagagattgggattgaaaatttagttaatttctcccaacctcagcagggagaaaatgacagtcagctcagaattcaatgaaaagcccatctctgtttcagagtgggggaagaaattatggatgattctaatttttctttcagcttagctgtattttccaatttttctagaatgtaaaaattatttgaacattaaattttatttttctgaaagagcacatgagatagctgtctcatttgtccagtagtgctgactgggtgtgacagagttttttacctccctcacagcttcctctggggtcaacccccctgcccctatgcgccatcttcgtcacacctctctgggctgctcagtcctgatctgatagtcatgaaggagagcaagcaacgtttacctttgtagaagttagaaaagtgagacatctttctgctatgtttgaacacagtacagtgttctgtgagtacaatgtacaatgaggaaggcgaggtagatcatgtaaatgctgaaagctccatatgtgcttgatgactgggaagaaagaacaataaaatttaagaggaaaatacttgcctgtgtactgctttaaaagctgtggcctaagtatagcaaagaagtctcttcatatttgctaatactcattaattgcttattaagtatactcacttaagaattcacttttattaagtaccttcagtcttctcatcagttttgcactaagacgcgtacgctactgttcagtatagtgtttatatggatgctaaattggtacagatttctcctttaaaaagcatgaaatagataattaacttccatttttatgaatatttatcacagtagattaacttgaaacatgtagctttttcagtgtgcggcaataaaacggtatagtgattttgtgttttagtttgtaaatgtattacctgtacctagtgttatttgacaagtatctttacaaaattagatattagtcccatgctccttgaatttgtcacctgctcatcaagcaggccaagaatatatttgggtgagaagagatagactatcctaggctaatccttatggtaacaatggtacctggaaaaatgtcggaaaacaatttcccttggttttgtgtttgttgcacaatcaaaatgcagctgatgggatctgttgagttagtgctgactggtggtagcttcttctgggatccttctgccagctcctggactgagcactgtcccatctttcagttgctggaatgtcaccagcacagttagaaccctggtggtgcagggcacagcagcaaggcccacggggaaggaatgcccagcttgggcagagccaagcaagggtgactgtagcaaccttgttaccccaagcttaactgttcctctgtgacccttactggtatcactttgggccacttatctgcctggcacatgtcaaaactacctattaatgtccaagggccagacttgctgcagaatccaaagtttatattgataaggctgccacaaaataaattcagttcttctgtatcagccatgttacattctggctctgattatcaaaggtagaccttaaattgccttccgttccatgccactcttgtcctagctttccaactacaccctcccacactctgtatccagcctccccaccctgccagaaggtagtggtgtttctcattttatgactgtattaatgatagagctaagctggctgtcagtcatgatgcttcactccacatggattagtagtaacataactatgacagaacttagaatttgttgtaattcagtggtattttataaacacagccctggcctaggactgactaaacactaaatactatatctgcatttttctattaagattgcaatggccaggcacagtggcttaaacgtctgtaatcccagcactttgggaggctgaggtgggtggatcacgaagtcaggagatcaaggccatcctgactaacacggtgaaaccccgtctctactaaaaatagaaaaaattagctgggcgtggtggcacatgcctgtagtcccagctacttgggaggctgaggcaggagaatcgcttgaactcgggaggcggaggttgcaatgagccaagatcgcgccactgcactccagcctggtgacagagcaagactccatctcaaaaaaaaaaaaaaaaagattgcactaagtacattttcttctaggctgatttctaaaacattattccaggaagatatatgatttttgttaactttaggaacttttataaaactataatgacttttttggactaaattatatgtcagttttgatcatttgtgttattaatgtttcattatttgctttcaataaaattgtcttactattcattctcccttcaaccataggtatggaacaggatgtttcttactatgtaatacaggccataaggttggttttttaaattaaaaaattgatttaaaagtctaagttcatctaaataatgcttgaacataatttactattaaacaacttttagtctttagcttttacttaatctttatcagggtttaatttagagctcaatacaaaatttgaatcgttctaataagaaccattttagactctttgaattttatatgtgtgtttttaattgtgctggtgggaaatctagactgagacctcatcaaattcttaatgcaaatctaatttgaaacaaggaataaactttttatacagcttaaatgtgttcttaattctgatcgttttgactgtaaggatttattttaaaaattggtttattgattgcattattttgtacctatgttattttaactttaaaaaaaagttctcatgttatcttttcattttccactactgaaatcttttttttttctttcttacagtgtgtattttctgatcatggccttctcaccacagtggcttacaaacttggcagagacaaaccagtatattatgctttggaagtaagttctttttaatcaatatggataatatgacaaacattcaaagctaataaaaattacagtgttttctaacacttttctggtaaatcttaatacagaggactcaaaaagttctgctttcttggcatttgattgagttgaaggaacctgaaactgatctgggtgtcaggactcacaggagaccttgattagattggttcctcagttcttatgccaattaatcatgtcaccttaggcatattacttgagagctctacaatgtaaggttttttttttttttatctctaaagtttaatcggattaacgtgctctctaacatttctttcatcttgaaaattctttgattttataaataaaatgctccagtgttccaaagagaaccctgggcacaaataggcagaacaactctcttcacttgtctcctcataaaaataaattttgtgtaacattttgatatagaaaagaaagtgaggagatttatgccacttatcactggaaacatttgtttcaaacatttttgtatgttatagtaggaatatgccagcctaagcctataggatatggtaagttagtgttagaaatatttatttataaagtcaaagaaataatattctttttgtaaaattagatacatttcttataagcatttctatataattaattttgaaatggctaccttataatgcacaagtatacacttgatctgcagactcattgaggctcattttttggagtgcctgataataatttggtcacaagttaaagacttctagttagagttaaaacattttattagtcattatgcctagcacatgaggaatattagtttatttctatttttctcccttccccaccccataaacactataatatttctccccagctccttttctatggatggaagcatttgtgaaaacttagtctgtatattaaatgtatcttaacacttctcagaacttaaaatcctacaagccctctccctctctactttccctctgtggagagtgcatagcacaacactaggcacatagaatatgcacttgataagtgttacctataatataataagaatatgattctgctttttttcttcttgcatgggaaacaatcagtgctttagaatacaggtgccttagacctgggacaggcctcagggacaggggtcactcggtcttaactcccctcccaatgtgaaaaaccttctcctgtctcctttaccagtagccatccaacttctatctgaagacagcacccaaagttgcttcttaataacacctctagcattggacctgcattggttgtcaaaagtgttccaacattagaggctgcggtcagtttctctgggtcttcctcctccagggtaaactgacccaatgccttgatctcacatggtttctggatgctttatagttctgagctcccttcattgggtgcattgcaattcatgtcgtccagaatggaatataacattctacatctaatctgacctgtactcaatcaataggatgatttgtgcctctcctaccataagcactacttttgctcctctagcctgagagttcattaatttagactaatatttattaaattaatatttattaattaaaataattaatattaatttagacttcatattattggccctgggagcatatgctaaaaaacctagctcgttttcaaatgaatcattgtcaaaccaagtctgctctgttctgtatttgtgtagtttttttgttaaatctaaattcaggtctttgtttcttcctgtttaatttcataatagtgattttagcctattcctatatagtctgaattcgttttcactctttactgttactctttcagttttgtctcatctagagatttaacaagtatatgctttatgattttgtttcaatttatgtaatgcttttagatgcttagaattgtaaaagctcagagagacgctagatcatatgacaatataccctcctatccccttgttttacacgtgaggaaaccgagattagaaaagtgaaattggagtcccttggccaagtaacttttgacaacagtaagtagcagatccagatgcttggacatcaaagccttgatgcctaggccaccctgctgtaccatttccttccttgtaagtctgaaagttctgggctccagtctcccaagtccagtgttgttgtcactgcatctagcttatgtcccttccttcatctgctaacctagcggtctcagcaacaacaacaacacacatacgcatactaatatgttaacggtgtagttagaatttttttctttgttttcttaatttttttttacaattaacaaacatttaaaaaaaattaaattaaaccaaaccaaaaaacaagggtggggaataatgctagactggtaaaactttttatcagtaaacacatgctaatttcacttggtcatactaattcctttttttgtaaatgcttacaaagtatatatttaataatattgtctttcatttgatcaattgttgttaggcttagaagttggagataggaaaattttagtctttatgctctttaaaacctaaaactatagctacccatcttcagtcttttagtctttttccattcttcctctgctgatttgggaacaataagatacatttctatgtttttattttggtgattttttttcttttgcgtataccctcagatttttaagatattgtttaaccatatatttttctaagagtgtatgtcattttttggtatttttaatctcccgaccatgataaggaactctaatattttattctaccgcctccatcaccaattgtgttattttgtttaaagctttcatttcccccattttgttcaacatgtaataattactgttgttttctttgcagtccacagtaaatcatatttattgacttatttttcttagtttgtgtccagtatcatttctttggtctcacaccttttttattcccacctacttttttcctttttttcttcttctttttttttttgctgaggggcatccttctatagttcttttagttttagtgtgggatagtaagcctattctttttaggtttgtctttgttttgccctcactctgaggatgagtataaaagcctatattaacaattgtttttcccacatcccttctggccattttcgatgttgatgagacctctgctgtcaatatgtggttcatttgtagataatctggtttattgtctgggagtttctaacattatctctttatcattgatgttctgtagttttactatgatatgcctgtgtttggatttatttttatttatcctgttaggtacttggatccaagtctgtcttcagatctggaaagttctcagcaattatctcttcaaatattgctcctctaccattacctccatcctcttctggaattgctattggatgaatattggaacctttcaacccatcatccatgtctcttaactgcccttttatatttttttaatctctttgtttctctgtgctgcgtccctggtgagtttctcagtatctaccttccatttccaaatcctctctttaaaacaaacaagacaaatcataaaagccttttttgtattgtgaaatataagacacatagagaaaaatgcattaaatatcaatgtacaacttgaaaaattattataaaggctcatgtaacttgttcatagaacgccgccaatcccaagaacctctatttgccccacgatcacaacttcctccctctccctgagataaacatcagcctgacttttatcataatcacttccttacttttctttgtagttctaacacttaaatgtgcagccctgaacaccagagtttagttttgcatgtgtttaatatttgatatattaaaaatataaaagaaaagagagagagagcatgtgcatgcatatctgagtcacttagtatgtatttttttgtattttttgatctggcttctttcactcaacattatgtttgtgagattcatccacagtattatacatagctgtttttttcattgcttcttattgctatatgaaattattgaagtttagtatttattcagctgttgatgacattcgagttgttttcagtatttggctattatgaaaaatgctgctatgaacatttttgtatatgcctcctgatgtaaatgtattcacctttctgtaggagtagaatttctaggccatagattatgtgtatcttcactttgagtagatagtgcaaaccatttttcacagtagatgtgtcaagttacactcctaccagcaatatgggggaatgctagtttactcatcctctctatctagtctagagtttaccccatctagtacatttttcatcttatttaatattttcatttctatagtttttatttggttatttttcacatccacctgattttgtttcagttctcttttttttttattcttagtttcatgtttgtttgtttttaaaatggaagtcatttcctaatttatctccgaatacttaaaacatatgtattttaaaatctgtgttaggccggaatgaactctagtccagctattaagtttgttggatttcttttttcttttctttttttttttttttttttttttttgagatggagtctcgctctgtcgcccaggctggaattcagtggcctgatctcggctcactgcaagctctgtctcccaggttcacgccattctcctgcctcagcctcccgagtagctgggactacagatgcccaccaccatgcccggctaattttttgtatttttagtaaagactggaaataacgaagtttcaccgtgttagccaggatggtctcgatctcctgacctggtgatccgcccgcctcggcctcccaaagtgctggaattacaggcgtgagccaccgcgcccggccttgttggatttcttaatacaagatttcttcgtatagtttagaattgtcacttccagccttgtcttccattaagccatatagcctcagtcagcaaatacacagttgcttgtttttctagcatccctacacaagtaagagagcgccacctagctcctggcttcaagcattgagcctgattctattccctgtcttgcgcaaaacattttggacccctttcttctggaggaaccagttcccagccaccactcctactccctgacacatatagaaaaataaatcagaagccatcatgcttgtggcttcagtcctgtttggttatgtgtttccgtgtctgtccacatagatgttattctgtatttgagtcagcatgttgtttcagttttctcttttatatcgtgtctgttatcctctgtggttagaacaaaggggatttttgaagtacaaactcattatttctgctcatgtaagcatctgcatcttctttttcatcaccaagagaactctttttctctccctgaagcccctggcaggtgatagtaaggcctgacattttaatacctctaaattctcattttcattatttgtaaaaagaaataggtgttcatgatccttaagttgttctgtgacattaaactcatattaaactggttaaatttgtcccaccctttctagttggaaaatatttctcagtagtggaagagactggagcaaaatagagccattgagtggttctgccttccctctggcatccttgttcctcttctttttccaaatactgtttcacaaaacaaaaatccttttgggaacttttaatatgagtatgaacctgagcttacttatgacttgagacttccatgttccgtgttttgtcactagaatatagatttcctgaggccagggtacttgtctatcttgtttaccactctgtcccagcaggctggcagataatacatacccattaaatattgttcaaataccgaatcctatgttaggccatttttttctttttaaatatgagcttcaaagagggttccctatattgcctccctggtttctttaaatatctcttcccctatcttttctttgttatggtttaacgattatagcgttaagatttcctttttagagtttttcatccttcttgagctaaatccctattttaggtataaacctatgtaatagattatctattgctgtgtaacaagattaccacaaacttaagtggcttaaaacaacacatttattgtttctcagttcccatgggttcagaatccaggcacagcttagctgggtaccctgctcagagtctcacagggctgcagtcaagatgttgactgaggctctgctgtcatctgaggtttaatctgcttccaggttcattcaggttattggcaaaattcagttccttgtggttgtggaactgaggacttcagtttcttgctacctgtcagatggaggccaccctcagctcctagggctacctgcagttccctgctatctgagggacccccagtggttctctgcttccttaaagtcaggaagggagggaatatctccagcaagacaggcacagtaaatcatgtaatggaagcacgtacacatcaccacacatatcccatcacttttgacatgtactgttgggtagaagaaagtcacagatatcaccacgctcaagaggcgaggattatgcaagggtatgcacatcaggaggcagggatcatgggagccaccttaattaaaagtctatctgccacaagcatataaacattgtttatgaacttttataatgttctttcttgaaaagtatactttctgagcaataaatgcttttaattttagttccccaacttgttactgaagtattaatgaaatctgttacatttcaaaaataatgttgctccaattcaactcttccctttctctatgcaattaaaaatgctatagagttagacactgcatttgtaatctaatatatacaaattaactacattataaatcatatacgtacagatacatagcactgtagtatacacaaaactgtgtttgctatgcctgatgaatgattgtaagcaatttagggtaatctttactttacctgatttttctccatactcaccaattttcaccctaattgccttgtaagctacaattctactgcatcctgaaatatcctgctttatttttatactgtttgtggcagtggcattcatgtcaaggagcttttgaagaaaaatgtatttgcctgctatgacattacatcagatctacttgattatttttaattcaatcttcctatagcctgtttattagcctttcactttccaggctacatgtctagttttaaaataatttattcctcttgccctgttataatttaatttattattctttacaccctctcactttcattgcatctcccttagtgtacaactattaagcttgcatgcatcttttccagggaatcataacctagaacaagggctgattcaaatttgtagatgatatactaaagtattggatctttatacttagggtgtaatttatggtaacttaactgataacaagtagacagtcaccttcttttatcattttaggttttggctgctatactcttttcctgtccagctttgaaacattattaccatcttccattttatttcctgcctctgaattcagaagaccacatgtcttttgtgaattagagatgtctctcatttttatttctttaaaagctaaatcataccatgtattatatcctgacagcaaaattatttacttttttcagataagtgtttttatctaccttttattgtgttatattgaatctagtttttcaatcacaacaaaacacttctgtgtattcctgatgacagaatttaaaacagttatctcctggagccttaacagtgactatgtattttttttcttttgttttaatctaaataatactctgattctcaactaattacctctaatcaaaaccttgattttccttttgctaaaatcatattgctttctcttaaaaatatggtgtaagcatgtaacatcctatctttttcaatggaaatgaggtatatcagcacgtggtttcctagagtataaagtcccaccagctgtgccacaaaatcactttactagactcctagcacagtggcttctaaaaattcgcagtttaactgtacttgcctaaaacaattatgtatgcatttcttggttagatgctatttaaggacagtgtctttgagagtataaggaggagggacacctgtttttgtttttctttttcaattaggtctagaattatactgcccatggcagccatggccacatgcagctattgagcactggaaatgtggctagtctgaattgagatgtgctgtaagtgtaaagtatataccagatttcaaagatagtacaaaaaaaaatctcaataatttaatattgatttcatgttgaaattttttttaatacattgggttaaataaaatattaattttaccttccttttacctttttaatgtggcaaaaatataaattacatatgtgactcactttatatttctgttggacagcactggtctagaaactcttacatatttactagtatttggcagctgctatctctgaattgtctgtttccaaaggaaatttgaatcttaaatctctttaaaccaaaattttacttagttctcttgaatgatcccactaagtacctaaatatgtaaatgtgtcaaacttaatacaacaacttattttaggcagggaatgagctgtgttagagtcccttgtaaggtatttcttgaattgtttttgtcccatttttaaagccttgtcatatttgcacagctatgccagatctgttcctcaaatacttcctgtggttaaaaagccattttatatatgtaatgatacagagtactgtatgtatgtctacatatataaaaatgtataaacagaacaattgtggcattctgtagctttgcagtaacatagtaacttctcatagaagctatgaatgatggaatataccagcatattcattctctagtttacttacattttgacaactgacaacaagaaggcatgaccatttgtaattcagttaatagaactgaggacaggtccctacatttaatattacctgacgtttggtttggagtgactctgtggaagtaatttacattaataatctatatgaatgaactatcagagctaaaaaaaatttcttggtattcctaatggttcgtgctgatacttctttttttttttgccttcaggatctttttataatagctttattgagatatagttcatattccacacaatttacccttttcaaatatacagttcaatggtttatagtaatactatatttacagatttttacaaccatcaccacaatctaactttagaacattgtcaccaccccaaaaagaaaccccataaccaccccctatcccccagcccaggcaaccactaatctactttctgtctctatggatttgtctgttctggacatttcatatgaatgggatcgtacaatatatcgtcttctgtgcctggcttctttcactttgcataatgttttcaatgctcatccatgttgtagcatgtattaagacatcattccttttcatagtccaataatactccattgtgtagacatactgcgttttatctattcatcagtcagtgatatttggctgatacttttttaacattaaagaaattaatgaagtcaatatttacatttagtaagaaccttcacatatattctcatattgagcctcacagtaatttgtttaggtaagtgttgtcatagtcatcattttataggtgaagaaatggaggctcagaaagcctaagtaacttaggcaagttacttagatgaacttgctaagattaacttactaagttacttagattagttactaagattacacagcaattaagtactagaactgggactcaaagccagtttatccaactctgaaatatgtttttattgttattgccacagctctaggtgattttgttttaaagaaaaattacttactagctagcttctttgctttttgttttcttgatttactatactgttagatatgggaaacagacttgaaaaaacttttaatgtggcctctcccaataattttatgaacaatatggcaatatatttctaagtgataacatacctcagtagcttagcaacagacagaaaattgttcaagaagcaaactgatcaaagatcaatgtccacctatggggacaaatccaagggtgtgctggaaagctcacttcttttcctcatcccgtgaaaaacttttattagtgacttagataaaactatgtttgtattagaagacctagtttacatatttgtcggagtctcaaaatggaaactgaattctgtccatctgattgtgtcatacacagaatatgctcaataaaaaccttggatagtgataaaatatattctgtcttgaattcctttttttctttagggttctgtagctatagctggtgctgttattcgctggctaagagacaatcttggaattataaagacctcagaagaaattggtgagtgtgttctaacaaaaggttagaaaatctgaaaaatgacacatttcagtattttatctctgcaaagtaaatacttatgctttgccccaaatgtgatccataaattatatggatccctattatgagtttgacttatgcaaaagactatcttgtgaagatttataaaacaaggaattgacataattagtggtggttgttaataaactggcaatgtagggcataaaaattacccaagtgtaaaattgaacactggagattgccagaacctgcagatagagaagttgagttaaatttatctgatgagaaagagctttaactcttagattagagtgagcattaaaactctggtacctataatttaagtattaatacggctgttttcagtctatagataattagtttgaacttacctactcactctttcatccacttgcttaactttgcctgaaggtgagacaatcagaaatacatttctgattagggacacactagaggccactttttcatctcctagtcagcaaccttaaaaatagtggaaatgagctaaaataccttaaataaatgaatctggttccttgatttcttgagctaggctacattttagtggggggtatttaatgtgagagaaactcatttctgttgatcctagcatactactgtagttagcaacattttgctctaccaatgaattggaaaccaaaacccctgtcctaatttttctaatttttaaaataggtatgcttatataataatacacaatatttgtgtgatttttgttttgttttgtttttaatgttagaaaaacttgctaaagaagtaggtacttcttatggctgctacttcgtcccagcattttcggggttatatgcaccttattgggagcccagcgcaagagggtaagtattgaaaatatggagtgcttttggggatcttgatttatttaccaaagtcgttaataacttattagtttcttatctattttcaaataattataatgtgttgagaaaaccttttctttttggagaatataatttcagaaactttaagctccaagaagttatgaatcagctgacaataacccctgccatatccgtattcatgttatcttttatcttcatgatgtctgtaagttgtatagtgaagggacatcatcataatgaatactgattcagttttatgatgccatcatcttttcaaatgtgtcatgaattttttcatacatgaatgcagaattgtgaaatataaggactttctgagttacttaatgattatgtccaattttctcttcctggacatttctgtctaccaaatttgaccttttcatatttgagatatttcaaattgattggtttatatcattctaatctgaaaatctttgtgcgtatttttaggataatctgtggactcactcagttcaccaataaatgccatattgcttttgctgcattagaagctgtttgtttccaaactcgagaggtaacaaatatgggcctgttttcttgtacttagttcacttttatcactcttaagttatatgttaacacccgagatttattcagtactgaaaatgtagttaatcaaatattaaggctgcctaaatactaatctaaatataagcagggttttccccctttttccagctgtcattaccttctaagttcctgttccctgtcaggcactgggaattttatggttgtggggaggctgagtggcacacattaggcaaaggaaacagcacaaacataggcatcaaggcagaaaaacagggtgcaaaatagagttgtatagcttagctgaatatcaaggtgaatgcagaggtgtagtgagagaaaaggttggctgtgaccagatcaaagagggcttagaagaccagaataagaagtctcaatttattccataggctcttggaagctcttgagagtttctgagtggaggattgccattttcagagatgttactatgaaatagatttataacattaattgcactggtttatttaagattttggatgccatgaatcgagactgtggaattccactcagtcatttgcaggtagatggaggaatgaccagcaacaaaattcttatgcagctacaagcagacattctgtatataccagtaggttagtaagtcttcattcctttaaactcccagagtaatgtttcttgtggaataactagttctttgggcatatgtaaccacaaagatattgatggaactctctctcctcagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggagggtacatttaaagaatgaaatgttcagtgatatactgtgaaaacgaccttagtgcacgggagttttgtttttctgtttagttaaaagttaaggaaccaagtaaaatagtaaatgttatcattgcagattcggctgccaagcatattgggctttactgaataaatgtgaatgagagaaatcgttgcttatcaaaagaacttctaaaatcactttttaaaaatcatttgcttttactgtttatggtcctttagtgtaggataataatactgccacactgtcaggtatagctagttagaatagcctttttttttttttgagacggagtctcactttgttgcccaggctggagtgcagtggcacaatctcggctcactgcaagctccgcctcccgggttcatgccattctcccgcctcagcctcccgagtagctgggacaacaggtgcccaccactacgcccgcctaatttttttttttttttttttgtatttttagtagagacagcatttcaccgcgttagccaggatggtctcgatctcctgacttcgtgatccgcccgccttggcttcccaaagtgctgggattacaggcgtgagccaccgcgcccggccatagccttttttaaagtgagaaggaagatatatcagccactcatccctaatgtctacaccagatcatctttggtgccagtggcccagttttaggacataattagctgggttaagagacactctggtaacttttaagcacagcaggactaacctgatgaaggcagcaacaatttaagtaagtgaacattagatatctgattcactgtgctaactaagctaagccacaagctgtgatcagcacttttactaaaatgtagtgatgcggttcttaaatttaaataaatgtagaaaaataaggttttatatattagaattggttttataactttttagaaacctatgcataaaatagcatcagctgggaatggtaatttgtgcctatagccccagctacccaggaggatctcttggcttgggcccaggagttcgagtccagcctaggcaacataatgagacccctgtctctaaaaaaacaaaaggaaaaaaaaagcatcaaagtggattttgaggtattgggaataagctttcaaatgcatttttgtttggttttctgggagaatataccagtgtttctcaattttattcattcttttaacatataagaaaatgaattataatactagtaattttatagtcagattataccatgtaccttgatttagaaatgtatttcaccatctgatattctgtcatttttaacttttgcaatactggataaaatatgaagttcaaaaaatttttctacttttcaaaaaaaatcaactttataatatgcaaataatgtccagagcgggtatatggcctctaaatgccaatctcactcttaaagcaaggaagttctgtgccaagagagccatctccattcttaggggagccatctttgctggtgttgaaggccttagcctggggttgatcagtcatgccctattgtcctccctctcaccagccctcactcctccccataaacgaatgggcacctaggcatagatagtacattttgccagcaaacagttgtttatagccaaccacaggccagagactgtactgatgtggggatatagagatgaataaggccttatcttcttatcttcttttgcccttcagaagattagagtatattgggagcagaagacaaaaccataaaaatttggtagctgacatcctggggtgtgtgtgaagagagagggggggatagaaatggggcactggaaagctttctgaagtgagtgattcttgagccttctctcctgggtgttgcaggcctcaggtgctatggaaagtctgggaggcttgagagaaaggtagccccacatggggttcagcacccttagaagtgtacaacatcaagctcatttttgtttagactttctattgtggatttccacctttaaaaaatcttgctttaagatgctggggttggggggcatggggctgtctcagaggaatgcaattcaaatcttatgagaaatcagtatttgttaaatcctgtgactgaaataaaaacgtctcctgcggggcgtggtggctcacgcctgtaatcccagcactttgggaagccgaggcgggcggatcacgaggtcaggagatcaagaccatcctggctagcacggtgaaaccccatctctactagaaatacaaaaaattagctgggcgtggtggtgggcgcctgtagtcccagctaccggggaggctgaggcaggagaatggcgtgaacccgggaggcagagcttgcagtgagccgagatggcaccactgcactccagcctgggcgacagagcgagactcagtctcaaaaaaaaaaaagaaataaaaatgtctccttctagtcttcccacattacagcatacccttttcctcgtaccctttccccccaaaaagaagagaaaacagatcaaatgggattcccctttctaattcattaccacttgtttgtgagtggcccagtctgcatagcaggcagtctgtctgccaatctccctttaccctgctgaatttcccctatcctgtttttgtttgtttgtttgtttgtttgtttttgggaccgagtcttgctctgtcacccaggctagagtgcagtggtgtgatcttggctcactgcaacctccacctcccaggctcaaatgatcctcctgcttcagcctcccaggtagctggtactacaggcagggttttaccacattgctcaagctggtctcaaactcctgaggtcaagccatcctccctcctcaccctcccaaaatgctgggattacaggcatgagccactacacccagcctccctgtgtcctgtttcactccaacttccaagcaagcatgtcttccagtcactggcagtcatcagcaaccatgtgctttcaaatctgagtcctgctaaagccctactgcagtttaatgtgtgcaataatttgtcaagaatgttgagtgatcataagtatggtactaagaacatctcagcaaactacctttcgttatgtgttttttctaccttctaattctagaaagtgaaattcgttattctacatggaagaaagctgtgatgaagtcaatgggttgggttacaactcaatctccagaaagtggtaaaaatgtttttgtttattattgtcacattttcttagtatattaaatagttatttaagtatctaggcatttacacatagccaggctgctctgaagaaaagcattatcatatgtccagagattctgacattttgaaaacactttaaagttctaaacacaaaatgtaaattatcaggttgatatacatactttaactttatcctgccatatctttccttattagtttattcttggtacttcaattgacaacttagtcttccaagagtaaaattatttctagtttcttcttaatgaaaaaaaaaaatcaactagagtcttcatttttttcccctctcctcttactttacctttttggggggctgtctttatgacctgaaccaactgaaagctgtattaatttcagaatatattctgctacttcctaggctgattccaagtacataatgggaattcctttggaatcagagaaagaaatataccaaacatagtaaattcgaactcttataaatagattgggaagtgctcttagcagaaaaaatagtggactattctacctttcagtcacttaggaaggtcaagagcttaagtaaaccatttagatttaaacagccttaagatgcatagtattattattttttgctaaatgcaagatgtggagcataatgaatggaacaatggcagataatttattgaagcatatacttttttttttttttgagacagagtctcgctccgtcacccaggctagagtgcagtggcacaatcttggcccactgcaacctccgcctcctgggtttaaatgattttcgtgcctcagcctcccaagtagctgggattacaggcgcccaccaccatgcccagctaatttttttgtatttttaggagagacggggtttcaccatgttggccaggctggtctggaactcctgacctcaagtgatccgcccgccttggcttcccaaagtgccaggattacaggtgtgagccactgcacctggcttgagcatatactttaatggggaagagttgacaaatgaaataatacctgccttccaaccccaaagttaatgtatctgttttttaggagaagcttccagaactatctactgccacagataactgtggtctgtattttcagtcccggatgttcctatttgaagcttttgtttttctcctaaataagcttaatatcttttgttgtgagactcagcttcattttccaagatggtggcaacgtttttcttgctaagactgtaattttgagagaccctttacaactaaacttctcaatcataagtacttttctagcacagtgctagttgctgtgtgagatataacagacgtaagccttgacttcttttctagttgcccttaattattgcttataggaaattgagttacattatttctttaactagctggatgttttaaaatggcactttaaatggcatgtttaaaatgacattttgttttgttttttgttttttgagatggagtctcactctgttgcccaggctggagtgcagtggtgggatctgtgctcactgcaacctctgccctccgagttcaagcgattctcctgcctcagcctcctgagtagctgggattacaggtgcctgccaccgtgcccggctaatttttttgtatttttagtagagacgggggtttcaccatcttggccaggctggtcttgaactcctgacctcatgatccacccgcctcagcctcccaaagtgctgggattacagacatgagccaccgcgcctggccttaaaatggcattttaatcctcctgtctccctccctccaaccccatgccttacacacagatacacagttctcctcactagcggttgaggatgtaattttaactgcaaaattcccacaaaatcaactgatcatttttcccttgtttgtgtactttactatcaatgaatttaaaatactaagaaaaagttgataaaacaaacaaaaaaagatatcattgctccaatttctgctatcagcattaatgataaaagtaatttgatcttttgagagttttatattttaaagaactttgtttttgtttcagttaggctgcagtggatttaagccagtttgattttttttttttttttttgagatggagtttcgctcttgttgcccaggctggagtgcaatggcacgatctctgctcaccgcaacctccacctcccgggttcaagcaattctcctgcctcagcctcccgagtagctgggattacaggcatgcgccaccatgcccggctaattttgtatttttagtagagatggggtttctccgtgttggtcaggctggtctcgaactcccaacctcaggtgatccgcccacctcagcctcccaaagtgctgggattacaggcgtgagccactgcacccggcctgaaaatgttttttgaatagatttatgaaaaacactctaatatttaatattttgggggtctctaagctgtataataagcttggaatagtaataaaatgctagttgtattcctttaagcaatctaagctatataactatataagttatatgataatagcaatatagatagaatcctattttgataaacttgagaggatattagaattgctacctgtatcttaacctatgggaagaatatcaggcttgcttaagtttcaaagcaatttgccaattttgaagcaatcataattattttcttgtttgtgactatatttgaatgctttgtaaacaatttttaacatacttttcatatgtgtttaaaatgtattgtcaggtgcattttgttacgcaccaaattctattaaaaaaataaaactgaactaatattttagcaaacatagggttttaaattcatcttaggacactaatataactcttctctcatggccaaaagagaactataatttgaacttaggtggaattaaatagatcatttaatatatttgggggaagaatcaagaaagctaaaattaacagcctcccaaaaagttatccataggctcactctggctttgccagtggaaggctaatgttagtctatatgtattatgttcttggctgtgtggcatgctatctgtattgtttgttaactgtcataaaccttcaatattgattatatttttgatttgaagtaataactctttgctagcttttatgaatatactatttttatagcttattttgttttgctatcttgtgattcttaacacaaatattgtaattatgtgtctctcttttggtttgcttgactggaattctcttctgcttggatgaccacaggtgaccctagtatcttctgtagtctgcccttgggcttttttatagtgagtagcatggtaatgttaatcggagcaaggtacatctcaggttagttactctttaaattagacaactctattagttagctttaatgttttcgtgtataacttagcagaaatttttcagtgtttttcattctttctgtgtctaggaagctggaaaatcaataaaaggtctaattagttagaccaattaatctttgggggcagttagaagtaagaactgtgactctgcttaccctttttaaatttttaatgtgatgacttctttaagagggactacattctgctgtcagctgcagcaataagcaaaagtgaaaatactaatatttaaatgaaaggactttcagactgactgctgaaagttaaagtatacttttgacattaattaaattgtctttcaaatgtatataaattatttttcataatcctgaaaatttgctaagcaagtcttaacttttcaattctggcaagtttcagccagagcatgtccacagagttcctgtaaaaccctaaaaccagggaagatttatagttactcttattttagttaaaagaatatcttttatgaactgaagttttaaaaatgattccttaaatgaaggggttgaaatgaaaacagaattatttttccacattaatttatactgaataatctttttttaataaaagtaaaatggctcagcatgttatggaatatattgcataatcttattaatttataatagccatttgtggaagctgctcctggtgatagctcaatttttcttaaaattactggcttaaatggaaatgatgcttcttattctgtatgttcccatgaaagtgaaacttaaaaaaaaaattcatgattagggtttcatgaaaaggccttgtttctatgaaaattgagacaggttgcatctctctaagctaaaagatgggctatgtgtctagagtcttagacttctaaaatgcatgtggtcactatatgtaggttatctcttcggtgacatacactgcaatttgagagggctggaaattgtttgccttggtaaacgattagcaacagtggcaatatttgttaattttggaattggccctgtttgttgcattttaattgtgaggcatgatttagaaatcatatggactttctagcttaataaatgattgaatcatctgcattgctttaactcctgaattgtatgcatgtattattgacatatatggtttttgttccccatttcaggtattccataaaacctaccaactcatggattcccaagatgtgagctttttacataatgaaagaacccagcaattctgtctcttaatgcaatgacactattcatagactttgattttatttataagccacttgctgcatgaccctccaagtagacctgtggcttaaaataaagaaaatgcagcaaaaagaatgctatagaaatatttggtggttttttttttttttaaacatccacagttaaggttgggccagctacctttggggctgaccccctccattgccataacatcctgctccattccctctaagatgtaggaagaattcggatccttaccattggaatcttccatcgaacatactcaaacacttttggaccaggatttgagtctctgcatgacatatacttgattaaaaggttattactaacctgttaaaaatcagcagctctttgcttttaacagacaccctaaaagtcttcttttctacatagttgaagacagcaacatcttcactgaatgtttgaatagaaacctctactaaattattaaaatagacatttagtgttctcacagcttggatatttttctgaaaagttatttgccaaaactgaaatccttcagatgttttccatggtcccactaattataatgactttctgtctggatcttataggaaaagatactttcttttttcttccatctttcctt

SEQ ID NO: 5562 - DNA, 23725 bp, human
ttacatgcctgaacacacatagtagatcctgttgatagtttgttaattttgaaagtataagcaaagacttcttgtaatacttaaatatatcaagatatatagcctctaggtttcctatagattcactttaagccttttatgaaatttaccctttacttaatatccaggttcagattttcaaagaatatatacagtaaatgaaaatagcaggttttgctgggcacggtggctcacgcctgtaatcccagcactttgggaggccgaggcgggcggatcacgaggtcaggagatcgagaccatcctggctaacatggtgaaaccccgtctctactaaaaatacaaaaaaattagccgggcatggtagcgggtgcctgtaatcccagctacttgggaggccgaggcaggagaatggcgtgaacctgggaggcggagcttgcagtgagccgagatcgcgccactgcactccagcctgggcgagagggagactccgtctcaaaaaaaaaaaaaaattagccgggtgtgctggcacatgcctgtattcccagctactcgggaggctgaggcaggagaatcacttgaacccaggaggcggaggttgtggtgagccgagatggtgccattgcatgccagcctgggcaacaagagtgaaactccatctcaaaaaaaaaaaaaaaaaagaaaagaaaatagcaggttttgaattaaccagaaaacaagaaagaaataaaatgataccagctatctagaggacattttctattttgtaaagggtttctacatttatgctattatttcttcattatcatagctatgtgaggtgaattctattcttgccctcactttaacagacgggatatctaaagctcccagagcctgggagacttgctcatacatggcagaccaaggagtcaggtccaaagctttagtttggtgctcatcctagtacatcacccctacttcagggattttatatatatatatatgttttatatatatgttatatatatacatgttatatatacatgttatgtataacatgttatatatacatgttatgtataacatgtatatatacaacatgttatacataacatgtatatatataacatgttatatatatatatacacacatacgttttatatatatatatacacacacactttttttttttttttgagacggaggctcactctgtcacccaggctggagtgcaatggcatgatcttggctcactgcaaccccgcctcctgagttcaagtgattcttccacctcagcctcctgagtagctgggattacaggtacccgccatcatgcccggctaattttggtatttttgtggagatggggtttcaccatgttggccaggctggtcttcaagtcctgacctcaggtgatcctcccacctcggcctcccaaagtgctgggattacaggcaggaggcacagtgcccggctggggatcctatttcttagttctcctaattccttaatatcattaaatattgccttgagttaatgtgtctttttttaaaattaaggttgtcaagtctacaatcagccacttaaatctcatttttcttcctagaatgctggccatcatgatcaaaataaaaaccagtatttatgacataaattaactgttgcttatctaaatttgaagaaagatgtttgctatgaacaaataatatacaatacctgaacactcttgtgtttagagcagcttgagtagaaagaaaagttgctaaaatatggccttgcaaaataaatgtgtttcatactggtttgatagctattggaagaatatattagtcatttcttaataatggcaataatagcaaagtactaatgaacttgagcaatcacgtagcccaatctccattttgtagagaaataatgtgatgtattgagaggtttcaacagcctgctagtagattaatactaactaactaaccaagagtagagccctcatttactggctcccagtctaacgttttatgttcattctccagtgccacatctcttcctgtcattctaggaatacttgtagtatctgtctctttatcattcatttagttgaaatgctttctttgtcttgtctgcccacatcctctggcacattgctacttgtgttcactcttgttgcagctatgttagtagagccaaaattttgtgactattcataatcctttttttaaattttattagaaagctggggccttggaaggtgtgccaatatctggggtaagtttcatcaccaagtgtctccccatccccacccttccccatgttatggctttcctcctcttagttcatcagtgtgcctctttttaaactagggaaaacaagtaaaagttgcaaaattggctaattcttgttcttacatgtcatactgtgggccattgagaatcttttgaataaattaattttaactctcccttcccatacctattatcttacatattaacaaatggtattaacaaatggggaaaatggccaaatggagaaaatgcaaggaaatagacagttcattctttgataaataaaaaatgaaaaatcctatggctcttctaaaaagaaagttaatactattgtattagtcagtgttctttattgtcatttatactttcagtgtttaggggaccagtctgctgcattggtgggacaaatgtgcttccagattggacaagccaaaaatacgtgagtttaagaaacagacttaaaaaccaatgctgttttgttttttctacttggtgctttgaataaggaaaagcttttgaagttcatccaggatgaaaatcaatagcttaatagctccaatatgcatatatacactttttaccatttttttatatctttaaataaaatacaaaatgccatatatatgcacactgatgaagcttataaagacctaaatttgtaggctgggcgcggtggctcacgcctgtaatcccagcactttgagtggccgagacaggtggatcacctgaggccgggagttagagaccagcctgaccaacatggagaaaccccatctctactaaaagtacaaaattagccgggcgtgttggtgcatgcctgtaatcccagctactcgggaagctgaggcaggagaatcgcttgaacccgggaggtggaggttgcggtgagccgagatcacgccattgtatgccagcctgggcaacaagagtgaagctctgtctcaaaaacaaacaaataaacaaaaccttaatttgtaaaattcattaccttttatatcctaaaaactaaattttggttcaaagtattcttgcctttttggggagattggtggggtggtgagaggggtgggaagaagtgaggaagagctgtaatatatagtttttggcatattaagtctttctcactaactgtaaagttatatttttgtgggattttcaaggttattttcctggcattgtgctttctctccattatctgaagtttcgcctttcctggcattgtgctttctctccattatctgaagtttctcctttgacaagaagcagaaagaatgatagaagtagagatttggtatatttttctctcaatctcatcttcttactactcacacatgcagaatctggaacaagccccatatctaagagtaataagaagatgactcccactttaggataagaaaatggatactcaaggagcttgcctaaggtcatagccttgacacaaaagcagaaccagatctcaaggccatgccttctgagtctgaatctggcactctttctttctgttcccaccaatcactatatttatttgaaggtaatctttttatttatttatttatttttactttttatttttatttattttttttttttgagatggagtttcgttcttcttgcccaggctggagtgcaatggcgcgatctcggctcactgcaacctccgcctcccaagttcaagctattctcctgccttagcctcccgagtagctgggattataggcatgcgccaccacgcccagctaattttgtatttttagtagagacggagtttctccatgttggtcaggctggtctcaaactcctgacctcaggtgatctgcccgccttggcctcccaaagtgctgggattacaggcgtgagccaccactcctggccaaggtaatcttttaaatattaaaaaatctacctgccaattatacgtattcatgaacaaaattaaatatgcctcaaaagctgaattaatactaacaattataacacaagcttagccaatggctattgtgttacctataatgtttcatgtgctttaaacacatgatatcatttaatccacatatagatcctattattcccattttatagatcaagaaactgagaattaaagaaaaaaatttatgcaacagcacacaactagtaagtgggagatgcaatatttgcacccagatccatgtcattccttagccagggttcttaacctgtgtactgtactacctcctgtatggaaaagatttccatataactggcaagaggctacatttaattgctattttcttgaggatttcctaattatctcatcgattttaacttcagtggttaagttcttcctttgtgaataatggaatgtgtaacatttctagattaaacgttcttgtagtctagcagggtcagtggctctcatgcaagagtgtgacattatttgtgtgagagttttttgaggaggagggatgtgggaattctttgcaggtcatggtaatctgaggttacatgaccaagagcatctgagtcagcctgagtctggaaacattcttggaatctgggttccaggcagctggaatcaagtgccatgagaaactttgaagcaaagctgttgggtttcaatgggaggatagaaaagtcacaaaagattatcttagtaatgagatgctttgaaaaatgagcagtattggagggtacagggaacattgaacaaagatacgtatggggaaatagaagactttgtttagagaatgtagagaacattagagtagggaagtgacaaaaaatataaagctaggatcatgttgtgaagccctatatttcaggctaaggagcttttcttgataggcaataggaaacttttgaaggtttataagctggtgttcagagatgactggagttgtcagtagcagtcttgggtgaaagtgaggaaagactagaggccaagatgccatggaggaagccaccatagtgtcccggtaatgagcacatgggctcagaaggatggagacagagagggaggccatgagtgaatgtgcatggcactgcagaggagaaagggaggggaagtaggtatgtcatctaggtacctggaccctgtggttaggcttagccaaagtaaggaaagggtctgagtggaagaatttctgttcagagcgtgtttgtggtgctggcaggctgtatgttgcacacatttggaaatgtggaataagttcagtataaaaatagaaatttttggccaggcacagtggctcatacctgtaatgccagcactttgggaggccaaggcaggtggatcacttgaagtcaggagtttgagaccagtctggccatcatggcagaaccctgtctctactacaaacacaaaaattagctgggtgtggtggtgagtgcttgtaatcccagctactcagaaggctgaggcatgaaaattgcttgaacctgggaggtggaggctgcagtgagccgagattgcatcactgcactccaacctgggtgacagagagactgcctcaaaaaaaaaaaagatggaaattttagaatttccctagatagaggggattttgaagcaacagaagtagatgaaattaccaagaaaaaatatacaagtagaggagatatttacacaagtagaagtagcaggcacggggatggagaagtcagaaaaacaatgcagttattcattttatatatatatatatatatatgagatagggtcttgctctgtcacttaggctggagtgcagtagtgagatcccagcatactgcaaccttgacctcctgggctcaagtgatcctcccctctcagcctcctgagtagctgatactacaggtgcatgccaccacactcagctaatttttaaattttttgtagagatagggtcttactatattgcccaggctgtgtcaacttcctgggctcaagcaatcctcctgcctcagcctcccaaactactgggattataggcatgagccactgcacctagcctgaaattattcattagtgtggaaatccagggtagacatatttatgagggaggcatggtcagtagcgcaaaacattactaagaggtcatggaggctgagtaccaagaatggaccattatacatagaaattaggtcttcgtttggtgactttttttttttttgagatggagtctcgctctgtcaccaggctggagtgcagtggcatgatctcaactcactgcaacctctgcctcccaggttcaagcagttctcctgcctcagccccccgagtagctgggactacaggcgcccgccaccacacccagctaatttttgtatttttagtagagacggggtttcaccatgttggccaggatggtctcgatctcttgacctcatgatctgcccacctcagcctcccaaagtgctgggattacaggcgtgagccaccgcgcccagccgttttgtgactttcaagagtgaagttgtactagaatgctcaagatagaagcctggttgcaaatggtcaaaagagatgtaagcaggtaggaaatcgaagacatgtgctttgcaaaaatacaaccatccaggaatggtgagagaaggacatagtttgtgaggttaacaggattatgtaacattttgggaattttgtttgattttgtttgtaagttatggtaagaccagagaatgtttctttggagtctgagcggagaacagatgaaagttgtaaaataaatgggggataagtgatggacaagaccaagtaagaggttagagagattgggattgaaaatttagttaatttctcccaacctcagcagggagaaaatgacagtcagctcagaattcaatgaaaagcccatctctgtttcagagtgggggaagaaattatggatgattctaatttttctttcagcttagctgtattttccaatttttctagaatgtaaaaattatttgaacattaaattttatttttctgaaagagcacatgagatagctgtctcatttgtccagtagtgctgactgggtgtgacagagttttttacctccctcacagcttcctctggggtcaacccccctgcccctatgcgccatcttcgtcacacctctctgggctgctcagtcctgatctgatagtcatgaaggagagcaagcaacgtttacctttgtagaagttagaaaagtgagacatctttctgctatgtttgaacacagtacagtgttctgtgagtacaatgtacaatgaggaaggcgaggtagatcatgtaaatgctgaaagctccatatgtgcttgatgactgggaagaaagaacaataaaatttaagaggaaaatacttgcctgtgtactgctttaaaagctgtggcctaagtatagcaaagaagtctcttcatatttgctaatactcattaattgcttattaagtatactcacttaagaattcacttttattaagtaccttcagtcttctcatcagttttgcactaagacgcgtacgctactgttcagtatagtgtttatatggatgctaaattggtacagatttctcctttaaaaagcatgaaatagataattaacttccatttttatgaatatttatcacagtagattaacttgaaacatgtagctttttcagtgtgcggcaataaaacggtatagtgattttgtgttttagtttgtaaatgtattacctgtacctagtgttatttgacaagtatctttacaaaattagatattagtcccatgctccttgaatttgtcacctgctcatcaagcaggccaagaatatatttgggtgagaagagatagactatcctaggctaatccttatggtaacaatggtacctggaaaaatgtcggaaaacaatttcccttggttttgtgtttgttgcacaatcaaaatgcagctgatgggatctgttgagttagtgctgactggtggtagcttcttctgggatccttctgccagctcctggactgagcactgtcccatctttcagttgctggaatgtcaccagcacagttagaaccctggtggtgcagggcacagcagcaaggcccacggggaaggaatgcccagcttgggcagagccaagcaagggtgactgtagcaaccttgttaccccaagcttaactgttcctctgtgacccttactggtatcactttgggccacttatctgcctggcacatgtcaaaactacctattaatgtccaagggccagacttgctgcagaatccaaagtttatattgataaggctgccacaaaataaattcagttcttctgtatcagccatgttacattctggctctgattatcaaaggtagaccttaaattgccttccgttccatgccactcttgtcctagctttccaactacaccctcccacactctgtatccagcctccccaccctgccagaaggtagtggtgtttctcattttatgactgtattaatgatagagctaagctggctgtcagtcatgatgcttcactccacatggattagtagtaacataactatgacagaacttagaatttgttgtaattcagtggtattttataaacacagccctggcctaggactgactaaacactaaatactatatctgcatttttctattaagattgcaatggccaggcacagtggcttaaacgtctgtaatcccagcactttgggaggctgaggtgggtggatcacgaagtcaggagatcaaggccatcctgactaacacggtgaaaccccgtctctactaaaaatagaaaaaattagctgggcgtggtggcacatgcctgtagtcccagctacttgggaggctgaggcaggagaatcgcttgaactcgggaggcggaggttgcaatgagccaagatcgcgccactgcactccagcctggtgacagagcaagactccatctcaaaaaaaaaaaaaaaaagattgcactaagtacattttcttctaggctgatttctaaaacattattccaggaagatatatgatttttgttaactttaggaacttttataaaactataatgacttttttggactaaattatatgtcagttttgatcatttgtgttattaatgtttcattatttgctttcaataaaattgtcttactattcattctcccttcaaccataggtatggaacaggatgtttcttactatgtaatacaggccataaggttggttttttaaattaaaaaattgatttaaaagtctaagttcatctaaataatgcttgaacataatttactattaaacaacttttagtctttagcttttacttaatctttatcagggtttaatttagagctcaatacaaaatttgaatcgttctaataagaaccattttagactctttgaattttatatgtgtgtttttaattgtgctggtgggaaatctagactgagacctcatcaaattcttaatgcaaatctaatttgaaacaaggaataaactttttatacagcttaaatgtgttcttaattctgatcgttttgactgtaaggatttattttaaaaattggtttattgattgcattattttgtacctatgttattttaactttaaaaaaaagttctcatgttatcttttcattttccactactgaaatcttttttttttctttcttacagtgtgtattttctgatcatggccttctcaccacagtggcttacaaacttggcagagacaaaccagtatattatgctttggaagtaagttctttttaatcaatatggataatatgacaaacattcaaagctaataaaaattacagtgttttctaacacttttctggtaaatcttaatacagaggactcaaaaagttctgctttcttggcatttgattgagttgaaggaacctgaaactgatctgggtgtcaggactcacaggagaccttgattagattggttcctcagttcttatgccaattaatcatgtcaccttaggcatattacttgagagctctacaatgtaaggttttttttttttttatctctaaagtttaatcggattaacgtgctctctaacatttctttcatcttgaaaattctttgattttataaataaaatgctccagtgttccaaagagaaccctgggcacaaataggcagaacaactctcttcacttgtctcctcataaaaataaattttgtgtaacattttgatatagaaaagaaagtgaggagatttatgccacttatcactggaaacatttgtttcaaacatttttgtatgttatagtaggaatatgccagcctaagcctataggatatggtaagttagtgttagaaatatttatttataaagtcaaagaaataatattctttttgtaaaattagatacatttcttataagcatttctatataattaattttgaaatggctaccttataatgcacaagtatacacttgatctgcagactcattgaggctcattttttggagtgcctgataataatttggtcacaagttaaagacttctagttagagttaaaacattttattagtcattatgcctagcacatgaggaatattagtttatttctatttttctcccttccccaccccataaacactataatatttctccccagctccttttctatggatggaagcatttgtgaaaacttagtctgtatattaaatgtatcttaacacttctcagaacttaaaatcctacaagccctctccctctctactttccctctgtggagagtgcatagcacaacactaggcacatagaatatgcacttgataagtgttacctataatataataagaatatgattctgctttttttcttcttgcatgggaaacaatcagtgctttagaatacaggtgccttagacctgggacaggcctcagggacaggggtcactcggtcttaactcccctcccaatgtgaaaaaccttctcctgtctcctttaccagtagccatccaacttctatctgaagacagcacccaaagttgcttcttaataacacctctagcattggacctgcattggttgtcaaaagtgttccaacattagaggctgcggtcagtttctctgggtcttcctcctccagggtaaactgacccaatgccttgatctcacatggtttctggatgctttatagttctgagctcccttcattgggtgcattgcaattcatgtcgtccagaatggaatataacattctacatctaatctgacctgtactcaatcaataggatgatttgtgcctctcctaccataagcactacttttgctcctctagcctgagagttcattaatttagactaatatttattaaattaatatttattaattaaaataattaatattaatttagacttcatattattggccctgggagcatatgctaaaaaacctagctcgttttcaaatgaatcattgtcaaaccaagtctgctctgttctgtatttgtgtagtttttttgttaaatctaaattcaggtctttgtttcttcctgtttaatttcataatagtgattttagcctattcctatatagtctgaattcgttttcactctttactgttactctttcagttttgtctcatctagagatttaacaagtatatgctttatgattttgtttcaatttatgtaatgcttttagatgcttagaattgtaaaagctcagagagacgctagatcatatgacaatataccctcctatccccttgttttacacgtgaggaaaccgagattagaaaagtgaaattggagtcccttggccaagtaacttttgacaacagtaagtagcagatccagatgcttggacatcaaagccttgatgcctaggccaccctgctgtaccatttccttccttgtaagtctgaaagttctgggctccagtctcccaagtccagtgttgttgtcactgcatctagcttatgtcccttccttcatctgctaacctagcggtctcagcaacaacaacaacacacatacgcatactaatatgttaacggtgtagttagaatttttttctttgttttcttaatttttttttacaattaacaaacatttaaaaaaaattaaattaaaccaaaccaaaaaacaagggtggggaataatgctagactggtaaaactttttatcagtaaacacatgctaatttcacttggtcatactaattcctttttttgtaaatgcttacaaagtatatatttaataatattgtctttcatttgatcaattgttgttaggcttagaagttggagataggaaaattttagtctttatgctctttaaaacctaaaactatagctacccatcttcagtcttttagtctttttccattcttcctctgctgatttgggaacaataagatacatttctatgtttttattttggtgattttttttcttttgcgtataccctcagatttttaagatattgtttaaccatatatttttctaagagtgtatgtcattttttggtatttttaatctcccgaccatgataaggaactctaatattttattctaccgcctccatcaccaattgtgttattttgtttaaagctttcatttcccccattttgttcaacatgtaataattactgttgttttctttgcagtccacagtaaatcatatttattgacttatttttcttagtttgtgtccagtatcatttctttggtctcacaccttttttattcccacctacttttttcctttttttcttcttctttttttttttgctgaggggcatccttctatagttcttttagttttagtgtgggatagtaagcctattctttttaggtttgtctttgttttgccctcactctgaggatgagtataaaagcctatattaacaattgtttttcccacatcccttctggccattttcgatgttgatgagacctctgctgtcaatatgtggttcatttgtagataatctggtttattgtctgggagtttctaacattatctctttatcattgatgttctgtagttttactatgatatgcctgtgtttggatttatttttatttatcctgttaggtacttggatccaagtctgtcttcagatctggaaagttctcagcaattatctcttcaaatattgctcctctaccattacctccatcctcttctggaattgctattggatgaatattggaacctttcaacccatcatccatgtctcttaactgcccttttatatttttttaatctctttgtttctctgtgctgcgtccctggtgagtttctcagtatctaccttccatttccaaatcctctctttaaaacaaacaagacaaatcataaaagccttttttgtattgtgaaatataagacacatagagaaaaatgcattaaatatcaatgtacaacttgaaaaattattataaaggctcatgtaacttgttcatagaacgccgccaatcccaagaacctctatttgccccacgatcacaacttcctccctctccctgagataaacatcagcctgacttttatcataatcacttccttacttttctttgtagttctaacacttaaatgtgcagccctgaacaccagagtttagttttgcatgtgtttaatatttgatatattaaaaatataaaagaaaagagagagagagcatgtgcatgcatatctgagtcacttagtatgtatttttttgtattttttgatctggcttctttcactcaacattatgtttgtgagattcatccacagtattatacatagctgtttttttcattgcttcttattgctatatgaaattattgaagtttagtatttattcagctgttgatgacattcgagttgttttcagtatttggctattatgaaaaatgctgctatgaacatttttgtatatgcctcctgatgtaaatgtattcacctttctgtaggagtagaatttctaggccatagattatgtgtatcttcactttgagtagatagtgcaaaccatttttcacagtagatgtgtcaagttacactcctaccagcaatatgggggaatgctagtttactcatcctctctatctagtctagagtttaccccatctagtacatttttcatcttatttaatattttcatttctatagtttttatttggttatttttcacatccacctgattttgtttcagttctcttttttttttattcttagtttcatgtttgtttgtttttaaaatggaagtcatttcctaatttatctccgaatacttaaaacatatgtattttaaaatctgtgttaggccggaatgaactctagtccagctattaagtttgttggatttcttttttcttttctttttttttttttttttttttttttgagatggagtctcgctctgtcgcccaggctggaattcagtggcctgatctcggctcactgcaagctctgtctcccaggttcacgccattctcctgcctcagcctcccgagtagctgggactacagatgcccaccaccatgcccggctaattttttgtatttttagtaaagactggaaataacgaagtttcaccgtgttagccaggatggtctcgatctcctgacctggtgatccgcccgcctcggcctcccaaagtgctggaattacaggcgtgagccaccgcgcccggccttgttggatttcttaatacaagatttcttcgtatagtttagaattgtcacttccagccttgtcttccattaagccatatagcctcagtcagcaaatacacagttgcttgtttttctagcatccctacacaagtaagagagcgccacctagctcctggcttcaagcattgagcctgattctattccctgtcttgcgcaaaacattttggacccctttcttctggaggaaccagttcccagccaccactcctactccctgacacatatagaaaaataaatcagaagccatcatgcttgtggcttcagtcctgtttggttatgtgtttccgtgtctgtccacatagatgttattctgtatttgagtcagcatgttgtttcagttttctcttttatatcgtgtctgttatcctctgtggttagaacaaaggggatttttgaagtacaaactcattatttctgctcatgtaagcatctgcatcttctttttcatcaccaagagaactctttttctctccctgaagcccctggcaggtgatagtaaggcctgacattttaatacctctaaattctcattttcattatttgtaaaaagaaataggtgttcatgatccttaagttgttctgtgacattaaactcatattaaactggttaaatttgtcccaccctttctagttggaaaatatttctcagtagtggaagagactggagcaaaatagagccattgagtggttctgccttccctctggcatccttgttcctcttctttttccaaatactgtttcacaaaacaaaaatccttttgggaacttttaatatgagtatgaacctgagcttacttatgacttgagacttccatgttccgtgttttgtcactagaatatagatttcctgaggccagggtacttgtctatcttgtttaccactctgtcccagcaggctggcagataatacatacccattaaatattgttcaaataccgaatcctatgttaggccatttttttctttttaaatatgagcttcaaagagggttccctatattgcctccctggtttctttaaatatctcttcccctatcttttctttgttatggtttaacgattatagcgttaagatttcctttttagagtttttcatccttcttgagctaaatccctattttaggtataaacctatgtaatagattatctattgctgtgtaacaagattaccacaaacttaagtggcttaaaacaacacatttattgtttctcagttcccatgggttcagaatccaggcacagcttagctgggtaccctgctcagagtctcacagggctgcagtcaagatgttgactgaggctctgctgtcatctgaggtttaatctgcttccaggttcattcaggttattggcaaaattcagttccttgtggttgtggaactgaggacttcagtttcttgctacctgtcagatggaggccaccctcagctcctagggctacctgcagttccctgctatctgagggacccccagtggttctctgcttccttaaagtcaggaagggagggaatatctccagcaagacaggcacagtaaatcatgtaatggaagcacgtacacatcaccacacatatcccatcacttttgacatgtactgttgggtagaagaaagtcacagatatcaccacgctcaagaggcgaggattatgcaagggtatgcacatcaggaggcagggatcatgggagccaccttaattaaaagtctatctgccacaagcatataaacattgtttatgaacttttataatgttctttcttgaaaagtatactttctgagcaataaatgcttttaattttagttccccaacttgttactgaagtattaatgaaatctgttacatttcaaaaataatgttgctccaattcaactcttccctttctctatgcaattaaaaatgctatagagttagacactgcatttgtaatctaatatatacaaattaactacattataaatcatatacgtacagatacatagcactgtagtatacacaaaactgtgtttgctatgcctgatgaatgattgtaagcaatttagggtaatctttactttacctgatttttctccatactcaccaattttcaccctaattgccttgtaagctacaattctactgcatcctgaaatatcctgctttatttttatactgtttgtggcagtggcattcatgtcaaggagcttttgaagaaaaatgtatttgcctgctatgacattacatcagatctacttgattatttttaattcaatcttcctatagcctgtttattagcctttcactttccaggctacatgtctagttttaaaataatttattcctcttgccctgttataatttaatttattattctttacaccctctcactttcattgcatctcccttagtgtacaactattaagcttgcatgcatcttttccagggaatcataacctagaacaagggctgattcaaatttgtagatgatatactaaagtattggatctttatacttagggtgtaatttatggtaacttaactgataacaagtagacagtcaccttcttttatcattttaggttttggctgctatactcttttcctgtccagctttgaaacattattaccatcttccattttatttcctgcctctgaattcagaagaccacatgtcttttgtgaattagagatgtctctcatttttatttctttaaaagctaaatcataccatgtattatatcctgacagcaaaattatttacttttttcagataagtgtttttatctaccttttattgtgttatattgaatctagtttttcaatcacaacaaaacacttctgtgtattcctgatgacagaatttaaaacagttatctcctggagccttaacagtgactatgtattttttttcttttgttttaatctaaataatactctgattctcaactaattacctctaatcaaaaccttgattttccttttgctaaaatcatattgctttctcttaaaaatatggtgtaagcatgtaacatcctatctttttcaatggaaatgaggtatatcagcacgtggtttcctagagtataaagtcccaccagctgtgccacaaaatcactttactagactcctagcacagtggcttctaaaaattcgcagtttaactgtacttgcctaaaacaattatgtatgcatttcttggttagatgctatttaaggacagtgtctttgagagtataaggaggagggacacctgtttttgtttttctttttcaattaggtctagaattatactgcccatggcagccatggccacatgcagctattgagcactggaaatgtggctagtctgaattgagatgtgctgtaagtgtaaagtatataccagatttcaaagatagtacaaaaaaaaatctcaataatttaatattgatttcatgttgaaattttttttaatacattgggttaaataaaatattaattttaccttccttttacctttttaatgtggcaaaaatataaattacatatgtgactcactttatatttctgttggacagcactggtctagaaactcttacatatttactagtatttggcagctgctatctctgaattgtctgtttccaaaggaaatttgaatcttaaatctctttaaaccaaaattttacttagttctcttgaatgatcccactaagtacctaaatatgtaaatgtgtcaaacttaatacaacaacttattttaggcagggaatgagctgtgttagagtcccttgtaaggtatttcttgaattgtttttgtcccatttttaaagccttgtcatatttgcacagctatgccagatctgttcctcaaatacttcctgtggttaaaaagccattttatatatgtaatgatacagagtactgtatgtatgtctacatatataaaaatgtataaacagaacaattgtggcattctgtagctttgcagtaacatagtaacttctcatagaagctatgaatgatggaatataccagcatattcattctctagtttacttacattttgacaactgacaacaagaaggcatgaccatttgtaattcagttaatagaactgaggacaggtccctacatttaatattacctgacgtttggtttggagtgactctgtggaagtaatttacattaataatctatatgaatgaactatcagagctaaaaaaaatttcttggtattcctaatggttcgtgctgatacttctttttttttttgccttcaggatctttttataatagctttattgagatatagttcatattccacacaatttacccttttcaaatatacagttcaatggtttatagtaatactatatttacagatttttacaaccatcaccacaatctaactttagaacattgtcaccaccccaaaaagaaaccccataaccaccccctatcccccagcccaggcaaccactaatctactttctgtctctatggatttgtctgttctggacatttcatatgaatgggatcgtacaatatatcgtcttctgtgcctggcttctttcactttgcataatgttttcaatgctcatccatgttgtagcatgtattaagacatcattccttttcatagtccaataatactccattgtgtagacatactgcgttttatctattcatcagtcagtgatatttggctgatacttttttaacattaaagaaattaatgaagtcaatatttacatttagtaagaaccttcacatatattctcatattgagcctcacagtaatttgtttaggtaagtgttgtcatagtcatcattttataggtgaagaaatggaggctcagaaagcctaagtaacttaggcaagttacttagatgaacttgctaagattaacttactaagttacttagattagttactaagattacacagcaattaagtactagaactgggactcaaagccagtttatccaactctgaaatatgtttttattgttattgccacagctctaggtgattttgttttaaagaaaaattacttactagctagcttctttgctttttgttttcttgatttactatactgttagatatgggaaacagacttgaaaaaacttttaatgtggcctctcccaataattttatgaacaatatggcaatatatttctaagtgataacatacctcagtagcttagcaacagacagaaaattgttcaagaagcaaactgatcaaagatcaatgtccacctatggggacaaatccaagggtgtgctggaaagctcacttcttttcctcatcccgtgaaaaacttttattagtgacttagataaaactatgtttgtattagaagacctagtttacatatttgtcggagtctcaaaatggaaactgaattctgtccatctgattgtgtcatacacagaatatgctcaataaaaaccttggatagtgataaaatatattctgtcttgaattcctttttttctttagggttctgtagctatagctggtgctgttattcgctggctaagagacaatcttggaattataaagacctcagaagaaattggtgagtgtgttctaacaaaaggttagaaaatctgaaaaatgacacatttcagtattttatctctgcaaagtaaatacttatgctttgccccaaatgtgatccataaattatatggatccctattatgagtttgacttatgcaaaagactatcttgtgaagatttataaaacaaggaattgacataattagtggtggttgttaataaactggcaatgtagggcataaaaattacccaagtgtaaaattgaacactggagattgccagaacctgcagatagagaagttgagttaaatttatctgatgagaaagagctttaactcttagattagagtgagcattaaaactctggtacctataatttaagtattaatacggctgttttcagtctatagataattagtttgaacttacctactcactctttcatccacttgcttaactttgcctgaaggtgagacaatcagaaatacatttctgattagggacacactagaggccactttttcatctcctagtcagcaaccttaaaaatagtggaaatgagctaaaataccttaaataaatgaatctggttccttgatttcttgagctaggctacattttagtggggggtatttaatgtgagagaaactcatttctgttgatcctagcatactactgtagttagcaacattttgctctaccaatgaattggaaaccaaaacccctgtcctaatttttctaatttttaaaataggtatgcttatataataatacacaatatttgtgtgatttttgttttgttttgtttttaatgttagaaaaacttgctaaagaagtaggtacttcttatggctgctacttcgtcccagcattttcggggttatatgcaccttattgggagcccagcgcaagagggtaagtattgaaaatatggagtgcttttggggatcttgatttatttaccaaagtcgttaataacttattagtttcttatctattttcaaataattataatgtgttgagaaaaccttttctttttggagaatataatttcagaaactttaagctccaagaagttatgaatcagctgacaataacccctgccatatccgtattcatgttatcttttatcttcatgatgtctgtaagttgtatagtgaagggacatcatcataatgaatactgattcagttttatgatgccatcatcttttcaaatgtgtcatgaattttttcatacatgaatgcagaattgtgaaatataaggactttctgagttacttaatgattatgtccaattttctcttcctggacatttctgtctaccaaatttgaccttttcatatttgagatatttcaaattgattggtttatatcattctaatctgaaaatctttgtgcgtatttttaggataatctgtggactcactcagttcaccaataaatgccatattgcttttgctgcattagaagctgtttgtttccaaactcgagaggtaacaaatatgggcctgttttcttgtacttagttcacttttatcactcttaagttatatgttaacacccgagatttattcagtactgaaaatgtagttaatcaaatattaaggctgcctaaatactaatctaaatataagcagggttttccccctttttccagctgtcattaccttctaagttcctgttccctgtcaggcactgggaattttatggttgtggggaggctgagtggcacacattaggcaaaggaaacagcacaaacataggcatcaaggcagaaaaacagggtgcaaaatagagttgtatagcttagctgaatatcaaggtgaatgcagaggtgtagtgagagaaaaggttggctgtgaccagatcaaagagggcttagaagaccagaataagaagtctcaatttattccataggctcttggaagctcttgagagtttctgagtggaggattgccattttcagagatgttactatgaaatagatttataacattaattgcactggtttatttaagattttggatgccatgaatcgagactgtggaattccactcagtcatttgcaggtagatggaggaatgaccagcaacaaaattcttatgcagctacaagcagacattctgtatataccagtaggttagtaagtcttcattcctttaaactcccagagtaatgtttcttgtggaataactagttctttgggcatatgtaaccacaaagatattgatggaactctctctcctcagtgaagccctcaatgcccgaaaccactgcactgggtgcggctatggcggcaggggctgcagaaggagtcggcgtatggagtctcgaacccgaggatttgtctgccgtcacgatggagcggtttgaacctcagattaatgcggagggtacatttaaagaatgaaatgttcagtgatatactgtgaaaacgaccttagtgcacgggagttttgtttttctgtttagttaaaagttaaggaaccaagtaaaatagtaaatgttatcattgcagattcggctgccaagcatattgggctttactgaataaatgtgaatgagagaaatcgttgcttatcaaaagaacttctaaaatcactttttaaaaatcatttgcttttactgtttatggtcctttagtgtaggataataatactgccacactgtcaggtatagctagttagaatagcctttttttttttttgagacggagtctcactttgttgcccaggctggagtgcagtggcacaatctcggctcactgcaagctccgcctcccgggttcatgccattctcccgcctcagcctcccgagtagctgggacaacaggtgcccaccactacgcccgcctaatttttttttttttttttttgtatttttagtagagacagcatttcaccgcgttagccaggatggtctcgatctcctgacttcgtgatccgcccgccttggcttcccaaagtgctgggattacaggcgtgagccaccgcgcccggccatagccttttttaaagtgagaaggaagatatatcagccactcatccctaatgtctacaccagatcatctttggtgccagtggcccagttttaggacataattagctgggttaagagacactctggtaacttttaagcacagcaggactaacctgatgaaggcagcaacaatttaagtaagtgaacattagatatctgattcactgtgctaactaagctaagccacaagctgtgatcagcacttttactaaaatgtagtgatgcggttcttaaatttaaataaatgtagaaaaataaggttttatatattagaattggttttataacttt

SEQ ID NO: 5563 - DNA, 24176 bp, human
tggagattgagttgtaacccaacccattgacttcatcacagctttcttccatgtagaataacgaatttcactttctagaattagaaggtagaaaaaacacataacgaaaggtagtttgctgagatgttcttagtaccatacttatgatcactcaacattcttgacaaattattgcacacattaaactgcagtagggctttagcaggactcagatttgaaagcacatggttgctgatgactgccagtgactggaagacatgcttgcttggaagttggagtgaaacaggacacagggaggctgggtgtagtggctcatgcctgtaatcccagcattttgggagggtgaggagggaggatggcttgacctcaggagtttgagaccagcttgagcaatgtggtaaaaccctgcctgtagtaccagctacctgggaggctgaagcaggaggatcatttgagcctgggaggtggaggttgcagtgagccaagatcacaccactgcactctagcctgggtgacagagcaagactcggtcccaaaaacaaacaaacaaacaaacaaacaaaaacaggataggggaaattcagcagggtaaagggagattggcagacagactgcctgctatgcagactgggccactcacaaacaagtggtaatgaattagaaaggggaatcccatttgatctgttttctcttctttttggggggaaagggtacgaggaaaagggtatgctgtaatgtgggaagactagaaggagacatttttatttcttttttttttttgagactgagtctcgctctgtcgcccaggctggagtgcagtggtgccatctcggctcactgcaagctctgcctcccgggttcacgccattctcctgcctcagcctccccggtagctgggactacaggcgcccaccaccacgcccagctaattttttgtatttctagtagagatggggtttcaccgtgctagccaggatggtcttgatctcctgacctcgtgatccgcccgcctcggcttcccaaagtgctgggattacaggcgtgagccaccacgccccgcaggagacgtttttatttcagtcacaggatttaacaaatactgatttctcataagatttgaattgcattcctctgagacagccccatgccccccaaccccagcatcttaaagcaagattttttaaaggtggaaatccacaatagaaagtctaaacaaaaatgagcttgatgttgtacacttctaagggtgctgaaccccatgtggggctacctttctctcaagcctcccagactttccatagcacctgaggcctgcaacacccaggagagaaggctcaagaatcactcacttcagaaagctttccagtgccccatttctatccccccctctctcttcacacacaccccaggatgtcagctaccaaatttttatggttttgtcttctgctcccaatatactctaatcttctgaagggcaaaagaagataagaagataaggccttattcatctctatatccccacatcagtacagtctctggcctgtggttggctataaacaactgtttgctggcaaaatgtactatctatgcctaggtgcccattcgtttatggggaggagtgagggctggtgagagggaggacaatagggcatgactgatcaaccccaggctaaggccttcaacaccagcaaagatggctcccctaagaatggagatggctctcttggcacagaacttccttgctttaagagtgagattggcatttagaggccatatacccgctctggacattatttgcatattataaagttgattttttttgaaaagtagaaaaattttttgaacttcatattttatccagtattgcaaaagttaaaaatgacagaatatcagatggtgaaatacatttctaaatcaaggtacatggtataatctgactataaaattactagtattataattcattttcttatatgttaaaagaatgaataaaattgagaaacactggtatattctcccagaaaaccaaacaaaaatgcatttgaaagcttattcccaatacctcaaaatccactttgatgctttttttttccttttgtttttttagagacaggggtctcattatgttgcctaggctggactcgaactcctgggcccaagccaagagatcctcctgggtagctggggctataggcacaaattaccattcccagctgatgctattttatgcataggtttctaaaaagttataaaaccaattctaatatataaaaccttatttttctacatttatttaaatttaagaaccgcatcactacattttagtaaaagtgctgatcacagcttgtggcttagcttagttagcacagtgaatcagatatctaatgttcacttacttaaattgttgctgccttcatcaggttagtcctgctgtgcttaaaagttaccagagtgtctcttaacccagctaattatgtcctaaaactgggccactggcaccaaagatgatctggtgtagacattagggatgagtggctgatatatcttccttctcactttaaaaaaggctatggccgggcgcggtggctcacgcctgtaatcccagcactttgggaagccaaggcgggcggatcacgaagtcaggagatcgagaccatcctggctaacgcggtgaaatgctgtctctactaaaaatacaaaaaaaaaaaaaaaaaaattaggcgggcgtagtggtgggcacctgttgtcccagctactcgggaggctgaggcgggagaatggcatgaacccgggaggcggagcttgcagtgagccgagattgtgccactgcactccagcctgggcaacaaagtgagactccgtctcaaaaaaaaaaaaaggctattctaactagctatacctgacagtgtggcagtattattatcctacactaaaggaccataaacagtaaaagcaaatgatttttaaaaagtgattttagaagttcttttgataagcaacgatttctctcattcacatttattcagtaaagcccaatatgcttggcagccgaatctgcaatgataacatttactattttacttggttccttaacttttaactaaacagaaaaacaaaactcccgtgcactaaggtcgttttcacagtatatcactgaacatttcattctttaaatgtaccctccgcattaatctgaggttcaaaccgctccatcgtgacggcagacaaatcctcgggttcgagactccatacgccgactccttctgcagcccctgccgccatagccgcacccagtgcagtggtttcgggcattgagggcttcactgaggagagagagttccatcaatatctttgtggttacatatgcccaaagaactagttattccacaagaaacattactctgggagtttaaaggaatgaagacttactaacctactggtatatacagaatgtctgcttgtagctgcataagaattttgttgctggtcattcctccatctacctgcaaatgactgagtggaattccacagtctcgattcatggcatccaaaatcttaaataaaccagtgcaattaatgttataaatctatttcatagtaacatctctgaaaatggcaatcctccactcagaaactctcaagagcttccaagagcctatggaataaattgagacttcttattctggtcttctaagccctctttgatctggtcacagccaaccttttctctcactacacctctgcattcaccttgatattcagctaagctatacaactctattttgcaccctgtttttctgccttgatgcctatgtttgtgctgtttcctttgcctaatgtgtgccactcagcctccccacaaccataaaattcccagtgcctgacagggaacaggaacttagaaggtaatgacagctggaaaaagggggaaaaccctgcttatatttagattagtatttaggcagccttaatatttgattaactacattttcagtactgaataaatctcgggtgttaacatataacttaagagtgataaaagtgaactaagtacaagaaaacaggcccatatttgttacctctcgagtttggaaacaaacagcttctaatgcagcaaaagcaatatggcatttattggtgaactgagtgagtccacagattatcctaaaaatacgcacaaagattttcagattagaatgatataaaccaatcaatttgaaatatctcaaatatgaaaaggtcaaatttggtagacagaaatgtccaggaagagaaaattggacataatcattaagtaactcagaaagtccttatatttcacaattctgcattcatgtatgaaaaaattcatgacacatttgaaaagatgatggcatcataaaactgaatcagtattcattatgatgatgtcccttcactatacaacttacagacatcatgaagataaaagataacatgaatacggatatggcaggggttattgtcagctgattcataacttcttggagcttaaagtttctgaaattatattctccaaaaagaaaaggttttctcaacacattataattatttgaaaatagataagaaactaataagttattaacgactttggtaaataaatcaagatccccaaaagcactccatattttcaatacttaccctcttgcgctgggctcccaataaggtgcatataaccccgaaaatgctgggacgaagtagcagccataagaagtacctacttctttagcaagtttttctaacattaaaaacaaaacaaaacaaaaatcacacaaatattgtgtattattatataagcatacctattttaaaaattagaaaaattaggacaggggttttggtttccaattcattggtagagcaaaatgttgctaactacagtagtatgctaggatcaacagaaatgagtttctctcacattaaataccccccactaaaatgtagcctagctcaagaaatcaaggaaccagattcatttatttaaggtattttagctcatttccactatttttaaggttgctgactaggagatgaaaaagtggcctctagtgtgtccctaatcagaaatgtatttctgattgtctcaccttcaggcaaagttaagcaagtggatgaaagagtgagtaggtaagttcaaactaattatctatagactgaaaacagccgtattaatacttaaattataggtaccagagttttaatgctcactctaatctaagagttaaagctctttctcatcagataaatttaactcaacttctctatctgcaggttctggcaatctccagtgttcaattttacacttgggtaatttttatgccctacattgccagtttattaacaaccaccactaattatgtcaattccttgttttataaatcttcacaagatagtcttttgcataagtcaaactcataatagggatccatataatttatggatcacatttggggcaaagcataagtatttactttgcagagataaaatactgaaatgtgtcatttttcagattttctaaccttttgttagaacacactcaccaatttcttctgaggtctttataattccaagattgtctcttagccagcgaataacagcaccagctatagctacagaaccctaaagaaaaaaaggaattcaagacagaatatattttatcactatccaaggtttttattgagcatattctgtgtatgacacaatcagatggacagaattcagtttccattttgagactccgacaaatatgtaaactaggtcttctaatacaaacatagttttatctaagtcactaataaaagtttttcacgggatgaggaaaagaagtgagctttccagcacacccttggatttgtccccataggtggacattgatctttgatcagtttgcttcttgaacaattttctgtctgttgctaagctactgaggtatgttatcacttagaaatatattgccatattgttcataaaattattgggagaggccacattaaaagttttttcaagtctgtttcccatatctaacagtatagtaaatcaagaaaacaaaaagcaaagaagctagctagtaagtaatttttctttaaaacaaaatcacctagagctgtggcaataacaataaaaacatatttcagagttggataaactggctttgagtcccagttctagtacttaattgctgtgtaatcttagtaactaatctaagtaacttagtaagttaatcttagcaagttcatctaagtaacttgcctaagttacttaggctttctgagcctccatttcttcacctataaaatgatgactatgacaacacttacctaaacaaattactgtgaggctcaatatgagaatatatgtgaaggttcttactaaatgtaaatattgacttcattaatttctttaatgttaaaaaagtatcagccaaatatcactgactgatgaatagataaaacgcagtatgtctacacaatggagtattattggactatgaaaaggaatgatgtcttaatacatgctacaacatggatgagcattgaaaacattatgcaaagtgaaagaagccaggcacagaagacgatatattgtacgatcccattcatatgaaatgtccagaacagacaaatccatagagacagaaagtagattagtggttgcctgggctgggggatagggggtggttatggggtttctttttggggtggtgacaatgttctaaagttagattgtggtgatggttgtaaaaatctgtaaatatagtattactataaaccattgaactgtatatttgaaaagggtaaattgtgtggaatatgaactatatctcaataaagctattataaaaagatcctgaaggcaaaaaaaaaaagaagtatcagcacgaaccattaggaataccaagaaattttttttagctctgatagttcattcatatagattattaatgtaaattacttccacagagtcactccaaaccaaacgtcaggtaatattaaatgtagggacctgtcctcagttctattaactgaattacaaatggtcatgccttcttgttgtcagttgtcaaaatgtaagtaaactagagaatgaatatgctggtatattccatcattcatagcttctatgagaagttactatgttactgcaaagctacagaatgccacaattgttctgtttatacatttttatatatgtagacatacatacagtactctgtatcattacatatataaaatggctttttaaccacaggaagtatttgaggaacagatctggcatagctgtgcaaatatgacaaggctttaaaaatgggacaaaaacaattcaagaaataccttacaagggactctaacacagctcattccctgcctaaaataagttgttgtattaagtttgacacatttacatatttaggtacttagtgggatcattcaagagaactaagtaaaattttggtttaaagagatttaagattcaaatttcctttggaaacagacaattcagagatagcagctgccaaatactagtaaatatgtaagagtttctagaccagtgctgtccaacagaaatataaagtgagtcacatatgtaatttatatttttgccacattaaaaaggtaaaaggaaggtaaaattaatattttatttaacccaatgtattaaaaaaaatttcaacatgaaatcaatattaaattattgagatttttttttgtactatctttgaaatctggtatatactttacacttacagcacatctcaattcagactagccacatttccagtgctcaatagctgcatgtggccatggctgccatgggcagtataattctagacctaattgaaaaagaaaaacaaaaacaggtgtccctcctccttatactctcaaagacactgtccttaaatagcatctaaccaagaaatgcatacataattgttttaggcaagtacagttaaactgcgaatttttagaagccactgtgctaggagtctagtaaagtgattttgtggcacagctggtgggactttatactctaggaaaccacgtgctgatatacctcatttccattgaaaaagataggatgttacatgcttacaccatatttttaagagaaagcaatatgattttagcaaaaggaaaatcaaggttttgattagaggtaattagttgagaatcagagtattatttagattaaaacaaaagaaaaaaaatacatagtcactgttaaggctccaggagataactgttttaaattctgtcatcaggaatacacagaagtgttttgttgtgattgaaaaactagattcaatataacacaataaaaggtagataaaaacacttatctgaaaaaagtaaataattttgctgtcaggatataatacatggtatgatttagcttttaaagaaataaaaatgagagacatctctaattcacaaaagacatgtggtcttctgaattcagaggcaggaaataaaatggaagatggtaataatgtttcaaagctggacaggaaaagagtatagcagccaaaacctaaaatgataaaagaaggtgactgtctacttgttatcagttaagttaccataaattacaccctaagtataaagatccaatactttagtatatcatctacaaatttgaatcagcccttgttctaggttatgattccctggaaaagatgcatgcaagcttaatagttgtacactaagggagatgcaatgaaagtgagagggtgtaaagaataataaattaaattataacagggcaagaggaataaattattttaaaactagacatgtagcctggaaagtgaaaggctaataaacaggctataggaagattgaattaaaaataatcaagtagatctgatgtaatgtcatagcaggcaaatacatttttcttcaaaagctccttgacatgaatgccactgccacaaacagtataaaaataaagcaggatatttcaggatgcagtagaattgtagcttacaaggcaattagggtgaaaattggtgagtatggagaaaaatcaggtaaagtaaagattaccctaaattgcttacaatcattcatcaggcatagcaaacacagttttgtgtatactacagtgctatgtatctgtacgtatatgatttataatgtagttaatttgtatatattagattacaaatgcagtgtctaactctatagcatttttaattgcatagagaaagggaagagttgaattggagcaacattatttttgaaatgtaacagatttcattaatacttcagtaacaagttggggaactaaaattaaaagcatttattgctcagaaagtatacttttcaagaaagaacattataaaagttcataaacaatgtttatatgcttgtggcagatagacttttaattaaggtggctcccatgatccctgcctcctgatgtgcatacccttgcataatcctcgcctcttgagcgtggtgatatctgtgactttcttctacccaacagtacatgtcaaaagtgatgggatatgtgtggtgatgtgtacgtgcttccattacatgatttactgtgcctgtcttgctggagatattccctcccttcctgactttaaggaagcagagaaccactgggggtccctcagatagcagggaactgcaggtagccctaggagctgagggtggcctccatctgacaggtagcaagaaactgaagtcctcagttccacaaccacaaggaactgaattttgccaataacctgaatgaacctggaagcagattaaacctcagatgacagcagagcctcagtcaacatcttgactgcagccctgtgagactctgagcagggtacccagctaagctgtgcctggattctgaacccatgggaactgagaaacaataaatgtgttgttttaagccacttaagtttgtggtaatcttgttacacagcaatagataatctattacataggtttatacctaaaatagggatttagctcaagaaggatgaaaaactctaaaaaggaaatcttaacgctataatcgttaaaccataacaaagaaaagataggggaagagatatttaaagaaaccagggaggcaatatagggaaccctctttgaagctcatatttaaaaagaaaaaaatggcctaacataggattcggtatttgaacaatatttaatgggtatgtattatctgccagcctgctgggacagagtggtaaacaagatagacaagtaccctggcctcaggaaatctatattctagtgacaaaacacggaacatggaagtctcaagtcataagtaagctcaggttcatactcatattaaaagttcccaaaaggatttttgttttgtgaaacagtatttggaaaaagaagaggaacaaggatgccagagggaaggcagaaccactcaatggctctattttgctccagtctcttccactactgagaaatattttccaactagaaagggtgggacaaatttaaccagtttaatatgagtttaatgtcacagaacaacttaaggatcatgaacacctatttctttttacaaataatgaaaatgagaatttagaggtattaaaatgtcaggccttactatcacctgccaggggcttcagggagagaaaaagagttctcttggtgatgaaaaagaagatgcagatgcttacatgagcagaaataatgagtttgtacttcaaaaatcccctttgttctaaccacagaggataacagacacgatataaaagagaaaactgaaacaacatgctgactcaaatacagaataacatctatgtggacagacacggaaacacataaccaaacaggactgaagccacaagcatgatggcttctgatttatttttctatatgtgtcagggagtaggagtggtggctgggaactggttcctccagaagaaaggggtccaaaatgttttgcgcaagacagggaatagaatcaggctcaatgcttgaagccaggagctaggtggcgctctcttacttgtgtagggatgctagaaaaacaagcaactgtgtatttgctgactgaggctatatggcttaatggaagacaaggctggaagtgacaattctaaactatacgaagaaatcttgtattaagaaatccaacaaggccgggcgcggtggctcacgcctgtaattccagcactttgggaggccgaggcgggcggatcaccaggtcaggagatcgagaccatcctggctaacacggtgaaacttcgttatttccagtctttactaaaaatacaaaaaattagccgggcatggtggtgggcatctgtagtcccagctactcgggaggctgaggcaggagaatggcgtgaacctgggagacagagcttgcagtgagccgagatcaggccactgaattccagcctgggcgacagagcgagactccatctcaaaaaaaaaaaaaaaaaaaaaaaaagaaaagaaaaaagaaatccaacaaacttaatagctggactagagttcattccggcctaacacagattttaaaatacatatgttttaagtattcggagataaattaggaaatgacttccattttaaaaacaaacaaacatgaaactaagaataaaaaaaaaagagaactgaaacaaaatcaggtggatgtgaaaaataaccaaataaaaactatagaaatgaaaatattaaataagatgaaaaatgtactagatggggtaaactctagactagatagagaggatgagtaaactagcattcccccatattgctggtaggagtgtaacttgacacatctactgtgaaaaatggtttgcactatctactcaaagtgaagatacacataatctatggcctagaaattctactcctacagaaaggtgaatacatttacatcaggaggcatatacaaaaatgttcatagcagcatttttcataatagccaaatactgaaaacaactcgaatgtcatcaacagctgaataaatactaaacttcaataatttcatatagcaataagaagcaatgaaaaaaacagctatgtataatactgtggatgaatctcacaaacataatgttgagtgaaagaagccagatcaaaaaatacaaaaaaatacatactaagtgactcagatatgcatgcacatgctctctctctcttttcttttatatttttaatatatcaaatattaaacacatgcaaaactaaactctggtgttcagggctgcacatttaagtgttagaactacaaagaaaagtaaggaagtgattatgataaaagtcaggctgatgtttatctcagggagagggaggaagttgtgatcgtggggcaaatagaggttcttgggattggcggcgttctatgaacaagttacatgagcctttataataatttttcaagttgtacattgatatttaatgcatttttctctatgtgtcttatatttcacaatacaaaaaaggcttttatgatttgtcttgtttgttttaaagagaggatttggaaatggaaggtagatactgagaaactcaccagggacgcagcacagagaaacaaagagattaaaaaaatataaaagggcagttaagagacatggatgatgggttgaaaggttccaatattcatccaatagcaattccagaagaggatggaggtaatggtagaggagcaatatttgaagagataattgctgagaactttccagatctgaagacagacttggatccaagtacctaacaggataaataaaaataaatccaaacacaggcatatcatagtaaaactacagaacatcaatgataaagagataatgttagaaactcccagacaataaaccagattatctacaaatgaaccacatattgacagcagaggtctcatcaacatcgaaaatggccagaagggatgtgggaaaaacaattgttaatataggcttttatactcatcctcagagtgagggcaaaacaaagacaaacctaaaaagaataggcttactatcccacactaaaactaaaagaactatagaaggatgcccctcagcaaaaaaaaaaagaagaagaaaaaaaggaaaaaagtaggtgggaataaaaaaggtgtgagaccaaagaaatgatactggacacaaactaagaaaaataagtcaataaatatgatttactgtggactgcaaagaaaacaacagtaattattacatgttgaacaaaatgggggaaatgaaagctttaaacaaaataacacaattggtgatggaggcggtagaataaaatattagagttccttatcatggtcgggagattaaaaataccaaaaaatgacatacactcttagaaaaatatatggttaaacaatatcttaaaaatctgagggtatacgcaaaagaaaaaaaatcaccaaaataaaaacatagaaatgtatcttattgttcccaaatcagcagaggaagaatggaaaaagactaaaagactgaagatgggtagctatagttttaggttttaaagagcataaagactaaaattttcctatctccaacttctaagcctaacaacaattgatcaaatgaaagacaatattattaaatatatactttgtaagcatttacaaaaaaaggaattagtatgaccaagtgaaattagcatgtgtttactgataaaaagttttaccagtctagcattattccccacccttgttttttggtttggtttaatttaattttttttaaatgtttgttaattgtaaaaaaaaattaagaaaacaaagaaaaaaattctaactacaccgttaacatattagtatgcgtatgtgtgttgttgttgttgctgagaccgctaggttagcagatgaaggaagggacataagctagatgcagtgacaacaacactggacttgggagactggagcccagaactttcagacttacaaggaaggaaatggtacagcagggtggcctaggcatcaaggctttgatgtccaagcatctggatctgctacttactgttgtcaaaagttacttggccaagggactccaatttcacttttctaatctcggtttcctcacgtgtaaaacaaggggataggagggtatattgtcatatgatctagcgtctctctgagcttttacaattctaagcatctaaaagcattacataaattgaaacaaaatcataaagcatatacttgttaaatctctagatgagacaaaactgaaagagtaacagtaaagagtgaaaacgaattcagactatataggaataggctaaaatcactattatgaaattaaacaggaagaaacaaagacctgaatttagatttaacaaaaaaactacacaaatacagaacagagcagacttggtttgacaatgattcatttgaaaacgagctaggttttttagcatatgctcccagggccaataatatgaagtctaaattaatattaattattttaattaataaatattaatttaataaatattagtctaaattaatgaactctcaggctagaggagcaaaagtagtgcttatggtaggagaggcacaaatcatcctattgattgagtacaggtcagattagatgtagaatgttatattccattctggacgacatgaattgcaatgcacccaatgaagggagctcagaactataaagcatccagaaaccatgtgagatcaaggcattgggtcagtttaccctggaggaggaagacccagagaaactgaccgcagcctctaatgttggaacacttttgacaaccaatgcaggtccaatgctagaggtgttattaagaagcaactttgggtgctgtcttcagatagaagttggatggctactggtaaaggagacaggagaaggtttttcacattgggaggggagttaagaccgagtgacccctgtccctgaggcctgtcccaggtctaaggcacctgtattctaaagcactgattgtttcccatgcaagaagaaaaaaagcagaatcatattcttattatattataggtaacacttatcaagtgcatattctatgtgcctagtgttgtgctatgcactctccacagagggaaagtagagagggagagggcttgtaggattttaagttctgagaagtgttaagatacatttaatatacagactaagttttcacaaatgcttccatccatagaaaaggagctggggagaaatattatagtgtttatggggtggggaagggagaaaaatagaaataaactaatattcctcatgtgctaggcataatgactaataaaatgttttaactctaactagaagtctttaacttgtgaccaaattattatcaggcactccaaaaaatgagcctcaatgagtctgcagatcaagtgtatacttgtgcattataaggtagccatttcaaaattaattatatagaaatgcttataagaaatgtatctaattttacaaaaagaatattatttctttgactttataaataaatatttctaacactaacttaccatatcctataggcttaggctggcatattcctactataacatacaaaaatgtttgaaacaaatgtttccagtgataagtggcataaatctcctcactttcttttctatatcaaaatgttacacaaaatttatttttatgaggagacaagtgaagagagttgttctgcctatttgtgcccagggttctctttggaacactggagcattttatttataaaatcaaagaattttcaagatgaaagaaatgttagagagcacgttaatccgattaaactttagagataaaaaaaaaaaaaaccttacattgtagagctctcaagtaatatgcctaaggtgacatgattaattggcataagaactgaggaaccaatctaatcaaggtctcctgtgagtcctgacacccagatcagtttcaggttccttcaactcaatcaaatgccaagaaagcagaactttttgagtcctctgtattaagatttaccagaaaagtgttagaaaacactgtaatttttattagctttgaatgtttgtcatattatccatattgattaaaaagaacttacttccaaagcataatatactggtttgtctctgccaagtttgtaagccactgtggtgagaaggccatgatcagaaaatacacactgtaagaaagaaaaaaaaaagatttcagtagtggaaaatgaaaagataacatgagaacttttttttaaagttaaaataacataggtacaaaataatgcaatcaataaaccaatttttaaaataaatccttacagtcaaaacgatcagaattaagaacacatttaagctgtataaaaagtttattccttgtttcaaattagatttgcattaagaatttgatgaggtctcagtctagatttcccaccagcacaattaaaaacacacatataaaattcaaagagtctaaaatggttcttattagaacgattcaaattttgtattgagctctaaattaaaccctgataaagattaagtaaaagctaaagactaaaagttgtttaatagtaaattatgttcaagcattatttagatgaacttagacttttaaatcaattttttaatttaaaaaaccaaccttatggcctgtattacatagtaagaaacatcctgttccatacctatggttgaagggagaatgaatagtaagacaattttattgaaagcaaataatgaaacattaataacacaaatgatcaaaactgacatataatttagtccaaaaaagtcattatagttttataaaagttcctaaagttaacaaaaatcatatatcttcctggaataatgttttagaaatcagcctagaagaaaatgtacttagtgcaatctttttttttttttttttgagatggagtcttgctctgtcaccaggctggagtgcagtggcgcgatcttggctcattgcaacctccgcctcccgagttcaagcgattctcctgcctcagcctcccaagtagctgggactacaggcatgtgccaccacgcccagctaattttttctatttttagtagagacggggtttcaccgtgttagtcaggatggccttgatctcctgacttcgtgatccacccacctcagcctcccaaagtgctgggattacagacgtttaagccactgtgcctggccattgcaatcttaatagaaaaatgcagatatagtatttagtgtttagtcagtcctaggccagggctgtgtttataaaataccactgaattacaacaaattctaagttctgtcatagttatgttactactaatccatgtggagtgaagcatcatgactgacagccagcttagctctatcattaatacagtcataaaatgagaaacaccactaccttctggcagggtggggaggctggatacagagtgtgggagggtgtagttggaaagctaggacaagagtggcatggaacggaaggcaatttaaggtctacctttgataatcagagccagaatgtaacatggctgatacagaagaactgaatttattttgtggcagccttatcaatataaactttggattctgcagcaagtctggcccttggacattaataggtagttttgacatgtgccaggcagataagtggcccaaagtgataccagtaagggtcacagaggaacagttaagcttggggtaacaaggttgctacagtcacccttgcttggctctgcccaagctgggcattccttccccgtgggccttgctgctgtgccctgcaccaccagggttctaactgtgctggtgacattccagcaactgaaagatgggacagtgctcagtccaggagctggcagaaggatcccagaagaagctaccaccagtcagcactaactcaacagatcccatcagctgcattttgattgtgcaacaaacacaaaaccaagggaaattgttttccgacatttttccaggtaccattgttaccataaggattagcctaggatagtctatctcttctcacccaaatatattcttggcctgcttgatgagcaggtgacaaattcaaggagcatgggactaatatctaattttgtaaagatacttgtcaaataacactaggtacaggtaatacatttacaaactaaaacacaaaatcactataccgttttattgccgcacactgaaaaagctacatgtttcaagttaatctactgtgataaatattcataaaaatggaagttaattatctatttcatgctttttaaaggagaaatctgtaccaatttagcatccatataaacactatactgaacagtagcgtacgcgtcttagtgcaaaactgatgagaagactgaaggtacttaataaaagtgaattcttaagtgagtatacttaataagcaattaatgagtattagcaaatatgaagagacttctttgctatacttaggccacagcttttaaagcagtacacaggcaagtattttcctcttaaattttattgttctttcttcccagtcatcaagcacatatggagctttcagcatttacatgatctacctcgccttcctcattgtacattgtactcacagaacactgtactgtgttcaaacatagcagaaagatgtctcacttttctaacttctacaaaggtaaacgttgcttgctctccttcatgactatcagatcaggactgagcagcccagagaggtgtgacgaagatggcgcataggggcaggggggttgaccccagaggaagctgtgagggaggtaaaaaactctgtcacacccagtcagcactactggacaaatgagacagctatctcatgtgctctttcagaaaaataaaatttaatgttcaaataatttttacattctagaaaaattggaaaatacagctaagctgaaagaaaaattagaatcatccataatttcttcccccactctgaaacagagatgggcttttcattgaattctgagctgactgtcattttctccctgctgaggttgggagaaattaactaaattttcaatcccaatctctctaacctcttacttggtcttgtccatcacttatcccccatttattttacaactttcatctgttctccgctcagactccaaagaaacattctctggtcttaccataacttacaaacaaaatcaaacaaaattcccaaaatgttacataatcctgttaacctcacaaactatgtccttctctcaccattcctggatggttgtatttttgcaaagcacatgtcttcgatttcctacctgcttacatctcttttgaccatttgcaaccaggcttctatcttgagcattctagtacaacttcactcttgaaagtcacaaaacggctgggcgcggtggctcacgcctgtaatcccagcactttgggaggctgaggtgggcagatcatgaggtcaagagatcgagaccatcctggccaacatggtgaaaccccgtctctactaaaaatacaaaaattagctgggtgtggtggcgggcgcctgtagtcccagctactcggggggctgaggcaggagaactgcttgaacctgggaggcagaggttgcagtgagttgagatcatgccactgcactccagcctggtgacagagcgagactccatctcaaaaaaaaaaaaagtcaccaaacgaagacctaatttctatgtataatggtccattcttggtactcagcctccatgacctcttagtaatgttttgcgctactgaccatgcctccctcataaatatgtctaccctggatttccacactaatgaataatttcaggctaggtgcagtggctcatgcctataatcccagtagtttgggaggctgaggcaggaggattgcttgagcccaggaagttgacacagcctgggcaatatagtaagaccctatctctacaaaaaatttaaaaattagctgagtgtggtggcatgcacctgtagtatcagctactcaggaggctgagaggggaggatcacttgagcccaggaggtcaaggttgcagtatgctgggatctcactactgcactccagcctaagtgacagagcaagaccctatctcatatatatatatatatatataaaatgaataactgcattgtttttctgacttctccatccccgtgcctgctacttctacttgtgtaaatatctcctctacttgtatattttttcttggtaatttcatctacttctgttgcttcaaaatcccctctatctagggaaattctaaaatttccatcttttttttttttgaggcagtctctctgtcacccaggttggagtgcagtgatgcaatctcggctcactgcagcctccacctcccaggttcaagcaattttcatgcctcagccttctgagtagctgggattacaagcactcaccaccacacccagctaatttttgtgtttgtagtagagacagggttctgccatgatggccagactggtctcaaactcctgacttcaagtgatccacctgccttggcctcccaaagtgctggcattacaggtatgagccactgtgcctggccaaaaatttctatttttatactgaacttattccacatttccaaatgtgtgcaacatacagcctgccagcaccacaaacacgctctgaacagaaattcttccactcagaccctttccttactttggctaagcctaaccacagggtccaggtacctagatgacatacctacttcccctccctttctcctctgcagtgccatgcacattcactcatggcctccctctctgtctccatccttctgagcccatgtgctcattaccgggacactatggtggcttcctccatggcatcttggcctctagtctttcctcactttcacccaagactgctactgacaactccagtcatctctgaacaccagcttataaaccttcaaaagtttcctattgcctatcaagaaaagctccttagcctgaaatatagggcttcacaacatgatcctagctttatattttttgtcacttccctactctaatgttctctacattctctaaacaaagtcttctatttccccatacgtatctttgttcaatgttccctgtaccctccaatactgctcatttttcaaagcatctcattactaagataatcttttgtgacttttctatcctcccattgaaacccaacagctttgcttcaaagtttctcatggcacttgattccagctgcctggaacccagattccaagaatgtttccagactcaggctgactcagatgctcttggtcatgtaacctcagattaccatgacctgcaaagaattcccacatccctcctcctcaaaaaactctcacacaaataatgtcacactcttgcatgagagccactgaccctgctagactacaagaacgtttaatctagaaatgttacacattccattattcacaaaggaagaacttaaccactgaagttaaaatcgatgagataattaggaaatcctcaagaaaatagcaattaaatgtagcctcttgccagttatatggaaatcttttccatacaggaggtagtacagtacacaggttaagaaccctggctaaggaatgacatggatctgggtgcaaatattgcatctcccacttactagttgtgtgctgttgcataaatttttttctttaattctcagtttcttgatctataaaatgggaataataggatctatatgtggattaaatgatatcatgtgtttaaagcacatgaaacattataggtaacacaatagccattggctaagcttgtgttataattgttagtattaattcagcttttgaggcatatttaattttgttcatgaatacgtataattggcaggtagattttttaatatttaaaagattaccttggccaggagtggtggctcacgcctgtaatcccagcactttgggaggccaaggcgggcagatcacctgaggtcaggagtttgagaccagcctgaccaacatggagaaactccgtctctactaaaaatacaaaattagctgggcgtggtggcgcatgcctataatcccagctactcgggaggctaaggcaggagaatagcttgaacttgggaggcggaggttgcagtgagccgagatcgcgccattgcactccagcctgggcaagaagaacgaaactccatctcaaaaaaaaaaaataaataaaaataaaaagtaaaaataaataaataaataaaaagattaccttcaaataaatatagtgattggtgggaacagaaagaaagagtgccagattcagactcagaaggcatggccttgagatctggttctgcttttgtgtcaaggctatgaccttaggcaagctccttgagtatccattttcttatcctaaagtgggagtcatcttcttattactcttagatatggggcttgttccagattctgcatgtgtgagtagtaagaagatgagattgagagaaaaatataccaaatctctacttctatcattctttctgcttcttgtcaaaggagaaacttcagataatggagagaaagcacaatgccaggaaaggcgaaacttcagataatggagagaaagcacaatgccaggaaaataaccttgaaaatcccacaaaaatataactttacagttagtgagaaagacttaatatgccaaaaactatatattacagctcttcctcacttcttcccacccctctcaccaccccaccaatctccccaaaaaggcaagaatactttgaaccaaaatttagtttttaggatataaaaggtaatgaattttacaaattaaggttttgtttatttgtttgtttttgagacagagcttcactcttgttgcccaggctggcatacaatggcgtgatctcggctcaccgcaacctccacctcccgggttcaagcgattctcctgcctcagcttcccgagtagctgggattacaggcatgcaccaacacgcccggctaattttgtacttttagtagagatggggtttctccatgttggtcaggctggtctctaactcccggcctcaggtgatccacctgtctcggccactcaaagtgctgggattacaggcgtgagccaccgcgcccagcctacaaatttaggtctttataagcttcatcagtgtgcatatatatggcattttgtattttatttaaagatataaaaaaatggtaaaaagtgtatatatgcatattggagctattaagctattgattttcatcctggatgaacttcaaaagcttttccttattcaaagcaccaagtagaaaaaacaaaacagcattggtttttaagtctgtttcttaaactcacgtatttttggcttgtccaatctggaagcacatttgtcccaccaatgcagcagactggtcccctaaacactgaaagtataaatgacaataaagaacactgactaatacaatagtattaactttctttttagaagagccataggatttttcattttttatttatcaaagaatgaactgtctatttccttgcattttctccatttggccattttccccatttgttaataccatttgttaatatgtaagataataggtatgggaagggagagttaaaattaatttattcaaaagattctcaatggcccacagtatgacatgtaagaacaagaattagccaattttgcaacttttacttgttttccctagtttaaaaagaggcacactgatgaactaagaggaggaaagccataacatggggaagggtggggatggggagacacttggtgatgaaacttaccccagatattggcacaccttccaaggccccagctttctaataaaatttaaaaaaaggattatgaatagtcacaaaattttggctctactaacatagctgcaacaagagtgaacacaagtagcaatgtgccagaggatgtgggcagacaagacaaagaaagcatttcaactaaatgaatgataaagagacagatactacaagtattcctagaatgacaggaagagatgtggcactggagaatgaacataaaacgttagactgggagccagtaaatgagggctctactcttggttagttagttagtattaatctactagcaggctgttgaaacctctcaatacatcacattatttctctacaaaatggagattgggctacgtgattgctcaagttcattagtactttgctattattgccattattaagaaatgactaatatattcttccaata

SEQ ID NO: 5564 - DNA, 144747 bp, human; identical to SEQ ID NO: 4452

SEQ ID NO: 5565 - DNA, 144747 bp, human; identical to SEQ ID NO: 4452

SEQ ID NO: 5566 - DNA, 1297366 bp, human; identical to SEQ ID NO: 4457

SEQ ID NO: 5567 - DNA, 1297366 bp, human; identical to SEQ ID NO: 4457

SEQ ID NO: 5568 - DNA, 1297366 bp, human; identical to SEQ ID NO: 4457

SEQ ID NO: 5569 - DNA, 1297518 bp, human; identical to SEQ ID NO: 4460

SEQ ID NO: 5570 - DNA, 1297518 bp, human; identical to SEQ ID NO: 4460

SEQ ID NO: 5571 - DNA, 1297518 bp, human; identical to SEQ ID NO: 4460

SEQ ID NO: 5572 - DNA, 1905516 bp, human; identical to SEQ ID NO: 4468

SEQ ID NO: 5573 - DNA, 1905516 bp, human; identical to SEQ ID NO: 4468

SEQ ID NO: 5574 - DNA, 1905516 bp, human; identical to SEQ ID NO: 4468

SEQ ID NO: 5575 - DNA, 1905516 bp, human; identical to SEQ ID NO: 4468

SEQ ID NO: 5576 - DNA, 147733 bp, human
agtgctttcagctgtgagcttgggcggcggcggcggcggcgctccactttcggggagcccggcggctctgggaagctcactcctccactcgtacccacactcgaccgcggagcccttgcagccatgagggaacagctcaaagggtaagtggatcgcggccccggccccgtctgatggccgcaatccgtgcacttgtggcgcgagcagggggcaagctgaggcggtcaaaacttggacaggcgcggcggctggacccggggcgccgggcggctgggcgtctaggaacctctcccgcgggttcccgcggcgcggctgcaggtgcgcccccggggtttctccccaggcgccgggctagtgggggaacctcttccctcggctttgggacgggctcggagagaaaaagctgatttctccccgtccccagaggggataacgcgttcctcacgcggggattggggccgggggagcttttcactcctttccaggctgccagtgtggacgtgagcaaggctggctgttcctaaatcgtcgctcttactcgtagaaggaaggggcgcacgcggcgctaccttccattgcactgcaagtgccaaaaggtcaactttctgcctgatttcttccgaggattccaactgacatttccctcgctgcattttctaccgtgctcattccatgccccaagacctgcagaaatcaggaaagaaagaacaaacaactaaagcccagaagtcaaagatttcagggggtggggatttttgtttgtttgggcttttttttttttttttttttttttgcccttcgggattgggtgtggagtcatttctagggtgttctctcgcatttctccaggtgtctgtgctcatcttcaagcaaagtttgtcactcccaatcccagcacggcaataaaaagggcagaacactttgcttatattagtcaaatttgaagttaagtttgaagctttaaattgaaggggtttagttgctcgagggaggcataatattaattataaactgtttttacatcatgaaaaaaatccatccgatttaagtggtgaacttttaagtggcgtctttaagtgaaatctacatttttccttgggcaataaactcttcttggtcttctgctttatccctgtcatctctccttgtcacccaccccccccccccccacacccccaatcaacctttctttttttgcctagcttttttattgccttttactcaagcccctctttggaggatacatttgctgttggagaagcgagtggagcaaatgaagcaacacggttatatgaaaggtctctgacccttgaacaccgtggaattggtttcagtcatcattgtttgatctccgattggacacgaccctgaaaagaaattgctttgaccaaagttgagggtgggtaggagttaaaccttgaaaagcaaataaaacggaggacaactaacagctggaacagccaccgaggcaatcatctttgccctggctttagccagacagaataaaatggtaaatatcccagggaacaagaaatggggaactagaatggatttctgatgcttatattgatgcccacccctccaaacccctgccccacggtagcagaaactttaaaatatattttaccatccacaccctgccagtattccagcaatgcaagccaagttcaacaattcagcacgcaaatgccaaggttcctctagaaaaagagtctgatcctcagattaaagggaaatcatttgtgtgtgtggatcaatgggctccagattatatatgaaaccaaactctaatcctctgcaaatcgcaagagaacgctccctttttatattgctgcatagcgattagttttctccctgggaagtagtggacagatagttttttaaaaaggcaactgtttggaatattttcagtaccaaataacaatggtggcagaagaaatcttattttaattaggcaactgccattttcccagccacagcagtagatatttgttactttttataagtgtttaatgtttgtttttaagaaactaaaaaagcaattccaataagtctgattattccagcactgacagcaggaacagctctgaggcagttataataaccttgcacactacttgaaactaaagcaggtgagagaaaatttaaattgtatggtaggaaattaggtcagccttgtgctcagtagagtaatgctttaatttcttattattgacaagtaggtgttgctggggtcttttgtcatagtcgatgactttatattttaatttgcatcagggtcctatcaccgcctcaaataaaagggaaaaagattatcatggtttgtagaaagaagaaggagaggggaaatcttcgtataaatactgctcagagaggcatatctgatgccaggctttggaaccagcagggccaaaatcaataacattttttaaagatgtaaagagcgttttaaggattatttatgaagctgatctctgtgttaatgtacgtacagacttgtgatctatgttgaacattgttgttctcagaaaggccaaacaaagatgtacccattaacatgtgaacaggtttcagaatttcccttttggttgttcatggtatatggggagtgtatttccgatgtggagagtgaaatgcagaaaagagacaattaccaaaacagtgccacccacccttccactccctcctccctagcacaccgtgtttttctatatcgtctgcatattccaggtaaatgtgggctcttctcatggagttactgagaattctctactgttttagaaggcaggcacagagtaagaaacgaagctgtaaaatcggtattgatcacagacaaaaatgtggtttgtccttcaaggtacaagatagatatgagttatgcagatttgtgcttacagtttcatccagtccatattcatagttcctatctattttggagggttaaatgtgtcccagtggggctctggattcatcacaggtagaaaataacaagccgtgaagtgaatatttggttcgtcatatagttaccaaagaatctgaaggttttttggctacgttgccaagcatttttagcattaaatgattaaaagactatttttctcgttttaagaattagtcacaccctttattcttttcttctttccacttgtgctcacttcttttgcttagaactgatttgcaattgaagtgaaactaagactgcaaaggtgaaatctaaatctgtttttctagttcttttgcattgcttagaaataaaaggtttgtgtgttgaaggtgagaaaggttagcttctggaattgtttgaggagttcatttatctatgttattcaagtcccccagaatcacagataactgggagaatagtacctatcaaggactagtatcttaactcacaaatgggcaatggaattgggggcttagaatttcctccttcttccagtaaaggagattttcagttttgccgaggactgatggattaaaaaaaaataatttctaaaacccttttcataattttaaccttcaaaataaattctttaaaaaggcaggaatgtatgtatgccaacagtcatgaaatttctttagaagatggggagctccatgaagccctcattcattctatgtgggattctcctgtaaattgtacacactgtttccctttccttttagaactgtgtttggtacaggtttatttcttgcctatgttcctctaatttgaagtccattccagatggtggcttttcaccgtggttccctgtctctgtctgatcaggcttatcagctcagctaaatgtttttctgcagacctatagaagatgctacggtccttacaaatatcctggagatgggacattgttgttacacagtgtgactagtaagggcctgtgtgagcccttgtacatgtgggcacacatgtgtgtgcttcctctcttcgctcttcctttctccctggtgcttatatcacatctggatgacctttggaaatagaggaggcctgaatgcagggtggtctcaatagaaggtaacctttccttgctctgcacttatatatggaattggtatacactcactttccgagctgagaaatgcctgagaacaagcaacactttttccacgaagctgcaagctgcagcctccttgtgctgtgcatgtaaagtaccagtcctgcctaccccttctccagatcataaaccggcttggtcatggggtgtcctaaaaccccttaaagcatagagaccatatctcctgctcttcttgctctttaagacttgaatgtcactctgttatattccctcaactgataagcccttgttatagtcctcaaatgtgagttgtctctatggaaaagtaaaactgaaataaacgtatttggaagacagtgaaacagcacttcacaagtgaacattttcttgcaaattgatttcagtagccctcactgttcaatcactgactagtaaatattacagggatggtctttgaagttgtacagtttggatgatttccatatgtctttatgaggtttatgattgtgttccatttcttaaaccaacttaaacggttgttttaacttattttttttaaacataggtgataacatgtagtgtgttggttttgctctctaggaagggtctttcttcgccttgattgacttaattacagttggatccacatctatattgtaatcaactaataacagatttgcttttaatagatgacaatttgaggggcacatgataccaaaagcgaccacatattgagcaccaaatggtgccggtcacttacctatttcaactaatcctttaaccctccaaggtaggcaggcttgctttaaatttcaccgccagtagggcgcagagccctaaaattcaaaacatacgctaaggccattcgacattgttgcctctccagactcctctttctgtgtgaggcccctgtactttctggtcctctggaaatgccccagtttaagcgatttctcttttttccttccctccccttcccctcaaaagtttatgaataggctctgcatatgagtacccaaatatcattcagaactgcattttactgtatcaaagcctgtcatgcaatccctgaaaactggaaatatgacgctatggtgatttatgtagatgggccaaagtaaggaaaagtatatgtagttatttctccagggtttattcatgtaattgaatgaggaacaaaggtgttttgttctttttgtggcaggagctgatagccagcaaccacacttcaagaaatggaagacagctgtgaatgcttcattcaggcccaagtaaatataggaagaggtgtagtggtgtatagcgtactgcgtttaaagaaaaaacactctgaaataatgggaagaaggaagttatgatatattagtcaggcagtagatataccttaagctgaaatgaaatacaggtatcatggatatgagatctgtatatgtagaggaaagagtaatggaaaaatgtcaggggcagtgaaagcaaatgagaagtgagatgatttatatttattgaactaatgtccggtatctctttgacagagttgaataataatcagttgtcggtgtcctttctgtagtgttccacattggatgggtgaagaagtcctgatagtcgattattgatcacataacaaggtcaatttatcataactgaagtgcgatcgatttgtgggtgcaaagaagaaacaaattctggaaccgaataatgtttatattgcttttctctttggaaacaaagcagaaaggggcctttctgcttgtaagataaacatttcttcaatacactatggaagcgctttgaaataaagattccgaatggttcaaaagcaaaaatcatgttgttgttattgttgttttcttttttcctgttttcttgactactcattgtaaatgctaaagtctttctttatgttttgtgttttagccacgagactcaaacaacttgctgggaccatcccaaaatgacagagctctaccagtctttaggtaaggacatggccatgtttcctccaagttaaatgacaggtgacctttaggataaagtagtttgcagtgtgaaagttacttgctatataaatacatcactagattgtttcaagggtgaaagcagtggcaccttcctatccaaaattgacagtcagctttctttttatcagaggttccttaaaaacaagttttagaagttgattgattcctaaaaattcaatatacctgagagggcctataggtctttgtagttctctttggtgcctaaaatgatggaaaaacagttgcaatttatggctatttttttttttcttcccacgaagatagaaaactgtttcaggtgcttgttgatttcttccgtgtgaaaccaagacaacccttttgccaaaccacaaatgttgtgtaaaggaattttctgccgtctttccggtgctcacaattcctaaggcctggcgggtcattaatgtgaacatttaaatgatttctttagtatggcttgttttgtgtttatgtaagagcctgacagttctgttttctttcccctcataacttgaattattttgaatgggtacagagcatacaaataagggtttgaaaacaccagtctttttacactggacaaatgtccagatgtctggtttgtcgttttagatctacaaggaatattctgaaatgagttatcttaagttgcagcttgttttgggttttgttttgggacagggtcttgctctgtctcccaggctggagtgcagtggtgcggttatagcttattgcagcctcgaacccctgggctcatggcggttcttctgcctcagcctcctgagtagctgggacaacaggaatgcaccaccacacccagctcatttttaaaatttatttttatttatttttgtagagatgggtctcactatgttgcccaggctgtgtttttatgtatttttttaatataaaaacgtcatgtcttttctactttttcaagcctgcatttctgtgaatggacatattgatagaaaaacacataaggcgatctctttggatttaaggttatgtgatgaacactgtgggaatcagggtacttaaacataaattctgtgtaggtatacgtaagtggggtgtgtgtgtgtcagggggtacgtagctattactgcttttgtgtcatagattctcacaaaatgaattgcagctatagagacaccaaggactagagaagagatattagccaaaaaatggttttattaaacatttttctaattataaatgattaaatgtcttctagaaaacctgaaaaatgtaaataaaaaacatgaaaaaggaaaaacaaagtcacttatactagccagagagatccaatacatttcgagtaatattatgtcatttcagtctggttataagtgtgtaaacgtttaaaattttaaataaaattgggatcagctaattttcaagtgctacatttccagcccctacagaatgtttttggcttataattgtggactgtttataccacaggtggaaaacgtgaatgcttatcttttggcaaatgagagaatgaaaaggcttcatctgaagtgggcagcagctgtcctgggcaagctggtctttctatcccagtactcccaggacccctgattgtacaagagaaaaactagaaatctgtccacaaagagctaatttaaattagtctgtgggcctcctgatcgtaacctgtggtttacacagatttagcccacttctaacatttcctactctaattacagtaatttctagttgtaatattttaattcactcttattttaaaatcattattattatagaattaatacctattcatatttttgaagtttaaaaatatagacaggctaacaataaagaagagacaaatcattcgtaaccccacttcttagagttagctggtgtttaatagtctaggatcttcaaaaatgtctttctatacatatatttttatagaagttgaatcattctgtcttataacttgctttttttttttccactggaaagtaatgtattaccatggccatatttccattttgttgtatagtattctctaccactttcaattactctgtaatgagaaattgcaaacatgtttgatgaaaagctaattatggactatcaatgaatacatgtttgctcctttaatacaaattaaatatacatttaatcattatatttctaaaattttctccatactttagatgtggtgataaactcaaaactgataatctctcatgacttgtgacattgggcttgtgacatcactcaattttgaattataacagaattttacagttgcaggggattttagaactcatttattgcaaactttctcttttatgaaatcaactttcaggtataatttttatataataaaaggaagtcatcgtaagtgtgtgatcaattccagccccctttgaaattctgtttcttgctagcccaataacaaaccacttgcaagtgaactaagtgttgaagtttgcttttcacctttcagagttaatatttccaatagttttgtaacaatcaaacattcgttgggcttttatccaagtggtgattcatcagataacatctcccatttattgcgggcctattgtatgttttccacatgggatgtgccagcaaccaacctgcatggtggatggtatcaacatccacatttcacaggacagcgaagccaggctcagggaggaattgatcagggctacacagctatgtggggctacacctggatttgtcctcagttttctgttagtactttcactgttctcattgattttatttactaggtaaagtatatttatgttggttactacatacctgctacacgtatataggaattgatagttttacctatgaatagtaagttacttgagtggtatttctggaaatggtatggtgggtcctaaacaatgggcactcctttcactgttgcctggcacatatagaatgattgttatatggctacatccttttttgtttgtttgttttttgagacagattctcactctgtcacccaggctggaatgcagtggcacgatcttggctcacggcaacctccgcctccccaggatgaagtgattctcctgcttcagcctcccgagtagctgggattactaggcacccgccaccatacccagctaatttttgtatttttactagggacggggttttgccatgttggctaggctggtctcgaactcctgacctcaggtgatcctcccaccttggcctcccaaattgttaggattacaagcgtaagccacagcgcccagcctgcctacatccttgagatcccatataagattaactaccagcactgcctttccccctctccaaaattacagtgtttcagagtcgaaacataagcataaaatactgaaaagaaacttttcattgattttagtttttacttattagtttatatttttcttcttcaagaggtatccctttaggtccaaattgctctttgagctggatgaaatggtcggaagccttcaactacagtcagttggtgaaaggtatcttgaaagcagaaatggtgttgtggtctggcgtgtcaaatgtttaagaccacatctagccccctctcctaatcgaacctgaacctcatgtctctggtgaggtgctgaaaatatcaagatgttgctttttccctctgtacccccactccaggcatactctaccgtggaagctacagtggttcacagtatgcatggtaggttacacattcctagagacgcccacttctaaggagatttccattctctaatttgccaaagttcccaagcagcctgttcaacacatgtttatgttacctgccttgccctcaaaagcattcaggtgttcccctgcacccagggtttgaacacaataggattagaaggtgaaaacattttgttagaactgaaaaagtagcaagtatttactgatgaaaagctataatattgcttgagatattaccattggagctctctaatacattctgggtggttttctttttcattccttttccactgattttctacaatgaatttatattatttacagttagatgtttggtaaaaaagtttcttcgtcgatacccccattccatttcttacttagtgtctctatagctacaattcattaactaatgagaacttatgacagaaaagcagcagtagccacacacacacacacacacacacacacacacgccccacatatatgtagataatttatacttaaggaccctgattctcatggactttgtcaggtaactttaaactcaaagagatcatctcatgtatttttagtctgtatgtccagttgtgaaaaatgcagatgtagacattttagtggtagagaaaatagaacttttttgattaaaaaatagataaaaaacaatataagataattaattttagattatttccaacagatctaaaatggctttgcagaggaggtttccatcaagtgttagaaatattgtgtttccctcatttatcggctgtgtacctacacaaaaaattgagagaaaatattgccagagtcctacacaaacaaagcaagacatagtaaagaaataatttaaaggttcactatgatgactgaacagtcattaggaatttgagtccccagaaaattttttacatcacattaatggtttgacaaaagcattgtcttggattttcacagggaataaatcactaaaagcaactggaaatcagttttctttcagcatttgtctgtgactacccccaatagtcatagaatggtagtagagaatagtagtggagtaagtgggatataagagaccaagtgtctcatgtctattttttgtagaccttggtgctttatctttaaaatgtgaggatattggggctgggcacggtggctcacgcctgtaatcccagcactttgggaggtcgaggtgggcggatcacctgagtcaggagatcaagaccttcctggctaacatggtgaaaccccatctttactaaaaaaacaaaaaattagccaggtgtggtggcacatgcctgtaatcccagctactcaagaggccgaggctgaagaatcacttgaacccaggagtcggaggttgcaatgagctgagatcacgctgtagcactccctcctgggcaacaagagtgaaactccatctcaaaaaaaaaaaaaaaaaaaaaaagtaacgatattggacaagtgtctaagatttttgtttttcttttactttgggctgagggtggggcaggctgtttctaaacttgctgtgatcattatttttcaagaggtacctttcggctaactctgcagacaagtggatttctaaaaatgtaatcattcctatgttttaaaatgtacattctgagaaaacaaacaacaggagaagattatgccacccatccgtgtcttacaggctgagtgaggcaagctgttgtcaaatagagaggctcttgagatatttcccattagactcctctgggtcattcatttgttattgagagggtacattcttcgtcactccctagaagtaataatatgtttgattcatgaggtgagttttagatttctattagcatttttacaaatgtaatggaaagactgttccaataggttagcttggtgatttaaaactctgagctcttcaaggctccagaaagcatttacaacatcagtagatgttagatagtaatatgctctggaatttattttgaaatactaatataatattgatttacatgaagtgcaattatgtggttaaaagcctgtccttttctcacaatttatgtctaggtccctaagttcattactgaaattttaagaaaatattttttaaaaagctcaccctgcccccacacacataatatatgctgcttagagatacttttattggggtttttttttttttttttgacagcatcttgctctgtcacatagactggagtgcagtggcctgatcatggctcactgcagctttgaacacccaggctcaagtgaccctcccacctcagccttccaagtagctgggactatagccgtgtgccaccgtgtctggctaatctttttttaaattttttgtagagatggaggtcttaccatgttgcccagcctggtctcaaactcttgggctcaagcgatcctcccaccttggcctcccacagctctgagatcccaagggtgagccactgcacctggccttcacaatttccaatgtcaaatcttactacaaatttaagtaatcaagagtatttacatatggacagatatactgaccaacagagtagaatttaggctgggcacagtggctcacatttgtaatcctagcacttttggaggccgaggcgagcagctcacttgagctcaggagttcaagaccagcctgggcaacgtggtgaaaccccgtctccccatctctacaaaaaatacaaaaattagccgagcatggtggcatgtgcctgtagtcccagatactcaggaggctgaggtgggagggtcgcttgagcccgggaggacgagactgcagtgagccgaggttacatcactgcactccagcctgggcaacagaacgagaccctgtttaaaaacattatttcttagcctgtcttattgggggggggtctcttaattataaatacaataaaatatgtggttccccaatggttcctttttaaattacaatgtgagtttttttgcatttgtgatactgtcagtatagtacaagaagaccagtttatgaaggagacatgtaggtaaaaataggataatgtgaagagagaatcgctgcacttcagaaagctgattttatttcaagcagtttattaaaatctagatgcaccgtatgttctggtgttacttattccaatttccttttccttcattgaagccctcttaaccacaagtgttttctcaaggggtactggttttccttttcttaagttatagcgttcttcagaaggatctagccctttttaatctgttgcccaatttttggatcctactatccagcatgatgctcacctgaatgatgcgaaagctctcaattttcaaaaatggacttctgagtgtttttggaattcttaggaaaagtggtctttaaaaaccataagatttgaaggcagtctatcagcacgtagcccttagcttcatgtctatggtttgcagagagcttcagaatgttaaaatgagggtttaattttagggtctgctgggcctgaggttaggggtgtgattcttcagcagttctagttaggagaactagttaagtcctagttaagtcaatggggctaaaagctttttaaagatacatcaatatcattataaatcagcaatttgcaagagagttaaaaacactgctatcaaaatccttgtacctctttcctcagcttgcccaagaggaagggatattgtagttatttgttcactctcctcttttgataggctttctacattccattaagtattccctcctgaggatgctcttgggttagaaactgcaggattctgaatgactatgaattccttccttttgcattaggagcttgtcctaatgcttttctcagcatattttgtgaactaaactgttctccactaagctactcaatatttagctttccttggctcttgcttctagttccttaatatattgctcagtgttaaaacctctgccttttgactttttactgccataacgctttgaactggaaaggatagctagattcagatgccagctttggtgtgacctcgggcaagtcccttgctttctattggtcttcattttcttatatgtcatgttggccagtgatctttcatcattaaatgactggttttgttttaacccctggctagagtaaagcttggttgtatgaatgttgtcagccctaaacccccagttcctctttgtcaccaccaacctaaaggatatgaataataggataatcatatttattaatttaattttttttttttgagacggagtctcactctgtcgccaggctggagtgcagttgcacgatctcatctcactgcaacctccaccgcccgcgttcaagcgattctcctgcctcagcagcctcccgccaccatgctcagctaatttttgtatttttagtagagacggggtttcaccatgttggccaggatggtctcgatctcttgacctcatgatccacccgcctcggcctcccagagtgctgagattacaggcgtgagccaccgctcctagcctataatcatatttgtaataattgtactttatttgtgtagcactttacaatggcgaagagttttcagaaataaccatatttaatcctcacacagctatagagtaggtggcatatgacctggattttctatcaatttcagtttcagattttttgtcctgtcatccctttgagtgtccttccagtttttgatttgggaaataatgctaccataccggtggatggggcaacttttcccttctttccatttggacttgagcagactgagactcaagacttgatttgatttatactcactatggtagaagataaggaaccaagtccagaacacacattttacaaactccgagttctctgttctcaaaggaacatccattactcttagcatgatttataaaactgctttatcggcataattaaactggaatccatatgacattctttattccctagctgacaaaattagcacaggagatttactcaaatttgttattaaggctgttataaatgttcttcctttactattcagcttataaaagaaaaaagaaaaataatctgctcttttaactttgattaggatccattgactttccccatttgtaaaatagaaatgtaacttccaaatcaaaatttatggcattttaatggactgttctaaatattataatattttttcttgttcaaataacttgatttaaagcttctaattgaagaacataatagatatttctgaattgcatctctccaagcttatttcagaaggaaactcaaaaagaattgttccttagactttgactggtttacagttttaaaagagctgccaaattgtagtttactgatctaaataagaggaacattaaggttacacctgcagctagaagaaaagtgctggatatgtacaattttatgtagctggatctgcagaagatgatttttgcacacagagtaaaggcatctaaaaacgtgtctgctcttattcagacatttccaatatttcttttttaagcccacaagtctgattacctctgtatgtctcttgggagctgcaattttgctggaaagagattcagaacagtcagagcactcacataaaatagatagtttttaaagtctgtaccctctacggtagtaataaaatgacctaaaaatattctgaaagtctctcttatgacatagtggatgaatcattagcttatttatgaattggtgatattctgtgggaatgtttcaaaatttgctattccacaaagcgttcatcgcttgcataactccaggaaagtcattacaccccctcataaatagaagcttatataacggagacaaatgttgcttatattgatatatttacatacagatttctttaccaagcattaattttggtaagaaagtgattgtttttatattttactttcttggtctgtaaagaggctatcactttaaggccaggcatggtggcacgcacctgtagtcccagcgcttccagaggctgaggcagaaggatcccttgagcccaggaatttgagtccagcctgggcaatatagcaagacgttgtcttagaaaaaaaaaaaaagaagctatcactgaagagcagtgcttctcaaactggtgaagggccaggtttttgttggtggtgggtttttttttttgtttttttgagacagagtcttgctctgttgccaggctggagtgcagtggtgcgattttagctcactgcaaactctgcctcccgggttcaagcgattttcctgcctcagcctcccgagtagctgggattacaggtgtgcaccaccacacccagctaatttttgcatttttagtagagacggggtttcaccatgttggctaggatggtctcgatctcttgacctcatgatctgccagcctccgcctcccaaactgctgggattacaggcgtgaaccactgcacccagccgcggtggtggtttttaacatactacacatcacagatttttaggtggtgctaatgaaactgacaagtatgcattcacaccacatgtaactcaacagtcaagttcaacaacacttgacctcgtctgtaccctgctccatgagatgaattcattgatcatgaatttggatgtcatggcaatgtcaaattgctatagaagttacttaacacactgtccatatctatgcttgtgaaagaccatattttgagtagcactgttctagagcacttaatttttgaaagtataaatgtaaactcaaatcaagtgactcaggtcgggggaggataattaaccaaacaggaacacctgaaaatgttatttatgcggtttaatgttttgccagttgagtcaagttcaggcagaggagggatctattttctttcccacttggtagctctccttagcaattgttttagaagacaaagcatagaaatcattgtgttacaggaaggaaccagagattaagcggcagagccactgctgcctagtttaatgtctctcgcaccccctataattaaatataatgtatataatgtgataagtttaaaatacaggtttgcttttatctagaatataaactgtgatatatgcactctttatggggtgcattcagtgggggaactaattgattatactgtgactttcctattgtcactttatgagtttaggtttggaggcaatgttttgcagcaacaaaattgttcattgactttgaggctggatttaaattctgattctgtcaccagttctctgtggtcaaaaaggaagccactaataattttaaacctcagttatgtgatgtattaaatagttatgatgagacttatcttgtgttgtgaggattagaatgacatatgtaaggtaacagaatgtctgatgtagtaactgctcaaggaattataattgctattagtgatatgcattattattattagttattattatcatataccagtgtctctccttatttaataatctattgggttcctgaattgagataccaagaattcagatagtgagagacacctaggtttaggtcttcacatttgacactcaaggagccactaaatttttctgaagtattttacttcttaaccaaggtgataaagatcacctgatcacaatttatcctaacttttggaaagcatacacgtactttaatttgacatgcaaattaaaataatacattttgtactgtgttgtttgccctcccccaattctaaaataatatatcattcaggataaaaaagactacactttgggaggccgaggcaggtggatcacctgaggtcaggagttcgagaccagcctgggcaacacggtgaaaccccatctctactaaaataaaaatttaaaaaagccagaagtggtggcgtctgcctgtagtaccagatactcgggaagctgaggcaggagaattgcttgaacctgggaggcacgggttgcagtgagccaagatcgcaccactgcacttcagcctgggcaacagagtgagactctgtctcaaaaaagagcataaatatctaataaatgatggtggtactagtctgtggtagtggaggtatcacagaatggctgtagagatgaggagggctaaaactgtgaaaagccttatatggtatgttgaaggttttttatactaaggtttttgatttggaagatgtatcaatcagggtctgcctggtcagaaaacataaaccctctagttatttcaaacaaagggaatttaatgcgggaaattggttactcaagaatggaagtgctgagaagccacacacacagcatgaagtttctgttatacctagggctggagggacaatgacaagaggtggtatcaccagagccccagatgtcatgggcatcaaggcggagttggaacctttggccagctgggaccaatgagggaggggctccgagggagctggagccaggaaggagacacagttagccagacctattgccggaggtagaatgaaaaaggaagtacgcccggcttctcctttccgcctgccctctaggcttctgccagtgactcctattggccaaacttacttggaagccaattggtaagggagcaggaaaatgtactgtaataaacagcagagcagagaaaaggcagagaaagtatcaaaaaccaacaagcaaatgattgaagtacaggagatcccatggacagtaaggcaaccaaccctctatgcagatatttcgggaacaagaaacataaaaaaactaaaaagctttcataggagtttgaggtgacatagataagataccagaaggacatcctgggttcaaaggaaactgatcttaaaggagaggaggtagcaattaaaacaaattatctgcagagaagtccaaacactaaggataagcttccatgcatttgatgaaagtacttgcgacgtttacaggtgtttatgctcatgactctcaagactaaatacagacataccttggagattttgcaggttcagttccagaacacttcagtaaagcaaatatcacaataaagtaagtcacacaagtgttttggttttctagtacatataagttatgtttactctataatgtagtctagtaagtgtgcaacagcattatgtcttaaaaaacaatgtacataccttaatttaaaatactttattgttaaaaaagctaacgatcacctgagccttcagccagtaatgatccttttgctggtggagggtcttgcctcgatgttgatggctgcacagcatggtggttgctgaaggttggggtggctgtggcaatttcttaaaataagacaacaatgaagactgccactcagttgactcttccttttgtgaaagatttctctgtagaatgtgatactatctcatgaaaccacttactttgctcatccataagtagcaactccctatccattaaagtttgatcatgaaattgcagcaattcagccatatcttcacgccccacttgtgatttcaattttcttcctgtttccactacatctgcagttacatcctccactgaagtcttgaacccctgacagtcatccatgagggttggaatcaacgtcttccaaactcctggtaatgttgatattttgacgacctcctatcaatcacaaatgttcttaatggcatcaagaatcacttccagagattttttttttttttttttttgagacacagtcttgctatgttgtccaggctggagtgcagtggcgtgatctaggctcactgcaacctctgccttcctgggttcaagtgattcttctgcctcagcttcccgagtagctgggactacaggcgtgtgccactacgcccggctaatttttgtatttttagtagagacggggtttcaccattttggccaggctggtctcaaactcctgacctcatgatccacctgcctcggcctcccaaagtgctgggattacagccgtgagccaccacacctgacttccagagattttccatttactttgcccagatccatcagaggaatcactgtctatgtcaagctatagccttacaaaatatttctcaactaataagagttgaaagtcacaattttttcttaatccttgggctacagaatggatgttgtgtaagcgggcatgaaaacgtgaatctctttgtacatctccatccaagcttttgggtgacaaggtgcattgtcagtgagcagttatattttgaaaggaaacctattttgaacactaggtcttacagtgagcttgaaatattcagtaaaccatgccgtaaacagatacgctgtcatccaagctttgtttttccatttatacagcacaggcaaagtagatttcacataattccttttttttttttccttccaagacggagtcttgctctgtcacccaggctggagtgcagtggtacgatcttggctcactgcaacctccacctcccgggttcaagcaattctcctgcctcagcctcctgagtagctgggattacaggcgtctgccaccacacctggttaatttttgtatttttagtggagacggggtttcaccatgttggccaggctggtctccaactcctgacctcgtgatctgcccgcctcagcctcccaaagtgctgggattacaggcatgagccactgtgcccggcctgatttcacataattcttaagggccctgtgatttcagaatggtagatgagcattggcttcaacttagtcaccagctgcattaggccctactaagagatacagcctgtccattgaagctttgaaggcagtcattgatttctcctctagagctatgaaagtcctagatagtatcacctttaaatagaaggctgtttcatctatgttgaaaatctgttgttcgttgtagccaccttcatccatgaccttagcttcatctggaaaacttggctgcagcttctgcatcaatgcttgctgcttcatcttgcaccttaatgttatggatatggcttgtttccttaagcttcttgaagcaacctctactagcttccaacttttcttctgcagcttcctcatctcttttagccttcatagaattgaagggagttaaggttttgctctggattaggctttggcttaaagaaatgttgtggctagtttgatcttctattcagagcactcaaactttctccatatcaggaataaggctgttttactttcttatcatttgtgtgctcgcagggtagtacttttaatttccttcattaacttttcctttgcattcacaacttgactgtttggcatgagaggcctagctttcagtctgtctcatctttcaacatgctttcctcactaagctcaatcattaatagcttctgatgtaaagtgacagaggtatggctctttcttcccttgaacacttagaggccattgtagggttattaattaccctgattttaatattgttgtgtctcagaacaggaaggccagaggagagggaaagagatgggggaacagctggtcggtggagcagtcagaacacgtatgacgttgatcaattaagtttgccatcttatgtgggtgtggttagttgcaccccaaaacaatttcagtagtaacatcaacgattactgatcacgattcaccataatagatataaaaataatgacaaatttgaaatattgagggaattttcaaaacgagacacagacccaaagtgagcacatgctgctggaaaaatgtccatagacatgctcaacacaggattgccacaaaccttcagtttgtaaacaatgcaattttcacaaagtgcaatacagcaaagtgcaatttaatgagatgagcctgtaatgagcctctttaaagcaggaactgtcttcctcatctttgtcaccagtgcctggtgcatggtagcctctgaaaaaataattgttcattgaatgaagcacagtagagcaagggagagtgattttgctcgggaggaaaacaaataccactcaagaagatggaaagatacagatgagggttttctaaggcggattattaaactggcaagatggaactctggagagatggagttctttccagaaagtagaagataaagcctcaaagtaattaaaatagggaatatcagttaagttgtagattttattggcaatttgttatcttagcaaaaccaagtgaactgctattctggaattaattttgccctaaaaggaataattaattgataaggagaaataagacccgtaaaaagtgtcactatggattcagaatttatatgacaaagaaaggaaacactgaacacaatttgatgtgctgatggcctcgttcgttcattggtttcctgcttcagtaaacatttaagagcgtgccatgtattttcaaactttagggcaacaggctaaaaatatcaaggagaaaaacgtttactgagggtatagaagtttttatgatcttacttttattgaacattaaaacatggatgttcattctagaaattttagaaggtgaagtgcaaaaacaaaatgaaaatcacctcacatctcagtacccagaaatagccactatttacattttaaaagattgcttccggtcttctttcctatgcatttttatatagttgtttgagataatagaatgtttaaagtgttgtatcctactgtaatcataagtcttctcttattcttagttcctcagagatgttatttttcgctagttgcagtttattggggtaccacttttgtaaaaaaatatttcccaatttttgaaaattgtgacaaagaaaagtcaaattcgtgttgaatttatggaaggaaatctttaagaatctggaggcttattactaacaagcttctgagaagaaagccaagtaaagtgttataataccttctgtccaacaagctacttatgtataagtgatgttacagaataaagtcagtgtggtcaaaaacagacagtcagttatcagaaagttgataagtaacatttatcctatgaaaaatatagctatgaatttaaatcaatagttttctaccacaaatatcttaatggataaaattttctttaccaaatatgtatggtgtcaaggtgacaaggcaagtatccttgtaaactttccgaattacaggaacaactttgcccttcttagcaagcaattttatacagaaactcaactttatgatgggtttctgtaagttttaatttttataataactgatatgtaaatatttagttacctttaacttatctctccaggtagaatggctagcagactgttttatcttctcaaaacatttgtgtgtacagttcccatgttcttttcaaggttcttgcttctaactgtcagttaaggcttttgtagcctcttacttcagttacattttctggccaagacgcaattaaagaatatagagctgataattatttccatagtcgtttccaatttttctactgttccacgtaagactttgaggaacacctttatgcataacacctttctacatttgattcatgtaagtggaatcactgagtcaaatggtgttaatgtttctaagcttcttggaatgcactgcctgaaactttctcaaaaggctgtagccatttacactcataatacttcaaagtgccaatctaaccatgtccttcccagcatggagtattatttttacttttgctattgtaacaaggaaaattaaaccatctcattgttaatatttgtgtattttttatttctagtgaccacaaatgttttcttttaaatatctgctgggtgtttttcttcttttttgagtaatgtgaaaacaaaacgaagttaaccaaacacaactcttccaaacttttctgatataatacacacttttttgtgtgttatgttgaggggctctagttggtaacagcctcctggttacataaatactgtacagtttaattttttttcagctaaataagccttatccctttatccatccttagtggatctattatctacccattaaattaaattttattctctataccaactcctgtttcttcacattttttaaatatatgcagagccctaaattacagtggctgtcctaataaaaggctattcagttattaacagaaaaggaagattgcttcctgcctcttgggtgaggaagactcatgtataccatagatatggtcagtttacatttacagttttctgtgaggcattgatttttttcccccataaatatggagtacttagaatgttcaaaacctttctctgggtaatagaatgcacaaaagtataaggcatgatccctgttcattgcccaagctggcgtgactctggtcatgcagcggacttcatgatgtgatagaattccttgcctatgagagtgaaggagatggtaccaggtctacttgtggccggtggtggaacacttacattattctaagtcctttctgtctgtagaacccaaatgacaaccatattattttatcttctcttattgctagtggtatcgtttattaatgccaacgtatacccattttgcttttcaaggttactttagatgtcttaggttggaatgactgaaggcttatacattcaaatttatatatgacacacacacacacacacacacacacacacacacatatcttattgttgcctgctatctttctacctgttgtataagaaatcctttgaaaaaagcctatgtcagcttcacaaaagatgttactgtgttttgggggaaataaaattgggaagtaataaaacagttaataaatgttacaagaccgtgtacaccaacttaaataagattaaggtcaaacgtatggtaccttatataggtaggaagagcagtattaattagaataattagggagagttgtttggagagtggaaaaaaacattgttctaggaagaaattttgtaatactcaggtaaagtaaaatgtagggccaagatattccagatagtgtagcagcataaacaaaggtatgaaagactggcttgtttgcgagtcagtgaagacattgttctctgagaatctactccagatttttttttttttttttttttttttttttgctttttgagacagggtctcactttgtcgcccaggctggggtgcagtggtgcgaacatggctcactggtgccacaacctcctgggctcaagtgattctcctgcctcagccccccaggcagctgggactacaggcacacaccgccatacctggctaatttttgtatttttggtagagacagggttttgccatgttatccaggctgttctcaactcttgagctcaagccatctgcccatctcggcttcctaaagtgctgggattacaagaatgagccaccgcgcctggccactccagatttttaaaagggaaatctgattcagtgcccctggggtgaactaagtgccttaaattatagagtgagaaatttacattgcatttgattggcaatgggaaaaacattgttaaatcttcagaaaagagaaataatgaagtccgtcttctgtgttttggaataggaatttggtgggtgagtttaaggacagttagagaggggagagattatttcgttttgttttgaggtaattgacatgatgagggtcttaggatagcaatgggggaaggaaaagggaacgtgactccagaggtttttcttaacaaggtagaattgccagaaggtaatcacagattggacaggttttaaagaaaaagggagttatatgtcttcaaaatttgaaggcgtggtgacacagagaatggtgataccattgaggaaaagaggaaattgcaaactgagcggagcaacagggaatagatatgaatttgattgaattacatacttatgggtttatttacaatttctcttcttagaaaaatttatttttggtggctcatataaatgtatgtgctgccataccataagcatatatttctcattaatcctttcaaaaaccctgtaaaagatatttgtatctccattgtgcagatgaggctcagagaaaataggtaattttctcacattgcaaagcagggatttacgtgtacttttaactcctaaaccagcgatttagcccctcagctatactttcttcctgagaggggacagtggcattttgaagaggaaatactctaaagccatttgaaaaggggaaccgaagaaagagtttggtccacagcatgataaaaatattacttgcacttttattatactttataacaagaagtacaggggcagagaaaggttcctaacttttactgagcaagtatatatccaagatacatctcctctttggagcttttgagatacactatctctcttagttttgcaacagccctaggaataggtactattactgttccctttaaaaatgaacaaaaaaaaaatgaagcttaggaaagttaaggttactagaccaagcttattgggagaccatagtgatgaagaggaagggctttagggtcaaatggatttgaattttacttcttaggcctttggtttccttatttataaaatgggattgaaataatgatatcacagttgaaggtaattatatgagaatttatgttatttattgcaaacatagggtaagcacctaataaatgataacctgagaatttatgttatttattgcaaacatagggtaagcacctaataaatgataaccattattactattattttacagcaaagacataaatagagcccattaagttttcttctctacccagtagtttttccattgtacaatagtactctcctgaaggacagcgggtgaagctaagaatttggaagaaatcccagatagagaaatcttgaaaagaagatagatagatttaatactcaatcattaaaaaaagtgcacatgactttaagaaatcaaacattgtaagaggatagtattgaaaagtaagtctccaaccactcttggtatcaatcccctaattttacttcctagagacaattaacagtatagtttttatgtttgcttctgtaaatatttttgcatatacaaacatacacataaaaatatgcccatttttgcacattgagagtataataggcacaatgttctgttctttgatgctattaccttttacataattaacctggagttttttttttcctgtagcgcaatagactgacagatggtgaatgaaaacttgcactatggagagttatgtcagtgttttaataagacaggaacccagaaataaatgtacgaagtttaacatcagcatctcgtggcctttaagtcaaattggacaaccattcaaagcttcataaatgctaactgcttctcatgacttcagaagcaaacaaaaaaatcattattcaaatgggaaattaagctgatcatcagaagtacagagaggatgtcctttcttaaaggcggcacgtctaagggagtgtctgagacctggcttcttcattcaggatggaggctgctgctactctttaaaagaaatgttcacatccttacttcctgacttccttctataacacagtctgcttcacaacactatgactttatatgtcagagcgggttaggaggagctgaatcttaaaaatttaagaagatgccaaggtctagaaaccactcttaacaggggaaaattagaccctgcttgcttttgggaaaatttgttttccagtcagatgtttgtcaaggttaaagaaattcacgggccctctgttcgaattgggagcaattgggagcccttaagctgaatgagtagacttgaagtcccacttagaatgagcctttatatttttgttctgtggcttgctcagggaagggatacacacttggggagaaaaagacttggattctagttgatgtttttctcctagctgactagggaattcagaacaagttactaagagctttctagtccttagttctctcatttggaaaatgaaaattttaaattagagattctatttctaaggcaccatgtatttcattttcttaataaaaagtatatatattcccctaaagaatactcataagaaaaaggtagagttaaaatttcccaaattatttaattcctggttgcccagtaaccattaaatttctcagcagtcaggcaagaaccacattcccaccttgagacaagatttaggcctttccaaacttaccctcgggctctgttccaagtttatttgtaagtcagttgcatacaatttggaatgaaatgtgttataaatggtggttaggtccctaagtcacagaatcttagttaaccctcagagtgcctgatatactgcaccatgtaaatagaaagcagctgtatgtttctatgggagcaaaaaacttttgtaggaaaaatggtagaaactcgtactgcaggtgttgattattcagcaaacttctctagataaggaggactgggaacttcatcattattggtctagttacattcctggtcactccctcatcccattgactggtcagtttccctccctgtggtccttgtgcaagggtttctgcctcaccccataccctctgctccttgcccggtatcatggttcttctgagggtactactgcccattcacccttgtgctaattaggattacactgggtaaggaaagacatttgttctgtagcggagaagcggggaaggccatcagaggctttgagtgtcagaaagatttggtcttgaatgcaggctctgggatgcaaccgtagggaagttaccaaacatttgtgagcctcattttatctttaacaaagctgataatacagaactcagggccttgtaaggactcgatggtatcaggtacacacgacatttgcccttgagtgctcagcgaatgttagtattccttctgccatcggcctgtcacttccgtttttctctttggctctacagggaatacttgcatacaaaaagagctgaagtaagagtcacctacatcttaggaaaaaagggctgctttaggtttatcctcaagtagttttgtccaggattctgaggagaataaaagctgggtcagatccagtgtgttgaaaagaaagctgaggtgagaagtgagagaaacagagaggcagagaaagggggaatgagccctgtctgctatgaagtaggaggcaatccaaaagacaaggaatccgtggtcattgccactgagaggagaaagaaggcaaactcactcctgtgacttcagggccatccatgaggtgggcagaggaactcagagtctgcccgattcttggattgaatcttcaaattggtaaagctttatatcaagcaactcccaaatgcagcatagttttgaggtgataaagaagagtcttttcaaggctgggcacaatagttcacgcctgtaatctcagcactttgggaggccaaggcaggcagatcacttgaggtcgggagttcgagaccagcctggccagcatggtgaaacctcatctctactaaaaatatgaaaattagctgggcgtggtggtgggcacctgtaataccagctacttgggaggctgaggcacaagcatcacttgaacccaggaggcagaggttgcagtgagccgagatcatgccactgcattccagcctgggcgagagaatgagactccgtctaaaaaaaataaaaataaaataaaaagagtattttcccggagtaccggtaatattggttccagattcaaatgtattgtccagatacacagagggtaaacaggaacgcttcaggcatcctttattaaaagcacctcagtctatgtcagagggccaggcagtccattatctaatgaaaatctcctaccattgatttattttatcataactgcagctgctaagtaattttgtttaaggaatgatttacatattagtgtcttcagcaggatctcatcattagcatctagtctccagaaaagttaacacataacagtgaaaagaaaacattctctatcacatgcttctgcatgcatgggcaatttgagtcataccacctgttcccctcttctgttatgctagagtatacaaaaagcagagatacgcatagtttactatgatcctagatgcttaaatatcttgaattgtgttctatcttggactcattattcatgcataaagactcaacagattctcttcttgcacctctcaaacagcaacatcaacaaaacccaaacaatgtatctttcctaatgaggtgaaagcatgcataccagcctaagacagaaatgttgcaaaaatgttttttgcaagaaggtcagtttgcttttcccatggtaactaaggttaatttctactgtggttcattttggcatccattttattcatgatgattattagagggcatggatattgggggtgtgttgatgttgggcaccagagaaatggaaagaggcagatggaggatgcaaatcattttcactcagaacctaaaatgtttactgttagataaagggtagagaagaatcttaatttgactgtcaaaacatatgattagttgaagttaccaaaactatttttttaaataacatttatcttaagagctataaataaagaggaaattttgcactagagatgaagttatgaacatttcattaactctaaagagttaatgaaaaactagttgattatatgtgttcatttataggttgacacgtgaatttccagagaagtaacttgtatgtttttaaattccaatccttatcttacatctgggcagaatcagacttgtgaacgtcccattccaaacaaatggctaaacactttgcagactttgtctagaagagtgccttacccatataagccctctgttataaaattgttttaaacgttaaattagctgtcaagctgttctgcatcagtggcaccacctggtagcaaggatggagatctctgccacccaagatctctttagtgctcacgtcatttctccaccgcaaggaggattgcgggggtggacgatgctccctatttagtcttctgcattttgttgcttacagttcaattaacatgtcagttagagatgacttttggttgcagttaataaaatatctgaccaattgtatcttaaacacagaggagttgatattttttgtagaacaagaagtctggaggcaggtagttgagagctatggaagagttccgtgatgtcatcagagacctgggccatggtttattctgctgtaccatttttaacgagtgactttggtcctgatggttccaagacgactgctgcttctcaggcaggaagaaagagaaaggacgttcagcctcagagtctctttgtctttccatttgggaagggaaatcctttcttgcagatatcttctcaagcattggccaaaactgtgtccacacagcttcccctggctggatcagggaattgagatcctccagcctttgtagcagagaaagaccaaggagaaagaatttgggaaggggtgttgagtgagccaacatacagttatctgccacaattaaatacagcggattcaccttgcaaataagcattctttttagaccatttattttctttctctctttgtcccaattcctttattccttaggaaagtcttgatatctttgtgaggtgtgtttcaaaaaagaagctccagctcaggttgtaaggagtaagcaaaaataataattccagtgattcagccatagaagtggaaaattatattatttgaagaaaaattagatgtaaaatcaatgtcatcgacagcttaaacctggtaaaagcaaggaagttcctttcagaatctaattttattccaaatacatttattgagcaccatcatttattgccctagatgccaaggataagtgaacacaacatgacctcttcagaagtctgcatttttctcatcttttttccctcaagtataagaatgaaaaataaagctatttctaattagttacatcagtcatttctatcagtattactatagattttatttttattgtatactggatatttaaactaaatttaagcctttgtgggcttagaaattactgtttcatgagtaacatggcttatgtaggaaatttccaatgccattaaccttaaaaatgttcattggaatactgcttatgtcatcttggaaactacctttgcggttgacatataaactgcacgatggtctattttcattatatgtttctgtatgtacataagcatcctcatgataaagattgtctacttgatcaaacttcagccagactcctgaaccttctcctaggcccacctgtgcacttctttgtaaaaatccagctgtagcgagaatcctgctaaatcagtttagcaagaaccaccttcctcttatgtatctgatcaggttcctcatcctccaccatcccccatgtgacgtctgatcaccctggcctgtgtcttcagcaaggttcctgttaagttttttttagctagaatcccccttacccccatgctttctcttagtagttttccatccaccaaaccccaccctgctccttggctatcaattcccacttgtccatgctgtattcagagttgagcccagttctatactgaggtctctttcccactattgcaatattcctgaataaaatctgtttttaccactttaccgtccatctctggtttttctttgacactcacataaccagagttttgtatgtgtgtgttgcttgacacatcacaaatacctgggatacgtgtactgattttttacagggtgaataatctttttgttttccccaatatcttagaaacctgaatctttaacccctgggcttagtacacagttaggcatataataggtgcttaagtaagcgtcaactgatgattttaaatgcagaagtaattgtcacttaatgaaatatagtcaggagactcatggattttggcctgtcttcctacctgttcttgtactgcaacagtaagtgtattaaggcaatatttttggcagcacaatcatttagtttgaatgcattagtaaaaggtggagtccaaagaattaatcgctggaaagttttgggaaaacccagtaacaactgtttccatagagtaatttgagtgacagccaggtaatagctacttattggagggactccacagtcagagccttgacagggacctgaaaaagagtgtaactgaagggtaaatgtaaaagcttttgggagaacaagggagtggtcaggctgaggcaaagatctgaaaagaaatgcctcctggggccaagctggtaatttgaatgactgaaggtgactgggtgggaactggggcaacctgaaaagcttctgttagggtaacagagcctccgttgcagctgactgttctatgagaatgtgagtctctattgtcaggtcttcaggttcttccagagaagcaagacaacgggaaatcaccagatttttaactaatggcgtatcattcaacaatttcaaaaaccattatgtgagcccaaactgaccaacgaatcaaacacacacacacacaaaaaaagagtctgcagactaaattcaaccagttggtgacctctggtctgtggttaccagagaagtaattgaaatggagttttgggagaaagatcatatgttgaaatcttgggagataagggcagagaaataagtaagccgagacggcggtaaggccaaggtagaaaaggtagcctttaggaaaattaagttaagactttttaaaacaggaaggggcaaaagatgaggttaaagcagatgaggaaatttactgttatttattttcatcattaaaatacgctttccacaaatttttcaactgtaagagagagtgataaattcaaaataggtaatgtcaaccatattatgaagagtatgtttttgcaatccaaaaaagctaaggcacaacattaaaaaaaaaaatctgtgaatttggctttgcaaaggtataagaattaagtcacatctgatcatttttagagtcttaccttttataacaaagaggaaaatttaattaaactggctctgccctggcgaatctgggatgtgtgttcacttatgaagagagactgttaagattcgttaattaatgaggttgagaatagagttgaaggagattggggtaaatttataagtttgtgtcattctgagagttctgtaagtagctgagttacccatgttgtgactgagaaaaacaggagagagcagtgactgaaggttctgagccaaaggaggagaatagtattgtttattccagcagccagagtggcctgtgtgactgtaagtcgcctgtcaagagggagactgcaaggaaagtgcattgatttgatttggagtagttgtaactgcagcatgaagaatatgatatatagggatgataattgaggaacaatttaatggctgcataccttgctgaagttgaagttccttctggagataaaggtggcaaaaaagaaagtgcttaggtagaagagctttttaaaatgagttaacagaaaacagcagactaaatatggaattgaggagtaggaaatgaaggaaatgaatttgaagatttactttctttcaggatgcagagctggtatgtaatccctctgtttccagtgccttctcccacttccaaatttcactgctcctcatgcgccctggtgtgtggtgcagcttcgagattaagcctccagccttctgtcaggatgaagcagcaggtggctgagatgctaggctccaagtgggggaggtgtttagggctctaaagactttcaaccagtccttgtattttcagccacatttcagtcttcagaggaacctggagcctttcatttctgagacttcttggctacataaactggcatgcgtcttgttagttcctcccactccctgccccaatctccttgtctccccaacatcattaattgagcttgggatttctctggtctcctaagttggttaccagcaggtcattttctaagccaccaaaatactggagctctgatctgttctcatctcctctcctgttttgttaattttcttttgggtaaatgccattttttattcctcttctatcaacctggtagagtttcagggataaagagagacaaatgagtctgctccatctgctgtgtttaactagaagtcccaacacccaaaatccttcacacgatgtgcagggctctgcagtgggcctccccctgcctacctgtcaggccttatctgtgcccactcttcctccttcctctctgagatttcagcaatattggccttctaaggattcttaaagccccaccttcttctctgcttcagagcttttttttttttttttttttttttttaacatgtgctgacctattacgctgctgtgttcttacctggcacgctcccatcatccttcaagtctttgcttcaatgtcaccttctccaagaagcctctcggacctatgtttccctatgtatacagtctcatcacttcctgtgtgtttccttcaccattttaccacagtacatatgaatatttgtttgttagtttgtttgagacggagttttgctcttgttgcccaggctggagtgcaacggcacaatctcggctcactgcagcctccacctcccaggttcaagcgattctcctgcctcagcctcccaggtagtagctgggattacaggtgcctgccgccgcatccagctaattttttgtatttttagtagagacggggtttcgccatgttggcccaggtggtctcgaacttctgacctcaggtgatctgcctgccttggcctcccaaaggctgggattacaggcgcgagccaccgcacctggcctacatatgaatatttgattattatccatctccttcgctacactgcaaagtcaataaaggcagagatttattttggttaccagtgtattccatgtacttggcatggttcttggcttatagtacatgcacaataaatattgaaaggatagatgaaaggattatggatagatgaatgtcttttaagcagttataaaacagttctgcctaaagagtcttttttaatcagtagtattacttcaaatacatatttaaatacacatatgttataaatatataaaatatgtatttaaatatgtcatttgtactattttaaatgtatttaaaataatatatgttatatattaaaataatactaatgatttttaaaagatcaggcaacactgctttgtagctttttagaagacatttatccttatggatccataattattatggattgtatgttttatatataatgaaggttttgggagttagagccctgatccttccgctcttgaagcttgatttaaaggagcatggcacagtggtgcctatatgagtcagccctccattatctggggcagaattcaggccccagaaatggtacttaagatacacagttctcccccagaaaactttatatcggccatttgttacagaaactgctttctcaacaaaccttttaccagggcagctaacaatgagcaaaactaatttgaatttcaactctgccattattacagtgttgctaagaagtagtgagattctgctgaggaaggccaagcaagaggagggagccagaaatgccttaaacaatccacagccaggattttgtgctatcttttatttcacagttgaacttctcagtattttttggttcataacctttttctcttttcctcaattctgagtcttccacatttgtgccatactaggtactttattgcttctctcccttttttttttttcttgagatggagtctcattctgtcgcccaggctgaagtgcagtggtgcgatctcagctcactacaacctccacctcctgggttcaagcaattatcctgcttcagcctcctgagtagctaggattacaggtgtgcaccaccatgcctggctaatttttttgtgtttttaatagagacggggtttcaccatgttggccaggctgctctcgaactcctgacctcgtgatccgcccgcctcgacctccataagtgctgggattacaggtgtgagccaccacacctggccctctccttcatttcttagaagagttttacaaagtcattggtgataaataagtaataccatttcacatctggaaacataacttgatagtaattataaattcacagactgtactttctgtacttatctaagtatgaatgcataattcctgtttatctgtgtgtaggtttatttttcccccatttaagtaaagctctatgttgatgatgaggtttttacgagttgagattttaagaggcctcaaatatatctaaaaaattatagaccaagtatgatgtgttagtgttcctcttctctcagctaattctttaaagatatgttccagaattcctggtctgttcttgaagatctcccaataattctagacttctgaagcctggatattttggcttaatttgctttcaagacagactggatttaaattactcaatttgtctgaagtctcattaagatccaaggttcttgtctgttctagtgagtttgagctggcaagaataatacttgtcatctgaaaagtccattagaatcctttggaggagtgagactggaaaattggagacatattattatattttaaaatatgccacctttctataataggagtatgtggggagactgccttgttttggcttcttgggaaaatttggaaaattagtaaaataggcaggcagtagtagttcaatgcgtattgtatgccaaacactgaatttagaacaatactcccccaaaagcatatgtgctctaaattttatttttcacttaccacctgggagatttggattaaatttcttctgggaaatagagttggtatgaagaaacaaagaccactataccaatttatctgttggaataatcatttagccgtacagctctttccactcataaagttaatgaggtcattattgttctttctagctaatagataggcatattgaaaccttaggcctttccaaaaagtctccataagccattggaaagatagactaaaacactccttgttttaaattctagacctcagttcagtcagagatagtaggatttttgcagtattattaaaaagacagaaaccagctataaaattgaaatgaagggacttaatgttttttttctgtaatatctttggaatgcttccatggctttaaaatgctgaggtgtttctcactatttttcaaaagcatgtaacatgtagatatgtgacgcaaacttgaccagttgttcctcttttctggtgaattttgacacctgctactattacacagagtaaaagtgaaagtcataaaacagaaatacttaccaaagtcaagaaaaatgcatagactaaacaaaggggcaagagaagcctattacttgtttcatgtttcaaaataaaagatgaatggcctatcacttcagtagttggaaattcaacttgagaaggtaggtggtttgatgtttgcccttgttccttacgtttctagatttctctatttataggctagaaccagccctggataaaataatacaagttatgaagagaaatgtgcagttcagcatttttacccttctgaagtgcgctttctcccagctgccatggaaacatggcgtaactggtttcttggatagtctcactcctcttgagttccggctgtgagagctagtgagctcattacaacttggatcagagtcctggaaagtcagctcccagggaaagtggaggacagtctctcatggggcacgggaatggggggctttagctttattaaactgcatacatactttcactacacagtcatcccaagctttagcccaggacagtgtcacattgttcacagctgtattgcatcttgaggtttctgtgtgcatcctacacactttcctaaggcagagacttatctcttccagctgtaagccggagggagtggtgctgcagactcctagcaacacatgcggactcaaacaacacaggcagttaactctcttgagtagtagacttgtagggcaccagaactccgttgcagttcactgacagttaccagatatacatttgtatggcttccgtagcattgtgatggaagctaaacgtttgccctgctactttcttttttttttttttttatttttttattttttttttattatactttaagttttagggtacatgtgcacattgtgcaggttagttacatatgtatacatgtgccatgctggtgcgctgcacccactaactcgtcatctagcattaggtatatcacccagtgctatcccccccactccccccaccccaccacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccacaatgtgaaggacctcttcaaggagaactacaaaccactgctcaaggaaataaaagaggatacaaacaaatggaagaacattccatgctcatgggtaggaagaatcaatatcgtgaaaatggtcatactgcccaaggtaatttacagattcaatgccatccccatcaagctaccaatgactttcttcacagaattggaaaaaactactttaaagttcatatggaaccaaaaaagagcccgcattgccaagtcagtcctaagccaaaagaacaaagctggaggcattccctgctactttcttctggtatgcctgaatcactgtttgagaatggattggactttggtgcgtggaaaactggtagcagaaggcttattcactgcagtgggttgggggtaggctgaaaagatgtcagggaggattaactagaggcagaatgtgtcatagttagaagtatttagaagggaagaaagtttgaactctgatactgttccacactaatattcatgccctgaaagaatcagatcattcttgcctctcccacttggatctctagctactggaatttgccaattcttgatatgaacgctaagatttggatggagcttgtgacctcatttagaccatttgttctaaatgctgaatagaaccaggaaaataggaaaagagggtagaattggggtcataagagaggaatcgtcgttctttgaaagaagaaagatgataggaaactaggcacatgagttacgaggcagtggagaaggaggattagaaagggaaaaaaagaagagaaactttatgccaatatcttctacaagatgtttggctggcacaaaactaacactcaatacttttgcataagtaaaggaatgagagaaaatttgggattggatgcttatcccctggaaactgctacaggctggtgttaatgggaaagggatctgtatttgaccaaaagtgcatttccacgtctctacatttctttttataaagagtcaaagggactcaatgatgagtgtgtgtgtaagggaactccacactagcaagtacaggaaaaatttgatggtactggtgaaggatgttgcaccaatctggaggggaggacaggaattggtttctcatggattgatgccgcaagacaattcataccatgagttggctgagaccacttaaaaaagtaagcagtgatgactgggcaaaagagacaaaggaagaaccacatcttttaggggagagagagagaaggacaattaaagggactcaactagatcaagttctgctcactaaaggacagcgtccaggcaaatgttaattatcttcaagaagcaatctgtatatatagcatttcaagatactccgagatgcttttaatttattgaatactttttattggtatttatcataaacaagagactcacaaatatatcccagaggggaggttttggtgtagttgactatagtagttattaaataatctattaataaaagcccacaaaatggaagatagaaagatagaaaaacaaaagacaacacaggatggtgttggtatacagaatttatacttgaagtttaacaacacggaacaagaaactttattaaaatattcatttaaagaacttccatatgaatcaccagaggctcttagtaaaatattgattcggattcacagatctgggtggggcctgagattctgcatttctcataagctccaagcagatactgatgctattcttcctcaaatcacactttgactaacaaggactcacacaggttctctgtaattggtgttggtagtcattcatggttagatgtagttgaggactgccctcttaactacctctcggctgccaggttataaagaaagcaagtctcagtacaagttctgtcacttaggagcatttattagccaatgggtacaaaacaatcttacagcctgtgccagagacacagtgaagtcacagttctgtcttttggggtgcttggtgtgagaggctcacagtctacacaggccacagtcctctattagagtggttctcaaagtgtggtccctggaccagcagcatcagcatcacctggaaacttgctagaaattcagattcccaggcccttcccatacctactgaattagaaaatctggaggtggggcctaggaaatctgcatctttaaactatccactccaggtgattctgatgtttgctcaagtctgaaaaccattgttctagcagcaggattccctcaaccatctaactgaattctggcaactaagaatccggtgaaccacagctggacattttggaattcagcctagggcaccatttctaaagatggagaacctactggattcttcttaaactcaatttaaaggcagggagtgtttctaaatgtttttcaacaatcttcatattttgcaaaccactaatatcactacacaggcccgtctaactattaattaggaaaattaatgaaacccctggtgtaataagagctaaatataactgaatcacttacagtggccgcctgtggcatgaggctttttgattaattgctagccaaccacccttggagttcactcctgattaagacaactgaccacctctacagtgtagcttaagctaacacacacatacatcagagtgtactgttcatgtgagggtttttaaagactcttaaaatttaccttatcagggcataatttaaacactataacatgtttccattttaagtgttcaggttagattttggcaaatgtatacactcgtgtaaccaccatgccaatcaagatataacatttcgatcacctagaaaacacccttgtgttcctttgaggtcagttacctactcccaccacaccccaggctaccatctggcatagtagctaagttttgcctgttctagaagttgatataagtgaaatcaaacagtatgtactgttttgtgcctggcttcttttacccagcttagtgtttttcagatcagttcacattgttgcattatcagtagttagttcctttttattgcactttgcacagtagtatcccactgaatgactttaccacaacttgtttatccattaccttactggttggtttccggtttttgactattatgaataaagctgctatggatattcatgtacacatctttttgtggacatacatttttttttattctgtgcaaatatccaggaaaagaatatttgagtcataatatacatgtgtgtttaatttcataagaaactgcctaactggtttcccaaagttgtcgtacattcccaacaagcagtgtctgagaattccagtcgctccatatcctcaccaacatttggtattccggtcttttaaacaaaattgtatgctgaatagtttaaattacagacattgttttctttcccctagttgaaattcaggcttttatgtttggtctctgcgatggccataaagctgaaaatgttgacccaagtgacttggatatggattgaattattgccctttcctaacacctcatcagaattggtttcgtaggtgtcatttgattatggcagtcatgtatgtcagtgtactttttctttctttcattcttttgtttattgattcagttggtcagtcggtccatgatctgtattaaaacagctttttcagagggcagttgcatattaagttgctaggaaaaatgacagaagtaggtgacagagttcttgtcttcaaggagctttttggagctgagttcctgaaataaatgtagcccagtatctatcaaggcttgtgcagacttgagtaagaacatcatctaaatatagcttcctgctaggtggcgtgagtcagggcttgatagaccggtgactgcagaaaccacagtaacatatattgttgttattctgtgctgaacattagaatgattgtaccttagaatatagagccaaatgtttattttattcctaattatatttttaaatacatatcacacacatagacacatatgttggataaaaaatactcaaaatgttaacagtgcttatttaaaaggtttatataaactttttttgtagagatgggatctcactatgttgcccaagctggtcttaagctcctggcctcaagcagtcctcccaccttggcctctcaaagcgttgggattacaggcatgagccactgaatccagccagttgtgcctatttttgagtttatgggcttgtggatgatttatttgattatatatgtatatgttaaatgtctaagttacccaaagtgagcatgtataacttctacagtcagaaaaaatgttatattgccacttgattgtttaaggtcttatagctatttaaataatgtatttcttgttctctttaatcttgtgcagaaaagattcactacagtagatccagattactttctagaaaaaaataatgcctgtccatctctttcctcttgggaacaggactacatgaatgcccttcaggctataccactttagtcttcacagaacttagccttcctggttgtcaaagggcaaaaggaattattttttcttttccccacgttaacagaattttcacctccgaaagcttggcgtatacacactatatgttttctaggctatttttgtggtggttgtagttattggcaaatcactgggcgtcgggggtgggttgtctgttatttctgatggaataacaaatgctctttgttttccctcttttcagctgacctgaataatgtcagattctcagcttataggactgccatgaaactccgaagactgcagaaggccctttgctgtaagtattggccagtatttgaagatcttgatactatgtctttgcttagaataaaaagtaggttgggtacatttttacttagagaggggagaaacagctgtcacaattcctgttgcaatgtataattcattctttaatgtatccttggcctagagtttgcctagaatgttttgttttatttttagaatcattcctgtcaccattcctcagctactgatgttgaattaagatattgagaatttttattttccaactactggcattggcatcggcatccataattacctttgtgaaacttgcacaatccttgttctacctttgtttttttttctttttacaaaatgtacttagtattagaagactatgactatctgatctaaaccaaacttcatagacatgtgtggtttattagcttgaatgctaacgtgcagatgaatgaagtggtagaggaaaaatgacagaattgctttcctccttttttatcatacatctgtggaaaaatcctgaagtgttacacagctctatcatgtcatcaaatagtttatgtataactctactattgtctgagggtctgtgtgcattgatgatatgcccatgaaacaggcacagtttctttttctttttttctgtttttttttttttttttttttttttgagatggagtcttgctctgttgcccaggctggagtgcagtggagtggcgcaatatgggctcactgcaacctccacctcccaggttcaagtgattctcctgcgtcagcctcccaggtagctgggattacaggcatgccccaccatgcccggctaatttttgttttttgtttgtttgtttgtttgttttgtttttttttgagacagagtctcgctctgtcaccctggctggagtgcagtggcgcgttctaggctcactgcagactccacctcccgggttcacgccattctcctggctcagcctccggagtagctgggactacaggcacccaccaccacgcctggctaattttgtttttgtaattttagtagaggcggggtttcaccgtgttagccaggatggtctcgatctcctgaccttgtgatccgccctcctcggcctcccaaagtgctgggattacaggcatgagccaccacgcccggcctaatttttgtattttttaatagagacggggtttcaccatgttggtcaggctggtctcgaactcctgacctcaggtgattcacccgcctcagcctcccaaagtgctgggattacaggcgtgagccaatgcgcccggcccaacaggcacagtttctgctctgatggaacttacagtctaacaagggataaccaggatgttcatgaaatttgtagacataagcaaatatatgtataatgtattaagaatgtctacagttggttaaaaaaataaagtgatcttgtctctatttccaagaccatttcaatgtcatatatttagttgtgcaacagtgggacaatggggtactatgtgaacagctaactgtgtggaatgagattcaaagaatgtttgtttgaagaggtgatgtctaagctaggtaactctagaagagtaagcagctctctctctaggaagagcgttctagtcagaaagaagagcatgtgctgaagggcccagagaaagcatgacacattcaggaactgaaaatatgtcagtatggctaaagcacagaattccaggggaaagatctattgtgaaataataggctggagagagaagcaggaagcagattgtgcaaggtttttaaaacccaagttaaggaatttagaggtcaggggatttggcctgggggtgacataatcagattgtcgcttagaaagatgattcttgctgtggaacagagtatggattggtgcgatgtgggagtgacaggagaaaaacctgttgcagtaatctaaaccagcaatgtggtggcttgaattagcagagtagtaagggagataagtggagagaatttagaaatatttaggaagtggatttgacaggcctcagtgattcatttgatgtggtgcagggatgtccaatcttttggcttctccgggccacagtggaagaagaattgtcttggaccccacataaaatacactaacgctaacggtagctgatgagctaaaaaaaaaaaaaaaaaaaaaaaaatcgcaaaaaaaaaaaaaaatgttttaggaaagtttacgaattcatttgggcctcattcaaagccatcctgggccacaggttggacaagcttgatgtggtgggtgaaagggagtcaaggaagacacttaggtgcttggcttggaatatcaggtgaatgtgggacttgtctggtaaggttagacacggagctgtggtgctcaggagaaatatacaaacaacgtttagggatcatgagcctgtaggtgctgcttgtaacgggggagaggattggatagctccaggaaagtgtagcgtgagaagggaagttatttaggacacaggataagcaacctacagaagggactgcaaaggaatggccaggaggaaagaaggaaaattccaagaggttatgatgccacatgctccatgggaagaaagaaagaacccgttaccagggtcagatgttgctgggatgtcagcataaagttgcggaaaatgcccattggacttagcaacaggaaggtccctagtaactttggtgagattttagaggcacagtggaagtggtgtggtgagttcaaaagtgaaccaaaagtggagaattagagaaggtatgaatgattcttggagaaatttacttatgaaggggagaagagtggggtggtagctagttggagggggctgaggagttaatggaaatgtatgtacagtcacgtgttgcttaacaatggggatatgttctaagaaatgtgttgttaggcaactttgttgttatgtcaatataggagagtactacacaaacttagatggtatagcctagtacacacctaggctgtatgggatagcctattgctcctaggctatacacctgtacagcacgtgactgttctgaatactgtaggcagttggaacacaatagtaagtattgtgtatcgaaacgtatttaaacatagaaagatacagtaaaaatatataatagtgtaatctcatgggctcgctgtcatataggcagtccattgttgactgaaatgtcattatgtggcacaatatgtgtatataagtgtgtgtgtgtgtgtgtgtgtgtatacattgatccttgaacaacatgggtttgaactgcttgggtcaacttacgtggatttttttcaatcaaatgcaggccaaacatatagtattcgtgggaatgtatttatatgagtatgagaagacagggtgagattacaattattggcccaagaggagatgataaataatgggtgttctcagagaatacgggcaggtaatccagagcccaagggagggaagagatacctctcttccactgtaatgggtggggtagagggaaggatctgggcaggtccaggtaactaagaaaccaggtagcagcaaggtgaaggatgtcttactataaaggcttccattttttgtatggagtggagagtccctgcaacgcagttaacagcaggagatgatgaagttgggcttatctttgtggagaataagagagagggcggagttgaaaaccagctgtgtgaacccagaggcggctgagtgtttcacggtagctccaatctgcaggggtgtggtatttccccaggcacgcttagcacttgggagccagatgcttctgtcctggggtagggagggaacagctgggcaagagaagtgaggatttgggcaaaagattgattaaaatgatactgacaagtccctgttgggtaggagaagctgtgaacgcatatggaaactggtaattaggaggtagagggatgaaaatgctaactcttcagggaggtaggggaagaagtagtaaaggaactgaaggtcaagaagttgtggtcagagagaatcatagatgaacattattttgaaggtggaacagtttcaggtgattagatctaggatatagccatttgagtaggtggcagaggtagagtggatgtgaatttccatggaggtgaaatagcaagttaaggaactgagaggctagaatgatgcatgagtcccccatgccaatgttgaaatcatgcagaattggagcgagaactgggcaaaagagaaggaccgtgaaccctggctgccaggtcttcagaaataaaggggttcaaccagaggatctgcagaggctagcaataagatagtcaaggagtcacttggcatatggttcttacacagagatagagaagaaatgccttagaagtggaattatttggaaagagagactaggccttttcccttcatcttggtatccccaatgcttagtacaaaacctggcacacagcatggttcaatatgttttcatgagatgaatgcatgaatgaaagtaaaccaaggcttccatttccttatagcccgaagttatcatttttcagctatatagttgccaagtttaactggtgtttaaagggctttccaggtcgagggtttccttaggacctgttaatacgtcatagctgggaaaaagtagtttgggatgggatcgagtcagggggctgaatagagaaagttttcttgcctctttttcttcacctgcccctgcccctgcccctgccccatcccagagctactgctttcctttaataaaggagtaattaggcactggttatcatgaagtgctagagaatattcctgtgagatcctaaaagttcagaagctaaccatttgttccagtttatactatggaaaaaaaaaaaaaagaaacccagaaatagaccagatggaaaaaccttataatgactgttcctttctataatgtccattttcaccctggatttaggcattattcgattttcctgctcaaaaaaaattccattcacatatgtgttttattgtctgtcatttcaacttataatttccaataaactttgggaaaatgggggaatttcataatatacaaaattttgtccatttgaggtgataaccttgtaataaaggtaagctccgaatgtagaataatttctttaaattttcacttttaaatcaatttgaaattctctgcatttcctttctgagcatggcttttctaatatgtgaaaaagattcaagtatgccaaaattaaggtgtatgtatctaaattaagtattgaattctcattaatgctaggagggtgccatatatagtaaaactatagaatgaagagttcaccccatccttttattgaacatatgtgtggtcacattacttactttcaatatatgatttaagaattttctcctaattttatatttgcttagatttagcttccaggcttttgtcatttctaagcctgcaaagccatgataaagagctattgtctgcggtacaggcaaataaaacttgccctggctagctttccctaccaaaggccacttctaccaactctaactttaaggaaaattaatgatgttatctcagtgatttcctggtgccagtgaagagtttgaattacagatgccttggaaatatgcacttccacctctattaagcacttgatcttatttttttttcacttccctatcaatgtttccgtattgcagaaagccaaataacccaattgtatccactatagagaattcactatttaagtggagagcatcaccgttggcctataatgtccccagtttgtaatcagttaagtgttgcatgactccttactgcctctcaacacattggaaatgaaaatgaaacttggtagaaaagcaggaacaaagataaaatcttggtaagaaggatttataaactgtttcatatagctgatactccattgaaagttatgaagaaggtaatttaagcattttctttctccctttgtagttctgatgacattctacaggtgtgaggcttctaaaattaaaaagccaacttgtaagagcagaaataaaaacgcacttaacaaagcaagtgtatttagtttattaataatgtgtggtgggttggagagagcccaaaccatagggctaaatatactgcagttgataagtgtgacaaatattctgcaaacagtaagaaatagagaacattttgcctctattcagcaactaaagcacacattatagagatttggtacaggctggagttgtgtgaatagtcacagtttctggactcgccctcaccatgacaaaccaggtgaaaaatgcaccgccttctctgtaaatgcacctcaccttttgatggtgcgctaagggtgacattagataggcttcagttgctaaagaagactctcaggacccacaataacatggcttacaaatccgcgctctattgccagaaaaggctacattacaagagcattactgtcaggatatggatccacagccacaggctgcctccacagcaagggggtctcgagaggccagtgtaattattttgccactgtcctacaaaaatctactttttctatataccatgtattatttttcacataggttagaggccatgtctctgttagttctgagtttaagacgtcttgaggacatggccaaactaattttctcagtttatatggtttgacagatattagtgcccaagagaggtctcataacatgacccatctatctcccaggggaaatactgtaatcttgtttagctgttacccactagggaaagaatggttttctctcagtcagatgctaaagagattaaagaacacctcgtaggttccgttttctagtaattattggttccattctccagctatcaaccttggcagcttgccatccctatccttcctcctggaattggatgcccttgaagtgcgcttcttgcactaggaagtctttctcgtcagtttatcatttctcattcaaagcaaattctacctggccaggtatctctagcccagttcctaattctcctaatagaagtttcttttatttcaagtggattcatgccccttggcccaccagacatgttgccattgagaaatagcagctttaatgggaaatacacatgagacacaaaaatgtgactaggctaaaatcatatgaatagtagtcactcctaaaaggactttggtttgggtatgtcacagaaatttctgtagccatccatatccaatttctagcttttcagtctcaggaaagtaggcccaccaaattcaacttaaatatctgtcactgattcaagctgtcccaattgtccctccacccactaatggctttccacacggagtaatggggcaaatagctatttttttaaacacataatgttatgacagatgaaacatacagcacgtaagccttctatcacatgcccaatacctttgttaaaccttcatcatcacaattgatggccacacagtgtttattgagattgttataaatcattgttcttcagatttgactgggtaaatattccctcaggttatttcctgacacagctgattaataacagatatgtcctgtgaaagaagaaccaaaagacattaacgaatactaaccaaaagccacattaatattgctccatggtgttgtagtcgcagttagaacgcccatctcgtcatccagtgtgttggataggttggctgactctcccactcacatcttggctctttcaaggaggaggaggttttagcagagtcccccaccccaagaggcatctgagtctaagccaagggagcatattattctcttattttaaacctctccgtaggcagcaacattatattaggttttccctttaaaaaaaaaaaaaagtatcggctgggctcggtggctcacgcctgtaatcccagcacttcgggaggccgaggcaggcagatcacgaggtcaggagttcgaggccatcctggctaacacggtgaaaccccatctctactaaaaatacaaaaaattagccaggcgtgatggcgagcgactgtagtcccagctactcgggagtctgaggcaggagaatggcgtgaacctgggaggcggagcttgcagcgagccgagatcgcgccactgtcctccagcctgggtgacagagcaagactcggtctcaaaaaaaaaaaaaaaaaaaaaagaaaaaagaaataaaaaagtatctttggtggtttccttccccttgcaacaatctcacctttttccttttatcattaattttaagccaaacctcttccccagctacacacacacaccacacaatgcagacagtccccaacttgtgaagtttcaacttaacaattttttgatttcacagtgatgcaaagtgatatgcattcaatagaaactctacttctagatttgaattttgatcttttccaaggctagtaatatgcggtatgatactctctccccttgctgggcagcagcactgaacctcagctcccagtcagccacaagatcatgaggctaaacaactgacactttactgtgtaaggtgttgctagacagttttgcccaactgtaggccgatgtaagtgttgggagcacattgaaggtaggctaggctaagctgtgagtttcagttagttaggtgtattaaatgcatttgtgacttaagatattttcaacctatgatggggttgtgtgatagcttcaattaggcaaggcacaaggaaggagtaatccattccattgatccttgtggaatgcttgtgcttaagtaccaactaatagccatagtatcttattttggaatattaccagcctttgaaactcttaattgtagccccagttcagggactactaggtctggcatcaaaaaagaaacctgtagtgacatagggaatacctgtaagtgccccacttgaattatctttttaattgtaactggtctcacaggtgtagcccatttctcaaaaatgatagttgcttcagctttttggttgggactccacctgcaggccagagagggtgaagcccagtggaaagaaattctgaacttaacattagcttttggatttttttttagcagccttgccatcagtttgcaattgcctcctaatccattttgttagctccttaggttcaagttctctcacttccagattccactagaaagttacaccatcagtaaccaatttcaaagcctgtgttacttttcaaccaagcgtagcttgttgagcaacttcaaaggttctttttcatcccttttatcagaatcttctttttttctttctaaataatgcctcagtcatacttttagctaagaatgagttggaggtgttctaaacaatcttgcttctgacactcactgccctgacagtggaagttaaacagggttcaattgctaaagaggactcacaggaaccaaatgacagtgcttacgaatctagagttccttgcagaaaaaggatgcaatatacccacaacattaaaacaagaataagtgtcacagccacagcctgcctcacagcatagggtccagagaggacaggtgcaagctataattgccctctgtctgcaagagccacaccacgatgcattttctctcttggaacaagagctactgatgtgagcacagaacaccttggaaaccagggagcacaaattggagtttcagccagggtttcttatatcccgtgggtaacctaggcatactgttcctatgtaaccagcctcaaactcagtggcttccgttggtctgactgtgcccgggtaaaaatggtcaatgttactgttagcaataaacaatggtgataacctgcaacccatggctacacttcaacacagtaagtcactttgaaaagcaagtgctttgaccagggctctgcactgtgtagatattttagcaagtcatctcgtgccaactccagcctctctggaattaacccttactgcacagacaactacatcaaagtgcattgactttcttgaagtgcaaagatttgcttgggaggtccctcagccataagtgtaagttgcctgtagagtggcatgcctgggcaagaaaaatcagcaaacatacagcagttcttccaccattactcacctctttctgtttctgtgctaattagatcacagaattatttatacatcaacatagaatatacagattgacctataggatgaacttggggttatatgggcaccatgagactttttttttctccactaaccaactttttggtgcttctgttttatcctactgttgtcattagcatggaatgcagaatggttttcctgttctgtaaagtcagtaaggacaccttctgccacccacttttcccccttacaatatgtacctccatgagaaatcagaaaacctagatatcctgccataacacccagagtgagtctccatatctctggtctcagttgtctcaactgcaaaatgattttaaagcaaccttctggctctaagagtctatcactctgtaaaagacaaaaaaaatctgtcttacataggaaggaatagcaagagttagctactgtggcatacatagaaaggaaaagaatgagcttttgaagctagaaggttgagaagatgattaggcacaaccagagcctcaggaaccattagtgggatccctgtgttgaagtcctgcctgctcgccgccccccaaccgccactgtctgcttttcctgcacagcaaagaggatcctggagagtcagccatttcttttatcctgtccccaccctctctcacccccacagccctcatgcatagggtaccaccacatggtccctgttcttcaatggcttcaaagcctatagcatcctctactgtaaacataatttagaaagtgaagatgtattagaatacttgggtttttatgtagctttaaagatatatctactagtgaatacacacaaacacacacacacacacacacacatacacacacacatatatatatatatatatataatatatttaatggaaattcctagcttaaggaaacaatggtttcacacaactgtatctgctggttgcttattgagggtcctagaaagagctaatcattacatttaatgtttcatcaaaaagtctaggtgtgttctctaagatgctcattttgaaaagcatatgcatggcaattaaattgtccctattgatattctcacctccttttcgggtccatagcatggattgtgtatacctaaatggaaattttttcaaaatagctccatgaaagttgaattctgtttgacatgtttgtttagggaaatgtgctcttcagtcttctgtgatggattgttcttgtgtttaaccacatccagttttagcagagcacactgcacagtatttctctcctaactgtgtcatcttctgctcctgtaatttcagagcaattgctttgctcccctctggagctatttctactcaacatttgctgttctatgtgttacccattcacctgtacagagataagagcaggccccataaaatgaaatgcatgcagtttttctctgttcatttccatcacacggctaaataagactcttaatacaaaagtgattcgaaaaattttcactagttacttcttaaatgcctggatcagaggcaaaatatttatgatgactaaagcagagtaacaaaaaagaaaataattgaaaaacttcaaaccacccatagcttccttcagtatataaggaaacatgttgggaatattggtgtttggaagaaatccattcctctcttccagtaatggagctggcataccgtgtttctaagtgttcctactacgtgcacttgagtatgtgccctctgaggaaaacaagcacacagaagagagagagaagaaaagtttgagtcttttgtctctggacctcgctccagcctcccacgcagtcttctttcagccattccctcctcacgtcctcccgtcctcctgcctccttgcattgctttttaaaattctttattatttttctcacttgattcttcagataagtctcccaagttatcttccttcctcccactttaaagaaagtctcagcttccatgaaaagggtcatttctctatctttagagtatttcagagcaaaaacagaggggccttcccttccaagggaggagtgcagactcctgcttccaccaccatgtctgtttcatgcttctggggaaactccaggattttctgttttcctttttttaaaagagaaaaatgtgtgcgcaatataggtggaaaagtatttttgcacaaacctacataggtattaaccactatttttgtttttttcttaatatttaattagaactggccatgaataacttgtaaaatatactaaagccttaagtttgcatttctttattactgggaaaggtgtttactgagcgggatttacctctatttatgtgaactacatttataattgaattgccccttccccctagatgcatgagagatttacttaattagcattgattccttgcctcaaaggactgagaattccaaccagagcttaggtgtataaggtagtataaaagcaatgttgttgtgtttctagtttggctaataaattggctttagagaaatgcatcttttcatgacacttgggaataaagcttgtgatttgctgatgttggacaaggttgaagtttcacttttgttaaatttttgtccccagcataagattaaacacctcctcagatcaagggaattttcctccctcagccttataaagttgttagaggacttagaaagaatattatgaaatacaatttgaaggtgaaaggagaaataagcgagcctcaggtctgaaaactggatagattatgcaattactttagtttgcctatagaaaattttagtggagagtatttttttcacctaatattagggtagcagagagatgctgaggtgactgatatttcaaggagaaaagcgcttaatgattataaatgcatagctagaaatagagtttacacaaccttagccatacagattaatctaacagatcttctctaatgctaatacaagaaagtatcatcggatctctttaaaaatttctgctaaaacattttttttttcttattcaggtgacaattgactctgtttatgtagaacaggctaggtccccttaactctcagatattccccagtaatccaaggatgggaattatatctttgcccatatcttcacccaatgccagtgagatttaagaacaacttcagatcctgaatactgatcaaactcatcaacttagagtcgaggcataaaaataaaacacctttcaaagagagtgtggttcacgtttggtgtttattaaagggtatgagagagtcctagctaggattctcagaggaaaaaggacactgaaaggaaggttttactctttgagtcatttgtgattttatttgttttttgcagtggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgtacgtatggcatgtttttatttcccgggctctgtcacaggaggcttagcgtacagaatggtgaagtgtaattagcattacaacagggccctggaagctgtggacctaatgctcttcctgtgataaatcatttttgcatttatgacttgaaaaatattttgataagctaggagttaagagccagaatgtagattgctctcagattagaaaacaaacaaaaccctgagacactcattttgcaaatagtggaatgagtcgacatatagcctttggttctttccctttctcgcccatggattttggaattcttccatgcacttcaggggtggcttcctctcactggcggccatggctgtgctcctggagatactggcacacctgtctccagatcagaatggtcttagctgatacttaggacacttttgcagaagattatgaattgataggccaaacaaaatgaaaacaagcccttaatacagcaaacttagcttctcaaactgagaacatttttcgttttcttttgttttttaataagattttatgaagtttcagtttggcgcctccattcatcactctctcttagagaacaattgtttgttttggattgcacacaagggagatatccccagttctgatttttttttttcttgagcttaatgaagacaattgaagaagggagcagaaggaattggtcttaattttgcctaaattcttcttagatctcaaaattattacatgcctcatttcaccaatcaagaacatactcccatttggaaatctgggaaggttttctgaaaagagttgcaaaacaactgttttgccttttacctttgttgtagacttctactaccttttgaactaaaatttatacctttttttctttcttattttgataaggtattgctttttaaaatttcaggaccacctgactattacattcatcatagtcatctaccaagtccttgaacatgtcggatttcaattgtgaactacgttcacattagttttgataagagtttgtattcaggtttcccctcaaatatattttggcactgttttctttgcagatgacatgtgaatgcattctgaatgtataacttccttctacctgactgaaaagtatttggtgacaattttaactccttgaagacctgagttgctgtataaagtggatttgttaaattttgatctaccttttcttaagagggagaaagataagaaaattttccagtgataggaatttgtttagtccattagtgcccaggatttctttttgactgagggatttaataaattttagtagctggaagttgagcatattgttcaccgaaaataaccgccattgggacctatcctttgtgattttgaagtgctaataggcgaattattctgaaatattttctcctttttctttttaccaatatctaagggccagtagctttccgtaataaaataagaagccaaaaaactattgaaagacactttttaactttaattttaggtttcggggtattatgtgaaggtctgttacataggtaaactcacgtcacgggggtttgttgtacagattatttcatcactcaggtattaacccatttatgcctagtgttccattattggaacactaagcttgtgggaattattcctatcctactgctcaaggtcatcgccaaggtctgattttcacaaaaagtaatatgcagcctccagcataaatgggttaagcgcagtacccaacagttgtcttttctgctcctctccctccttccaccctccaccctcaagaccccagtatctgttgttcccttgtgttcgtgagctctcatcatttagcttccacttagaagtgagaacatgcagtatttacttttctgtttctgcattagtttgctaaggataatagtctccagctaatccgtgttcaaaagacatgatctcattcttttttatagctgcatggtattccatagtgtatatgtaccatatttctcattgatgggcattcatattgattccatgtcttgaaagacattttctacaaaatggaaaacttttcattcttatttttcctttttttcccccatggataaaattagcttattaataaatttgttatgtgaaatgctttatttcagttttctatatgcaaatatagaaaatgctatgcaaataaaagcaatctatattaaaacactgatatagcaacaggttatttataaatttattttttagatcatatatttgaatgttgtttaatagagtatgatatttttcttacggagataaacatttatattctatattatgtgttatgtggcctgaagtaattaattttctttcaataaggggcaatctgatgaagatctgagcatttaagagggctgagcagttagttgctggtaatttttttggcttccatgaccaaagtaggtaatttgctttagtaaccaaagtagattggtgaagattagtaattcttctgcttaccaacttaaaccaaggtggctttccataggtgaatagaatttttttttcttaatttatgtagaacttttgcagttcaaataagggtttttaggaattgaaacttggtaaacattcagtggtcaagttggttgaatttccattgcattgtaggtcatcagtcaaagagataatgaatttggaaaagttcaaaacaatcttaataaaacagtggtcaatagagttcacacatcattgagcactttactcctttatttttccttttcaaggctttattcttaactagaagtgtttaccctctaggaaagggtcagtaattgttttctgctttgattcttcataataggggacgaacagggaggatccgtgtcctgtcttttaaaactggcatcatttccctgtgtaaagcacatttggaagacaagtacagatgtaagtcgtgtatattaatgctgtattcttttattaatgttggctaattaccctagttctagatgggaaatgacagactgttcttatttgacagcagattcctcatgtaagatgtagaactgcttttagagtgtcataaaatttggtttgtgccattccttgtcaaacattaaattgcaggcatttaagtagagaatgaggattagcttttccagtccaggtattattttacattacattgactgtgtctgaataaaacacatgttcctaggggataaagtctgattttctaacctctttctgtaagtcggaaaaataagtgtgaagatttaatctctgcacttgtctagtctttgggttcttatttaaagaataccatgtgacattcatgttcaagaaacattgtttattttataatcatcttactgcaagttgtactgacacatccaattccgtgacgtgactaacattttattatttgagagacagatagcttgctgtttcttaaaggatagatacgtaccaccctacagaatttccttttgattacgcattgggttcttctgcttaaaaactgtaaaaccaaattaaaagccaatgctagaggagtgatggttcagatgaccaagtgaccatccattcatattgtgaaaggctgcagttggttttccccttgaaatgcttataagcaatcttttcagtaggaatattaaacaaattcagcctagcttgtcttttctctcttcccctgaggcctagccacacatgtgaggagatgtgctaagcttcaggacaggcaggagataaaagccactctgtctcctactgatcatttctccttcaggagtaagccacaaaatacacaaaccattttggccctcacttttatgtagtttccacttgagttttctcatcctcagaacgagagaaaaataactgaacagcttttgttaaccattttaaaatgtatttcggatgagatgggatacctgtgtgcttttctcctttaaatattgtagttacttagtataggttaggttctaatctaccgtatatatggtatagtgacagcacattgtaaatataatattaaattgaataattgaggaagctttgagttggtgtttcgaataactactaagagggaacatgtttttaggttggtgaaacaaaaatattaaatgcaaaatgagatgtttgaaagtaactcataactttgaaaataaacacctaggtatgtatatcggagagcagataaaaagctgtgcgtacaatctcaatttttagtgccatcttaggtatcctgttaaaacatttaatttcctagagtttaaagtgtgcttatgggtacagaaagctttcttggatttactttttttgaggggcaacttctaggtgaatataaggtatgattaaaattttatatctgagaacaaaacataacattgcaagcattcagtatgttcattcattctgttacatatattgggcacctactatccaccgggtactgccattctactgtagatacttctggcacacaactgaccaagatatggttccttccctcaaggggatataagtctcctgccaaaaacgatagacacatattgaatcaatgccagcataacatgatgtgagctattaattagaaatacgcagccaggcgcagtagctcacacctgtaatcccagcacttagggaggccgaggtaggaggatcacttgaggtcaggagttcaagaccagcctggccatcatggtgaaacacgtctccagtaaaaatacaaaaattagctgggtgtgatggcatgtgcctgtaatcgcagctactcaggcggctgaggcaggagaatggcttgaacccgggaggcagaggttgcggtgagcagagatcgcaccactgcactgcagcctgggcgacagagcaagactccgtctcaaaaaacaacaacaacaacaacaaactatgcacagtatcctgtgggaacacatacatgatggactagaagctcagtgatcttatgactccataaagaagtcccaactgtggtacatttttgaatctctggtgtccaaggagggtggtgctttgggccagttatatgtctcttaatgctaaaacacttattttttgatgtagttacatcctatatacaataattcccaaggattatgttctggcttagaagaaatttaagtgtcgagggtacgtgtaagcttgcgcttcttgcagtgacacagtttatgtaaaagttatcacacttcatatatatacagtgatcattaacttgattcataaaaataataaatatccagattagcacaaattagaagtaaccccactctgtggaaatactggctactcttgagaattgctactggaattgagttggatgtcaggttctgctggcatccatgggtgctgtgttttgactgttgcaattttcttcttcctttgtagaccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgtaagttattcaccttctaggtaacatatttattctttcatattttagaaattaattaaaaaacccacagagcttcgttttctcatattagctcttcagtaggcagtaggtatgggatttgggatatttggaacctctgtaagtaagcagcttctggaactctaggttttgggaaagaagacagtgctgaggaaggaaaagaaatctccatctgcagcagggaccccacagttattgaggtgctagaggggaagaagttcagcaagggaggaaataagtctctagccacagaaatcctatgtatataagaaaatggcctttgtaggcgagtctcttagtctctgagtcctttctctaattctatcattatagcctcctttcaatggctgttggtaaattgttagcacagctgtccttttttttaaaactgtcctttgtagctttgacattcccctattattccaaagtctagaggtgtatactctctgctaatgtccatcactgactgaacacactcttgtccgttctctttcctatcctgtcccattgctttttctctgtcgtagtcagtgccccagaaacaccctcttcttcccaaatgcctgagcactccactggtagacattcatcttgttctaatttttttttctctttccttttttttttttttttcttttttgagttgcagtctcgctctgtcacccaggctggagtgcagtggtgagatctctgctcactgcaacctccacctcccgggttcaagtgattctgctacctcagcctcccgagtagctgggattacaggcgcccaccgccaccccaagctaatttttgtatttttagtagagacagggtttcaccaggttggccaggctggtctcaaactcctgacctcaggtgatccacctgcctcgaactcccaaagtgctcggattacaggcgtaagccaccgtgcctggcctctaatttttattaggtagatagtgctacaatgaacatccttatcgtttagcttttgtctttgaagctttctttataggatcaattctcaggcgtgtgattgccagacaaaataatataaacattttttgtggcctttcttcaaaagttgttctaattgtaacgctatcagtattgaaggagtaagatgctttcggtatcacattattcacagtgttcttatgtttttgtttttggttttttcaagtgctaagagctgtttttcttatgtagggtttctcaatccattctaattctattaacaatggctgagatttacaaaatggaactagctgtagaactaactgggttatatctgaagtctttgaccacagactaggatgaaactatagaaggtttcctgggcagatcactgtgaatatttaggtgtttaaagcagtttgagtatttatttaatagttagttggatagatttaccggatgcacacataataagttcatttatgtaaagtgggatatactgtttgaattattttgccaaaattatggcaaattagttgtaaatgtaaaatgcatgtggagaaataaatatcttttcctcctcatacccaaaccttccaaaatgcagatagatgatcaatccaatcaatcatcaaaatgtagacacaagtaacttccatacaatgaatattaatggccacaggcaatctaggttcattttgattttttaaaatccaattataaaacaacttgccataaacgcgagttatttcctaatcttttggttgtgtgttttttttgttttgttttgttttgagatggagtctccctctgtcgcccaggctggagtgcaatggcgcgatctcggctcactgcaacctccgcctccctggttcaagcaattgtcatgcctcagcctcccgagtagctgggattacagggtgcctgccaccatgcctggctaattttttgtggagacagggtttcaccatgttggccaggctgagctcaaactcctgatctcaagcaatccacctgcctcggcctcccaaagtgctgggattacaggtcctaatcatttttcccctttagtcaagtctcagttactctttgagttctagtgaaacacacacacgtgttcatatatagggatatataaacatatgtgtgtgcattgtgacttgggttaaaggtaaggctcagtgatggtccctgctgcaaagtaaactaggctgtattcagggccagctggattctttgttttctcgcccgagtactgactcatcaggaagccaccaccatcctcactgcagcctctggccctcttggatttggttgtcaggataagcggtggccatacagaagctctgctttccctgggctgccccccttatcaggagaccaacctattccatttctgcctgctacatccttttgctggataacctcctactcccctaagcccatgtctctggtttggttacatttctgtctctgtaataacaactctgtattctcagtctcaaagctttgaattcagtccatccttgcatatttgttgaatgcctcctggttggccagccagtctccaagctctttgaaatgtgaaatgtgttttgttttgttttcagaaggggtctaacttcgtcacccaggctggagtgcagtggcacgatcacagctcattgcagcctcgacctctgggctcaagtgatcctcccacctcagcctcctgagtagctgggactacaggcatggaccgccacgcctggcatttttttggtgtatgtgtgtgtgtgtgcgtgtgtgtgtgtgtgtgtgtgtgtgtgtgtgtgtgtgtgtacagggtctctcgccatgttgcctaggctggtctcgagctcttgggctcaagctgtccacccacctcagcctcccaaaatgttgggagtacaggcgtgagccacggcatccagccttgaaatgttttctatgagactggggggaaatcagtcaagatatgaatggtggtaacaggtggcttttgattttctctgtactatttttattttctgagttttcttctttgaacatttataattagaaaaaaaattagtaaagtgctgcctctttttttagggaaagaaacatgttttgtttgattgctttccattgccattcttacattgtttccaggccttctcatcattgcactggcttcctagcaagcctccacttcacactccagtccttttcattggtcttattgccctcatactagttttagagaaaagcatttcccatatgatgccgtccttgaaaatgtcagtatctttctgttgtctagtgaacaaatcctaattcctctatttaactctcagacctttcctactctggtttcataaccacccatagtttgctttcactatcatgaaacagcttctccttaccatttgtacctattatgcttataaataatattgttaccattgctactaacaaaactttgttcacatgaattctctcatttaatcctcaccaagtctttgaggggaacagaatagtcaggctttggagattttgcttttattattgtttaagtggatgaataatttatttgcgcccttaaagtccctcagctggtggaagggtttgattcctagtccagtatgcccaccgccacatttactacctcattcccaaatatgtagtttctgatacttctgctctccagcttcccaaggccaaacaacagctacttttcctgagtcctggatagaataagaaaaggtataacaagacaggggacccttgagggggaagaggaattagtttgaagtgctggcaaatgtagtatttctaatcagatgctagtaaattccatatgtatggcgaggctttcattacttagatttggggagcctctcagcgttttagcaatttgcaatcaggttgaatggatccattgtaaatacttaggaatacttaggaatccacgtcctggccctggcatgcttttcctcggccaggtgcactggcggtcaccttgcctttcattgtgccacgtgcataaaaatacaatgtttgctgtagggaaagataacaggagtgaaaatgtcctctgccctttgtttgaagtataggaccttcagaatgaggctgggctggttccttcagcaagcttgtgctcaaaggctgctatttctaccagcctgaggtaaacggtaataaagtacttgtttatcctacaagtgcattccttgcattgcagatttgatttcctttgatttcttgtcaccacctggaaaccttactttgtttcaggttggtacagttagaaaggtactgaatcttctgattcagacaagggcccagtagtggcaagaagagaggtacgtgtttgtgtgccacactctctggattatctattaaaggttttctcatatccctccccactaaccacttagaaaaggaaatcacctatcaggtctaaatgtaaaattttgcttatttaaaaatcactataggtcttccaaggaattatccattaagccaggaaatgaagtcacatccatggatatgaaaaaggaatagtcactgtaaatttatggctttgacagtggtatcttcgtagatactaaatgaggcaacaggatatgtttccacattaatagcatattgcagtcaacacatttactgggaaattgactcattttggtagtgatagaagtaaagttttgcaacgagtttaagagatacagctgtaattaatatattgccagcttgttcctttctcatattccatggaaacagccctgttgagagattagattgatttttacgaccttagtaaggccaagcctgccctggcagtgagtcacatagactgcctgaaggaaccttgaggattttctgcacctctcctttttcagatgagaaaacaggcccacagtggcacaatgaatctagtctacatcgtgcaatttacatcatgttatggcttcaaccagttcggagactagattgaaatgacagagtgttaatgtgtcaatgtgatcccctatatgaattttagattgtaatagaatgagatagataaataaacacccctcccccaaaacacatacatgcacacacacccatctttattgaaaatactctaatcccaacatagctgtttagtctatcttcagataaaaccaagtatcacttttaggtgggaaaactatacagtcatgtgctgaagaatgacgttttggtcaatgacaggccatatatactatggtggtcccataagatcaacgtaagaagagattataatggaactgaaaaattcgcattactttgtgacactgtagccattgtaacatcatagcacgaagaattatttcacaaacctgcactgccagtcatttaacaggtaaaaaagtatgttttaaaatatttttaattattatggacacataatagtactcatttatgggttacatgtgatattttgatacaagcatacaatgtgtagggtaacacaatcagagtaattggggtgtccatcatctcaaacattcatcatttctctggtaggaacattcccatttcactcttttagttattttgaaatatacaataaattattgttgccatgcatggtagcacgcacctgtaggaccagcgtttcaggaggctgaggtgggaggatcacttgcgcccaggaattcaaggctgtaatgcacaacaattgcacctgtgaatagtcactacactccaacatggacagcatagtgagaccctatctgtaaaaagatttaaaaatatattgattactatagtggccttattgtgctaccaaacactagatcatatttcttcttactgtatttttgtacccattaaccatcccttttttatcccccgatcttcactacatttcccagactctggtagtcatgattttactctatctccatgagttcaatttttttttttttttttttttttagctcccacacatgagtgagaacatgggatacttgtctttctgtgtgtggctgatctcaacataacgtcttccggttccgtacatgttgctgcaaataatgggatttcattttttatggctgaataatattccattatgtgtttatagtacattttctttatgcattcatccactgatgggcgcttaggttgattctatatcttggctattgtgaacaatgctgcagtcaacatgggagtgcagatatctttttgtggtttcgattttgtagtatcttcttcagtaaacattttaaggactttattgtttagataacgtcaagtataccaactttatattcaatatgcttcacctatgagagctggagtgtcaaaatctgtttattttacatctgttttctgcctcctgttgtacttagtattccaaatgagtaagttgcttttccatctatcttctgaatttctctatttgtatgacaaaaatgaataccatctatgcacagttgttgtaataatgtagaatgatatgaaaatgagaataaattacagtctcaactgttgagaacaagtatttctctgtgttagaaacattcccaattctactcttttagttattttgaaatatacaatgtattattgttgccatgcatggtggcatgcccctgtagtcccagctactcaggagactgaggtgggaggatcagtaacacataaatgagaaagcattccagaatatctggagaagtgactggcagagtggttaagtgcataggctttgaaaccgaactgtgcctgagtccaaatctgagctctgctatttgctggctgtgtgactgtggacacatttcttaaccttcctggcccctgaactcctggaggtgattgtgaggattaaatgaaccaatagaagcaaagcacttaagagctgtagtggatacatagaaggtgcccagtgaatgttagctatgattatctaaagtgtgttgtggcatgaaaatatcctgccaatgttaacagttgcttttatctataacaaaacatcatctgtggattgcattttagagattctggagattctgtttctctgcaaatgttaaaatgccatatcaggagacttttggctggttagacagcattccccgggtcaactgattacttttttttttttttttttttttttttttttttttttttttttttttttgagacagagtctcgctctgttgccaggctggagtccagtggtgccatctcggcacactgcaacctccacctcccaggttcaagtgattctcctgcctcagcctcccaagtagctgggactacaggcacgtgccaccacgcccagctaatttttgtatttttaatagagaaggtttcaccatgttggccaggatggtctcaatctcttgaccttgtgatccgcccacctcagcctcccaaagtgctgggattacaggcatgagccatcacacctggccgattccattttattaatagattttccatcctgaaagtaactcctaaaaaccctccttcacttaggtttcctttggctttttgtgtattaatcagactgtgggccctttggttccatagacattccttttacaccccttttggacggatgaatactcactagtaactaagtaattagtaagagttactacaatttggtatttataaagaggtggcctttcccagaattgaaggtagaccctaatagtccaatcagccttccatagagatagctggctgccatgaaaagctgagagatatcaccgacctcttactgggcctgctcatgaacagttagttaaaattcctgcaattttcagaaaagacccttatcagagtattatcagtattgtcttaagtttaatattggtttccagttgttatttttaaaaattttaagctaccgtgggttaagctttatgatgatctgtttaagtggtttgtttgattaacttctctattggagtaatggatgttttcttcaccagaattttgaagataggtttgtgttgtagttgaaacctgttttgtttatacacttactgctaaggaaaagcacatgtcattttgttttccatcttcatccttctaaagtagcacttcattgttatgaccaaatctttctttcttccttccttcctctcaccctgtcttttccttccttccttcctgccctccctcccgcctctcttcctttcctctcctctcctttcctttctttctttcttttctcttttctttcgttctctctctctccctccctccctctctctgtccccttctccttccctccttccttcctttcttccttccatttctatcacccctaaaattccatcatgctgtatcatctcactaagtcccaatctctggaaaccacagctctgttttctgttcctgtaattttgccttttcctgaactggattttaaaggattgtaggaggcagtagtggaagagctaactttatatcttgttcttttacataatgcgccctgatccacacttgggaaagtatattccatggtacctatagacagatatatgtgctttaccatgtatatgtgaaacttttctaatttaactttcctgttaaattagaactcggtagcataaattaatactgttgagtatacttagggatttgcatagatttaaaattgtgcatatgttccctagggccatggcgttaattggtttattagtcaggtggagtgcagagcctgaggtcaggacagttgtccttgaacatggaaatgaagagtggataatcaccatgtgttattgtttgggctgattttatctttaatgggtgattcagagtcctgattaatatttagagcagtgactgctggcctcctacctgctcattatcttcagaactttaaataaaatacttgatttctacccaagatggtagttatgggaagccttttacttcttcttgtctcacaaagacaactcttgacctctcaatccttaaacaaaaagttctgcttctgcgcatgtggggactcttaaactcattttcatgcctggagattcacatttagggatctaggaaaagcacatctaggcagagtcgatgaggagatgctttaagaaccgtgacaaggacaggaaggaaatcaattttgcgttaggtttgtatttttagagaaaacgaatcctggggaacttttcacactcattactattgacattaataccattgtcctgtccctttcacagttactaaaatcactcttgcccaccctcctgccttgcccacaacctattcccatgaaggggtgacttgggagaaataacggtttccaaccaacgttttattttggaaacatttcaagcacaaagagtagttgaaaggatagtctaaagaacactcatctgtgtcatacatctgttcaatccatggttgcttttcgctctacttacctcctccaccctctcagctctgtttatgtatgtgtctgtctgtgtacatacacacacaaacacattttcccctatgccatttaaaagtaaaggagcatcacaacataaacccctaaacacttcaccatacaccattttcttaaaggatgacattctctaacataactgcaatgctatcgttacacacaaatttaacagcaatccagcaataccctctgatatgcagtccacactgaactttccccagtgccccagaattgttccttatagccactgttttcttccagcatctagtcaaggtttttgtctgtcatgtctctgtaccttcatttagttttgaacagtctcccagcattttgttttcctttcatgacattgacttttttggtagggggacagagtctcgctctgtcacccaggctggagtgcagtggcgcaatctcggctcactgcaacctctgcttcccgagttcatgtgactctccacctcagcctcaggagtagctgggattacaggcatgcaccaccacacccggctgatttttgtatttttagtagagacagggtttcaccacgttggccaggctggtcttgaactcctgacctcaggtgatccacctgcctcggcctcccaaagtactggaattacaggtatcagccaccacgccgggctgacgttgacatttttgaagagttcagaccagttctcttgaagaatgtcccatactctgggcttttctgatggtttccttgtgattagattaatgttaacattttttggccaaaagacgataagatgatgctctgtacctaccactgtatcacaatctggaggaacaaaataacattttgttcctattggtatcactaagaatgttaaggtggtgtctacaagatactttccttgtaaaatatccttttccctttgtaatgagaaagtaattttttgatattttgacatattataatatccattccttaaccttttaccctatggttttagcatttatggatgatccttgtctaattcagttataatattggtggttgcataatggtggctttctaattctaccatactttctgcatgtattagaccattttcttatgtaaagaagagcttctacctctcccccgtctattcatgaatatcactgtggacatccaaggtggttctgagtgtacaaagaatgatatctctctttactgaactgccattggatactatttttgtcttggaattgtttaaaatggcagtgtatggaattgaaagtcctttctccagagagccacataaacagatgtctaataaatacatttccatattaaccaatccttttatgggaacaacacattgacataattaaaacacgtaacatgaaaactgtgctgaattgagaagctcatagagttttgtttcttttttttcctttttgccacttcaatatatatggacccgcacctgtcagtccaggtagctcatacatgccgtagcatctaatggtacgagggacatgtaatgctgaaaagaagggggaaaggagttgatcagatgagatataagtatgcatttatcagtgttgtggggtattcacttgcaccttccattggctctcgcagccatgttatcggcatataattcagttgaagatttatattcacctggaaattgtcctaagtgggccttgcttacttagctatcagactctagtactttcaaacaaattaaagattcaaaagattttggggatcgccttgctttttcccataggaaatcacttttgtcctgtctttttaagactattttaagcatatatttcagtattaaaatcgtagataatcttaagctgtttccttaacctctttgggccttttcttatctgtaacataaagttaaaacaggttatctcaaaagttacttatccctaagtgtctttgattctatgctaaatgttataaaggccgaaagggaaatggattattgtacttatttcaaagcttggccatgatcagcaaagtcttacctgatcttccgggtaacaactcttgtatcagagctataagatatagaaaacagtcttgtacatagagtgtggcatttcacatgagaccaagtgttctctgaatggaaacacacactaagagcaagatgtgaaaaaccattgtgtacaacctcatgtaaatgatcccttgcgtccgtacactatagtttcctcagtaactcaaaggtaaaacccaagtatcttgtgtctaagaggatcaaaatgtcaccttccttctgttttatttgttacatgcaggttttgtatagttttatagagtctttttatcactcatttgattttcataaaaattgggattgtttggaagaagagtcattaatattctttacagcttgttcttgttcctccttttatgttctctgctggtgcagacttctctcttatgtaaaatattccactgatgcccttggtagatttagaggttgttaaagaaattgtaataacagatcagggaacagtcagggactgcctgtcctatactgtctgaccctgactaaccgttctccttgtagttttaaatctttgtgtacagactgtaattcaaaaaacagtttttataaatttaaattcagcaaatctttccaaatgctaaggctttttataacgagggctagaaaagttgagttgtcagctattaatgccaatacctattaacaatggcaatgacattgaaatgattttttggatttatgaagggaacatgttactaatgaaaatagcaaatgaaaatggccactgtattagtccgttttcacgctgctgataaagacatacctgagatggggcaatttacaaaagagagagggtcattggacttaacagttccacgtggctggggaggcctcacaatcatggcagaaggcaaggaggagcaagtcacaacttacctggatggcagcaggcaaaaaaagagcttgtgcagagaaactcccgtttttaaaaccatcagatagtgtgagactcattcactatcacgagaacggcgcaggaaagaccaacccccataagtcaatcacctcccaccaggctcctcccacgacatgtgggaattgtgggagttataattcaagatgagatttgggtggggacacagccaaaccatatcagccacaaaggagagattaccctttttaaaaatctgtggtttgcccacaatgttttccataaatttacctttttctgtcaataaaaatgtttaggaattctatttatggatatgtatgtatttaatatttgcatatttagttcttattttttctctaaatggttatgacctgtactaagtaaaatcaaaacacacacacacacacacacacatacacattgtactagcagacctgctttaccttgcttgggataattatctgccatgattaaataaataaatttctgcaactgtttatcctggaatacactgcatagagttgtcagtttgagaagcaacttgatttcaaatctgagtctacaattttagcgtgtttccttgtgacttctagtttggggcttttaatttcccttttgctctctctaccctcagtttatgaacgagtgtggcatttcggcagttgaataggcctatggtagcctcccagtttctgtgttgtagaggatagttgccggcttattaaatgcccttgcaggactctcagggaagtctgttgtttagtgaatagtgatgaatcaatgtggatttcttagttttgacaagtgaaccatatggttatgtaagatgttaacattggggcagggtttctcaaccttggtgctactgatgctttggcccgaatcattctagttctttgttgtgggaagctgccctgtgtgctgctggatgttttgcagaatcctggcctctatctactaaatgctagtagcaccccctccccgccctccccctcccccccccccccccccccccgcccagttgtgacaaccaaaaatgtctcccgtaaaagataccaggatgaaatcactttttgtcagtcccaaactaactagagccagggcagcatgaaaggaggagggttcatggttacatgcctgagataaagactgtctcaaggactttctaaaatcgccccacaagaaattcctctgttaggactgcagcagtgcacgtaatatgctctcaaaagaacatctgcccagtaatggcatccccactaataaactgacaccagttctggcgttgagcatctgaaacgaactatgtttccaagcagcttatgtaaacttctgtttttaccaataaaagtttccctctacagtctcctcttcagatgcatcttgggttgtaatcctcatttctaattccaaaataaatttaacatatttggcgatgtttttctctgatgttttttggtcgacactccaaacattgttatatttcctctggggtacggcatcatttccggttgagaaccaccgacctagagaaaagctatctgcctgtgcagttcctttcaagggccccaagtgtgaattttgtgtatacctatattttaagccagatcattctgtacataccttctaagtccagatgaagtctgttagccttttatgtgtgataccatcacatagaaaccaacacaaggacatttactgtaatcgataaaggaaattttggacagtttgagaaagtaacttattttgtcttctgctctttataaaatctttacaagtgtatgtttttgctcttcaggatgactaggcagctttttaaaattctgacttcatacagattttataatcttccttttatttcttgcgatcatattgcagttgaattcccacccactgttcaattcagcagattttaacagagactccagaagtatagttcctgtctttaattaatctgcaatttaggaaagaaattaaggaggtatcgttctgtattgtttccaggatggtggtttcttgttatctgagaattactgggcacagtctcttgcccaatgtttacttctctatatagagttgacccttgaaaaacatagatttgaactgtgtgggtccacttataagtggatcgttttcaaccaaatgcgtatcgaaaatgcagtactcaagagatgtgaaacctgcggatatgcgttcagctgggcctactgtgggacttgcgtatgcgtggattttgctgtatctcaacagcaaaatccccgtgggagtggggctgcggcgggccaggaagcaacccctagcatatactgagggatgactgtactaattattgtagtttattaagtgttcacatggttttcacaaacctcacaattgaaatgccaattgccttctcctaaaaaatacaatgtacgtgttcatggtagctgggatgcagggcttgctgagaaatacttaattgcatttcttctgtagccatgaattgattttattaccttgagagaaaaatgagtattcaggtggacctcctggcaggcggttggcccttcagtgtccaaggatttatagaaagcacaacatcaaagaaatccaaaagttcttcggaaccccagcaactctcctacctccaaacttgccatgtaatgcccttttaaacttattatattgataggtaaatcggtttgctagaaattccagatattgagaattctttgtctgtgtaccttgttatatttgtataaaggtgatatttgtatgaagccaccctccagtgtgctgtaacagagcaatagtaatgacaactgattccttcccctagcttttctgttatggatagttgctggcaggtgaggaccaacagaaaaagaggagaaacccaacataattccaaactgtgaccatcataatggaaggagctgtgatagctttgctttctgtgtgtgcatgacatagaaggggaaaatggagttattgccaaaacaacagcaaaagcaaaacaaagccaacaaacaaaacaaaacccagggctaaatgacctttccaagagattttgcttgcatggcttgaaactggtgtttagagatgaggacaaggtcacccttgatactgagaggggattatatctgagacttatatgtatctcaacaaataatggtacttacaaagattatctcagtccagtgaatgccatcatacttatcttttgaccttaataacttcctgctattccaatctatccctatatatttttttctggaatgatcgaaatgtaattttagctgggtttaattctagttctgttaggtctttacagaagcttgcctggcttttaattctttccttcttcattgccagacaaaaggagagggaatataccactaggatacagagtagtttgtcataaaaatgaaagattgaaacagaatgagaacgtgaatccccgtaccttgtcttcagtctgtcagttggcgtaggtgagcagttttaaaagagccaacatgatggatcttgcatcttaggggctagaaatttgagaatgttcaacctttaagcatagaagaatctatagttttttgaaagagtagaacattctacagcctcccttggtaattcacactaatgctttaacaactttcagcatcaggaaattcttccatatgagctacagcctaaattcttcatgctgcttaagtctgtttcttcttgttctgtcctcagtggagagatcgaacagctggtcacaggcccctatgcgagagccattcacataattgaaaactgttattaaatcgccccttcagaagtcactcttgcttgttctctctctctctctctctctctctctctctctctctctctctctctctctctctctctctctctctctctgagaatctgggaagattccagagctgattaacatgttgctttactgatgaccttctcagcttttaatatgttaacgtgctctaagaattttaagaggcagatataatgtgcactgtttctttcattaatttgaccttctcgtgaagcattttgctggacgattgatctgctggacatactgggaaacactgactcagagattttagttgagtaggaaccgtgtgtgagcctacggtacagaacaaaagaaagtaatccagttacactgtctggagaaatagaggtacattctccgcaatcatatttgaagaatagttttctaaatgacaatggcaaactaagccgtgtcatatgaagaagaagtaaaaagaataggaatgaagaggcatggacagataagacagctctggtaaaatatttaaagggctgttcaaagaccaagaacttctgggttgctggtcagatggataataataatgacaataacaatagcaaacatgattcttgctatgtgtcagacacggttccaattgcctttcatttgctgactcacgtaatcataaaataactctatgaggtaggcactattaatatttccagtttgtagcagagaaaaagtaagacacagagagataaagttattttcctaaggtcacacagccagtgagtggtgaactccagtggtttaactctggaacttctatatgctgtgctgatggatttcagctcaatgtgatgcagcacttttgacaggggtatctggacacaggtgttcaggatcaccttctaaggatgtttcccagctctctcacatgggtggtgtagtggctgtaagcacacactggcatgggtaagagtttggactcgatgaatgctgagtttggactcagtgaatcctgaaagtcttacagctctgtggtgccatgccaaaaggatgaatggacttgcatgatctttttcatttttagattgcataattctttataaacttttttttccacaaagtacctctgtgatggaactctacacagagaaaagtgctcagcaacagctttttaaaatttaacttgtaagttcaggggtacctgtctaggtttcttatgaggtaaacttgtgtcatgggggtttgttgtacagattattttgtcacccaagtattaagcctaatacccattagttattttcctgatcttctccctcctcccaccctccatcctctgataagccacagtgtgtgtttttcccctctatctgcccatgtgttctcatcatttaactcccacttataagtgaaaacatgcaatacttggttttctgttcctgcattagtttgctaaggataatggcctccagctccatccatgttcctgcaaagaacatgatctcattcttttttctggctccggagtattccagggtgtatatgtaccacgttttctttattcagtcttccattggtgggcatttagattgattctaggtctttggtaaacagtagcatttgatcggaagtttgaactgataccattttgcagctaggaaatccaaagttaaacagtttattatagtgttgctaaatttagaattaggggtaatgactggagtgctgttgaggtgatcagtgttataagccaaatgacctgtcagtctaaaccctcctgcctttctatctgaaatgtggatatgtcctttattaggaaaccacattacaagagaagcaacttggctttgcagctcaaatacccatgacttgtgtgatactaagtattcccatgtcatatattcaactgaaattggctgtggaataagtaatgcttcttggttcttggcaaaagcaaaggagaatcatctctggagaaagcacttttattctaggctcaagcttttatttatctctagaaaatattggtaaggtcagtttagtacgtggtaaaaaaaaaaaacaaaaaacatattaagcacacaagaaatcaaggtggaaaaagaaagaaatcaaggtgaatgagaaccagaagaaatagcaaaccatagaagcagacctacgataacatcatattccagaattattagacagattattttcttaattgtgtttatgcagttagaaaaataaaaaacaacattgaaaaatatctacagggaaccacaaacctgagaagttaccttaaaaatgaccaagtagtatttctagatgtcaaaagtacaataatcaaaatttaaaactgtatgggtttacagcagaccggcaagagaaatggatacccagacagtaaggcagaaggaattaataagaatgaagcacagaaggatgttttaaaaagatgtggggcagagaggggggaactagggaagtcctgttcagagaaatatagattgaagaagagtaacatttatgtaacagagttctgaaagtagaatggagagggaatggagaagaggcactatttgttgagagaatgacggagaagattccacagctgattaaagactctaaatcacaggtttaagaagtccagtgaatcctaagcagtctaaatcaaatcctagaaacagcacaagatagaaaacagatagattatctttattttttttattttatttttattatactttaagttttagggtacatgtgcacaatgtgcaggttagttacatatgtatacatgtgccatgctggtgtgctgcacccactaactcgtcatctagcattaggtatatctcctaatgctatccctcccccctccccccaccccacaacagtccccagagtgtgatgttccccttcctatgtccatgtgttctcattgttccattcccacctatgagtgagaacatgcggtgtttggttttttgtccttgcgatagtttactgagaatgatgatttccaatttcatccatgtccctacaaaggacatgaactcatccttttttatggctgcatagtattccatggtgtatatgtgccacattttcttaatccagtctatcattgttgggcatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttgcaaaggagcaacagtcatctttactattgacttctcagcagcaacagagatagacgaaagtggagtaatatttcagtattcaaaaacaaaataaaaacaagaccccaaaacctttcaatcaaaaattttatacttgggccaggcgcagtggctcacgcctgttatcccagcactttgggaggccgaggcgggtggatcattttaagtcaggagttcgagacctgcctagtcaacatggtgaaaccccatctctactaaaaatacaaaaagtagccgggtggggtggcgtgtgcccatggtcccagctacttgggaggctgaggcatgagaatcacttgaacccaggaggcggagattgcaggagccgagatcacgccactgcactccagcctgggcaatagagatagagtcagtctcaaaaaaaaaaaaaattgtatttaatgaagataactatcaggaatatggattttttttttaaaaaaaggaggtattttcagacaaacagagcttgagaaatgcaccaccaacagctaaaggaaattctaagggacatatttcaggcagaactaatcccagatggaagatttgagatgaaagaaagcaatgaagagcaaaaaagtagtcaatatataggtcaatctatctaataatataaaaaattaaaacaatcctatagggttgaaaaaaacaaggtataattaaaattcatgaatatagtaacatataaatcaaatggtggtattttgagattgttgagatcattgtcctgtctgggatgaattgtatttcttacatttagactttgaaagagagagaaatagagaggcagacagaatcaacagggcatcatgaaaacagcgctaagccaggaggtttggattctattatcagctctgctgctagctgtatggcctttgaaaagctccttttctggtctacaaaatcagtttgcttgtctgttagatgaggctttggaaccagatgaattttaaagcccctcattatgattctatgagaaacagattctctagaaaaaaaaatcagttgtccccctcctttgaaattttatcagtaaacacctgcatttcacttctggctaacttttatgtatcagttcaaaaattaaagctaaataaagtctcgctcaggtgtgtagtttgcttacctttctcgtttgttggttttgttttcttttcttgtcatctagtagccaaaaagagtaatggcagtttaccaaagccttaggagtgggtagctctttggatatcagggagcatttgcagaaacaagctgtgaaaagccagcctagctttgcaaccattgttctttctatcttttctgtttaacttattaatcgaactgatatacacctcctttgccatcttgccttctttcctttcatccttttgccctccttctctctccctcctgtctttgcaggctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtattaggaaccaaaaaaaaaatgtcatttttttctcatcatttttcacctttttatgacttgatcttttatctcctgtgccagttgctgttagttcgtaccgtctccaaagtgggagagaaggtgattgggctggaacatcgatcattcctgtcaccctcctgatcgctaggttattttggtggatctcacttattaggctggtgtcccttaccaccttcactcttcagctcttcggagccacatttttggttgagcaggccaaagtgcgtgtcttcacggaggtattacagatgaactgtacctcctccttcctggaaccaaaacatttttaccatctttcctttttcacggtctttcctgtttatagaaacttcccaagaatcagttataaaactgagagatgattctattctgggaggaaccataatagtagctcagtctctcattcactttgcaccatttttttttctcccttaagtaacaagaattgttttcagcatcttagaacttgcttctttatctgtgaatctgattacattctttgtatagtatcccagtgaacttctaaaggaataaaaagtaggcaagtaaatggaagattcacaaagcagctaaaaaacaaccagtccttatacatttagaagtgaaagagataggaaacgtagcaggttattctgatagtcttaaaatatcatggaaaacaaggccaaataaatctttagccctgctgacctgtttggggagacaggatttttttttaaatgaattaatctcacttaacattaatcctaaatcctaattctgaaactgcgatgtccttaaatgtgtgaatcaacatcaaggtttctatagtgatgaataagccacaaagttgtaaactagctctatggtctatgcctgtgcagaatccacttagcagcaaagtaaacactcttttccagttacgtgtgaactggttttgttactttattttctaataactaccttgtactgttgcgtgctttttattcatagtgcttttttacttttggtgtttattgttccatagtcatgctgtttacaaagaggttttacaaaaacttttagaggtttctgaagcctagatagacaacagtgagtaggtactgcttgcaaaggtcaccttctttccttcccggtttcttggcaggtaaaaatgataccatgggggtggggagtggggaagggaagccacagtgactgcattagatttctaagctaccttttctctgcttccttagctagtgggctttgtatacaagggaaatttttataaaataaagaagaagaatgccttggaggatctgaaagagcactttcaccttcaattcttttgcccttatcatattatattattttaggacccagcacttctcattcctcctgtccccctcttgaaagatggctggaatctaaaaaagatagctttccttcccacttccccatatgtgacataagaaatatgtttatttgaattggctaaggttcttatctgagaaagcaaaaggcaggagagtatgaaacaaagaatatcgcattctgataatggaggaaatgtaccaactagtatttacagattataaattcttccatctaatccaaatttcatgttctcttggggcttcagttatcatttgtaggtaatggggtgagagatttctgaagagatagagataaaagagttcattcgagtaactgtttgaagatgaatcgtatcagtcaattagaaaacattattaaagcgagacttgttttaattgaaagttcttgttcacatttcttttgtcttgtgaaattgctttatcttgacaatgttttgaaaataattgcttcagaaaacttttgtcccatgatgggtaaggggcatgcacagcgtaagtctgtcgctcctggaagttcttttaaatttgagtatttggttttcaaaagactggaaattttccagtaccttcctacttaatctcaaagagttcctagtggagtttaaataaaagctgagtttttcttccctccttccatatgtttataggataatctttctgccaaaatgttttggtactgtaggagaggcaccggaaaaatctggaggcagaaagttaatcacttaccttgtgggactaatgaacattgctttctgtttctcaaattagaacgtggtagaaggtttattaaagagtgttctttgggaatttgattcgaagaaatacatacgtgtttgtttttgctctttatcaggtacaggagtctaaagcactttaattatgacatctgccaaagctgctttttttctggtcgagttgcaaaaggccataaaatgcactatcccatggtggaatattgcactccggtaagtttgacgccagcctgacgtgagagttagttcacctgggataaatttcagttttgtacaatactgcagatcatgtataatgctgtgatttgtcacttccccagatgttccccagctaaagtggctctcaactgtaggcttcaggatttaccctatccctggtgcctaggggagtgcctggcacatatggaacatgatagaccctcaataaatattgttggatgaataaatagggttttcattctgtgtgcatggttgtattgaagacgttttcacgtttattttgcacagccttagaggttgtgtggggcgatcttatggccatgaggcatgttgagtatgggggatggttctaggttcccccaaattcataaactaccacttttaatcaatgttgctcacctattatctgtcctgtatactagtgacattttaaaaatccattttatatgctaacacttactaaatgctaggcatttaccttttaaactaccctgtgtaaaataagtactatgatttttatcccctctatacagatgaggaccctgaggtcctgaggttaaataatttactcaaggttctataagtaagagttgaagccatctcctaagatgttattttaggaaaatgttaagtggccaatagaactgtgaaaaatcactagggaaatggcaaggatgtagacttggtggccagacagacctgagtacaaatctgcctaagaattaaagacaggctcctctcaggtttgttttttctaaaataaacctgtccctgttgactgtagagccacccttcgtgtttctcttctctttctttaattcttacagtctcctcttctctaaactttgcatgcttgctattcaagatacggtctgttgactaatcatcatatgtctattggcattaccttggtctttattagaaatgtgaaaccacaggccccaactcctgatgctctaaatcaaaacccacattttagcgagatctgcagctggttcccatacacaacaaagtatgagaagctctgctttagagcatctctctcttccatcatcagagtgatcctcccagatatttgcctgtctcacttttattcctcttatagagatggtcagtgattgagaatgtaccatgctatgaatagaccgaaatttagtgggtgaagcatgctatcattttgtactaagtagtttttaaaataccataaagtgtggtaaaatttaatgtcacctttttgaccttaagacctataaactaccatttattgagtagcctagtaagcttgtatgtttcttttatttatcataacaacgtgttgaggtgttgttgctcccattttactgatgatcagagcctctgagaagtaaataactcagccaaattagtacatgccaggcctggtttcagagccccatttgtctgattccaaagcctttgctcacaaccacaacactctccttaattacaaaacaagtgtcatggggcagaagactggagtggtcattagttttgaaatcatcctgtcctaaatctgatctcaccatgatctcccttttagactacatcaggagaagatgttcgagactttgccaaggtactaaaaaacaaatttcgaaccaaaaggtattttgcgaagcatccccgaatgggctacctgccagtgcagactgtcttagagggggacaacatggaaacgtgagtagtagcaaaagcagaacacactcttgtttgatgtatatttgaactcctctcagctgaacaccctccttcactcccaaatgcaaacagtctcttctatttctttctttttatttacattagctgaaaagagaaaaataagctgatgtccagttgccactttcccacgtcacttgacaatttctttttccaaaagttaaactttatctcacagggggaaaaaaaaaaaaaaaccacaacacaatacagccactaattgccttacaagccttataagaaatatgggactgtttacaaatgagtgattccagtatttcattttgattttcctctctcacaaatcagtaaatgtgtgtctttttgtatctcattgtgtggtcatatctagtcacttgtttctactcaaaagaaaatatagtcacaggaaactacttcacagtaagtagtaatgattctcaagatcaaaggggacgtcttcacctcttttcaacctgctcctcttttttgccttaactctgatggcagtcacacaactgtgtgtttttcttttaattcactttacaccttggtttggctattgctttccatggttcatacttaattggctggattttatttattttgacctttcagtaaatttttttgcggctgagtttgcgtgtgtctccttcaccacctcattttttgttttgcagtcccgttactctgatcaacttctggccagtagattctgcgtgagtactttttttgctgaagggtgctgctaccaccaacacattcgctcgcttggttctcttttgttctgtttatttgtttgttttcttttgttttgttttgttttatggacatattaattccccttccttcatttcagtttttttttttcttttcttgatgagactttgaaagtaccatctacacagatcaggagaatcagagtgggttttttggttcctccaccaggtgaaattcaaaccagcagaaatcctggcttgaattcaaattataatcaaagaagttattggagttttagctgtattcctgggagacatgtttatatatttcttcatataaaagcaaggaagaagcttctgattacataataacattctttagccatatttcttgagattcgatgctttttagaatctttagggtctgttataagtggactattaaaaatcagcagaattcgttttaaagtatgatgctgagtttggttgaataattttaatgaggtgtgcggactgtttatcaggttatgccatgctatttgactaatcattatatacaagggtttctaaattttgaactaaactcactttgctctcctctccaagctaaatattcagctcataaacaattatacatttgctctaggaggaaagtatttctttgttattactattggtgtgtattaataatactgagcttagataccagcagatgatttatctcagagtttataatgctagaaaactcttttttggggcctgtgatttctatattagcaaacaaagtgcctattttaaaactacattatgtagggttgttataacaaacttttggtatttcaaagtatgctttattaaaatatttattgaaaatcagacagctctgttatggataaaggggaaatgaccaattcggaagataagcttgtgtaagaattcaatttctttttattaaatcttttttattgttccaccatataatttaatctaaactagatccttttttaaaaaccctgtcgtgataaatgcatattattaattgaggtttattttcagtctttaataggcctaaaggaagtggaaggctatgctttcctttttaaaacttcgttattgcgccccttaattttgagatatggtagctataagtagtatattatctgatttatttaatcatcatgcttaaagaacttagggagttatttaggttcagttatgtcctctgcctcttggaaattgtgtttcctaacccaggtagtctgttatagaagttacaaccgttcataaataagaaacttttaaagagttgatacactacagtttcagcttgattggatcctgataagggaatggatttactctatgtggaaataagtttaaccgagtaagaaatccaaacgacaaatatgctaaagaacagttgttacaaatacatagataaaagtagcaccaaataataaacaaagagtaattaatagtccttgaaaggcaaaaaggagctacacgtaagctaatgagaaaaacattatgacaatcagattaacttattttaagtagaagattttgtctgtcttaaacgttgaaagactttaaaattaataacatcttttatttaaaaatattttctaacaactaaaacacacctcccaatttgcctttttatgaagagttggttagattattcagaaatagtgggaagttttaattttgaggaagaaaacaaatctagcagactgaagtctgtgttttctttaatagcagtaattgtatttaaagtatttattcataggattataaatactgtataaaatatattacaaagccatcctattcaggcataagagccaggtcctaacgtgtttcattttgcaagacttgtatctaatgttaacaaatcctatgatgattacaatatttgatccatttgatatggatcacagaatttgaaagtttccagagatacagaccgtttggttttccttagactaaactcttatttgcttgtgtttgtcatattactttaaaactaaagctaacataggcctttacgttgtctgtccataagtgagccagtcaaacgatattctttgagcgattctgcattgaaacctaaatgaatgtcagcttttaattaatagagttttcataaaagagaaggtggtggtgggtgggatggaattgaccaagtaggtcattaactcttatagtaagtaatccttctgggtatatggttttgtgtttaggaagtgggaagcggggaacagtattattaccttcttttggaagtgttttagaaggctttgcacttagttttgtttgtggactaagtggctttgtattttcactaattcttggtttttaaatgattcatctctgaccagtactcccttttggctcattttctggtttaataaatgtctcttttagtgtatattttttaagatttctggttattgtaagttcttgtgcttatgcatgctgtgataggcgccactgatattaataagaaaaataacatggaattatccttgaggcaaagaattaaagctctgtataagattttctgtataaaatggtattaaagtattttggatttatatgcctacttttcttggtgtacttatgctccaaggtcttaggctttcattcttgtacacacttccaggatagcaactattacaagggaaaacactactaatgtattttccctgatggtaggctttttgcttattaaaaaaatatgtaattgaaagactggtctgttccaaaagatagttcttataatacaaataatccaagtattaatttatcttgatctgcagtgaagatttcaaaacagaccttagcatttttctaataatgggctatgccagggttctagaagattaacagattaactctccaaaactatagtgaagtttcacatggaaatctttggatctgcttattaaattgagtagtcatcgttttgtttcctcttgacaatttaaacgtctttataactcatttcaatttgattatgattacacttgacctagatgacattggtttcataaataagacctttctctctcagggaagaattccatttccctagttatttgctatagtgtgtcgtaattatcttactgtagtatattaagaaatatgaatttctggcacattttctaatgcaagcttagctactggtaactgcatctttttcttttttaatgtaagaagaaacaaacacattctccttagtgtttcaaccaagtccttcaacgctacttggacactgggctaaaccagggtcctctctgaattacattatcgttgacttttggatttatgcctttacctaagggctttctgtgtcagcagagaaatggaagagaccttttgtgctattccaattaaaagaaaaagtccaagcctaaactggttttcagaacagatggttttttttcctaaggttaatccaaaagatactataaaaacttcaaggataattaatagatcagatatgaaaggatgaaaaaatgttaaccctaccagaattctagcctatggagataagaaaagataggtgtttatatacaaaaagcatatagactattcctgctaatgatctcctcttattttctcacctatgttttagcacacagtatctctaagaaatatttcagatatcatgacgttctatgaaatttagtcattcttttttaaaacctcacaatataatccagggtcattctattttgtgctagaaattagtggtatagtcttgctgctgaattggaagatacatttcttctttacaaaattgcatagatcaagacatcttgatacatggagttttaagaagtcttgtactagagtagcctctttgaagctaaaataattgtaagtatctaggcagatatacagctttgatccaataagaagatagcctataaatggcgcaggtgtaaactatttaaaattttaaaccacatagggctaacacaatttcggaattataggatgtgagaaattacaaagtaggaggacaaaatgcttcctagaaactgtctcccccaaccttttctacgatgggaattttccagagaagattttggcctctcttcatggcttttaataaaagcagaagtatgagaaatcatctctcaatcctggattttaaaatacttgataatatttaagatataggagcaactaaatgtatacattatccatagaattagaataaaagcattctaggccatgtgtataacataactgtgtggtgggttttttctccattaatggatggtatctgtgactaatcacattttctgccttataggcctgcctcgtcccctcagctttcacacgatgatactcattcacgcattgaacattatgctagcaggtatgagactagttgtatgccaggcaaatattgattgaaataactaaccaaggaaagctaacctatgatattttaaacaaatcttttctttttttccccaaacttgtctgattcctactaatcaacttgccctctaacgtgcatgccgttccactgcatgttgtttttggtcaccaacaagagcattagtccagaataatcttccctaaccctggcttttaaacatttccggtagccttgctatgtttttttatactgagcacatttactaaattggcttacaaatagtttaacctccttagaaaactgctagaccagacattcatatatgaaaaaatgatactatattatatggagaatatgaaagcatcagctttccgtttgtgtatttattttacatgatatgctgtaaagaagagaataattaattttcctaatccttggacttttctgtctcaccttctttgtgtttgagatgatttttatacctaaaaactgaattactaattttaaaatattttatgcttgttaaatccgtaagagtttggttaacttttttagttgtaaaaaaacaaacaaacaaacaaacaaaaaaccccctgtataattgcctgaggtgaagaagattttaaaggtaaaaattggtggcagaatgtttagagagcttactgtgcatccatcctttgtcaatattctaactgctggacatgtttaccaatcgtgaaaagcattagctagctgtgtaagtctgtcatcagtggaaagtagtaattgtcctaaaagacaaggggtagtgtaaggtagggagtgcacttattgttagggaagcttttcttctgaaaacaaagacctgttctcagtgaaagcaagactgatctgtagggggaaaacagtgaaatataactttccttagaatttctatcataaatgtagtgctactaactagctgtggtctaccacacactgcctcaaatggttaagccaacacacacatcctttaatttgaaggattcctttctcttcttgccatgatttatcctttagttttcaggaatgttcgattaggtcttgaatagattctaagacgtcacataagttttaatgagcttttacgttttttatcaggctagcagaaatggaaaacagcaatggatcttatctaaatgatagcatctctcctaatgagagcatgtaagtatcccatctctttttacaaaatgttcctgacaatgaaattgctttgagggatttagaggtaggatagcacaggatataggaattagcatcatattcatttgatcttttaaggagccattcatttacttttttcctttaattcttaatgccctggcatggaatgagctcatccaaattctggcattattagtattcagagtagcaaaaatagtttgccttactcttatttgaacttatttcataccatatgattacaaattgcagagtcccaagtatttatagtaatgcttaatctttgaccaaacctgccagatatttaaagggataggatattaattttaaagtcatggctaagtactattttctccactcatggggagtggaaacgtgatcttggtatagcatggctattcacatatggtaggttagttgggcattttccttcagaaatccaaagaagtagatttttgtgatttagcatcttcacaagataaataaagtgaggcaatcttatgaagagtttccagaggagaagtaccaattcaggttgcaggttgttagcaggatgataagccaaccctgttaaactttaaggacggagatagagcggtgctaagagcagcagggaacacagctatggcagggaaacaggcttcattatagagtgagggcagtgttcacaatacagagcacaaaggaacattgccatgaaccaagtaaatgctgaccggggcttgaggtagagagagcagacattgaagcaaatatgaaggaaaaaataaggatttgccaagtgaataaataacataaagagaagaaatctagtcaaagtattacgatgcctttttagtttgataaagtaaggatatctcacccatcttggagaatatagacaaagggaagaatggtaaatttatcatatgtagttggtgtggcaacacaaagtcatgctcagatgagaaaagaaccttcataaggattaggccaaaagaaatagtatcaaagtggcatatatataactagttattgaagacatgagaataaataatctcatctggtacataaacgatcaagctaataataaagaatcaagtcaaccctcagtcatttgtatatgacttacttccttcaaacaaacaaacaaaaaagcctttccccaaccataactgtgatgccttatctttcttagctatgggaaaaagtattaatggtactaatatataagatacttcaacagtaaaatgtgtggccaaagaatcagccaaatgtaaatagcttgtgcttctttggctcactgattttggtattagaagctctagcacattcagattaattcgagttgtatctacgtaacagtggctgtcattcattgactgcctaagagaacaggaagaaaagtgtagttacaactctaggttataattaaacatgggaagttctagcagtacaacttcagaatttggaatgagtgtgataaattaggtggtaaaactgcttttgttttattttaaaataagctttagcttattctgaggacataaaatccattttgactcaatgttggatggcaaaaactcatggcattttaggggcaggtttggggaagtggtttggtggattggttgacttcacttaaatgtgtgtttttaatacccaataattatttttagtcagcttttcacatctaaaccaggtaactggcttgataaacaaaaataattcaaatgagaaggactttttcctaaatttctgatatttttcaacttaagtgggtatggagaggagaatattagcgtatcatcttaatgatatctaaccagaaacaatgagctttagcctgtcattacggacagaagaaaattcttataacttggaggtaaacaggcctttccggagcttggagcaatgcattcagaaaaaagtttgtcctgtgtattagagagttcctagtttccaggaaagattgtagctgcctccccaaatagaagcctttttgcctccttttcccgcaagattagtccttaaaaccattatgtataaatttaaaaataaataaaacttgtatttaaaaaaactctgccccgaggaatgagatgttcagtcttcttttaatcagtcaccttaatgtcttttttccccttaattttcgttcttctgtctaaacaataactgaatgaaacaatcatgtatctccagtttaattgttgttgtcattctgcctcaatgacttatataagttaaaactgacttactgaagcaatactttttggttacattgccttccacttaataaaatatttcctctgttacttttagagctgcaaggtattttttcctactcagtacaacaatagcgtgggttagtgaacagattatcttgacaggcttggtggccaaagcattatacagccattattatatcttttaatattttttagctattgactaacatcaacgtagagtcccagtatttctgtaattctgcctttcatttatccgtgtaaataggccaatcaatttcatttgaaaatctgagcaagaaaacactttgaattggtaccagtagaatggtagatcacaacctcagcagtatcaaaaggtctttagaagcaggaaaaaaggtctaattaattgttaagagcaaataaatgtttctattttcaaatacactcctgagtccctaacccccaaagcaaaataagggggggaaaaaaccaaaacctttgattttattttccagagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggtgagttttctttctagctttgtcattggtatgcagagtgcatacacttgcacacatagaaaagtgccaggaatcttcacttagagtcattttatgtctaattgttttctaaaataatctgtttagctccatttgcagattctctctctcttttttttttttgttatctgaaagaagacaatggatgcaatagtatgatgaagaactcatattttaggtgtgaaggagttaatgctgatggtggtatttgacttgttgcatgtgtctccaaggctttgattttatatttcagaatagaatttaagaaaaaagtaggttatttaattttatgattatatgattttttttacatgtgtttggccatattatctacctcaaacatttaagaaagtagggttattggcttggtcatattgggaaaccaattgtttcatcttatttttcatcatcaaatgcagaaattattatttatgctcaccatcatagcaggttagtgagacaattccaattgtcagccatcacctgtaaaagacagtcatgtaaaaatagcagaaattgtagaagagaaaaaggctaaagaactctcataatgactgcagggaggacaaagatgtaaacatctggggtactgtattgtgtcaggataatgcaaatcattggactttcagttctgtattacatttattatgtcacaggtcccttggtttaaaaagtcttctcacatgatcacttctaactcacaatgtgccttcttcagacagatgccaccaagcaaggatttaaagtagatgttgctcagatttgtgggtcttaagtactttcatctctttggttgagcccaaggcaccaaaagctcttaacgtaggcaacgcagtgtgtctgagatcagtgccctcgggagtatgccacttcaggatgaaaaaacaaactgccactcttccattgcttcctgctgccactgcgagccttctagctcttaacaccttttacctatggccatagctccttatctggttggcttccctttagtctctttcccacccttgcaataaatcctccatactgactctacttgtacatcttgccagaaccaagacccatcatggcattcccctttcactggatttctgcatgtagaaaaaaatcaagcttcttagtggggcgttcaaacccttccacaatattctcttgacttgctttttctatgccatcttcttttgttctccctgtgttctggctatgctgttgtagctagtatttctgaatacatcctgctctcatctacctttggggtcaagctcaagcttgagtctcagcctaactgctaacctctaacccaccactgccgtatctgacaaaggaatcccacctatcctccatcacactgctcaaaataactttccccatggagccctgctagatccctgcagttggaagaaatctgtcttttgcctctattcccagagcactttggacctttctcagaaaattccttgacagttttcctttttatcagttattaccagtgcctctctttaatgagctagtgtgtgtctttggggcatggactgtatcttaatcatcttcatatcctccagagtacttagcatggtttgaatatttaatggctactcaggaaatgtttgctaaaaacctgaaaatacagcaagaacatcacatgagtaccatccacgagataatattgaactttttttgttgttttaatgatagctttatttttggccgtacttttgagatcatttgtcagtgaagaccatggtagagaaaacatttctactttattgagaataatcagtaatatccatttatgttaaatctgtaattattgtaggggtcaaagtcaaatcggaataaaaagttggaactgacactgtaaatagaatttgatgttaccaaggagtaaatatatttttgaagtatatgatcgtgtaatatatcttttgagctcattggtcaagagccctgcctcgtttgtggttagcatagtctttctccgtaccattgcacccgggtcaaagaatgtttgtaaagagtactgataactatcatttatttatcattttatcattttgagtgcacttttacatattttagatcatttaatcttcttacaaacgctatggagaagagactgtcgcctttctgtgaatgagacacaggttcttagaggttcacacagcttgccccagatttcccagtcagccagtggtagaactgaattgaaatccagatttttctgactctaaataggcaactctgccttcaaccagataataaagaagagtaagtctctgtgaatgtcatttacatagaattgcggcatattccccagaatgtgccttaacttgagggactatctatgaggactgagtgtcccggaataaacctgttcatctacttgtggcacagcgataaccgctttaccctggaagatatccaagaccattctccaagaatgggatggtttgttctctaaaagaacaaaaaacataacaccaggcctacttagagctccaaaatgaggactctggggttgatgcaaatctttgtgtaagttaccttgaccttcacgaaatgatcaggatgagcttccttcattgtcccttcattttgtcctatttgaccttctaccaaattccaaagaaatgtctccacagagttcccttcctgaaaacagcccgtgtgttttctttgatctgccctgtcctgtcttcttgcagttctgcgcaaggagcttcagagccctagatttgccttcgctacccttgaattcagtgttgcttaaggagcctttaatttgccatttcctgttgagaaaacccaggaattctttagatgccctctctgtgcatgtctagctggctatgtcctaagtcagcattgggctacgcaatctgacaaatacgagcatacttttagagaaaataagaaagtatatttaaaattgagattgccccaagtcctttggatgtgtacttattgatctgttaatatatatattttatgttcctttagctgtgatttatctccaaataacagcaaaagagagaggcctggagagccccattcctgactagatatttattaaattccattaattgttcttattcatgacacctccctacaaccccctagaaaaacagaggatggctgtttgagaagtgtctcagaggtatcttatctctgcctttagaattccatttctcctggttgttgcacatagtattcaataaatatttgttgaatgcattaatgaataaatgaattgaagctgaatttattttaattgtagcatacatgcatgcacttttgactaaagttcttttacaaacctaatttcgtagagaaaagcctttcaaagactttgttttctgcttgcttttcaaaattctcccctttttcaaactgccttgattagcaccaggcatggctttgtcataaatttagaatgttaagaacccgttttccaaatcacaggcactgtatgtatcccacattggtgttctctgattcttggttgatgccacagagataaggctaaagctctgagtaaaagctaaatctgactgagtttttcccatagtgcctcccataagtttggatgactaatggtgttagtgagatatctaatctttaatatttcgcttctgcatcatatttctccctcattaccacatataattcagatacatctttatttggcaaagagccactggatcttgggtttttgccccattgtgtgtccttagcattgcagactcaaggtttacttttttttcttgcgttgattaaagccttcagtctcctgacttaagcctgtagtgttcaaatacagagatgtatttgtctctgcactgtctaaataaaccaagacttgctctgaaattcaaggtatgatcctagcaatgaaaaggtagcctttctgagagacaaagacattgtcgttctactacctgcagagcaaattgattagattgttctcaagtcaacaaggtggctaaatattaacctaattcaccataaagtctaaagttaaagttgttagtagatgttatataacacgagggaactctgtagattcttaatacctactcaggacctttcatatgtcttgttgggcagtaagaccttatgaagccaaaatttgagttttctctttttcctttaaattcctccagtgattgtgcaagattattattgttacagtcaaagaagttctagatcagttactgataccactgaattaaagtagctggaaatcatgatcccgttgctttactttgtaattgacttgatgactttggacctagtctagtagctatcaatcttcatagctacgggaaatctttattcaatgttctttcattaggtctttgtgcaagtctccaatgatggtgaaaagatggccaaaatgaagggaatctgaagaggttaggaatgggcattcctatggaatataaacaaaggtgtcagggtgaggaatggcagagtttgtttgagggaaactgcagttgtattaccttttttaagaaggcaaagaatgagaggagatgaggctgaccaggtcagcaagggcaggtcgggaagggtgtggtacccactgcagagttgctgcctccgtgcctagtctagggagcaactcaagggtgtgatccaggagtcaggccatgatattgacatgaatatacgccacacaggcagctgtgcggagggtaactttgaaaagagcgatgctggaacgaggaaatcaagctggggggagtcacatgggagcccaggaaagagatgattagagccttaagtaaggtgatagaaatgaagtagacaggctgatctgagtgatatttcgggggaggatagagctgtttgattcggtagttctgtgggactagggtatgaaggaatgattcccagggctggtaactacaaaacaagatgatagtagttatttgcagctgggactgataattcaggaggagttgcagcaggtccatcctttaatgcagcagtgtttattagaggtccttcctgaagggctgagtagctggaaggtgataaatgaggtatggaagaggtcgagttgaggtcctggtgacatctccatgtgtaaatgtctgacagtctgagagatagaactctgatgcttgtagaaaggatataagcctgagatattaggactgtgagtcgccagctcacaggtggtagttgaaaccgtgagaatgaatttatatatcccgggagcatgtagcagaaggagaacactggatttggtagaactccggaagatgtgaacattaaagtgtgtatttaattacttttatttttagtagagaatacatgtatattattatacaaaatccaaagggttcaaaaagacatatagagaaaagtgaatccttctccaaccttctcccctggctgtggtgtttccagctctggaggctgccatctttcttggtttcttgtgtttccttccaaacatgctctctacatatgcaaatatttgcaaacatatttatggttgttggggttacttcacacagtgtcgtgcagtgttcactctggttttctctttttacttaaaaatctctaattttcacatgctggagaaatgtgccagaagaagaggagggcagagcttgggaatgatgggagcattttcccacaggaggcaggagagagaagggttagggaactaaagtatgggaggaggcgtgaccttgaatgagaggaaggactgcctctgaagacaaagtggtaggtaaggaatttagggtaaggaagggaggaaagaagcataatggaatgaatgttaaaatgtccagtagacatcactggaaataattcaagactgattcctacggctgttcccacatgtttttaaagttggagtggagaggaaagcgtggtatatgatacatttaacgaaactaggcattcaagttacttggtgtattagtccattttcatacggggcaatttacaaagaaaaagaggtttaatggactcacagttccgtgtggctgggaaggcctcacaatcatggcagaaggtgaaggaggaggaaaggcatgtcttacacggtggcaggcaagagagcatgtgcaggagaactgccctttttaaaaccatcagatctcatgagagttactatcacaaaaacagcatgggaaaaccccacccccatgattcagttacctcccactgggttcctcccatgatatgtgcggattatgagagctataattcaagatcagatttgggtggagatccagccaaactatatcatttggtgacatgggccccaaaacaaagggctacagagcccttcttgagacaaagggagctagtttgatcacagaaatcagaaagccaagaccttttatggcaaggatgaataagagctgaagggcatacatgccacatttaagaagctgtgtaagaatggggtcaaccatctcagctctactcaggcagggaggacaggaacatggtagaagtggaatcaccattattcacagactcagtttctaactagcagggccagtgtaactaaatttccttcagtttatccaaagttaattgaagtctgaggggactgattcatagtatgcagttcatggcagtgaatggataacccagaatgaaagtttatttctccctttatcctaattatctctctttttaactgccttgtattaaaatgttatcaaggttgccttaaagcttttttaggaggagacagcatctggtttaagtgcaaatactagatctattaaaatgaggaatatattcattttttcggcacacagcatcctgtgtcttagaatccagtgtcttaggaatcacaataaaaatcaaattgtgttctggtgagcctagaatcttggcatctaaaattggatgtttgtgaggactgcttcatactacaaaaaaattgaagcacccctctggcgattagaatattcacatcttacaagtacagctgccatctccctagaacatgctggataagagtttatgttcttacaatccaatttcccttttttttttttttttttttttagatttttcatgaagaccctcatcctcctgttggccttcatttgccaattgtccctctacagtagaattgattatggtcatgagtttctttagctactttccaggcctgaggatgtaattctgttcaattctgcagatagttactgagtgcttaatgtaattttaaaattatgagactacaaagatgaataagccttggttcttaccctcatggagctcaaaatttattttaaaaaagttaaaatagaaacaactacttatatcctactgttacaagtgctctgggggcacagaggtgaatgatttattctatcagagggagtagagaggcctttacaaagagagtttaagagttgaagactgaatgggagttttccagtctgagagatgggggaaggatgagttttccagactggtggaccagtgagtaatgtgtggcttggaatgaggagaataagagggcagtgggatggtaggtggggactactgtttaaaggactttgtgcatcatactaaggagtttgggttttatcctataagcaggtgaacagtgatggctttttgacgggggggaggattgagaaaaataactgacctggcagaaagctaaagccatgaagattggtagaagcacagtggaatagtccattaaaagatgccaggttcttaactaaggatgtcttaggcaagtgaagaaggggatggagaaattagaaggtcactgaatgaatgagaccaagggaaaatggagagggggaggcatctggtgttacggaaagttttaatttgggaactgggaaatgatcattgaaaaacaaacaaaagcaacctagtgcacccaggaaaaactcctgatttgcaaagggttagtgcatggagagaaagagctacgtatcagacatactgaattctatttgcccaaggacatttcaagtggaaatttcctatgttgattttacgtattcagttttcagaaaggattctttaaaaagtcatagcaatacaattcctgcaatataaataatagatcaatgaacatcatagggattagcatagttgatttgactaagcttcagattcagtttgagcttccctgtagccagggagataataggaaacaaagatttgtctgtctcttaatattgaattaaagaagcacgcagcatcctaaagaaacatcattgttttcctggctctacgtaataataataataacaaaaatagctgtcctttgagtgattgctatggacaggaactgttctgagtacatatgaactcctatttaatccttaaaacaaccctatgaaagagaggctgtttccagaggattacgtggcacagagtattaaggacacttcatatggccagcaagtaataggacctgtattcaaacttgggtggtggtcctgaactcttaagcagcgttacacttgaagtgattattggctagtgtccttatcaacatttttataacaaatcccaagggaaattatatgtggctgtttctcatggcctttgataattgtggaaagcttaacattaaaacaccaaagatagggtgacagttctccaaggataaaggtcactgttgcctaaaatgtattctgcagaataccactgagatactctgagaaaaaaaggattccaaggacagtaaaactttgaaagcactcatactggaaagtcatcattacgttagcatttgcactgaggagtttggaagtgaagaaacctgattagctttgtctaacctcatgttgctcccacttacttgacctcgagcccaactgcaatgttatatggaacacactttggtaaagaaattcaagtctgaagtaaactttgaaaaccagtctaggagatagcatagttgactctctactgtagttgttgagaagcctatccgttgtgtctctgggaacatcagaagataaagctataacaggtgcccacgtaggaagcctggatttttcgcacaaaagtaacttttcatatgctctagtggtgaagcagttaccctgtagacccagaagccagaatgatttagtctgaaaaatctaaagataggtattaaattaactctcatgatcatagaaaattctttgcaccatttttgtagaatatcccaccgaataacttggcttttcacccaaaccaccaagaaaaattgccaccagtgacttgatgcaattaacttgctatcgggagttctttcttgtgaaatgattgaactttgaaagatgtttaccaaagacagcacctttagcttcatcacaattactgtggaatctttctttgtaagtagttagatgcaaaggccagttgttgcttgaggcctctcctggattgtgattttaaagtgtatcatcaacacatgggaagatatttctccctctttatcttatgacagaaatgcaggtatagctttcatctcaaagtaagattaaggtataagttacaaagatgtgtagctactatatggtcctgtgtaatgctacttgaggaaggctgttcctttcctggcactgaaattttagagcttgcataatcagtatatcaacctcgtgtggcttggtgcttagcaagtttcagcttctagagcccatggctaatggagccatccaggagaatgttggagagataggtctgaagccttagaagagaagtcttgattaaggagtaatgagttgcgggaaggggtcatggttgtggcggagatggaagcctggggagaggacagagacctcctaggaagagagtttgtgtaagaagaagaccaaggacctcctgatgtacttgattgtaattgggcatgagcagcccagttagaaatggtttcctgttggtattacatatgtacatggatggcttctgcagatggctaaactcacccattttatttttttactatcttaatagttaaaatatgaccttttcttgtgtctccaaattctgagttaccttatggtgctagtctgtctgttgtaactacaagtcataagtaaatccatatgattcttttcctgtaatttcctggtaaatcaaggcgataatttcaaagataaaaatctgtatttttagctttagcagtgagcatgattcccagtctttttgccttcgagtaaggtttgtttccatggtggaagtaaacaatatcccacactctagaatgtgagctcttcaagggtaagggacagtgtcctacatatatctttatctccacagcactgggtacataaatgtgtcataaaaatgaatgggtaaatatcctttggagtttttctgttacttgatgggtttttggggttgattttcaggtatctcccttgtttttctcatttcttacattattttctttcccaaaatcccttaatatacctgtttagtttgtgatgtcattttccattagactgaaaccatccaagttgtttaggctaacccagacttaagcattttctgggcttatttttggactctttttaaaactcatcatctgaaaatatttaatgtccacacggataattctgaagacatgtgcataccatttttcttttatgtacatgggttaaaccttgatttttccatagtaggagaaagcattataagattttattgttttcactggggtaatatcttttgtgctataagaaataaaattttgaatctagaacttagttttttataagacctttattgagatataattctcgtaccataggagttacccatttacagtgtattagtcactgattattagttaataggttaaccagtattagtaatcactggttattaattacagagttgtgcaaccatcagcgcacaattttagaacatttttatcaccccccaaaagaaatcccatccccattttcaagtcactcctcgtttctcctgcaactactcttttcagccctagcagtagacaatccctgatctactttctgtctctatggatttgcttattctggactgttaatgtaaatgaaataatacaatataaagtcttttgtgactggcttctttcacatagcgtaatcttttaaaatggtatctatattatagcccgtattagtatttcattctttctttaatgctgagtaacatttcattgtatggatataccacattttttaatctattcattacttgatggacatttgggctatttctacttattgtctgttatggataatgcagctatgaacattcatgtacaagtaccggtaattattttaaagaagttattctgggctgggcatggtggctcacacctgtaaacccaacactttggcaggctgaggtgggaggatcacttgagaccaagaatttgagaccagcctgggcaacatggggagataccgtctctacaatttttttttttaattagccaggcatggtggctcatgcctgtagtcccaactactcaagaggctggggctggaggatcacttgagcccaggaattcaaggttacagtgagctatgattacaccactgcactccagcctgggtgacagagcaaggccctgtctcaaaaaaagaaaaaaaaaaaaaagattctatagtttctgtcattgtaatagaggaggccataggatcatatatggcaagagtatatagcagtgcatgccagggagtgaaaaataggccatcaaattgaagttactgggagaacttaagactaagtctaactacgcatgagggattgaagccgggacacacaaagcttaaaattatgattcttctagagactgttacggctttttgctgaccacagacaatgaaagtttgatattttgctgtatttgtctgaaaatggaaacacacttttcccaatggcagtattcctgaggactagagttcttcacctctaaaacctctccaatcctagtttttccttttggctgatgatgaccagccactgccatttttgtcttaggttttgttagtctgtcttatttccagttataagtggttaaaatttcttatgaattcttcttgtgttgaacttttgattaatacatttagtctatagacagtaatgaattagcatctgatcaggaatttgtgaaaaacatctcagtcattaaagattaagaaactgaagccaattaatattgtcatgttctgtctcttggaacttgagcaagatacagatctacgtgtcaatgacatatccagaaaatagactccacctagatacattaaccctgtacccttggtccacatattttatttcagcaatgatccatggacatattataatttgacagtttcatcacatacctagcgtattgggtcaaatcaaggaaatctcatcctagtgatcttaactcagtgatttcattttgcccagatgttcagctgtgataaactttactaaggcacagatgatggatgatacacaataattccaaaatttgggggtggctacaatgtggctaggggctagaactcaggtatctacaggacaaatactgagtgattagtcactttctaagcgctagatatgcatatgttctgccaagctcagtaggtctaagtagattgcttccatttcagataattaagtgctttctttttataggaagtttttagcacatctgaggttctaaatccaaaaagtaaataatatatagagaaagaagtaataacaataataatagtaaccaacatttattgaacacagtatgggctgggcatggttcaaagaaagtttgacatatagaatgtcgaccatactggcttaataatcctcataactgaattagtgcttaagtcagttgcccagcctcagcaagcagcagaggcaagtaagtcataaatcaagatcttctgaatccaagaccatctctcaagccttgttctaattctctcctcagccatggatggtgaaaggcaccacaaaggcagcgtgtcaaaaagtggcattgttcaacctttcccctgatggggcaaagcttttatttttttcctttacgttctttgacatctgttttaaaatgcagatatcactagaagaaatgacaactttattataaaatcccagtaaaatgtaaatgtcttatataaaacctttatactgagcaaatttcagtaggaaagggcttggaagtaaggctctgaatgttttaaagggggacagtgctaagaaatgattagaaacaagagcctggaggggtcctgccatttttactgttttgcttaaggctgacctaaaatatgcatagtcttacttctcaccctgtgagcttatccttattaatgtctttttccacctagtttaggggtatttttgaatttgtgtttgataaagatgtctaaagctgtactgtaaaattttattgtcacttttttttttaaatggagtctccctctgttacccagcttggagtgcagtggcatgatcatggctcactgcagcctcaacctcccagactcaagcggtcctcccaccccagcctcctcctcctgagtagctgagactacaggcatgtgtcacgacatatggctaatttttttcaatttttttgtaaagatggtgggggtgtctccctatgttgcccaggctggtcttgaactcctgagctcaagtgatcctcccacctcaacctcccaaagtgctgggattacaggtgtgagccattgcactgagctttattgtaatttcaagggctcaatgcaatttccagtttttaaagttcatcttgcttgcagaatttgtctttcatttaaaaaaaaactgctgattggctacatttatagctgctgtaatagttctgtatgatttactacatttgcctgaatttagattggtggatatgatttagctgcttttaatattatatgagggtaaagccagatttctttggatctattccttttagatggcaatctttgtagttgttctactttacaaaataatccctgtgtgtgctcatgctttggtatacagttaaatgtatgatactgttaagaaaacattgatcactggaaagtgaccttcatttctttatttcataaatatcattatacaactatataactacacgtagtagggaagctccatttaaagagtagatgacttacactgaaatcatttgacctttgtaaattagtttaaattacacagagattgttgtaatgttctttatcatacataatagttacgattgctagagaggcactcataaatcattgctaaaagggccagctgctttcatgttttcagcaggttgagttaagggaacaagccttgccaatttgattaatctcttatgtccattagttggttgggaagtttttttgagtgtaaatttgtatgtagacaacagagtttatattctttatgacataaaattaatcagatatatctacatatttgtagaatggggggattcttagctctatagagaataagaaatactggatggaagactttttttaggatgactggctacaggaagaaattgtagtgacagaagccatgtgtattgaatttgaattaatgttccttagggagctaccagagaaatataatttacaagataatcaagaacgtaaatagattctctgtggagtcgttgtctgatcactgacatatattcatctgtattgaaatgacttcatgactacattctaacaattagagaatcattaggggtgagatgtacgtgtataccttcaagaaaagcaaaatatgtattggtaataattgacagctgttaaaacgagtgcattgtgtacttgttaaacattagaggctgggcatgttggctcacacctgtaatcccagcactttgggaggccgaggcaggcggatcacgaggtcaggagatggagaccatcctggctaacacggtgaaaccctgtctctactaaaaatacaaaaaaaaaaagccgggcgtggtggcgggcacctgtagtcccagtgactctggaggctgaggcaggagaatgtgaacccaggaggcagagcttgcagtgagctgagatcgcaccactgcactccagcatgggcgacagagcgagattccgtctcaaaaaataaaaaataaaaaaataaaaaaaaaacattagaataacttaccttggaacagtaactctgagggaaccttgatcatttatgagaatgatctcccctacgttaatactgcatcaaaactaacattatggtatacctcaaaaagtattggcatagatgtttttaaatataagaaaattcaaatgcgtaattgataagggctaaatggctcaatttcccaacccctaacaaaaatatgccctaacacagctctgtgactatgactgcatttattagaaaacatttagtaaaaatcatctctagttcaaaccctccagcatcagttcttcttgataattctcatgaacatttagaaataccttaaaagagaattcagactcaaatcaaaaaaccttatttcatttggttgcaggccaagatacctcttttaaccatttctggcttttagaatccttatcatgacagcttgtcctatctcagagcttcaggaggaaaaactagtccctcaaaatcaagtttgctattgagcttaataagaggtttctgtatgtcatatgtttgtttagaagaaaagcacttgttcgactcatttaatcctggcctgatgaattaaggcttgaattaatactgagggaaccttgactatacatctacaaaatcaatgtgtcctggtaggcttctgattaagataacattagctcttgcttgaaggcatctttctctgctcctaccatttatccagtggtagataatatatggagtgaaaaatgaaaaagacatagctgggctttaaagcaagatgaacatctctgtgaaccagaaatgtgaaagaaaaaaaaaaaagtaagtggggctaaattagtgggctttcagctcgtgctgtagtaacagggattaaaattctccttacaaggtagtggcccaaagccaggattactatttgaaatcagagccccacaaaaacacacctagagagagacacatacacacttacacttaaaagcaacatgaaaagaaacagtttgctgcaagggtctacagcttatatgcagctatggccctaatgcatagagccgagggaagaggcaaagattcgcagttgggaaagagagcatcacagccttgaaaccaggacctgaaccaatctacctactgcctggcaatgaaatgagtgatatctctgtatcactcagtgtaggagctgcaaactaccaacagatgtggctctaaactctaagcccctgggtatggctgggagaagccataaaaccacctgagagagagataatgagtttaaaaagagaggaaaatattaaagtacacacacatgagaataatagaaaacatacacatgcatatgtatgcacatgcaaaacatcccttgcaaaatttgtctccaaatcacgatccaaaatacatgaagaaatgggatagcaccccccacccaagttaaacatcaaaaagtgaattaggctgggaacagtggctcacacctgtaatcctatcactttgggaggccaaggtgggaggactgcttgtgcccaggtgtttgagactagccagggcaatgtagtgaggtgccatctttacaaaaaataatttaaaatatattagccaggagtggtggtacatgcctgtagtcccaactactcaggaggctgagataggaggatcgcttgagcccaggaggatgaggctgcattgagccataattgtgccactgcactccatcctgggcaacagagtgagaccctatctcaaaaaaaaaaaaagatgaattaattctagaagaaagcaaaataatacactagtacaacaaagatttttacttacatttaagatgctcagaccaggtgcagtggctcacgcctgtaatcccagcactctgggaggctgagatgggtggatcacctgaggtcaggagttcaagaacagcctgcccaacatggtgaaaccctgcctctactaaaaatacaaaaattagctgggcatggtggcaggcacctgtaatcccagctactcaggaggctgaggcaggagagtcgcttgaacccaggaggtggtggttgcagtgagcggagatcgtgccactgcaccccagcctccatctcaaaaaaaaaaaaaaagatgcttaaaggcataaataaggggtaccactcgctaaaataacaagaaactaagaaacagagatggatgaaatgtaactaggtctgaaaacaaagatatctttgccaaaaaaactagtcattgaagttactaaactcaatatacaggataaattctagactttgtcctgtcagagaaggcaagggaattagaagatgatgctgagaatgttactgtgtacaacactcacagaaaaagataagaaatataaatgagcaattaggagaaatggagaattgaccacaggctctacaatataccttactagaatttagaggtttgtttaggagtgtatttgagaggtttcagaagaaaatggaggaaatggtagagaagtaatatttgaagctgtcatagctgagaatcttccagaattgaagaaggatgtgagtcttgaaggaaatgtgctcccaagagaaatttcaaacatctgggaaggaaagaaaggcctgcattgagcaattgatattctttacagctcagctttggctgattaaaatgagccttttctgttttcactggaaaccaccaaaacagaaatgtaatgtgttgtatataccaaaccatgcctcttgaacaagggtccttataaataaatcataaaagaagagccctgtggacaactaaacccacaggatcaagataccaaggaagatctctctagaaaaggcagtctcctgtcagcacctttgtgaaaaataggtgggaagacagtaatggcttgttgtaccatcttgaggtccatgtctaaaaactgttttcaaaaggaacaccatggctgccccaatctggtagaaagaaaaatttgaataggattctacataaaaagtgttgccagttagaacattttgttgaagttttcttttaatgaagagggaaaaatagaaagtaattcctatggaatgagaccttgtgaacattggatactgcttcaagttcacagaaacattgaactgattgccagttaagttctcagaaattagatttaattaatgtggacagttacatacatcggtgcacacccagaagacccgtgtgcagaatctgactgaaggtgtacttacttcgatgaatctcttctcatcactgctttgtcaaagcagattgctatgaaataaactatacaaacaactacccttgaaggctgatagcaataggatttcaatcagtacagataggagattctatttctgtagatgaaaaagatcatacattgattttctgtgtgactttaaataaattcctggaaaccttgtaatgttaggtactaggtagaatgaaaaaaatgaagcaaaacaaaacaaagaaaaaaaccagagtagattgggttttctttctgcttccatgtggagatctagccttttgaaactgagcattttggaagacatgccgtcccctgtggaatgttcattccgagtatgggacaacagaaaatatttagcagacctggtgatgagatgatcttgctttctcaaactggacaatgggaaaactcttcttggctactcactacttacatttcatctcttttctcattgatatagatctcccacatttgtggataggaatttctctcacctgatgaaatatcatctgtgaacaacagaaatctgtcatcttattttggtatttatcacaagtagaagaaagatgtcaagagttctaatcagtcactggatatcaaatatcagaaatgtcctcaattggaattgtattctcagtaaatcctaaagcatttgggaccttcacatgtgctaatactgtttatatttatttggaaattaaccaaatataaccaaaagacagtggaataaccatagaaacctttaaatggaataaaatttatggcaatcaacattattaggaagaaaaagtatactacctagaaacagtgcaagaacaacgaggatcttctgtgcatctaactatataggtctagaaatatataaagtgaattatgatagaattaaaaggagaaactaacaaatccataattatatctcaacactcatctaacaaaaattgatagctacaaataatcaaaaattaataaagatatggacaattttaacaacaaaatcagcacactatgtatttagagactccatctttccaatggaaaaatacacattatttcaagtactcaatgaacatttttagaaagtgactgtgaactaggtcacaaaaagaagtattgctaaatttcaaaggatcagtatcatacaggggttctctgattgaaacgcaattaaattagaaatgcactaagaagtgaaaatggaaatataaccactgtgctcctaaatgactatgggttaagttaaaagaaatcacagtaagaattacaaaacataaggcactgaattgaatcaggtgatgtatataaaaacttttggtatataattaaagtggtaccaaggaggaaatgtataaccctaaatgtgttcattaaaaataaaaaatcaatgacttattcaacctgtaaagcaagaggaaaaaaaagagtaacaagtaaaacattattaatggacataaaatgagaccatagtaagtaaggagcttcactgcattcttggatgtgaagactcaattattatgaacttagttcttcccagtttaacctatgaattcaatgtaattcaaactcaaaatttcaacaagcattttcataaaatcagaaaaccaaacactaaaatcatggagaagatcaaaggggtcagaatagtcaagacaattttgaggaaaaacaaagtgggctgagaaggcctatcagacatcaattgatttaaagctggagtgtgggatctaccagggatatgcagatagaaccacagactagaatacagagctcagaagcacacctgtatatttatggacacttgatgttttgcggaagcatcgttagagatcagtgggaaatagatggaccatacaatgaatgaggctggcttcatagtttatccatgggggaaaagtaaaattagatcgcatgttcacggcaagcacaaaaatagattctgggtaaattcaagtcctaaatgtgaaaaaccaaattttaaactttaaaatgtaggtgtaagaaaagattttcgtgaacaaaacataaaaagcagagaacatacagggatatgttaaaatttacatcttttataccataggatgccataagcaaagttaaagataagctacactaagataagggtagaagatcatatttgccatgcacataactaacaatggattagcatctagaacatatccaaaggtttaaaaagaaaaagacaatccagcaggaaaatgggtaaaggaagcatgaaaagccagttaacatggaagaagtctaaccttgccagtaatccgggatgtatgtgcaaattaaaatgcacccatcaggttaactaaaacttgaatgtctgataacaccaagtatttggtgaggaggtgggccaaatggaaaacctcattcactactgaagcgagagtaaattggtaaaagcaccgatttgtcacccagagcgattcggtgacatgtagcaatgttgaagatgttgctaagatccaacaattccacatcaaactatattctgtaaagaatctcttcaacaggtatccaaggagataggtataaaaaagaatttcattgtatcattgtttataatagtgaaaagttggaaacaacctaaatgtccatggacaggaaaatgttggcatattcaagcaacagaataataataccttatggcagttaaaatagcaaactattatgtatcgacctggagaaatctccaaaatggtgttgaaggcaaaaagcaactcttagaatggtatgtatattcttaaatgtgaagttcttaaatttaaagtttaaaaacatgcaaaataatgttattagattgaatcacataaaatgggtgtttttgtaggtgaaagaaaaatacaggcaaacatcagcatcttttttaagctcaacctagtatttgttgatacattcatggtaacactgggcatgaaattcagtgtggcattatctccttgagggcagcggggaggagagaatggtatggtgttgaggcgggcatgtgagggagcttctgctttggctgttaacttttctttcttcaaaaaacttttgaagaaaatatggcaaatgataaacttatcaaggggaggtgataggaacatgggtatacttactccattcttatacatttctgttgaaaatatttgctaatgtttagagcaaaccaaagtgttgatagaggtataaaatttttaatctcatgacattataaagaaatatttacaaagtgattaaatcctttgctgcttacttatctgaacataccagtcgcgaggcttttagtgtaacataaaaaattgaaaagcatggctcccttcacacaccaggcaaaagcttcaaattttgttttgttcttttagcactggtaagattgtcatcattaaaaccattcattagtgcctcttttgcttgctgttcttcggtggcagtcagatgcatctatctaccatggtatataaaatttggtgatgatattcaaattactttttttcttctttttctttttctttctttttttttcttttttacttttttgatgccaataggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaagtgaggagagagatgggatttttacaaacattcatttttccctcttaaacaaaactaaacctcagagagcactttttataggtgcaacaagcatcaattcttaagtgcttggtatgtgcctgcaaagtgatagtatcaaaggatagaagtagaggagatagaaaaactagtgtgtcttttttgtatttgtccaatattgtttcctaccaaaatggttttttcttgaccaatttgaaatacatcttggggaaaaaaacgcctaaaggtttccactagttctctaaaagtgaatatttcacttcttgaaatggaactatttcatttacaattagttatattttctggtatacctttgtgttttttttctcctaatccctaacacatagttctttaagcctccatcgaaaacctagcaagatactgcattgtaagaggacctacctggacatagttctggctttctgggaattttaaatttttcaattatgttctctctatcttgttacttaatacttcacaaagatatgaatcttccattacagttttgagatctcacatagtctcatcattcacacatgaccttctaaatcttccagttatttaatgtaatgatgtatagtctcattccagtgtagctctgatttttttctcaaatttataagggagcacaattcagatacaaagacagtttctatggattatatcaacagtgaaatatcccaaattaaacaatctttgggagggcttctaaagtaggaagggtcaaaatttatgagtcctgagtgtgtatcatattttgaaatttatacatttgtatgtttattatgaaaagtaattctgttttcttttggatgacttagccccaggcagaggccaaagtgaatggcacaacggtgtcctctccttctacctctctacagaggtccgacagcagtcagcctatgctgctccgagtggttggcagtcaaacttcggactccatgggtaagtgtcctagctactctcagattttgttgtctgaagaaaggtagagtcgtattacagggacatgaatatttggccgtaagtgtttgactcatcttggtatcagggagccactgaaaatcatataccaggcgaaaaaagtctaaaaagaaaattctaaaaaggtgtattctggcagctctatctggcccacagaaaacttgtataggtgagaagaccagttaggaggcaattgccaaggccaagattggtgagttctgagggcctgcacttgagagatgtgggaggagaggactgtgagactattctataaaaatagacttgccagggggctgggcgtggaggctcacgcctgtaatcccagcactttgggagggtgaggtgggcggatcacaaggttaggagttgaagaccagcccggccaatatggtgaaaccctgtctctactaaaaatagaaaaattagccaggcatggtggtgggcgcctatagtcccagctactcgggaggatgaggcaggagaatcgcttgagcccaggaggcggaggttgcagtgagccaagatggcaccattgcactccagcctgggcgacagagcaagactgtgtctcaaaaaaaaaaaaaaaaaatagagttcccagggtctggggactgagtgcaaattgtaagaagaggaatgaagggagaggatttggttggaagaagatagtgaaacttctgattgtggacataatgtgtttgagaaattgacaggtcttctaagtcatgtcccaaaagaaattaagatacagatctatacttgaagtaagtgggcaaactggagagatttgagaatgagtttcatagaattgattgctgaagggtgtgagatgagaaatctataaaatctataacacaggtgcttcgatccagtgccttggaaaagacctccatttgggtaatgggatagtaaaggatggataagtagggaggttcaaggaagatgtgacaaaaaggtgaaatgctaaagagagctcaatggaaattaaaataaatcacagtccattgggtcactataaatgcattgggtaattttgagaaaccattttaggccaagagaagggaaggtggaaaacttctgtttcaatgaaatgaaagactaggtaatcttaaaatgaatgaggattaaggaaagtgaagacaattttgaaacattaccaagtaagaaggaagccttaggcaaaagttggatgaatttgttgaggaaatggtccacatgttctgttctcattcttagcaatgttctctgcctaggactaggttctaagaaaggtggagctgatgaggcataaatgatcaaaggtcaaaacaagagtagggcattttacagtggtaatgaatggctaggacaggggttcctagccagctgctcattggtttttcctgctgtgtctggctagacaatagagggttttatgaaggccacaaatacttggtcccccttcctcatttctctttctctgtaaaggcccagtaggagtcagctccatcctctctccttacttttccctgggacctaaactggttatatacttggtcctctcaaatcttacctcacagaatagaaaagacctgtgactccttgattccatacacttacagctctattgcctgatatgatgatgtgttcaggaattcatttcatacttgagctcttccatgagggtagaataaagggaggcaaagtgccttaaccaaaatggataggacagaaaggaaaagtcaggggtgtgggtgagttttatggcgaaaaatttggagatcacagtcgggaaaattcaaaagttggatatcatggaagtaaaatactttcaagcaatttctacatctaacatggtgcctcccagcgagctgctgaagattttacttggagatcactgaggggtagggagtacagttcatggagttgatgagaccaacgttgctgagcttatcagcagaggggtgaggtccagatcctgacgacagtggtagatcaggatggaaaagatgttgaagaagatggacgagggctctgaggagatgaacatttctgaggaaagagacagggtagttgaaataaatgtgatgaagttcaagaacctggagcagtgggaagaggcacatcctcctctggagaagccaaatcttgtaggaaagccaggttttgatttttttgagaaggaaaaggatatgtttgaggttattttcctgaatttactacacctccatgatttaaggcaatctctgtgtcagattatctccctccacctgagatctgaatatagctaataaactgttgggattgtaaatgacaacacactacatgaaaaacaactgtatgcatttgcaaagtctgtaaattctgaaaacaactgagctttagtacctcttatttttttctacttcaggattttcccccttttttaagtaagtaaagcatatgaaactaagttacatattttagtggtcagattcagagccctgggtgcttagaagcattaataattatttaggtcgttgacaatggcgaataggcagcatactcgttaaagcactcaaattaaagtgcacattaggatgtggtcctgatgatctgtggagctaaaaagatcatggtagaactgaataccaggacaaaagtgctatattccaatggctaagctaagagataacttgctggcataaaatggataagctgtgttaaatttgtcctctgaaagaaaagactgaattcaagggtactttttcttgaactgtgtattaatctgttttcacactgctataaagaactacctgagactgggtaatttatgaagaaagaggtttattgactcagttccacaaggctggggaggcctcaggaaacttacaatcatgggggaaggtgaaggggaagcaaggcatgtgctacatagcggcaggagagagaaagcgaggggagaactgccacacttttaaaccatcagatcttatgcgaactcactatcatgagaacagcatgggggaaaccgccgccatgatccagtcacctcccaccggacccctcccgcagcacatggggattacaattcaacatgagatttggatggggacacagaaccaaaccatatcgaactgcataagctaacttcatttaaaaaggaaaaaagccttaccgtcttcttgaaggatgcacacaggtgtttaaataaatgcagtgtatatacttgggctttgaaggtttgagatacaaggctgggatctgctgaaccacattctggatagagctgcattctttaaatatgcaaccccgatgactgattttcttttaagtgaaacatgagacaagtcatattaggtgatgtgtctaaagagtcaacatatttcctcaagccatgaaatacttatcactgagtctctatgtaccatttgtattctgtacagttcttactgagacaatgtgctaatgaaacgtacattctattggaggaagcaaatacagaacaaaatagcaattaacaatgtttatcccctattggctctcatgggctccatatacaaatctgtgatgtccagacaactccttatctctgatgactcctaactttccaccagattactgttttttgaagcattttatattttattgatttaaaaattaaactgttcctttgctttttaaaaaatttatcatgtacatttgaggtttatgacataatggctccctagctttttatttagaacaatttcaaacttatggcaaaactgcaattaattcaacagtttgccacatttgctttatagctatttatttatgtacttttacattcatgtgttgttaaatggattgcatatatttagattaacatgtatatctgtatgttaacatatttttatatactgtatatgtttatattttatgtgcatatttaatcatattcatgcgtgtatatagtttgtggatttttttttcactgatccactcaatggttaggtttcatacataacacttcacccctaaacacttgaacacgtgccttctaaaatgaaagatattcttgcataagcacaattatcatgctcaaaaagaacaatactgttatataatgtagaatttaaattcaaatacctccaattctgccaattaatattcttcatagcgatattttacattcaggatcagtgatgtccctgtagtctcctttaatctgaagcactttcccagcctctttaaatctttcatgacattgatatattagaagaggtcgggctagatgttttgtagaatgtcccccaatttgaatttgtctgcttgtatccaagtgattgggttcgggttaaatgttttatgccagattaccatataggtaaggtatcctcagtacatcacatcaaggttttcctcaagattctccatccccttcaccgttcttcactctccctgggcgctccttccatactttggcttctgctatgctgacaactcttaagtcaagatttccagcccagacctcccacctgagcatcttctggataaaattataaataaaaatatagcctaatctgaaatcatgatcaacctttggagcatctcttccaatttcccaatctatacaaagtcattttctaccccttcttcctttacctgccttccttagctatgttccaccaccatcaatccagtcaccaaggtcagtgtgttttgctacttatgaaaaagagcaaaattcttcaattcagctacttctgcccaaatttagccctcatcatgtgttacctgaacagacaatatgaatactttcctaattggttcctctgcctttggtctctctccctttctaagctatcttccagaaacttcagttcctcttctaccattcaaattatatcatattattcccctctttaagcattttatgccttctgtttgacaacagaataaatgtgctctttggccttgagtacattatgttcttaacctgaaatatagcatcctttcttttcactcagtgagttttcttttggaacttaatcatgcattatatcattctggttttgttgttgttgttgttgttgttgttgttgttgtttcttttgtgtgagacggagtctcgctttattgcccaggctggagtgcagtggtgcgatctcagctcattgcaacctccacctcctgggttcaagcgattctcctgcctcaccctcctgagtagctgggattacaggctcgccaccatgcctggctactttttcttgtatttttagtagagacagggtttcaccatgttggccaggctgttcttgaactcccaacctcaagcaatccacccgcctcagcctcccaaagtgctgggattaaaggcatgagccaccacacccagccatgttttcagccagttactagtacttctttcttctgcctacaactccctagaacttaagctccttaaggacaggatgtaagtcttgctcattgtcgttactgtatgaggatactctgtgcaacaaacaatcagtaaagtgcttgttgagttaatattttagaaatcaagcataatacattcttgtgtacacatggaacagcccacacgtttaggaaatttagctactagtttcagtatctttcaccaccattcacaactgatcagctaataatcagcaacaacattgtacaccataatatgttaaaggtgttacacacagaatttatgtgtgaaattgaaagcatcggtcctatatcatatggaaaaaaattaattgtagccaaatgttgggtattggatacatcagtgtgctttttcttctaaaaaatactggagaaaggcaggaaatacacaagtactaagataataacacatcaagtcggaaactggttaaaatccaaagaaaaatgttggtgggcgtatttgttcatacacagccccctttatgagaaaaaataatttcttgtacacagctcctttttaaaaaaaagagaaaataatttgtttagattcagacaaaaacacaggagtaattcttgtgtctattctgcataggctgcgtaggttctggctaaaatcactttttaagcagatagaaccattatcagcgtttgaatcaaagggaagtgagtcagatgggatatcttcccttcaagaaagggatctgaaaccatcgttatatttcagaagactgaagaatatcttgccatggcaaagcattccttttcttttttctcggattaaattgagtcatcccacttcttttttcttcacttcagcagtgattaaaggagactatcatattttgctatatcacggtactatttaactttgactatgtctttccttattttaaaaaatgtttcagtgatttatttggaccacaatcagacaagccaggaagaccaaatagctaataatccaaaaaacattatttttctctttttattatttcagtagttttcagggaacccaggtggtgtttggttacatgaataagttcttcggtggtgatttctgacatttgggtgcatccatcacctgagcagtgtacactgtacccaacgtgtagtcttttatccttcacccccctcccacccttccccccaagtccccagagtccatggtatcattctcatgcctttgcatccgcatagcttagctcccacttataagtgagaaagtacaatgtttggttgtctattcctgagttactttacttagagtaatggtctccaactccatccaggttgctgtgaatgccattatttcattcctttcatgactaatattccatggcgtgtgtgtgtgtgtgtgtgtgtgtgtgtgtgtgtatataaacaccacgtacatactgcattttctttatccactcgttggttgatgggcatttaagctagttccgtatttctgcaattatgaattgcgctgctataatcttggtatgcaagtatatttttcacataatgacttcctttcctttgggtagatatccagtagtgggactgctggatcaaatggtagttctacattttagttctttaaggagcctccatagtgttttccatagtggttgtcctagtttacattcccaccagcagtgtaaaagtgttctgttttcaccacatccacactgacatctattatttatgcatgtttgtggaaatcaccttggagtagagtcaagtttaagtgttaaagcattgccatcaactaagtttaaaatcccccaaagactagcaatatgctatttgagcaggcaatgaatctgtgaagtagggataagggctgtgcaggtctctagtgtgcaactggaactcagtattttcttgttgaataagtgaaaaaagtgaaaaggtgtttttgtttttggtgatgaggggcttgtgatgacaggtattattgttagagtcagaaatattttgaggttgcctattaatatggtttggctctgtgttcccacctaaatctcatctcaaattgtaatccccacgtgtcaggggagggacctgatgggaggtgactggatcatgaagaagttttcccccatgctgttctcgtgatagtgagtgagttctcaggagagctgatggtttttaaagtgtgtggcacttcccccttctctctctctctctctctctctctctctctctctctctctctctctctctctctctctctctcctgctgccatgtaagaggtgccttgcttcccctttgccttccaccatgattctaaacttataatcatgaggcctcctgaggcctcctcacgcatctggaactgtgagtcaattaaacctctttcctttataaattacccagtctcaggtagtatctctatagcagtgtgaaaatggattaatacacctattatgttgtagctacatagtgtatgattagacaagccataaatattatatctggcttgtttcatgcccataatagtgtatcagtcagctgttgctgcataacaaataaccacaaaattctcaagttgcatatttctcattcacgcatctgttgtttggctgaacttttgctggcaatcagctggacttgacaccaagttgtggtttgggttcaggtctgttcaacatgtctctcatccttcttgggctagcaagctacctgggccatatgcttcttgtgcacataaacacaagcgggcaaccccaaccagtcaaagacattctaagcctctacttttgtcatgcccgcttacattccattttccaaagcaggttatgtggccaaatccgaatccccaggccagggaagtactgttttcccagctcttgttcactctgctttatctacattagacttcttgctgtgcttgaggaagccagtcacactctcctctcagagtctttgcatttgccaatccttctgtctggagcacttttccctcaaatacttgtgcaactcataccctccagttcttaaagcttttgctcaactgcatctcatcaatgaggacttccaagactccactttctgatgactctcattgtcccttgctagccctctcctcagagtgttcatcaccactcaagatacctatatagtttacttatttacttgttaagcctgtgtgcctccttatgaatgcgagtttcacagagagagtgtgtgggtggggtttgtttgcttattgctatatcttcagtgaacaatatgccaggcactgttcaaccatttgaacagtgcctggcatatatagttggattttaataaatatttgaataaataaatgaatcttactgtttttaaacttttgtggtttttaaaaggcattttaaaaatctgggttagtatcaaatattacaatggtattactttaacttcaggtttcatttagctgttttaacttttacaatatattctgacacagaaaatattaggcattaagcatttttcaatgagttgattcacttctactcatgcacatatgtgatgtctgatttcgattcttaaaaagagatgagcctgggcgtggtggctcacgcctgtaatcccagcactttgggaggccgaggcaggtggatcacgaggtcaggagattgagactattctggctaacacggtgaaaccctgtctctactaaaaaatataaaaaattagccaggcgtggtggcacgcgcctgtagtcccagctactcaggaggctgaggcaggagaatcacttgaacccggaaggcagaggttgcagctagccgagattccaccactgcactccagcctgggtgacagagcaagactccatctcaaaaaaaaagaaaaagagaaaaaaagcaatgcattaaaaccatcttgagaaatcatgaaaatatggagaaaagaagaaaacaagattatactctacttgtttttatactacctagaatgtaataggcactcaaaaaaatgtctgaatggatacaattatcactgccttaaaagttttccattaaagcaaagaagccaattttacatttgtattatacttggacactcatattaaagactcacagagagtttatctggaaaaataaacttggctgacatcattaggtttatactttataatttgatctttgaaataattcaggaacaggaatgccagtcacttcattgaactgtacctgaattttaacacagtacaattgagttcctagagctccaatatgatgtaattaaactgtcagaaatattaacatcgatgttcatgagcgtcgttcatgatgttctcttggttctgatttattcagtgaggcatactgtcactgaagtggacttactgccattaaaaatgcctcatgtttcccagttccgcaaaaatttgcatcagtaatgaaacagagagatgtaatcagccctgcagttgtcaggatcttgatcctcttggtagtatttcattcatttcatcttcaccagataatggtagtttaaaaccgcaagaaaaatgaaactaaaaatagtgaatttcacttctttttctaaaggcataaacttaagcaaatagtgcatgtgtgtgaggggggaggaagagagagagaaagaggagagagagagtttgtaactattccttttctgctttgtgaccttaattcttcagcacccatttcctgtacttaatattgcaaagaggtttcctgtggtatgttaccaggagactcatgtagtctgaggctttttatctaccttacgttcttatccctccattctaataaaaatatgaagcctcacatccacctagaatatgattttgtcttaatggttagcattggcaatgattcttttagcttctgctgttaaaaaaaaaaaaaggaataaatgcaggattctaatcaaacatgaaaatccaagtggcatagaccaaagggaatgagaagcatatttaagtcatttagtcactggcttccgaagcagttccaagtcagatgtaaacctgaggttgtccctaattaagttcattatggttgacttgctaaagcaaggtcttgttttagatggaagtgacaatgtgcaaaacaaacagagcttgaatagaagttattttcactattggaagattgtatattatgaaaagttagtttcaaaggacctttaaagtttaattttgtttgcacctaagaaatttccctttaacttgcaaatgctgtttgaagtgtatttctttaacacatgaacaaacaatacagacacagattcacaaaatctacaaggagatttccattcccagtgaatatcatccatccataggtttctttgcttccagatcatcattctctcctcacataaacagtcaaaatgtttgtaatgtcttctttataaaacccaaaacataattatgataaagtagtcccaagtaacagaggaaaggaccataactctccaatatatgccatatctacagtttttagaatattcatatttcattacctatataggatatatactatttttatttctattacattggagtttaaaggtacttgagtttcgtttgtatttttggttaaatgtcaaaacaaagagtgaaaaaaagacctcagtgtctcaactcccttcttaccttcatgaagtgactgcaaagtgttcaattcttactcttttgtgttgaggagacagcactgcaagtgtgcagtaatacttattttattacatagaacaaagtttcacatttgtgaatggggcacaaaagagagcttgtcagttttacctttttcaattgactttttcttttattctttttaacttttaaatttattttttgtttttttgtttttttgtttttaaatagagacagggtctcactatgttgcccaagctgctctcaaattcctggcagcaaacaatcctcccacctcggcttcccaaagggctgggattacaggcatgagcgaccgcacccagcctgttttttactgtagtataatatttgtacatatttatggagtgcatttgatattttgttgcatacacagaatgtgttaatgatcaagtcagggtatttagagtattcattatctcatgtatttatcatttctatgtgcggggcacatttcaagtaactagtcaacttttaaaaagatacgcagtaggctgggcgtgttggctcacgcctgtaatcccagcactttgggaggctgaggtgggcagatcatgaggtcaggagttcgagaccagcctggccaatatggtgaaaccctgtctctactaaaaatacaaaaattagctggacgtgttggcgcatgcctgtagtcccagctactcgggaggctgaggcagaagaatcgtttgaacctgggaggcggaggttgcagtgagccaagatcgtgccactgcactccagcctgggtgacagagcaagactccatctcaaaaaaaaaaaaaaaaaaagatatacagtttttttttctccaagggtaatgatatagataaactactgtatggatttcttcttccctttaaagaattacttcctcattattaagcttgagggttttctttgttatttatgagcaagtgaaatgaatttataatggtgttaaaaatgtaatcatggccctttaatatctgttttctataaatgtaattttccattatttgtttttgcttttattaaggtgaggaagatcttctcagtcctccccaggacacaagcacagggttagaggaggtgatggagcaactcaacaactccttccctagttcaagaggtaagctccaatacctagaagggactcagatttgctgggatcaggccactcgcttccctacccaactggtgtgtgtattttccatatggaagccaacacgcagtatcagaatggcaatttgggtccatggtgaaaagatttgatttttaagtgtgaatttgtggtttagagtactctgaattcaaatacccgtgagggcaacatgtttccaaaaataagaataccaccctctatttgtcaagtattttacttgcttcacacattagtctgaagagttaattatgaggtgccctttactgaagagcaattattatgtgacttttacagatgaggaaattaatgccctgatagtgcctttgccagggacatatggctactacgtgctacagcaaggcctagaacaatgcctactgattggtagtggtagagattctgacttgccatctgatgccctttatatttaaaaattgtatcttactccatcatttaaatatagggacaattaaatcttcatagagtagttggttattttttacttcgatagaggaaatacaggcttagcaaagaaagacattaatatttttctttttcttcatcactttggccttgcgtattttacccccatacaaaaacagcattttaccctgcagaattttcccactggcttgcatgagcttcagatgtcttgcttcatccaagatgatgttttgctgctactgttcgtttctgggggcatttatttggtttattgccctcacataaaacaaagtcactctctcgccttccttcaacgaataaaaaggatggtggcagtcacctgtgatcaaatagaagaaaagcctagagaaacaaaagggagaaaacacaaggctttgtggccagtgattggcacctctaatgggtagcctgggagggacgggcagcaggaaatctgggctgtttgttcctctccataagggcaatgaggagggtgtattgagtagtgtgtttttcctatctttttgttcagtgtcagttaacaatggccatttcctagctatttgatgtgcaagtaaacgttgtgcagtgcacattaaaagcaataatgttctggtagagcgttgctaaggaaccgtcaggggaagctaattttaaatgtctgcaccagccatcttttcactgctgagcgccactgaagtgatgattttaacagataaaaatcttatctgtcttccacccacctccacatcccccaccgccacccgcatccccattctgactatcttaggtatctccttcttctagatgtcataattcataatgagaagatcatacacaggcttgacagaatcaggtgctttcacgtgtctcctcattactttgtcctgcttgcttttactagcacctactacgtaccagtggaggtagtagggatggaaagaagaaatgacaaattccttgccttcaaggtacttatggtcaattgcagatacagaactccaaagaaattcaaatcacagtacaatcattgattactgtatgatcctggccccttgaactggcagcttgcttacctgctctggaaagttgctggctgccctgttggcaccctgggcatttcttccacatctaaacaagaggttagtagagaagaagctacagcaaggctcatgactctgcttcttcataggcagccttgacttcctagactcctttttgtacctgagtttctggtccaccctaattagctgtaaggtgaaatcctttgcaccatctccctgtgtcccgcttttagagtccttaaagctagataccacatgggtgtagaagcttcctggaagacaagaaatatacctcctctgatatggtatttagcagtcagtatctctgatgttgatttacttacttgtatggaaacttgggaaactcaattcaggccacctggatagtgtttactaaattagtgcttacggaagaatttcaggccttaagggctgatttaagttctcaaatgtgggagaaggaagccttgtccgataccaattccattaacttaagttccggcttactcagtggtacccttgtggcctgagaaaataaattcacattcttaaaaaacaaaacaattaaatacacaaaaaacacaagagagtagctaaggtattggaaaatctggcctatcattctgtaataccatgatcttggcatttcctcacgttttgctactttcagctaactcaggctttcttacaggcctttttctccccaaattcaagtggataaaaagtttcattattgtaaaaattaggctaattattgatgcactcaaaaaagtggtttttggatgctttctttccaactaaaagcacttttgttttttaattttgaaaaatggcatatgtgtgtgtacacacacatataccgtcaagtttggcgggaacatcttaccagttggtagatgtgttcagctgatattaagcagaaattcttgagaatcttaacatcttgggattacaaagtctttcaaatggaagagccttgaaaggtcattttaacacttttgacatccaggacagtgatttctgactctgttttgatggttatccatatcagaggaacattttacatcacaaactggggtaaagatataaaataaattgtacatgtgtttatgtacacacatgtatatatacacccaccatatgtacacacacacatttacagtgtcatatgcatacaaagatcagaaacaaaagtttcatcaagtgatgccttccatactacatacagtgcatgctgtttttctattttatttatttaaaaacaaaatgctggttgcaacccactaaatggattttctgaaccagtggtttaaaaatactaatctatgtgatctcagtttttcttgcctggttgaattatctttcaaaaaaatttaaattttgagatttttgccgtggaagtttctgccaagacgttgctaatgtctcagagacctttatagttttattctaacactaccatccatgttctcattgttgtgttacaaaaaacaaagttcatgattgctacagctgttttggacagctgtttgagtaactcaaaacagatgtgagagccagaggtctgacatttagtggaaatgtgctattaaataccaccgcgtggtttacttaaccctgctagataattgcccacagaggaaaagccgtttttaaaaaacttatgctcttcataaacataaagtatatagataggtaagctattatgtacctcaaatttacaacttttctgttgccccttgccacagagttggtcctgaaggtgtcagctaacctttctttatcttttattttcacaaagagtacctggaagccaagaaaagtcaagtgccttatttatggccattcagcaggttaagttaggcttctaatcttatcttaatggctttgctaaactgttatcaaaattaataaatgagtggcatgcttctccatttagtgataaaccgatggccaacactatcctgcataataggcaatataagcaggagcatattcaagatatgaatgtgtaaacattcagctttgtgattatatctttctggttggtctctagatatacttagttgttcacaaacacttgggagatttgagtggctcagtgtatatttgaacactgaatattagccaatttctatctaatctgtctatctctaatctcttcctttgtaagtatatgtgtagaaattgaattatagtgtaataagtcattatctactttactataaggtactctctaaagctctgccattctataggaaaactacatgggtacaataaacaaacgtaatttaaaaaataaccccattaagtgatttgtccataagtctctgatcatttagcagactaacaaagatatttttatatgtatgtgcattgatgaaagaaacgctctcctagtcagtagtatggtattaggctctctaaaatgtggtaccactttatatagatgaatgaataataggagccaagataagctcttaatgcagtaaaacaatccagaaagcagttagcagtgctactatttctgctacctgtacaatctcttgcctactgacctgtgccacattatctccaccagcccatgccatcctctttttttcataccatcccctctcaaataagcccgcgtacattctatcaaatacccctaaattaccaacccaacagctttgtaaaacctaccgtcttttaaaattaaaatcttattctgtggttcttttatggaagagcaacataaagaacaaaggcagatagaaatatggtgtgccctttttcaggcaccattctgtttcctgtatgctcccacaaaggatttgagcggttatccctttaatccaggactagcaaactacatacagcccaaatgccaaatctggcccaatacctgtttttataaagctttattggaacacagccatacccattcatttacatgttgcctatagttgctttctcattaccagggcagagtagttgcagcagtgctgaatagctggtccagagaccgtgggcttgcaaagcctgaaatatttactatctggccctttatggggaaaatttgccaatccctgctttacgctattatttcgttgtccattctgactcattacatgtatagagtcacaggcttctgtgctgatcaactttcagctgaacaagattattgagctgaaattgaattgatttatagatttatattcatattcaccaaagagcctgcaagtgtggccatttgaatttttttgacttataaaataacagaaatcctaaaaagggacttattcttccttaagtattttaaatagtcagtgaattaatataaaagaggctaaaagcacccagaaacagtactgtcctgcaattccaactctaaaataatgaattacaatcaataatgtcaattttatagtgcccgaggaaattagacttctcgggacctgaccaagccctttatttagactcaggactgccccagcacacttcccttttgtcttgattcatttcctgacaacacatcacattgccagatggacactgtaactgaaggtctacagaaactcatttccaaaaaaaaataaatgtttagaaaatgaaacatatctgaaactttatttatcggtcaagaacttttaaaaatgttgtaatcaagtagcctctgttttgtcagcgtagaactagtccttttacagtagaaaatatcatttgtttttaactttttctaaagtgaaaaaaaggaccttccttttgtaatgtgttaatgagtacgtggggacccaagtgatgagggaggattttagaagagattagagttagcttggctctgggaggtccattttcataaaatatggtttctgaagaaggatctggaacataacacaagtcatttgctgctacatattaagaaataatcaattgataactgagttctgaatatggcttagtgtagaattactaaagatatgtatcattaagcattcaaagaatcatcgttacattctgaagtacataaccataattacattctaaatcacatggctttctaacaacactgtccttcctaaagatctcaagttttcaaaactagaccaaagttacatgccgaaacaagttacccacctttggcatccaaactaaagtgtgccagtgaagggcaagttacttataacacagaaggactcctcttggtcatgacccaactactactttaccaattcacttcagccagtatttatcaaataccaaaagtgtgtatatacggtacagggcattgggcatagagaggtggatgagcaacatgtggaccccgtcctcaagaggcttatagtcttacaggggaagggaattaattctgccaccagacagtattatgaaacataaagatacttttttaaaaaaaccttgctaaaggaatcaaaaagaaggggtgagtgattcatactgggatttcagccatcaaggaaagaatgatgttctcctccccaaatgatgggaacatcatttggtatggatctcccactagtgacacccacagctgaggagctagtacccatttttctccctcttttccctggcttgaggagcatcttaaatacctggcccttacgtggtcaagctgaaaatctgatactcctaagaaatcgctgagtcatgtaggaaattcagaaggaagagaggaagggagagaaggagaaagggagggaagaaagagaaggagagagggaagaaaaacttagaaactatccttaaatgtatactagaagttttgaaccctaaccttgagtgagttttgaaaggtttctattggtgtcgtagctccatacctcttcattccagactagtagttctcaaattgtttcagggagtttttagtcttcttggagccactgagaatgatgggtggaggggaaagggagatgctgtacaggatctctcacagctctgctttgaactgctcaaaatattggaattccatataagattgttttaggagatgtcccattgctatagttaaaacagtttgaaaaccaagattttaaaggaaattgcatgcccaagacaggctattgacatgtatggacagaagtccctacttttctgtccaattatgacttatcatagaacactttctcatcagagtctacttttgaaatacaaataaatgcatacagatgtaggaatctatgaatcaaggccagtgggtctttagccattgcctcgtaaggctcctgatatttgctgaattggggaggaagtggaaagctcattcctggatctggctctgtggcttgcccattactgggacttacctcttcccctcatctgttctttctgttttctcaaatgcctccaatttcatcatggaaatgctcagcttctatcagatagaacaaattctcccaagaggatggagtccagcctctatgtcgggttctaccttgcatttgatgtgcagactttgggcacacagagtcaactactgtttatgtttcaatgtgctgattgtcaagagtgaagagattctgagactttttttaacattaagtttgagttgtccttgaaaacaatgcccaatttgtcagatttctattctgtgccagttttcatccagtttaatgcgtgaactctatggattttacaaatgacgtcttctggatcatgttatctgtttacactgatcttaagtgtatgtaaaggttatttgactagatgtgtcttttgggttttttgtttctgtttttttttttttttttttttccagcagagaataaatggtcatctcaacatttgtttggtaaaagaagcaaattggtatgaaattgtatatttatgcatgttttttttccctttctgatatctctgcctcttcctctctctattattaaaggaagaaatacccctggaaagccaatgagagaggttagtgagattcaggctcacggccatggcttctgtctgtctcatcctgctttttatgtttggcgtttgtgtaagaattgtgtgtgtgcacgcgcatgtgtgtattacacattgtgtcatcatgtaaggatggtagtcacctctccacttgcagctcatgaggaacattcctcaaatgttcattgccgttgtcatcaccatgacgacaagactggggttgggagcaagaatctctttaaaatggcaatcctttgtagtccctaggttggaatcctgccgttcatcatctgttgccatttgcaacactaacaaaatcttcaaaataaatttagccttgaacataactgatgagtcataaagctttcttccacttccaggaccttagcattttctgccagcgcccttagtttttattcttctgggatgacttcattttgcttttgtttccttttttcttggttcctacgctctttctctcccattttagcgaacattttttgagcacttactgtgtgccaagcattgttctcagcacttgccatctttttcatcatgtcatcttcatgacaaacctgtgaggtaggtactcttattaaccccgttttacagataaggagactgagtcaatgagagagtaagcagtgtgtcccaggtgacagagccaaggatttggatccaggcagtctggctccagacccacactcttaactctcatttgaaaggcttacatcatctcaacgtacccttcagaagatgatcttttttatttggtatttgaagccacacagaacaataaccaattcgattaaaaaattaaatattggagttttgagaggtttttaaaatgcctatttatgggttgaaagggatagggtgcagtcttatcactgaatgtggtttcaggttttacggtgaaagatgcttcttactcctattccaccaggaatattgtctgaatatcgaattacctaattaagtgactgttggatgacaaagtgttaactgacagcccaagtaaaatcaaggttgtctttaccaagaatttaatctgaaggaggagagaaggaaagctctcccatgggatgacagtgttctgggagacaggctggatgggtggagagtccttcttaaatgagaagattctggattccttagcaacaggatggactggagagaccactgattcatttaaacacaggagtcgtaatgaaaactctgccaacatcatgccatacaagtctaatcaatttaatgattcttcagtgtgtctgtgccagtgcctccttccaaggctttgggcagtggggccagggagggaatggtaggctgggaggagaaattgaggaaacctgacttggtgaagcattgaatgcccctgacggtttgcctggttcatgtacttcgtatgtgagacttcttgggttcattcttatggtaagtgccccttaaaatttattcattttaactttttgtagaaaaatgcaccataattttgaccaccttaaacatgtttcactcacaaatgaatttcagaaaaggctagcacatgtaattgaagttatataggcatttgcagacttgactacctgaggtgtatggtgttcagacaagtttccagaagccaaagaatcaaaacaataatgaccttttttaatgctatgaaaatatcccaaatgtacgtaaagcagatttttttcagagattaaattatagagaagaaaagataagcaaatttccctgtagtattccggctttcctttggacaactgaatgctaacaatttatttgggaattgtatttttaaaaaatagagcaccagattgctattgaggtcttggatctttgccagaaagtctcaattccaatcgctgtggaaaacaattccctcaggcagtggtgacgtgtgagactaaatgtgttgcagttagcgccaacttgaaaaacatacaactgccctaatgttcaaggcatagtgcctttgtgttcaataatccttaagaatggattaaatcaatactttctatagacatagttttctgtcaccttgtgcctgaaggtgattgcaaatgcctgaatcctggctgcttttcagtacctctcatacttcatagtatgagattgtaattttgactttagaaaaatctgtcaggtaacattaatgacctcccgaatgctctgccttacacacatggataatagaactaggatacaaatctactttctatagtcatgtcacagtgcagtcttacccctccaacggattaaagtatgattctttagggcagtagtttgtaaaaagagattgacttcttttttctggatctaatgaaaaactccatggaaagaaattagaattatttattctggtaaagcaggtatttagtgaagtaaccaaaggcataatatagatgatgaggtgactctaaaagttctttatttttatagcacaaagatggccacaaggtcatttgtgaaaatgcagcagtgtaaaccggttaaaggccacccaactttttgtcggagtgtgcatggcacattaagaataatgaacctgttttccctggcaaatctttaaatagcagatacccctagaacttatgcttcttgagagactcaagaattttccttccagttagtaactgaacaccatttcaaggaagagaagcaccacttggctatataatccataaatgcatttatttgttttattatattttgaactgccatctacatcccctagcacacagcctaaaaagaaagacactttgtgattatcgataagctgacaggaaaaaaaatgagttttctccccttttcgttgatgttttgtaatatgttttctagctactaggtggactacatactatagtcacatgtgggccatgagaaatacttcgaattacattcaggcaccatgttgtaaaggtcctggactttgtttttactgattttgttaaccgtaaagatcgctagtaattaaaaattggcagttagtccatctatcttcaatttatgcatgaataattatgcagatttcccagggttgctggacagccaaaaatagatacaggggaagccctccaacttgatagcagcagttatatatttgtactctgagctctaaggagcagcaaaggccccactgtgtcgtcttcctgtggtttttatggcacagaaagccaaaaatgatttcagttcttcactgagggctgccaaactattggcccactttatgaatagttgcatatgctttgttaaaaaatttttatacttgcagtctcagccaaaatccaaagtgattttctaaaatataattaatactccatgaaattctttgcactaataaagcacaaaaagatagatatacaaacttggtcaccttaatagaaatgcctgaatgacattaaacttttaataagtaagtcttcagttgatctggtgccatcactgtttaagtgcctgcccgtgaatccgcttcattttgtagagaagctatatctcttgaaataaatattaaaacaaaatactctccctagtctatagctttaatttttattgggatatctttaatttttattggtatttttaacaattattatgggaatctgtaaagttgatacatggcaaggtagtaatagcctagtaaagcatttcagttccaaagacaatacttgaatagtggaaggatttaccaatgtgcaataattaaaattagccatgtaaaactatgggacatagacgaaaaggcaagccataaagtaagtctcagattatcttactctaaatctgaattttgctacgaagtacccagggacattgtgctgttctttttctccgtgctgggagattcgtgctaggtcgtgctgcattattagtaaaaggctattgtgatagttaaccctcatttaggaggagctctaagatggattcacaaaatacccaaatgcatacaatacatgtgggtcaccttataattagggtctagagtaatttggaatgtaaagcaatttttattctgaggtttcctaattcaaatgttaatagtgcaccaaaaggtcaattcaagagtttattattattatttttcaacccaagtaaaagcagagagaaaatagccacctccaccatagcctcagaagcaagccaacagcctgaaacagctttgaaatgaaaagttggtgtggcggtgatggtggcagtgataatggtgacgatggttgggtgctggtgatggtagtggtagttgtgaaggtggtgatggtggtttgattgatagtaaaaaaaatgttcgttaatacaagtagagagtaagtaatcaatcaatcactcatagccaaggtggaaaagatgtatcccatcatggaatattcctgttctgatagaaatcttgtgcttatctatggaattcttttgatatatatttacattgggaacctgaatgtagcttgacatttttccatgtaaacaccagtagcctgatccaacattaagctgatactaacaaacaacgtgtaatggcttcattaataaggctttgcttcttcctggaaactggtgaaaaatcaaaccttgttgtgtacaccctcgatgcagcttctgtgttgtcttcacccagaaatggggaatgatttcccaaatggcaaagaaacagagtgatgctatctatctgcaccttttgtaaagtctgtctttctttctctttgttttccaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagt

SEQ ID NO: 5577 - DNA, 756152 bp, human; identical to SEQ ID NO: 4467

SEQ ID NO: 5578 - DNA, 756152 bp, human; identical to SEQ ID NO: 4467

SEQ ID NO: 5579 - DNA, 1036241 bp, human; identical to SEQ ID NO: 4458

SEQ ID NO: 5580 - DNA, 1036241 bp, human; identical to SEQ ID NO: 4458

SEQ ID NO: 5581 - DNA, 1036241 bp, human; identical to SEQ ID NO: 4458

SEQ ID NO: 5582 - DNA, 1036241 bp, human; identical to SEQ ID NO: 4458

SEQ ID NO: 5583 - DNA, 1036241 bp, human; identical to SEQ ID NO: 4458

SEQ ID NO: 5584 - DNA, 1036241 bp, human; identical to SEQ ID NO: 4458

SEQ ID NO: 5585 - DNA, 1036241 bp, human; identical to SEQ ID NO: 4458

SEQ ID NO: 5586 - DNA, 1036241 bp, human; identical to SEQ ID NO: 4458

SEQ ID NO: 5587 - DNA, 2009132 bp, human; identical to SEQ ID NO: 4466

SEQ ID NO: 5588 - DNA, 2009132 bp, human; identical to SEQ ID NO: 4466

SEQ ID NO: 5589 - DNA, 2009132 bp, human; identical to SEQ ID NO: 4466

SEQ ID NO: 5590 - DNA, 2009132 bp, human; identical to SEQ ID NO: 4466

SEQ ID NO: 5591 - DNA, 2009199 bp, human; identical to SEQ ID NO: 4464

SEQ ID NO: 5592 - DNA, 2009199 bp, human; identical to SEQ ID NO: 4464

SEQ ID NO: 5593 - DNA, 2009199 bp, human; identical to SEQ ID NO: 4464

SEQ ID NO: 5594 - DNA, 2009199 bp, human; identical to SEQ ID NO: 4464

SEQ ID NO: 5595 - DNA, 2092291 bp, human; identical to SEQ ID NO: 4461

SEQ ID NO: 5596 - DNA, 2092291 bp, human; identical to SEQ ID NO: 4461

SEQ ID NO: 5597 - DNA, 2092291 bp, human; identical to SEQ ID NO: 4461

SEQ ID NO: 5598 - DNA, 2092291 bp, human; identical to SEQ ID NO: 4461

SEQ ID NO: 5599 - DNA, 2092328 bp, human; identical to SEQ ID NO: 4462

SEQ ID NO: 5600 - DNA, 2092328 bp, human; identical to SEQ ID NO: 4462

SEQ ID NO: 5601 - DNA, 2092328 bp, human; identical to SEQ ID NO: 4462

SEQ ID NO: 5602 - DNA, 2092328 bp, human; identical to SEQ ID NO: 4462
